United States Patent 9,567,581 (SELECTIVE REACTIVATION OF GENES ON THE INACTIVE X CHROMOSOME) - sequence listing, part 42

SEQ ID NO: 4468 - DNA, 1905516 bp, human
attttagatgaaagagaagatgttcaaaagaaaacattcacaaaatgggtaaatgcacaattttctaaggtaagaatggtttgttactttacttttaagatctaagttgtgaaattttcaaaatggactatgtacctgtgtatcttaaaaatccgttttatttctctcatagtgtcattttattttagctgtgcaaatctggaaatattatgttcactcttatttaaggagtaagcagcagaagatatggcaaagatacactatttaattatataaaatgtatatctttgattcttcttgacaatgtgagtttctttaatgacatgagtcctcagagtttatagctgcaatcttccatcaagtagctagaatatgtcacccagcagaagaagatatgagggaattttgttgtgaaaattatcatttttttgtccctcttggtctttaccaagttcaagaaaagcaatataattgctttgggtgtattcagccactatagtttagagcatatttcaaatgattaaagacaataagttcatcttgtttttgtgcaggcttcaatccatactcttaatatttacttaatttgcaaatacaactcaatttttaatcaatagcgtgactctagatgattataggtggacacagagcaagatattcttaccttgaaaactagtattaggaatgcaatatatggaggtttattgggatgtcaaagtttaaaagacttgcattttaattattattctcgatttgggtaaatcaatcaaatgtttggtgagtcggttttcttatgtttccatcatgaatgtttgtatatgtatatattgattgcttaattgagacatcaaatctagataatggaaaaataaagctaataaaatatggcccttaaacccaaggctttaagagtggcatagttttgatagtggatattttgtttcttattgtaatgatttaaagagtcactaaaagtgaaaatttctactaaaatgcctgaaactcttaatagctatgaattactccctctatgggtctgattttgtaaaattcatgataatggagccaaaacaatccactaggagatccaatctcaaaagttctcccttttctatgacaaacatttttagaatatcgtctattctttgtggtatttggtagtagaatgttgccatgtactctttaatttaacttactgaattttaactaataaaagttcattttatttacttgctgaataattaacaaatttctattacagacgtaaacagaaacatgtattttaaaaacgttttttaaatcctcaactttttttagctaagtgaaataaaatataacaacacaaatatagaagaataaataaaaagtaaacctaggatatttaggaaagttattcataattctccgaatatttataagatggttatatatagtttaattgctgtatatactggcatcattgacatttttaagttttggaattctgaagcagacaagagacatattttcaaacaaacatacagacaaatcagaattgtgaagaaattttctgaaatagtaaatgtaacaatactctgaatctttgaattgaactagagtaatttttaaaaggtgtgtaaacatgacaagtactgtgtatcctcattcccgcaagttgaaatagatcttcgctctgtgcattaaccttttccattatcatttatcacaactcacctgttaatatagaaatcaaagcttgatatccaatccatcctctatttatatattgttagcactgcctcagagcaattcggtatatttttttctgtccttatgaatgcccatatcttaaaactgtaaaatattcacatatatgagcacatttattgttttcttccaaaatatttgcatcctctaactcaactcacacttttcatttatattacaaatgttctccctaagtctgttataactgatcaggagagtcaccattctttcaagtacagaaattctattatcaagcatatcctaggtgtcaggaatagaaataaaagtttacaaagacagaggagaaaacttatttaaaggtaaaatgtatatatacctgtgcactaacttctaattttgagaacttgcaaagaatctttttcctcttttcttattcttttctgtcaaaacttagctaagtgactgcattcttttagacacttttgaagaagatgggaatttagaggaagctagttgattcagtttaagccacttggtgaaaccaaaagataaacataattgtgatatatatatcatttggcaatttattgcatcgctgcatgcctttcagcagaattctagccctgtaggatacacagattagttgaagtggaatctcctgaactcatggaacctacacagttatttgggagtttttggttaattgataaatggagttagaactgagtgggctcagtgtgggtggtctgagaaggcagtaatctgagctagagggaatctggtaacctttatgaagaaagctctaaaatgtgagcccatcaaaggcaggaatgtatatcttctatataatctcattgtttattactagtacactatataaatataataaatatactaggtcagtagtacaaatcattaaatctatgctaactgtagaaacagaagaaaaactgggtggaaaaattgtgttgaagaagactttaaaaagagaaaaaagagaatgaaaaattctgtctgtgtggtaaattagacacaggcacacacacattcatacaactataaaaatgcctcactaataaatctaactcatattcatttttatagtcgtattaatgtctatctgtgtctactttaccacacagacagatgataatttttcattgccttttatacacacatttatataatatttgtaaattatagagagacaacaaaatatttccttgttattttgtaaagctacggaagggatatttaaaggaaataaatgtgattaaatgtatccttgttgttgtggcgtcatttgaagccaaatgtgtctttgcagtaaatctaactgattttccactttcctggtaccattttaaaaataagccctatctctttttaaaataagtcttctattaactttgattccaaaaaattctactagaatgtgatttatcacatctattatatagagataactgaacaatatttatctccacataaacacaaaaccatttctagataagattaattcagagtaaatattctttccatgtaatttattgatatgttataatcctttaaaaagcctcgtgtatactctatgacaaatatgattcgcattataaaaatcttgctcatccatgccggcttaataaagggaagtacagttttgaaaacatgaccaaaaataattttgtcataaaatgtgcttgatgtttgtgtttgagaaaaaattttatgggaaaaaatatttactgccagctcaattgagagagataaactatctcccaatgagtgatatgatggttttgatcctatactgaatttagtaatcatctttatttccatactcactcttctgtctgatttttttccaacatagtatgcatgtttgacttaaatgaagtagaaatgcataattagttttgtctaatgtcttcacaaaagcccatgatatgatagtgttcctggaccaaactgaggattgggctgcttattcttgtggcccaataacgagatgcagatgaacgggaaaaggagagagtttttatttctgtaagtggttacagggagaagacctggaaattatccccagaccaactcaaaactataaagttttccagagcttatataccttctacgctgtatgtctacatgtaagtgtgtatccatctaaagacataaatgattaacttcttctgatctgtaactaagatctgattcctgaagacattcctctggagcctcagtaaatttactttatctaaatgggtccaggtgctgggatgattacccttatcttatctccggctaaatcatggagtttgggggagttccttcagatgcccagtaaacttgtttgtggagtcctggggagtttcttcagacccccaataaagcttttttaattctaaaagggtcctgttaagaattccttcattatcttgtcatgcttcaaggcccaggaaaggcctgggcaaaactcttggtgggcttttgttaccgtccagcctttgtttaagggcgctggctctatcagcttttaatatgtaactttaccactcagtcagtgctgaaacagttgttgtggaggcctgcattagtgagacctggcctgccacaatagttcatttacctcttcattgccgcaacatatatgtccacattaaaaatccaggactcaccctctttgggcaatatcatgtgataaaataaattgatatgacatacttcttgcaagatttctttttaatttaccttttagccagcatgataagcatgatgtagggtaaattaacactaaacttttgagtcagtaaggtagcctttctttttttaacttttattttaagttcaggggtacatgtgcaggtttgttatataggtaaacttgtgtcacgggggttggttgtacagattatttcatcacccagatattaggcctagtacccattaattatttttcctgatcctctccctcctcccaccctccaccttccgataagctccagtgtgtgttgttcccctctatgtgtccgtgtgttctcatcatttagctcccacctataagtgagaacatgcagtacttggttttctgttcctgcatcattttgctaaggataatggcctccaactccatccatgtccctgcaaaggacatgatctcattctttcttatggctacatagtattccatggtgtatatgtaccacattttcttggtccagtctatcattgacgggcatttgagttgattccacgtctttgctattgtaaatagtgctgcaatgaacatatgtatgcgtgtcttataatagaatgatttatatttctctgggtacatgcccagtaatgggattgctaggttgaatggtagttctgtttttagctctttgaggaatcactacactgacttccacaatggtttaactcatttactctcccaccaacagtgtataagtgttccattttctccgcagccccaccagcacgttattttttgataaagcaggcttcttcacactactctctaccttaggagaaaacgttatatccatactttaatttatttgaaaagaaaggtgaatataaaattgaaattctctgagtcttatttttcttatatgttcttgcctacttgtaacaaaacatataataaaagggcattataaatagtaaatcatataaacacaaaatattcccatttttgtcattatgtaatgtattttctgaattgaattgaaaaatgcatatatttatgaatttttttctactgaatctctccttcttatttacttctattcttttccatgatgttacctggtcttcttgagaacatgatattttaattgtaatcattgtgttcctaactccataatttcatgatgctattgaaatgcacatgaattttgattctataacctagtttgtaataagccatatttccttgtttctctacattggttgaatctgttcctgcagcaactagtaaccccaacaatctgactggtgagaaattcaatctccgtaacattttgcattcttctacttcttcccacttccattccaaagggccaggtagagtccagaatactgtaagtgtcctggttttcagtgcattttggtcatagctgatatgcttaatagccaagtaaacatgactacataaaggacagcttgtccacaatgccctgccttgcttgaacacggaaggttttgctgatgatgctctgtgcttggtatctggcctctacagccatttaagtaggttgtctcagcacaacatttggaaactctgtaaagggagtaggatgttggccttcacaacttcatccctttccctgtgtttgaggaagctcattaaacctctctttaatctgactgattgcaaatttccactgtccccgaatcttaactcccatatcccaatagcctgttcagttgggacaatatatcaatccttaacatgaatctagattttcagaactaaagtttttgaagggtgattttcctctggatacttgttcatttctttattgattatggttttggctaccttcttggcatcaaacagggaaaacagagcatttattcatgtgttactatcctattacactctgtatgccaattcatgtcctcaacacgtacacacaaacacacacacgcgcgtgcgcgcacacacacacacacatacatatacacacacccagtaaacatattctatatttaaaatgagcttagaagtttttaaaaaaggatgatactgggacaaagtggcaaaacattatttcagtgaaggaggtaacaatatatatgtacctttccattgtgtaagtgaattctaaatctgtatatagctaacacatttatatataactattgtgcaatgtgcctgctttaacagaagtaatcgagcagagctattgtgccatggaaggttttacatagatctaaaatggctcctgtgcccctggcttcctgtttgtttttatctgataataggaagaattaaatcattagagcagatgacgtacagtgaactatgtctctggatgctgatgagcagcctgcacaagactttggtaacaattgaattatttagtgcaattattttggagagatgaatattgatacaggaaacttacggaaatcctcgtttcagaaatagtgaggattgggaactttttgtttatgtataccatgatgttaataatcctactgaaaattatatgtatatggttagttgctccaataatcatatgatacaagtattcaagatgagtaaaatgtgaatttatgtggcttgctcacagtaaataggagagatgaagctaggacccaagaaaatggactctaaaactcatgatatttccatacctattattgttgggacaaaaattccacctacccaataatgcatttttgggacaaatcatcaaattgataagtcctatgagaagcaggcaggggggttggagacagtgaagactcaataacaggtggtattaaatgctcgcttactcacagaggatttaatctacctttgaatgtttagtaaccccaaaatgcaaccattgtttaggaagttttttagttgattctttctgaatgatttctaatacaaatgcccctcaacttgtgtggttaggtccctataaacccatcataagttgaaaatatcacaagtcaaaaatgcctttaatatacctaaccttcgaaacaacatagcttagcctaccctactttaaatgtgctggcttaacactatcctagagctgggcaaaatcatttcacacaaacctattttataataaagctagctcatgtaattgattgaatactgtactgaaagtgaaaaacagaatgcatgtatgggtactcaaaatacggtttctactaaatgagtatcaccttacactattataaggtcaaaatatcttaagtcgagaactgtttgtactttaaatgttaatattttttacatactgcgttttggtgagtgaagtaaacttagtttgcagtagagttatctaaagtgatattgtcattttcaaacattgctttttatttctactactcataaacaaattattgtgtttacatgattatttgaatattaacttaaaacagttttatacgaaattcaaaataccactttactggcatgtgaactccctaacatctacacttggtgttaagatgacttgtcgaatgatgtgtttgtgtttggaatcaagatgattatactaaatggtttaatctactgagaaccattcccttgaatgttttcctgaaacaatctttgcaaagtacctaagtaacaaaggatattactcagttagtgagacaaaaatggattgtgataggtctcactgttttcaaagaaagacaaatcacttattgttaatagtaaagaagtttcttagaaatatgttgctgtttatcaacccagtgttactgagatcttgacaattccttttagaaggtaaatgttttggtctctaggttatcatgtcctgatacaagaaaattggaattattgattacacctatattctctggagtggtctcagtgccaagcatatttagcttgcatatgtaaatatttaccaattagcatgatagttgctagcaaaaaaaccaattctttatggctgatgggcctatccattatttatctgattttattttgctttctagcaaaacaacatacatggacattagtgaagcatttttatttagaaaagaacaattgacactctggtaccatcctatcagagatatatgtttactaaaataacctttcaacatttaacaaatacttattgaatgccagctatgtgctaatcatactgtcatacagtgatgaaggcataacccaacatggttttccctctccaagagattatcatctgagaaaggaaacaattgcatcaacaaataattaaaataaaacataatctttaatgcaatagaaatgctgtgggaacatagaagacagaatgactaattgcttggagaggataatagctttttaaaatatggtgacatttagtctggtgttgtctacgcagagacaatttcaagaaagatgaaggcagaaggaattgcatgtagaaatgtgtaataatcaaagaagtatgacttgtcaggtgagtagtagcaagggagatctttaggagtgaagaagagaggttgtgagagggcatataatgccattcttgaagaattatattgttgtggggctggttgagccaacaataagataatggcttagtcatgttaatttgcaacttctgattgaagactgtgaagctctaaaacaacaggcaatgatagaagaattagactgccccaccaccactaatgcttcatgcaaaatttggtctgaagtctaccctttacatttggcaatagacatagagacctaaaatggaaaagcaagcaggctaccatttttgtagagttgtttgataccatgcacactccaaaacgatgcagcaaaacgcattggaattacctagaaaatgtgttaaaacatggattgctgaggcccatagtcagagtttctaattccataggtctagggtgggacccaggaatccggatttctaacaggtcctcaggtgatgctgatgctgacggccaaagaaccacactttgagaaccacagtgttagaatttcagtaatttaatcaggtctgtagtagagaatgttggaggaaaccccactgaggaatttattgaaccctcaaaggggaatgacctttttccagttgagaatcaatgcaagtacttgatttaaattgggatttattttgtggggactatactcaaaaactgaatgagttaaaagactcaaaatcaatcaatctgatactgattgagcattcttcgtccaaaacgtttgaaaatagaaatgtttcaaattttggattttcgtttggaatatttgcattatacttactggctgagcatctcaagtccaaaaatctgaaatccagaatgctccaatgagcatttcctttgtgtgtcatgtcagccctcaaaaggtttctgatttgggagcattttggatttgggatttttggatttgagaggctcaacctatacctattttttaaaaaatgtgtatatatatatatatggatatacatacacacatatatatgtacatatatacatatttatacacatatatgtacatatatacatatttacacacatatatgtacatatacacacatatttgtacatatatacacacatatgtacatatatacacacatatgtacatatacacacacatatgcatatatacatacacaaatatatgcatatatacatatacacacatgtatatatacacgtatatatacatatatacacacatgtgcacatatgtgcatatacatgtatatatacacatgtgcacatttgtgtatatatacacgtatatatacacatgtgtatatacacatgtacacacatatgtgtatatacacatacatacgtgtatatacacacatgtgtatacacacatatgtgtatatacacatacacacgtgtatatacacacatgtgtatacacacatatacacatatacacacatatacacatatgtgtgtatatacacatatacacacatatacacatatgtgtgtatatacacatatacacacatatacacatatgtgtgtatatacacatatacacacatatacacatatgtgtgtatatacacatatacacacatatacacatatgtgtgtatatacacatatacacacatatacacatatacgtatacacacatatgtgcatatacacatatacgtatacacatatacacgtatacacacatatgtgtatatacacatacacacatacacacatatgtgtatatacacatacacacatacacacatatgtgtatatacacatacacacatacacacatatgtgtatatacacatacacacatacacacatatgtgtatatacacatatacatatacacacatgtgtatacacatacacacatatgtgtatacacatacatacatatgtgtatacacatacatatacacacatgtgtatatacacatatacacacatatatacacgtgtatatacacatatacacatatacacacatgtgtatatacacgtgtatatacacatatacacatatacacacatgtgtatatacacatatacacacatacacatatgtgtatatatacacacatacacatatatgcacatgtgtatatatacacatatatgcacatatgtgtatatatacacatatatacatatatacgtatatatacacatatatatacatatatacgtatatatacacatatatatacatatatacgtatatatacacatatatatacatatatacgtatatatacacatatatgtatatgtgtgtatgcatatagacacatatacatatatacacacatgtgtatatatacgtgtgtatgtgtgtatatatacacacgtatatatacataagtgtatatacacatatgtatatatacgtatatatacgtgtgtatatatacatgtatatatacatatatgagtatgtgtatatatacacgtatatatacatatatgagtatgtgtatatatacacgtatacatatatgtgtatatatatacgtatacatttatgtgtatatatacgtatatatacgtatatatagttgttttaggttataagacttaaaaatacttatctgatgtatatatatatttttaacaatcctagttattttgtgtttcagggcagataggtgatgaataaagatattaatataattgtgttcaaaggttagaaaaaaacagttcgttgtggcattactattgactgtatccgcaaatttctttcactgcaatcctttcatgggctactatatatttttcttaagaataaaacatttccaattgacctacagagtctttcaatctctcttttgtgctttactttgcttcagcagaaggatttcattttagtgacactctgaaggtcttcctctgtgcttcacttaagggtgttgcatttttaaccttaccaagattcctatggattcctagaattatatttcaaattatgatcatggtagccagaacacaaagaattaagatctactctgacagtaatgtactgatataactttaactgtagaaacctttcttgtaatgcacatggagggcagacttgtatgtatcttggaacataaaaggcagagtatggtttttaaaagggctttgcttatttgtatcctaatttagctaatttcactatgccagttctatatgcagagataagtaatagtaaaaatggacaaaaagtgatcaataaacaagtgatcactttcggtcttgtccagaattgtggccaggtgatgagtgcaaactaagagaccttttcattagaaatgtgtgaagttactctttggtttagcattagctgtcttttaatgagaacaaatgagagttgcagatgaatttgctaaatgtttctttctttgatttagtttacctggcctgaagaaaaaaaaatgtcttcgatctacaaggtctacggagagtacttttcataggaactagtcctattaaaattacctgcagttattatgtcagtcagagaataaatattttgagtatcatatctgtacttgaagttcttatcctttacaaataatttatatttaaggaaacatgctttgacagaaatacacatgaagtctacattctctatctatttcatatcaggtgctctagtgttttgaatataacagttaagagatcaagtccctttaatcataaggccctgttagctagcgagctaaaccaaagagggaaacatttagcaaactatctgacgttctctatatttgtttgtcaacttgtttgttttttctctctgcaagtagaatatagaatttcagagagtgacaagtgctaagagaaaaaataaagcaggataagggtagaatagggatatttcaaagggtaggttgccattttatgtagtgggtcctggaaaagcctcacttaagaggcatacaaaaaacctgaaggaaggaaaggagggcatcttgcaggtgtcttggagaagagagttctaggcagagggaagaatatgtacactctgaggagggagtgcgtgtttgtgggataacaagggagtcaagatggctggtgcagagtgactgaggaagagcggtaggatctgcaagtggagtggtattagaaggacaaatcagatagggccttattgaccattgtaaaggtcttggcttgtacattgtgggagattaggagattttgagagttctgaacagtagccagaaataatgtaagttagaatgtaggatgtaaaggtagaagtagagagatgagttagaggataatgtagtaatgaaggctgggtgtgtgcgtgtggctaggattaggttgatgtccatggatctggggagaaatgatcgaattttggatacattttgaaagtagatgtaacaggatttgctggtggactaaaaatggagattgagagagtggagaaaaacagttttagcttgagcaaaaggaaggatgggatggttatttactgggataagaaagactattgcaagagagagtttggtggcaaagtataggtaaatttcccatggaaaatcattgaaaataattttagttttagtatgtttttatggaaggagtatttattttcaactcctaaaatttatcctcaagaacaagaataaatacatttatctctattaaaaaataaggaacaatgagagatgatacaagtgcctctagcattgtatgagtgtgtacaaccagtgaacgttaacttgtaaatccagtagcagtaacttgatctttgtctctcttctgatctgatagagtgcaaggtctatgtctacattcatttttttgcatgtagatgtccagttgtttcagcattatttgttgaaaaggctatctttgctccattctattgccattgctcgtttgtcaaagatcagtaaactgtattcatgtgggtctatttccacactattctgttctattgatgtatttgtctattattttgccaatacactgtcttgattactgtcatttcatagtaagtcttgtagtcagatagtgtcagttttccaactttgttcttctccttcaatattgtgtgggttattctgggtcttttgcctttcatataaactttagaaacggtttgtctatataaggcaaggtaacttgctgtgattttgattgggattgcgttaaatctgtagatcaacttgaggagaactgacttctttacaatattgagtctttctatccatgaacactgaatatttcaccattcatttagttcctctgataactttcatcagagttttgtagttttcttgtaaagatcttgtatattttttagatttattcctcagtattttatttttgaaaatgttagtggaaatggctttgtgttttacatttcaaattccacttgttcactgctggtgtgtaagaaacaattgaattttatatattaatcttgtgtcctgcaactttgctacaattgcttattatttccagggttatttttcgattctttcagattttctacatagatggtcatgtcatctatgaagaaatacagcttcatttctacattccaatagatatgtctattttctttgtcttattgcattagctaggacttccaatatgatgttgaaaaagagtggtaagagagacatttttgtcttgttcctgatcttcctgagaaagttttcattttctcaccactaaataggatgtcaattataggtgtttttgttcatttttttatattgtcatgaccttgttttataaaatacaattatttctctcctaactttctgtggacctcaattataattttcccataattctcttctgcttgcattgctcatgttttctgtcttcttcccatttgttcttatttgctttattttgaggaactgtttctcattattgaagtcattcctcaaattacaagtgatcttagcttttggtttatatttaagtgtgagatactaacatttgataaaattaaaatctatttcatgattaaagtacatttaatataaaacagaattgaataattttgttgacatattatatatatatatgcgtgtgtgtgtgtgtgtgtgtttgtgtgtgtgtaaagtccaaaagtttgtacattacttaaagaagaaacatctgatgcattctggataaagacaggaaaaccatatgagtactacagctacctccattaatacttaacattgtgttgaaaatattagccattgcaaccagacaagataaaccaattcgaggcaaaacaattgcaagcagtggtaatgggatcccaatttacagatagaattgtttacctcaagagatcacacaaaacaataatattaacaaacacaaatatgaacacaaacaaataccaataaaataatttagtaagttagcagactataaaatttacaggcaaaatcagtaaaattcattttataggtaatgagctagaagtttttatggatggtgcacacccatttgcaacaatagcaacaacagcaaaaacaagaaacacatttaacaagaaatttcagtacctatgtttaaaactctcctgaacaacccaaaaggaaatcaaggagaaagatgctccttgttcctgaaaagcatggcttaacattataaagtaaactattgtttttaagttaatgtgtaaattaaaggcattccaatataataagtagtatttttttctggagttggataaattgattataaactttttataaaaaaatacacaagtaaaaataaccagaaaaacactaaaaataaatatcgatgaagggatagggaaacataaaattataaattaaaacttagggaaaactatcatattaaatataaattttcaataaaaactaacaatttgttaaaatgtgttttgtaaaaatatatttctatcagctgggaaggtctggtagtaatgagtatacctagcatgcagatattcattggtaagtctcattccacactgaaagaagtcacagctcattagaagaatatatgatacttcatcctggccaaggaacatagtgggtgagcctgcagcctttgttagagccataaggcaaggaagtacttcccaaaatttgctaacatcttgagttgttcatttttcttctcctgttttctttatgcttgtagagttacacctttttaaaaggttttcttcctgtcattttattggaaaggcttcaaataatttttaaaacatatttatagatgttcatactcatatattttcctgatactgaaagagaaatttatgcatttagtaacaataaatgttggcctagattttctctgatggtctcttcaagaatctggagcgttctctatctccacaaaggatggaaatgtttcatttcaatatgccagttttcaagtaaatgtgatttagtttctctcttttaagaataaagtcatagcagaatgctttatattactgattgtagtatcataacttacttctgaaacatcgaatacaattttggaaggtcagcaatgtcctgttaatatttaagtatgcctcactatataatatgtgcatacattctggaagaagcatttaaaatgaagactgtttctaataatatattaaacgagctatgtaagtagagttttatgatagctgatattgtgattttattcagagactatttatataagacatttcagcatatctgctaaagaacaaacctatcatctaagtcagtaaaccaataatttgaattaaaaaaacggacaaaaagaaaatacgaagcaacttgaaagatcattaaatacactgcctgatagttaagattctaaacagttacattatatgaatagtttactgtatattatatattttctatttccactttgttataggtaagctaatcagatgtctcaagttataaaataatagcactaacttataaaagaagtgctacctttcttccactccccaaaatacacaagattttattcttcataaatgataacatttgttgtttgttttctgtggttgaaagggaagtacaggaatgaaataatgtattttgcaacaacttggatagaactggaggccattattctaagtaaagtaattcaggaatggaaaaccaaacaccgtatgttctcactcataagtgggagctcaactatgaggatgcaaaggcataagaatgatataatggactctagggactcagagcagggggaagggtaggagatgggtgagagataaaagcctacatattgggtacggtgtatacttctcaggtgatgggtgcaccaaaatctcggaaatcaccactaaagaacttacccaggtaaccaaaaaccacctgttcccccaaaagtattaaaataaaaaaatttaaaattttgaaaaattaggaaaaggaagtacattttcatgtgttgctctgttttagcacacctggtgcagaggtccctgaggaattttttctttttcttttttcttttttcttcttctttttttttttttttttttttttttcgagaaaaaaatatcacacatttgaggcaggagaatagggtctggaggaagggaacctaaggccatttcacgctgacttccctaggactaaactgaaggcaaaaccctaactttccacccctaagtaacataaggaccagaggctactccctttgcaaacctcccaccttttctgtgtagcagatgggaaattggctgttcccaaccaatcagactgattgcgggcccagtctttgcacagaagtgcaactttgtaacttcaccttagcctctgattggttgctttttgcaaccaatcagatgtttgcacaggagagtgtcctatgtaactctacttcagcctctgattggttgctttccacaaccaatcagaccaattgcaggccaccacttcatttacgtggggtgagcatgaagtggccaatgggaaacctgtagagggtatttggaccccagaagattttctttatctgggcacttgagccgctgctcagcccgctctcacactatggcatgtacttttcattttaaataaatcccttcattccttccttgctttgtttgtgcattttgtccaattctttgatcaagacaccaagaacctgggcaccctccactagtgacacactgataagatcttattatattgggctgataattcacctacacttttaccttctgaatagaaaaggcacttgattagagatgtatatatctaggtgctgggatcaactatgccatttgcaaagtaccttacttcttgagcaagaaggtaaccaaaaggggaatgaataggcaatataatttcttttaaaaatgaattagtaagctcttgtggttacaacaagaggactgttgttttggttctttcacaattttctatagtaaaatttgttagtattaaagtataatgttgatgcctatatttttaaaagatataaaagtagagattttaaaagagaattaaaaaggttttgagggaactgttttagattaagtaagataatgaagagaaacaatgcttaaaatattagaaaaaaagacttatgagaaaagtcagaagtactgaaactgtctagccaaagtagaaacgaaaccaaatgatacctttctcattcatattaattatttgaatgctttggttttgtttttctttattttatattctgttagacgctgtctttcttgtcttcaaccaattcttttctatgtaacattagacagtgtctaataataatacacaaaacaaaaaagttgtaaagaaaccacccacattttctcttcaaaagaaaaaattgtctgagaactctgaatgtctaaagtccttgaataataatgggaaatggaggatggttcatgagtgtttttcagtattagcaaaagactgacaaaagcatgagtttatcaacaggaagtacatatagtcagacttatagactgaaactgttcctaaagctgtgtgtccctgttttagaactatcaccacagtcactgaagccctgggcaattcacagacattgcaaaatcaccacagtccctgaaggccaaagaatgagacacaggagtcttttatcatttcataactcagtgtgcccattcttcctaataggcaggacccagcatctgtggtcctcaatacaaccatttagaaagtcacattgtagtcactccttttgcttgttctggcagggactgaagttggagcacaaaaaatcttgtaaaattcagttcctatatcagggtgtttccccctttttatcatgaagtcacatgtcccatcctgtgtcttaacagtaggtgattattagaagagtagctggcacacagtagatttataataaacaatggaataattagagtgcctagcgcacagtaaatttataataaaaaatatagaataattaatgatgaagaaatgaatggtagatgtagtagaatagaaagatatataggaatcctgagaagtttggcagcacatccaatagaaatgtattgcaaaaagtttatatagtatttacatttcttatagcctcatttaaaaactgagaagaaacaggtgaagtaattttaataatatttatttaactatatgtaaaacaaaaatattatttcttcaacaggtaatcactatatcaattagtattatttattgcattatttattgtaccacctctctaaattccgttgtgaattttacacttccagcaaatctcagcaacacgggatagccactattcaggtgctccaaagccacatgtggctagtggctaccacattacacagcatagctatagaggggtcttagaatattctgactaagtcaggaagggacttttgtcacctccaccaacatcccatgggtcagaacccagttatatggctaaacttaattgcaaaggaaactagaaaatgtaactatagaggaatctttaagaaactattggtcagacaacctaagtgtaatgtgacaggatattatctaaaatcttaatttgaaacaattacatatagttgatataaaatgcataaaatagagaaggatgtactatttttgaagccaggttcaaagtgtatataatgaacactattgaacaaagcaagatttaaaaaaaattgtgaattgaataaaatatgtatagtaaatgtacactctattatgtaaactaaagtatgtttagtataaaaacacccctatactaaaactcctttcaatactccaaagcagtaagaaaaaaaacacaaaatatacatttaccaatcttaatagtctagcttataaactgatatggaattcgttacatgatccctgtttgaacattatgtaagactagcccaggaaatgatatggaaaaaggaatgaaaggtaactttcaacgaagttacatgggagagtgatcaaaagaaaatgtgactttttttccttaactcaacacgtgtacgtgacgcttcaagtatgcaacaatggatctgtgctcaagtcaaatgcacagaccagaaacagaaattggtcagaagacatttcttgttttttcggttttttttttgttttttgtttttgtttttgtttttgtttttgagatggagtctcgctctgtcacccaggctggagtgcagtggcacactcttggctcactgcaacctccgactccctagttcaagcgattctcctgcctcagcctcctgagtagctgggactacaggcacgtgccaccacacccggctaatttttgtatttttagtagaggcggggtttcaccatgttagccaggatggctcaatctcctgacctcgtgatctgcccgcctcagcctcccaaagtgctgagattctgcgttggtcatcaatgtttaaacatgttaaacgtaacatgttacatttaagtaacaatacctacataatcatgtaagtacattcattgccaacttaaaagggagtcttcaaagcagaattgtcagaacttttagcttccctgggccacactgggagaattgtcttgggccacacattaaatacagtaacactaatgatagatgatgagctaaaaaaaataaatctaaaaaatatctcatgatgtttcaagaaagtttacaaatttgtgttgggctgcattcaaagctgtcctgggcctcatgcagcctgtaggctgcgggttggacaagcttgcttcaaagctaacattttttctccaaaattttccctactgctatcgcgatcaatttgtttcctctgaagtgactgattttaactgagatatttttgtttgtttgttttctggttctgcatgtataaatccttcgaatagtgtaaggacactgaatttccagcaacttctgtttcgaaggttcacacttcaaactataacatgttgtgtaattattggaaaagtgtcctaaagcttccattattagcctataaactatagttttggaagagactttgcccaccattttacattactagctgtgagtgcctaacatttagtaagtacccaagaaatatgaatgttagaataaagtcatacatataagaaattctttacattgttcaactactggagaatatgttatatgtagtgattatttttaaaagcattataaaaagcatttcaatttgttcaagcatctcaataagttagttaaaatacacagaaaatgaataaaacaattagaatatatatgtagcatttgtgtgtgtgtgtgtatataaacatatatatgcaaatgtgtgtgtgtgtgtatatatatatataaataggtagagaactttaaagtaattaaaatctgaatgtggttagctcaagtcaggtaaatttgagaaaatctttacaaaagccatttgctcatactactcactctcagattagttgttcatcaggtaaacaatttgctaaataaacatttaaataaaagaaacacattgcataggggaagaaaacataattttacctctaccttgattttttttttttttttttttttttttgacactgggtctcactttgtggcccaggctggagtgtggtaatgcaatcttgtctcactatagcttcaacctcccgggtttgagccatccttccacctcagcctccccggtagcttagctacaggcatgcaccaccatgccgggctaatttattattttttttactttttggagaaatgagggtcttgctatgttgccaaggctggtcttgaatgcttgagctcaagtgatccttcagtctcagcctcccaaagagctgggattacaggtgtgagccaccgcatctagcctctacctttatttcttaactgggactcctataacaaaagagatatcaacaagaaaaaaacaataaagtttactaacatacacacctcatgtatacatgaaagatatataaggaaaaatgaataaatttctctgacaaagaacaatacgttttttgagaagtaacaagacaagggaaaaggaccctgagtctctatgagtggccaatttcaggaaggcaaatatatgggaaactgatggtagataaaggctagttaagaaaatttattatgtagattcctctgatgcagtctccgggctgataaagatctaaagttgtcattggtgatcaaactttgtcctttctgatagagaggagaggatggacacctttgcaaatgtatgtactgttttcaggcaaatagtgggagggcagagaacttatatctgcttcttctgaattgcctttagctcaaaatagtcctgtgtcaaagtggcatattttcatgaacatagagaatggaataatagacattggagacttcaaaaggtgagaggggccgggtgcggtggctcacgcctataaccccagaactttgggaggctgaggcaggcagatcacgaggtcaggagttcgagaccagcctgaccaacatggttaaaccctgtctctactaaaaatacaaaaatcagtcgggcatggtggcgcgtgcctgtaatcccagctattcaggagaccgaggcaggagaattgattgaacccaggaggcggaggttgcagtgagccgagatcgcgccactgcactccagcctgggtgcacagggcgagactccatctcaaaaaaaaaaaaaatggcgggaggctctcatgtaccccagaaatttatacacctacagtgtacccacaaaaattaaaaatacaaaattttttaaaaggtgagattgtggcaggggagtgaggagtgagaaattacctattaggtacaatgtacactattggagtgatggtttcactagaagaccagacatcactactatccaacatatgcatgtaacaaaactacactgtacctcctaaatctataaaaataacaacagaaaaaggcaaatatacatatgctttcttatagattcattaatctgttttatttcagtgaatgaaaacttttgacaatggctaaccttgaaaatatgttattagaacatgtttttctttctccattgtgccctatgagcacaacttgagaaatccagcaataaaatgcaagctagtttttttttttttttgaaacagtcttgctctgtcgcccaaggtggagtgcaatggcactatctcggctcactgcaaccttcacctccagggttcaagcgattctcctgcctcggcctcccaggtagctgggactacaggtgtgtgccaccatgcctggctaattttttatttttggtagaggttttgccatgttggcccggctggtctcgaactcctgacctcaggtgacccgcccgcctctgcctcccaaagtgctgggattacaggcatgagccaccgcggccatcaagcctgctttcttgacatattttgtgacatattttgggatggcatatttcggtctcctacagttggcagggcaatctaaagtactttaatatccttcttcatgatactttcaaaaaatggaatttgatgcctcagaaaacaatactaaaactttcttaaaatattacaatgtgtactatattacttttttaagtaataggacttataaatatttatttttaaaatttgtaaatatttaccatccacctttgattgaacatttttttctcattattttatccaaaaatgtctattgagacctttaaaatttgtattttgtggcaccatctaagacgtgatttatgctccttgtcattatttaatcgtcaaaatgatactttgtctttgcttaaatcagtgtgggtacatcgaacaaggtttgagagctactctgtaggactgagtcattagcctgtaattttacagcggatcaagtactacgttttcattacttggaaagaaaatgaccttgcaattgactcttacatttaacgtttttatctcagctttaccaccattaaatataactgtttgcactgaccacataagaaaccagaaaaatcactgggtcacagtttaatctaattcaatttaaatccgagctagatagctataattggcagtttaccatatcaaaggccagagttaagttacactcaaaattgtgttgatttggaagtaatttgccttaaattttcaagcattgttctgggggtactaaaatgctctttcaagagtttactatatggtacgtaatattttccaagtgttagatgatttatgaagtctacattattatctaaaacaaccaatgttgtaactaccatacaagtctatgaatagaccttatttcacttggcctatctcagggtacaggatcccagccttcttccgtggcaatatgcaggctgttcctcagcaacgatttctagtattgtgtgaaataatcatacttacaatactaacttcttgcttcccaatgccaagaacactcatcttgtttctattgaataaggtgacaggcatgatagaagcagggcagagccaagtcctgacagtaacatttcaagtacagagaaattcatatgagaaaaatggacaatgagggcttgttgtccgtgactttttgttccatgaaaaatatgcctgttagcaaaatcacataactaggaattttagataaagtttctatgtacattatttaaaagagtgctttatacggcatttaagttaaaaagaaagaaaaaacattcacattaaacctaaaagtaactaaaaagtcatagaacagagatgtcatacagatggctagcctttattaagtgtcaagcattgttataatggatttgcatgagttctttaattgcatttatttatcttgttttggtttggtttttgagacaagatctcacttcgtcactcaggttggagtgcagtggagtcattgcggctcattgcagccttgacctccaagccatcctcctacctgaacccccaagtagctgggactacaggtgtcccccaccatgctcagctaatgttcctattttttgtagagatgggggtcccctatgttgcccaggctggtctcagactccatagctcaggtgatctacctgctttagcctctcaaagtgctggcgtgagccacggtgactgaccttatttatttatttttaatgaacaagtaacagttgagtaatttatggtgtacaatgtgatattttaatctatgaatatattacagaaacattcaatcaagctaattaacatatctatcacctcactaacttatgttttgtggtcagaatgttgtctactcttggtgggaatgtaaattagtatggtcattttggaaaataatatggagattcctcaaaaacctaaaaatggaattaccatatgatccaactttcctacttctggatatatatccaaaggtattttaattgatttgtcaaagatatatgtgcactctcagttaattcttaaagcaacgtactgagatagacattattagtatcctcattttacatatgacagaaccaaagcagagaatagttaaataacttgttcaaggctaaacggagaaagaatcaggattctttttaatattttcaagattcccaagttcaaatgattaaacaatctattttttttttttttttaaattgggggcttccaccttttttatatttgttgttagtgggatttaggacatatcatccccaaatatggcaccttggcatttcgggaaacagcggaagtgagaaagtctctgaccttctgccaccattttcctctgaagcagatcagaaaagaattatctggccttgctctgaagtaggccataagacccctcatgtgtcccatacctaaaggaaaggaatgtcacactgggacacagagaagactgaacaaacaggctttgctacattcccccccaccccaactttattaccattagattacacccttttgttctccaatcatacttctgccaggttgtccactcttcatcaaatttagcataaaaatacacaggtctcccctttttctttaggtattcatttctgaatgctcctgtgtcctggtatcatttgtaaaatttatattaaatacatttgtatgcttttctcttgttaacctttcttttgctataggggtctcagctatgaaccttgtgataggcgaggaaatcaattttttctcccctacattgttcacaatccaatttaagagaaaaagtgagcactcttgatgatccagtaccccccaaaacacacagacacatgcagaaataaaacaaaagttttataaaaggtggcatttttagtatatgtagccacactttaataattttatttcattcttttctatttgtttttttttttcctttttttgagatggagtctctgttgctcaggctggagtgcagtggcatgatatcagctcactgcaacctctgcctcctgggttcaagcaattctcctgccacagcctcccaagtagctgggactacaggcacacaccaccatgcctggctaattattgtattttagtagagacggggtttcaccgtgttgcccaggctggtcttgaactcctgaggtcaggcagtccgcccgcctcagcctcccaaagtgctaggattacaggcatgagcgaccgcaccagccttctatttgattttttacattaatggcagttatgacacataaacgggttgtacagctcacaaatgtcttgacctatagcttgaagagcatttgtctaaatgacttgctcaaactacttactcacaaatccgggttctaaagttaggttttttggtttaaaaactgtaggctttttcctcttggttttataattgtgtcagtccaaaaattcttcatttcctaacttttctccatattagctataaatcagaatagttgggaactaaatgggagctttgccaaaggggcaatccccaactacaatgcgttggtctaatattcagtaaaatacattgattttagtaaaattcactgcatattttgcattttactcaaattcaatataaaatagacagtttttttttttttttttttttgagacagagcttggcttttgttgcccaggctggagtgcaatggcgtggtcttggctcactgcaacctctgcctcctgggttcaagcgattgtccttcctcagcctcccaagtagttgggattacaggcacctgccaccatgcccagctaatttttgtattttagtagagacggggtttcaccatgttgaccaggctggtcttgaactcatgacctcaggtgatccgcccccatcggcctcccaaaatactgagattaccccacctggccaacagtctgttcttaaagaaagaaaattaaaataaatataattactagattcagtgtacattttacttttgtgagtatcattcaggaattcttacctcagaaaacctggaaaaggcaagttatttagaaatatgaagaaatcagggtgttttattcttaatgaaagcatgcatcttaatttatctttagaaatgactgggggaagttgattatacaatcaaaatgattaaaattaggcatgtagactttagtgcaagcaaatctgggccactcatttccaggtacatgaggaaatgtactagcacttcttttattactatagctttgaaggcagcgtgttgtcttacttcccattgtttggatttttaaactgataattaaattcatttgcatcactgctgcttggattacaaatacttaaaacaattagttttctgtcagatcacagatctacatcaaatagatgttactttttaaagaataagccctcaccaattagaatgattcaaaagcttttgattgttttctccaaattgttaagtatgcatttgtctttaatgtaaataaatagacttaatggcataaaaagccattctgaattttaaatgaatgacaaaatgtaaatcatgttctggcataatagttttgccaaagtttcaagaaaagaaataggagcattcacaataagcaattgcaagctgtgaaatggcatattaaaacagaggattaagttatttttctagttagtttttggggaaaaaatctccagtcttgcagaaatggctaaataattgcatttggtatggaggctacttttggtcaaaattatgttaataaatatctgagttcctcacattaaagtgaagcaagaatctgtggcatttttttaagtcataaaacatttgtatgttggcttttagatagtaacaagatggcatccatttatctgtatgcttctgcgcatacaaccttatatgacatatgtaccaataaaaaaagtatacatgtattagtaattaaattctagacttgtgctgtccaatttggtagccattagacaatggcaaaaaattattttgaatttaaattagtgaaagtaaaagaaactatgttgttcctccattttgctagctacatttgaagtgctcagtagtcacatggttttagtggccatcgtgttatgtagtgcatgtatagaacattttttgttttttatcaccaccaaaaattctaatggacaatgctggtttagctcttcagtattgcaaactttagcctttaaaagctatttgcaattatttagcgtgtattgtttatgctccaaaatactttcatctcaatgtagaaagaaaacgattgcacttttgaatataagagaaatcaaatccttgatttttttctacataaaaacgtggaatttaaactgaattatttaacaaaaatcaaagtaccttagaaataacctgaaaagaaaaacaaattttagataatatatataattttgaagtagaagaaaactaagataaaacgtactgcatttgtatacttttatagttttctaattattattataattggaaaaaatgaattttaacaaattaggtataattatcactgtggtaagcagtctccagaatggtcccaaattaaggttgtctgattacggaataccatgttcttttaagtccagtaatcccaaccttttctaggataaagcttggtatatggaatcaagatatgtattcttgttattcttctgttaccattactgctgtgggtttcaagaacaggcacatacagtttctccttgtgtgacacaaaccttgtgtgaatactttttggtacgctttcaaactggggcagcactagatgaatgccttttccctaggtatgcctttcagtaaactctccaggtgagaggggtgtagtaagtactgctttacatggatctaagtgacatgatttgatcacagttcaggtggttgtagttatgaaccatttcatgttaaattaaggtttaggggtttattttctaaaataatgctacttacagtgacagcatagcatagaatctacaagttctaaagcaactcaataacttctcttaaatggcccttattattttggattagcattttggatgacaactaactccactccctctcttgaagggaaagagatttggtagaaataattgaatgaatcctggattaatctagaatatgattttatcaatgactgatgaattacactgcactcagttgataacggtgtcttcttctcttagaaatgttgagtttgttcctattattatttcaggagacaaagctttttaaaagagttggtcaactgtagctaggcatgaaagcatggtctctaagaagacacttataattccctaagtatttgattaaaaggaaaacaagtacctcaaaaactcttaagtttatgttataggcaaagaagtccccaaacaatttagtcaacactctgaaataaactcttaagagtggtgattttcacttggcattttggagattccatgtgtggcaatgtgctcctcaatcaaggagttacatttctatgtgcagtaacattgcagttgcacaattaatacaaaaacaaacatatattaatcaatgacaggttttctcattttcatacagagttatgaaacctttaggctaaggaacagaatagtgagaaattagacaactattaataataggattaattagattctggccctacagctaagaaaatggagtgacaatcagaataacaccaaagttttgcaagttgtccaagtgacaaaatacaactaattaatactaataaactaaagtcaaattggactctatttacacaaagtactttttatatacaggcaaaaatttaagtagaaaaattatggcctcccagaactaataccaaaaatttaatggtaagaaaatgaacgtattcatttaatatataaccacatcatttgaaaatattgagctctcattgtaaagacatgacattttctctaaaattaatatattccataaaaatagtttttaaaagagaaaggctttgtcttcattcttttcgtgtgaaggtcaaatatcttagattggaatttaactgcaggaattatgcttctgttcttactttagcaacactaacgatgacattttctgaagtacatattgttaacaccatcatgatgaaagcaaatcatttttctacacttactttgatgctaatcagagcagtcatttaagttgctacatgactctgagacagaaatttcaaaatgaaattgaccaccgattcccagacaaaaccagaatagtggtgtcagatgagaagggttttgcagtgttttgtcacatttcattttgatttttacttttttctctgtttgacatatgttctgaactagagtgccataaagttttatcaccataagtttgaaatgaccacattactcatgagctacagagtcacaagtgagtttttagcttctttcaaagctgtagaaataaaactttatagtaccctaccctggtatatgttgttttatgtgacacattttgttccactttattcttttcttttatttcccttcattattttctttttgaattatagcagaatttgtattaaatttttcctaatacacaacagtttaagctacattttataatatcttatgtatttttttcatacagattatctttgacctgtaatgcccatctcttaaagaaattttagatggtcattataaacaaggttcattgtgaaatatatttctgttgaaacactgattttattacaaaaaggtaatgtttgatttccatgagaaccaaaactattggttgagatatgaaagatgaacatttgcttccctttacacaattgattaaaattcttaatgcatacatagtcacactacacaattagtgtagtacatacatatccgtataacttgagtcttccatgtatatgttatgcaatagaacttctacaaagacatcaatatctcatgctgaaactatccaaactataaaatgattttaggattagcttatcccaaagggaaattgtgagcaatgtggctggcctgacagcctgaagtgatatgctcagagtggatctgataggcagccattcatttcaagctcaggaagcaaacttattattttgtcatacacggtcgtttttccattgaagacattaagacggtaaagaaagtcctcagagtctatggaaaggatcaccagactttcattttatctccagatcttgaactggagcttttgaagattccattttagtgatttctggaaggctgctaatcttaatgaataaagtcagaaacacatgtgtgtggctgattcagattccagaaagaattttggttgctatcatgattatttttaaggcataagtgattaacgctgagatatactgcttttcctatttgtggattaaatttcttctatcggagaagttctaattgaaatgtctccattcaatgtggttgtgcacacacacaagtacacccatgaatgatattttacatatgtaaaaaaagaaaaccgatattaagtaacttctacttttcattatgagacatgctgtgtgtgattttatatatatatatacacatatatatgtatatatgattttcctgtgttttgttaatcattttttatcattttataatttttaccattttcatcattttttattgtgtggctgatatatactagatattactcactcagggaggatacaccctcatctgggcactcttttatacaagttatggcttttgttttaaataattcatctaagtttaatgaaagaaataagtgactgctttatcctagagaagcagcaaagagattttgttcacctgtgcctttagagactacatgacagcctctacaagtagcagggtagaatcaggttgattataaaagccttcatttcatgctaaatggaaaggagaaaagaaagaattttctcctttaattagaatgtggcagtttaatgacagaggcactattgttgtgggttaacatggaatgaaatcaattaaataggactatgtatacttaggtgtctgtaggaatcaccaaaaatgtaactctccaacagtttgctgaatctgcctctgttttgtctggctgctatacttggtatgtgggccatctggctcctggattccagtaaggtttgcatattcacacatcaatcagaagtggtgtagggcctattaggaagcaccagccagttaggtgacatgccaggactgcaaagcactcaagcaggaatgccaagtggggagcttctgctgaagctgacgctgacacgggcattggaggcaccttttgatccgtctagctttactgttgatgtcacagtcctgctagatcaggcatagggatgtcaggtcacgtaaggcctcatttatgtcattggttttgcctggataattcaaatggagcaaaaataaaagtgatcttgatccttaggtcccatgacttttgatagtagaaggatcattgatctgaaattgtcttgcattcctgactagtagacagaaagatatcagaagcaactttgtctattctgtttctagaactatattgtgggtactagtttttcacagtagtactagacatttcagaaacagctaccgaataatctttccaaataaagggaaaggttgtaataaaatgcattcccattccctatgtcttctcaaacagttcactgaaacttaaagggatgagcacactttacaagaaatgcaaataaccttttagttcactgaaataagataaacaacacatgtgtgtatttttaattggaagctctatcattcagttccttgaactaacagctactatacttttcttttgatgtatgcttcacagatatccattgcaagttttagattgtttgcttcaatgtagataagacaaattaactgaaaacttaaaaagcacctagaggattggttattttaatgttttttagacctctggatgctttgatcccatacagaataggatgaaattccactataatggcattgttttaaaatttgaattggccgtaatgtgttgtgtgtgcacacatttatctagctatgaacacaattaatactcactgagagagctctttaaaatgatgacataatttttttctttgaaaagttatttcttacgccctaaatttctaaagtcaccaaaaaaaggtaattttctatatgtaagacttatttatagtaactaaatttctaagtaactgatatctcctaaacagaaatgtctaataacttacttctagatcagctttaacaatggttttgatttatctaacttagtgcagtaatacaaatattagtagtaaaataatacaagtttaactaacttggtataataataggaataatataattgctcatgtttgatgtatgctaactacttggcaccattaagtacatcacatgtattatttcacttttctcattaaaatagcagtgtgatgctattatctccattttacagagagggaaagtgaggcatggagagaagtcgcaatttagaaaagtaataagtataatacttattttaattttaaattattctttgctagaggaaagatgcatgttccttggacatcttctatactttaataatattatttctatgtttctagcaacccccacaatgaaaagcaaatacacgatgcctttgggggacaaagcagttctgtagtcaggcccacacatgaagtgttttacctttataggtttcaacaattaattggaataagctattttttctgttttggcatctgtctacttggcaaggcccccaactgtggtgttggcagctgcatgacagcgactgcctctggtttttccacagcaactggctgaaactcgcctccctgggctgtcctattatgttgaaaattattttctttgactcaaatcagaagagtgtaatagaaattgtgaaaattcctgacatcttcccaaagatgtttttgaaataggttaaggttctccgggagtaaacttggattctaaatatgattttttttttctgacagatgtatgcatgtgttatggtaggtattcagaaatgaatgctctcatttgtaaaataaaataaaataatcccaaactcttaactatagcaatttgtggttttaatcgttttcccttgtaaatggaaacttggtaagttttagagtgcattgtacatgataaaatacatcttatgtctaaaatcttagaaaatattatcttgcattggggaaaacatcataatagtgcatatgtgattcattttatgtaaagtcctaaaattatctaaattaaaatatctatattctatagctgtgcatgtgtgtatgcacacacaagaatatacacatctgcattttatatagatacaagtatattgaaaggatgatacattcttatacagatgtagagcttaggatttctttatcaatataagatagaaactgcgaaagcatgaaaatgaaattaagcatacttcctttattcacttatcacccgttttcagaattagttgccctatgggtaggtaccttttaaattatattgtacatctttcaattaaatatcgggaggttgaaaattaagtgacaattctaatatttctagtggaagacctgaagctgcactattaaaaagctagtaaatggaaggggaaggatatttctttatccatggagttaattacacaagcagtacactatgtaagtgctaggagaaaaggtgatacaaacactacttaaaaggtttccagcgagaagcagctctgaacaaagtagatttaaagtgttacctccttactcctacaaattctaatgggaatcaattatgttccatgagtaataataataattaatatttatggaagtgcttactatatgcttggctctgaaataagggcttcacatattatagcacataactatcctaagtagaagatactatttttacttccctttttatagatagggaaagtaaaacacagaggtgggccgggcacggtggctcactcctacaatcccagcactttgggcggccaaagcgggtggatcacctgaggtcaagagtttgagaccagcctggccaacatgacaaaaccctgtctctactaaaaatacaaaaattagccgggtgtggtggtgggtgcctgtaatcccagctacttgggaggctgaggcaggagaatcgcttgaacctgggaggcggaagttgcagtgagccgagatggcgccattgcgctccagcctggggaacaggaaggaaactccatctcaaataagtaaataaataaatagcacagaggttaaataactctcctacactcacacactccatgtgtctctggtgatcacttggtaccacttcttttcttgcatgtctcacctctcttataaacacattaccaattttaaatgggtgttatgaactatgtgtattaattatggctgagaaccaccatttttaataacatggaattttctttagctggcagggaaggaatgcttccagtttaaaaaaaacggtaaaggacatagctttaaacagaaaagacgctttgaagataagttcatgtccataaagtccattcaaataacttagtaaattgctgataaggtcatatcatgtagcattttttaaaaataagattgctgaaagttcagcttgctctgagtaaacacagagcaagatgattctcaattatatagtgaataaaatcaataagaacatctagtgaaatccaaacagaaaataaaaaaatcaaaattgacttttaaaaaaattgacattttatggagataattgtagatacatatacagttaataagaaataatacggatatcctatgtacactttaccattttttccctaaagttaatattttgcaaaactataatataatatcacagccagaatattgacattactacaattcagcaattttattcagtttctctcggtgttcctatatgtgtgtgtgtgtgtgtgtgtgtgtgtgtgtgtgtgtgtgtgtgtgtatttagttctgtacagtttcatcacatgtgcaggtgtaggggaattggatatcacctccaatcccccttttagttcttagtaggctcttcagttggatctagaaaccaaatcgacatcaggcagaaaacaaaagaaaagaatacaaattgtattacttatacatgtacgtggagatcatcacaagaaagtgaagcctgaagaagtagtcaaagcaagatgcttttaatgatgaatgatgaatttgatgaatttggaaagcaatgacaggataaagagaatctggctagggacagtaaattttctctaggggagtcactaggagatagatagtgggtataaaactagtgaaagataagggttacttcagtaaatatatttattcaggtccattgaagcctccaattctaagtctctggtaataagggctattttctcactctggtcctgtgagggtgcccctcccagaggaatctttatggtttgctgcatgtaggaagagacaggtgagctaactctttctgaaactacaatttctccaaagtttccaactgaaaatagccaacataccaatctggcatatttggggatggaacatcctttactccttcacaggtatctgtggatgagagctgaagcaggcccaccaggaacagagagtgtttccccttactgttggcaattctctggattgcatctacccatcctgtcctagaaagtgtcaggagaacctgatgttgtctcagggaatcctcttagatgtggagagataagcctttctaggctgctttcgactgctggttgtgggtctcgaaatggtgagtctgggtcacttgcttctattaagtgaaaagatgtaagtcactcaacttctgctccagacccagtaaaccaaaactccgtcgtcttcttctgactaccttcagagttatcttgggtttattcctgcattattaccagcatttgttgctgttttagtgggaagaggaagggaaaaatgggtcgaagttatcttacccttaccagaagttcctaaatagactttttcatgagaaagaatatttttaaaaaactgtttatattataaatattcttggtagtttttttgctgttacatattttttaaaaatccatagtgcagatataataaaaactattgcaggtatttaaattaacagaactagttgaattcctacaacgtgtcatgtacagtgctaggttggttgatctgtctgtgcttctgctttacttggaatggatgagcaaaggcttatactaatttgcacttagtattataatgaggtgtgagaaaccaattttcatattcaagtgtctataaaaagtgactatttttcaacagttagctcctttaattataaaatcagtttttattaaaggcagttgatgctttgtgtgttgttgctagggtgacatatattatagaaacatacagtttatctttccagtaagagggaatacagtctctatcttaccgttaatactttaattagagaatgatcgacagaaaaatcttttttctcttcatgagatttgaaaaatgcatatcttctttatctgcatttaatcaaccctgggttcattaggatttgttgtgttggcacctgagaacatcttagaaattattaaataattcattttctgctttttttctttattttttatttccagcagaggcttgtattaaggagattctcttttgacatacccccacatacattcacactaatatatatgcactattttcaactgacatgttttagagttattgagatattaattttataggatactatcacattttatagctcttagtaaatagtatggtatttcaaaacataatttagttatagtaatagaaataatccatcatatttgttgtatttataaaatgtcttcaaaaatatcatataaatgatatctgaaattttgtcctagtcttgcaaatgctaggggattaatattaataaggttgttgtcaatataaatttctagtgagatgctcattaactggaaatccagtgctagagagacatttcagaatacctaaaccttatttagagacaaataaacatactagttaatatggctattgctatgaaccgcataaaattgaaatttgcccgaactcattcagctaagcatgctaacctcggctttggaaaagattgaatggcctatcatcagtcaatcttggtactagagttaaaagaagaggcaagtaatatggacagcacaaggaaaatgacagaaatagcggcttgtgatgataattagcaagaagtttgaataagcaaactctaaagaatattgaaaatgagacaaaaactgttaatgtatatgcaattaaatctttggaccctccttgcttgttgtttcaaatatccaattgtggagagaactacgctagggtaataatattgcccgttttccctgtccctccatgtactccaattaagaaagcagaaatgaaccatctaccctgatttttggaggaggaattgagtaggtatggcttcatgctctttaaattggggttaagcccccatgatataaattatatagggaatgcttcttcttccatttaatgcttactaatggatgtcactaggcaaattattagcaaacatacataataagaagacttaatgctatgttcgctgataacagctttatcattagtaaaggagatattttcatctctattcgtctgactcctatatgtgcggcttaattgattacgaacctaggtggggaatagatttaataattttctcaaactccatctataagtaatatgaagacatgataaatttttaagcagaaaaatgaaatgaaaaatattatgattcggaaaatttgtttccttgtactatgaaggatacttgggagcaggttggagaagagggtgaaggaaccgtttgggggacgcgtcagtaaaactggtggtagagactaggctgaaggatgatagtgggaatggaaaagtgaagacatttgaagggaagaagacattgtgtcggagttctaacgatgttcatttgtgcataaaacttgcatttgtctatcttattgtactttatatattcttcctaataccctgtactccattttactcctttttttttttttttttttttttttgagacagagtctggctctgtcgcccaagcaggagtggtgcagtggcgcgatctcggttcactgcaacctccgcctcctgggttcaagcattcctcgcgcctcagcctcccgagtagctgggattacaggcgcctgctactacaccagcctaatttttctgtttttagtagagacggagtttcaccacgttggccaggctggtctcaaactcctgacctcaagtgatctgcccgcctcggcctcccaaagtgctgggattacaggcgtgaaccacctcgcctggcccctgtaccccattttcaatatggcaaatggaataaatgtttttacaacatttatttgactgttgtttataactcttcaatagctgtccattactgtaaagtttatgccacaacctatagggctctaccttttaacagctatctctttctgattttccacttctctccaacctccctccctaaattacggtgatactgattttcttttaaaatacaggactactatcagcctcctttttcatcttttaggccacaacttaatgtttcttcctcagagaaatttctaaaggacccaaacccacaatagcttctatatgagactacttctcccattatatatcttccaggtatcctgtaatctcctttacaacagccagcagaattgaagtacactatttgtcaaccaaaggtgtgaagcttcttcttactcctggtgtttgtggttttattgactcttctttgttttctttaccagtgagatcccatctacatctttcagtattttcaccagtatcttggtcttttgcttgcttgctttcttgttttctaggttgattataattttattcctctaaacacatgaataccttccgtcattccaatggaattttggacaaaagggaaaaagttataagtgccaatttggttgccatgaaccaaaacagaaaattaaatacaattgcctagataatcaggcccaatttgtattacctagtatgaaaaacactttggtaacaacagtaggtcatgttaaactaattaatttctaggaacattgataaattaaacattggttactctccagagtaactctaagcccagaaaataagtgacttgtacatccatcatctgattcaggttcaaagagagtttctttattttggcaaagccaactttactgaaatgagatgagaagatttctgttgccaatttataatggagattaaaaataagaccccattgtcagagttggagatcatatgttggtaattgtggttttgtacaaaattaagaattgatccctaagaacttgtaaattataaagactttgtttagctcagtcacatttgcctaatctaagatttctgtctaggagaaataattttctagatggagtcaactagtacacctagtttaagtcttctttatgtgagattgtgtttaaaacagtgactcttttggccatagttacaatgagttcttcaagggttgtgtatttgcagactatcagtggaaagcacttgaatggcaatagttggaaattttgaagcaaaggaaataaaattgttacttgaaaccttgtaaaaagatcatacggccgggcgcagtgtctcatgcctgtaatcccagcactttgggaggcccagacaggtggatcatttgaggtcaggagttggagaccaacctggccaacatggtgaaacccgtctctactaaaaatataaaaattagttcagtgtaatggcgcacgcctgtaatcccagctactcaggaggctgaggtgggggaatcacttgagcctgggaggcggaggttgcatcgagccgagattgcaccactgcactccaatctgggtgagagagtgagaccctgtctcaaaaaaaaagataaatttttaaaaatccatgcaaagagcttgctattttgctattttagggagggagcatgagcttcatactcacttggaatttcctgagataaaggcagaaatagaattggaaaatatttaatataaatctgaaaagataaggcatttctcttagaagaagtttctaagcaaggcagctatatagcaaagggtgaggtatatatccctggctgcctcttagcacagggaactggcaccacggggcctacactggcccaagagttcttcaaagataattgtgttcccacaacttttctctgtgtagtaaactcttcctgccctgtagcagtccgcccagttcatgaaaaccatgggatttgacccactgaagaagacttttctcttaaagtttttcctgtttatccaggttttacccagtaaaggtcagctataactggtaatagttttgtcaatgtttccataccttgggacaaagttccttatttgctcggtatttcctctcaagttttacttggcattttgaaatttgaaaaaaattctatgtttttcctggctgtgaaaatgtattttttctttagtatttgatattcaatttataaaataagacttaaagcagctagatatttgcccatcgttatgtttagtggaatgaagaactaatcagctactactagtcttgttccaattaacattctattcctccatttccttcccacactgatatatgtacatatatagatatcagtgtgatatatatatatatcacacatacatatgctcatatatacatatatatcttatataagtctttgacctttctaagggtcaaacaccatgtttttcacaatctaggcaagctgctacaaggaaggaagagtctattatacacagaaaagctgcaggagcacaattatctttgacaatacaccttatattggtattttattttttttctgaaattactctgggttgagtcttatatttagtttctaattgtgaaggaaagccctgtaatgacctggtgatccatcttctttagaaccaagtcggccacagtcctaaaataaacatctgaaggcataggaacatttacagatgaaaatcataatttaatcaattgggtgtattatcttattttctaaatatgtatacattatttctttttttcttttttgtgagatggagtcttgctctgtcactcaggctggagtgcagtggcatgatctcggctcaatgcaacctccgcctcctgggttcaagcgattctcctgtctcaacctcctgagcagctgggactataggggtgtgccaccatgcccggttaatttttgtatttttattgtaacagtggagatggggttttgccacgttggccaggctggtctcaaactcctgacctcaagcgatccgccccaccttggactcccaatgtgttgggattacaggtgtgagccaccacgccaggctaccgtgtttcttttaaaaactttttttcttctatgtaccgtataggttttaaccctgtaagactgaacaccctcttttgtaagacatattttgtaatactcccattactatcctcaaagagaatttaccaaaaatgtaacttacatatatatataaaattctaaaacaattaccttgtaaaaaataaatcaaaggacaataatgaattaaaaataatggatatatttatcatcaataattaattattcaatatgaaaataagaaaggtacatactgctctagataaatgtagtacctgtacctaaaaccacagaagtagacagctcgaaatgctgacgtatgcaggtgagtggtatgaatgattaaaatgccatgaacagcatattttaaagtaatgggatttttctgtatgattaataacatttggtaaagttctgaataaaataagtgcacattttccctttgatttattgtgggatagtttcattcttggaaaatgcagtgcatataaagactttgtatttatatgtaaaattgagctaggttctatatattcacatacttataaacaggctgtcccctacttttcaaaagctgaataggacatgaaacaattactcattttcctggactttcctgcgtgttactggatgtctggcgtccttagagcacctttccatccgttatggggacaatcacagtgctttcacgtttcttaaatgtacccagggtatggtggtgtgcccagttgagaggaactgcaagtgagggttgtatttttttttttttgagacgagtctcgttctattaccaaagctggagtgcagaggcgcgatctcaattcactgcaacctccgcctcccagcttcaagcgattctcctgcctcagcctcccgagtagctgggattacaggcttgcgccaccacacccagctaatttttgtatttttagtagagatggggtttcaccatgttggccagactggtcacaaacttctgacctcaaatgatccacctacctcggcctcccaaagtgctaggattacaagcatgagccaccgtgccaggccagggattgcatttttgcatcgaagtagcagaaactagaaccagaggattttaactttctcatatgatggaatctgaaggaatggagtctaaagcaagaaactggccctgtgatggcatgaaaatcccaggcccctttgatcttcttgctcttttacaccttactatcattctcatgcttgtcaactcttggttgcaagatgatggtttcaacatctccagcctcaagtcttacatttcagagcagaaagatgaaaaaggaagcaagaagaaggaagaggcagcatgtacatcaggaaaacaaaactatcccagaaatccctagctgtcgtcctctcagatgccaaaaggccatgactgggtgccagagatgcttgaaatagagctctttgttcttgcttgacaccttgctacttctaaacaaaatcacgattttgttgttgagagaaaaaggactcctccctatctacttgtcctgagactgcttcagcctctcagcttcctagaccctcatgcagttgatttccaattcttccaggagctggcttactgtctactttttcagggtttcaaaaaaaaaaaaaaaaaaaaaaagcattttttaaagtttaaaaagcaaaatgtggagtgaatattttttggttactatgctttttaaatttttagaatttgtttttactgtgggttggctgttaatagtccatcaagacaactatttctttgctgggtttattggatattgggcaagcaaacaagcaaatagcagtatctgccactggatgtaatcaggaagaaattttcagaaaaaaaaaatgatgcttcaaggtctagataagcagattttccactggttcctgattattctaaataaaatgtttagtcagtggttgtgtaagtttcaaggatgttatagatggctcttgaaaacaataacacattaacctaatattttcagtactcctttttctagcttcatttatcctctcccatgcctgtaaacatgttactttgttaaccaaataaagtcattaatacatgagaccattttgccaaaagtaaacttaaaattaggaggaattggtctttcagaaggcaagaagagaccaagatgaaaggaagtcatttttgtgaaccatatgttttgacccagaagaactatttcacagcctttctcctggtagcaaacaatgagggaaacagtttcttaccatctgcacaataaaacttgttgaatcactcgggaattgggattattgctactgtttgtttgttgttaagccttaaatttaaaaaaagacaggatatataagcagggttggttctaatactgaaataaaacaaaaatgaacaaacccagagaaatctgcttccaaaaagccacagcacaacaaaaagaggtgtaaacatcagaagacctcaagggaaaaatacgtttatttagaaatgggatatcctggggattttgttacagcagctttattaagatattattcacatactgtaaaattcactctctagaagtgtacaattcagtgttttttcagtatgttcacagagctatgcaactatcatcactatctagttgcagaatactttcatcatccccaaaagaaactgtatgcccattagcagtcactccccattcctctctccctctagcctctggcaaccgctactctgtgttgtgtctctatagatctgcctattttggacatttcatataaatggaatcatactatatgtggcctctagtgtctgtaatctttcattttgcataatgtttttaaggtccattcatattgtagaatgtatcagtctttcattccttttatttgctaaataaaatttcattgtatggatataccaaattttgtttgtccatttatcaccagtttacgggtattcgtaaggcttttttttcccactttttgcttccagtagactttttgtatgtcacaaatggccatatgtttctttatcccataatcagaataaaaattatcattcttttagtggacgtgcctttttttaatcaaggcacagaaataaaaaagtgagttgtattttctcattaagaaaacattttggggtgtgcatgttttcagttgtttggaaatatgtagacatattggcagggtatcccacttacttttgctgtgtataaaatcaccctgatacttagcagtttaaaacaattactttattatgccgtggatgctgtgagtaataaattcagataggacacagcagggatgttctgtttatgctctgcaatatctatagcctcatctgtcaagacttgaaagctaagttggactcaatggctggagggtggaattctgaaggcctacatgtgaacttgctatgttgtttggcttcttcctagcatggtggctttacgatactcacacattttctatggtaactcagggttccaagcaaacgctgttctagcaaacaaggtagtagtcatatggtcttttatgaccctgccatggagggcacaaaacattactcttgccatcctctatctgttgaagtagttacaaactcacccagattgaagaggaaaggacatagaccctacctttccatttgccaatgagttttgggaccatattttaaaaccattgtgccataaagggcatgttttatgacaggtgaagctttacgtcttaaaagtatataattacaaatgattaaatttaaaatcacgagaataaaccattgcattcatctaccatcttgccactaaatcagaatcagtaaaacaaggtcaaattgactagaagccacatatagttgacatttggaagaatttgacagaaatatggctcaattggagttactgaatttaaaccaaaacgtttggcaccaagaatcatgggagcccagactaaagaggaaacatacattatatagctcttattatctaatggtgaaaatcctatcaaatctccacaaaggtggtgaactctggtcttccatggcatcctagacaaactttatttacaggcatgtatggtatataaaataggcatagataataaatataataatccagaacaatgataaaacagctactatgtcaaggtaccatcctaacctcacttataatcaggcattaaattctcataagaatcctatgaattagacaccattattatccatatttaacatatggaaagaaactaaagtacggagatgctaatgaacttacccatcgtcccactaataaatgttaaagtcaggatttgaacctagatgctcaggctccaaagcctatgctcaaaactcttgctatgtgaatactggcatattactgaataaaatagccccagttttgtttttaaataaaaaatgttgatcaatttttttcaataaaatattgtttcatcacaataagacctacttattttcctcctgagcagtttttagtgacatcaataacaatttttttaggctgggcacagtggctcatgcctgtaatcccagcactttaggaggccaaggtgggcagatcacttgagctcaggagtttgaggcaagccagggtaacatggcaaaacctcacctctataaaaaaaatacaaaaattaacagagcgtcgtggtgcatgcctgtattcccagctacttgggaggctgaggtaggaggatctcttgagcccgggaggtcaaggctgcagtgagccatcattgcaccatcgcactccagcctgggctacagagcaagaccctatcttaaaaaaaaccaaaaaaattataagcgagtcatacaagttcttcacagcttttcattatggtaaaccttgattaaaagccaaggttataaatgtaatttttgctaagtgcggatgtattgtatctgtagcaaactgtaattcaggcccctgaatgtaacatcctagctctcattccttttgctgtcagatttccctatagataacgtctacatctgctaccttatctactcgcaaatatttatgattttcttccatgaaatttacttttctcccctgaacctgtaagccaaatcaagtgaccttttgtgaatctcaaacctctgtgaattttaggtagatttaatattcttggccaccactttctattcagtcaaattcaagaattctataaagttaaatatatatggatgtgtgcacacatatatatatatgtgtgtgtctctaggtcatgaatcttttaatactatagaacatagaacatagaaaattataagagaaattaaaatatattgtcaatttaaaagcataccgaaaacatgttatatgagaatggaataatacaaattattggtatggggagaagaatcatgaatagtttcatgaggaatgtggcatgtgtaacaggcattaaatatgattaagaactaacactgagtatatacaagttagctgtatcaataaaaatgtaaatcattcagcaataaactataaagttatttttactccataagggtttttttccctgaaattttcggcccaaagtgactgttttttcttcacatgccacttatatagtgtgaccaagtatttagttaaaaaaattattctccagtcaaatcatttgttgtacacttcttggagctgtggcttgcttgtgtttttattgattaaaaaatacagcacaatcttgcacctaataaaaacctaacaaactggctgagtgcggtggctcacgcttgtaatcccagcactttgggaggccaaggcaagcggatgactggaagtcaagagttcaagaccagcctggccaacatggtgaaaccccatctctactaaaaatacaaaaattagcctgacctggtggcaggcatctgtaatcccagctactcaggaggctgaggcaggagaatcacttgaacccgggaggcagaggttgccatgagccgaaattgcgccactgcactccagcctgggcaacaagagtgaacctctgtctcaaaaaggaaaaaacaacaacaataacagaagaaacccagtaaataataggaaaaaagtgaatatagaaaagtaatagaaaatggttgcctttgtgaggttagatgtaaccaaaatattttagcaattgtttagaacaaatagattaaatgaaaaatatttccattaatattttaaactgttaaattctgtctaatttcacatggtagatacacattcattaagacttttcagtgttaagactaaataaagaaaaagaaaattcttcttattgtgccttattcagaatccactgaatttcgttattatttttattatcattatcattatcattatcagtattatttgagatggagtctcgctctgtcacccaggctggagtgcagtggcgccatcttggctcactgcaacctccgcctcccgggttcaagcgattctcctgcctcagcctcctggggagctaggattacaggtgtgcgccaccatgtccagctaatttttgtatttttagtatcttatttttgtgggtacacaatagatatatatatttatggggtacatgagatgttttgatacagacatgcaatgtgaaataatcacatcatggagaatgggatatacacccctcaagcatttatccttcatgttacaagcaatccaattacactcttttagttatttttaaatttacaattaagttattattgactatacttaccctgttgtgctatcaaataggtcttattctttagcaaagcatatttgtaaagagtttggagtttctctttgctttacacactgtaaaaaaaaatgtcaaacaaggttatccaaagagtagtaggagaatgagcattgagatcataagtgtctcatctgatcaaagttattcaagaatgaatgcattttggaggcaagagttgaggaccatcgccatcattgactatggagtaacacaagcccagactcttgagattaatttggcattatctttcaaaattaaaagtataattacatatttacatagcaattctacttcaaggagtttgcccttcatttatgttttcacatgagtaagggtttagatggacatgggttttctttgtagctaggtaatagtaaaataggtaatctaaatggacatagcttggtggtagtccatgcctgtgccctttatactacagttttaaacaagagatgaatttatataaacagatgttgaaatgtgatcgttatgtagtattaattgcacaaaagtagaacatatatatgtgcatatgtatgcatacatacatgtacatacatatgtgcatatgtgttctagtttattatatatatgtcaaattgttctatttgtatgaaaacactataaatacatacataataaataaacaaatatgcgtttgtgccaaaaagcacagaacatttctgtttagtctcataccactcattttatagctttatagataggaagaaggtagactttgatggtacttgaatttttatctatgtatctgggcaagtattttatctatgtatgtggtagcatattttatctatgtatgtggtacatacatgttttatgtatatgtatgtatacatgcatatatgtatgtataaaatacatacatattttatctatgtatgtggtagcacgtgagagaatttttgttaatttatatgttatttcacttcaaaaattgataaactgtgtgtgtgtacatatatgggtggtggctatatacatatagatattatatttctgggtggtttataaagagcagaaatgtgttgctcctagttctagaggctggtgagtccaaaagtcaccagcatgttaggtgtcttgtgagcccgcttcctcagtgacgttcatcttgttgatgattcctcacatggtggaggggaaagggagcgttctaggttctttttttttttttttttttttttttttttgagacagaatctcattctgtctcccaggctggagggcagtggcacgatcttggctcactgcaacctctgcctccgggtttcaagcaattctctgcctcagcctcccaagtagctgggattataggcacccaccaccacgcctggctaattttttgtatttttagtagaggtggggtttcaccattttggccaggctggtcttgaactcctgacctcgtgatccacccaccctggcctcccaaagtgctgggattacaggtgtgagccaccgcgcctggcctgtaggttctcttttacgaggcaactaattccaataatgagagctccatcctcgtgacctaatcacctcccaaaaagccccaaacccatctcctaatactatcactttgggagttaggatttcaacatatgaattttgggtggacacaaacattcattcaataacagtgactatactatcctatgttaacattttactattttcaaagcttttgttcactttgtatatatgcatttatttatctttgtagcaaatgaaggataaaaatatcttttggagtattatcttgacatactctccagctgctagggatgacctgtcagtattgaccccttgggctgaagcaattcgatcctctcaaaactcaaattgaagtgagaactatctcttctcctttatttcctttcaccagaaatagctatttcatgttttaaaacaactggaaggtaactgaaaactttcagtggtgttaaatcactgtcagaaaaaaaaaaaaaatctgtttgaaagttggaaacagctcaagtaaagccatttaatctgaccagcataagcagattctgaagaaaatggtgaagaatatcattagcagcaatgcacacagtcatttattcattcaacagatgaacatttgatgaacacttactggttcttggggactatactccatgcctaaaatacaaagatgaacgaagacccaattcttgctctcaagaaaatgatagtctgttaagaagaatttactggaagatagataagtataatactgaaaagtgtgaagaatgaaacaataagatgtgcaaagtacagtgctgtcacaaaagagagagaaataaaagctaactggacaggtcagaagaggcttcacatggcactgtcttgaagaatgcatagaaatattctacaaccagcaacttccaattcagttgaactatctccatgcttcctgttcaaccgagattacattttcaatcttgtttctaaaggaaggaaaaaaagatgagtcatttggtacaaaaaagcaagaacagctatagtctacactataagataaatgtagggtactctttaaatctagtggacgctgtccgtaccctttcagcgctcccattttgtctcatcatctaattgcgtgcacctgaagactttctctgatgggtttgccactgcggggaaggctagaagtgctggaatattgaagacccaagcagcattcttcaggttaataatagatgagaattggatgataaaaactctaaactttttacactcaaataggatgcatgaggcatgtctatttcatttgctagaagtctccagtggcattaagtcccagtcatccatagtcataacttgctcattaatgtactctgtgtgttcctttcttctctatctcacttctctacttcctgttgatgctttctgtgatctccatcacagatcttcctgtttctcacttcctgttgatgctttctgtgatctccatcataatcagctacatggactcaaatttgtcatttaagtctgatcttggggaatccaattttagacattgagcaatggactggctgggagggatgaaagaggagacaaaggggctcctatgttcctggttcaggaaacggatgaataacatcaccagttagtgaataggcactgcctttcagtacctacgggagtgctttgttcagtacatatcctgcccagccaagcactgaagaattcatgaattttattgtaacctaaactgcctgtggcattatgaacctgtgtaatcatgggtagtgttggctttataccaggattttgctagcttgttagcatctccatgtgcatttgcaagaccttggccactcttcagtgttttctactccaatttgcatcattgtccctgcaggatgtttatcactcagacattctgaaatttggactgatgcttgacttagctctgtgattggatgcttctcccagaacctttctcacctctatcagctacgctaatgataatctagacagaggtttccctccacgggtgctgcagctcaaactgtgccctagaccactgtcagtcaacctcttcaatgccactgtttggtgctttgcttggttctttcagtctgcatgaagtcgcagctactcaacttacatccatgaagcagcaaggggaaacttcccattctcagtgttttaatctgttctctgttataaaggaggcatagtagagttgctggaccccaaagagtgacttgtaataaaataattctttaaaatgtatacatagatcttgtatcccagggcacacatttgacatgaaaatggctgttttggttgtaagtgcaggtaacagccatcaaggtgtacttgggactcctcctccactccaaatcttaggcctcattattatttagtttatcctgtctgtatctgcaagatgatttttacgtgagaacactagacttaccccttgacactgtgctttttgcagctcctcatatttgatgggcatgaaagctaatatgttgtctaattatggagagttttaagttattaattttatttttatcaggagatccttaaccccctatacaaattagatctaaatagatactaaaagatgaagttaatatttaactcctttacccaccagatgtagctgaatctttgcattggacaagtgagaatcctacttactctgaatcttagatactttgctttgagtatgattcaatgtcactgttgctacagaagtataaatgatggttatttatgcttgcatgttttccagaaagttaaagactattttattatattggctttctgattacttgactgaagttcataaactaacaaataaaaatctaaaaacactctctggggacctagacaaactataatgattaaagcatatagttactttgaagccaagatgaggtaaaggggataacttaagacatatttattcttaggctgacatatcttgtcattattatgttacaggtgcacatggaccatttattttttctcttatgaagaatttcaaacatatacaaaataaaaaagtaacataatgcataccatacactgctcattagctctaaccattattatcattaccatctggtttcctctctacctacccacttcctattctctgttttgaggcaaatccccgaaagtatatcacttctactctaaacatttcagactgtattcccaagtaacccccccaccccacttcttttttttttttttttgagacagagtctcgctctgtcacccaggctggagtgcagtggcacgatcttggctcactgcaacctccgcctcccaggttcaaatgattctcctgcctcagcctcccgagtagctgctactacaggcatgcgccaccacacccggataatttttttgtatttttagtacagatgggatttcaccatgttggtcaggctggtcttgaactcctgacctcaaatgatccgcccaccttggcccctcaaagtgctgagattacaggcgtgagccaccgcacccagccccggaaaatatttgcttaatatcatcaaatacattttatatttcccaaattatcctataggactcctctcttctctctgttgtctctgtttcctccacaccctacatcctcctcctccctcatcctcgttctcactctcccttttcatttttgaagaaacaggaccttttgtctaggtttgttgattacatccacatgatattgtttaatgtgtttcaccagctcctgtggtgctgacaaattagcagctaagtctagagagctacttgtagtcagtttgattttgttctttttttactcaagatgattgtatagaaagtgttgtgtactttcaacaaaaggtatataacgtttgatattggcagccattgatgatcattgttttgattgattatttcattatgagttgcaaaacaatgatatactgtttttacttcttcatttgttaggaggagcagttctataaagagaactttttgttttgttttgattttttgtttttgagacagagtcttgctctgtcacccaggctggagtgcagtggcataatctcggctcactgcaacctctgcctcccaggttcaagcaattctcctgcctcagcctccctagtagctgggattacaggcgcacgccaccacgcccggctaatttttgtatttttagtagagatgggattctgccatgttggccaggctggtctcaaactcctgacctcaggtgatccacccacctttgctttccaaagtgctgggattacaggtgtgagtcactgagcccggcttataaagagaactctgcatttctatttggttgcctcatagtataattgatacaaagcaaagcagagtaaatgcttcagtttttcccccaaaagaacaattttcaaaataatgaattgcttctctagtctcttccaaaagttgccagtgaattttttttttttttttttttgagatggagtcttgctctgtcaccaggctggagtgcagcagcgtgatcttggctcacttgcaacctccacctctcaggttcaagggattctcctgcctcatcctcccgaatagctgggactacagacgcgcaccaccacgcccagctaatttttgtatttttagtagagacggggtttcaccatgatgttggccaggacggtctcgatctcttgacctcgtgatctgcccacctcagcctcccaaagtgctgggattacaggcgtgagccaccgcacccgaccaccagtgaatattttatttatttattatcatccagttgtttgttttggcatcactgcgaatgcatgaatttaaatatatttaaatgtaactgaggctctccaccttctgtattatgatctttattgtcctcatatttttcatctttatgcgatggaagcctcctttacattgacctcctgagtcctttctgtatgacctttatacactttggttgaccccaacttctcttgtagatcaccagtgggcattcctgaggtgtgggtataacatttatctctggattatttattcattcagaaactttacttagtaattaacatttactaggcgttaacaaggaagcagtaaagcagcaaacatgctcatttcaatatttggattaatacaatcaatcaaaacagtagttattgacaacttacttattgtgtggttagcacactcaaaatttatgcagagaaaaaagatgagagattagacctcctccttactgtaacacattttcaatctgaccagagattttgcttctgcaaatttggatgcctagcattggcatcatcaagactttcatagctatggaaccatcagatataaaatacaccttagtatgcaacctcaacgtgttcttcctcttgcaattgaggttatattaatttattaagttcattttgggataaagaagacagaatcatagttctttcagcctgttattataacactttattatcctttacctccttccaatttttgtgtctaataattcgtgtgcatgtgaactgtcttcacttttgagttttattatgaaactcaaactacaatacacatgtatgcataaatttctgtatatgtggcatgcgtgtatatgtgtgtatgtatgtgaatatataaatttcgttgaatagagtggtatgattgtctttggcctccttaattatatatattagcatatgttctagggctcctgacgcttcttgcaggcagaaggcatttccagaggttgtgtagatccatgaaggacagttatcgggtcacatctcacatcatcactgtttctttcttgcccctgtcttacactagtacccttcagggtattgtatgaaagcttcattggttcaaattcattttgtcctctagtgctactttctatgctgacaaaagcatagtgaaactgatgccctggcttgtactgcagtaatattgcctccaagcatatcaagtacaggaagttaaatcctatatattattaagccagatcagtaacatgtacccaacaatgtggtgagacatattttgttttaataaaacgatgatgttacaaattcttcaaccttcccatatgtgtggaggtgtgtgtgaatgtctgtattaatctaccccatgtctcctggatagagtttttctacaaagaaccaagctcagcttcccctagtgttaagacattttgcttcatgcttggtatagtgtagtgctactcaaacctgagtaataaacaggccagtttaaagaaataaaaagccctatgctcaaccaatgctgattaaaattatttttattaaaatttacctatagaagcacgaatataaaacaaagggcacactctttatggtgaaagggcatatagatctacaacaacaaatcatattttcaaatcaaataaaacagaagtacagaaaagcaatagaactcaaaagcataaccttaatgtgtctgccaatgttgtcttggatacattaaatggccttttataatgtgaatatagtactagctgcaatggtgcaagttattgtatttttagcatttttcaatatatgttgtgaagactattttactgcttttctctattcagatctttgcaaaaaaactcatgtatacactataatcatgttttttgccattttgtagtcctatgcttttgtgtcatcagccttccccagctagaaaagtataatattctattattgtatgctgttgtcattttcccacaatcaaaagtacaaattattaaggaaactgaagtttcggtctaaaatgtgttgttcagatgaaattatccataagaaattaaagttgtgttcttataactggaaaaagaacttaacgcaagtataatatgtgcaaaactgggatgacttagttcttgctatcattaagaggggacaaatggcaacgagacgagctttaacagctgagaaaatcttatgcctagatgtacataggcctggaaattacatagcagtaaaactgtaccttcaaatagctcaaaagcagctcataataactgcttgagattatctcagtgataaagtcagtataacatagtgttttttattttaaaaaggaaaaatgattactttctttacagtatgctaattaaaatatacaggtgattgaaaaaactattaataaaaatcagtaattttgttgagtgggattatgaatattaattatttaattaaaatttccttcaatagttaacaaagatttattgagtttctgagtcaagcattcttctaaaggctctgccttattagaatttttaaatgtatttgcaatgagtgtatattaaatgtaaaatgtatgattcaggtttaaaaaaaaatagcagtgagagtaattgaatgctgaggttaaatagaatgggtgaatcaaccataccataaaaaacttctaagtggatattatattccaggcactctttcctacttcagctgttgataaaatcaaatatttccttagagacccttgactaatgcaggaaataaatgaatacttgcctatatagacaaaataataacaacaaaagccagaaaccaagccataccaaaacgaaacaaaaacagaaaaactgtgatgacataacttatctttcaataggattttctcagaatgggaggcaatatatattttatgcttccatggtctgtagattccaacatttgtataattaacatatacaattttacaagggaaaaatactattcaacaaatacgtaaatacgttcaatgtaatcatgcagtacttcgtttaaattgaccttttttttttttttttttttttacaaatggtgcaataaaataatcatgtttaccttcttcacatgttcattgatgttggcgtgcacggttttatctatatgatgtgaccttttgagaccacatgacattcacaaactgaaactaaaccaactaaataaccagttatccaaagataagcaaaagtggacgtcagtttaattagtaaggggagattttaatcagtaatacactattataatagagaagagttcagcatgaactgaactgaactttgatttgtgtagaggtgactgggagttttaaagggagaatgagagaatgagtttgagtggtggctcattaaagtcagggaagtaacaaattacaaaaagtggaaaggtgggattgttccctgggaaacctctacgtttgctaaatggcacttaaggttaggctcctgccttctcactgtcttcgggttttgactggaacaaagggtaaattattttggcagctttgagttttctcagaaatgcaccttaagtggggctagagttatcctagagaggtggctttgacctgttagaagctatgttagtgttttttgttcaggtctgtgcaggccaaggttatggcctagctgagaagagggctcagaggagcctagctaaagtttggtcaaggggagcgtcttggtggagcctcactcctgttcaagtaaagaagacacattattcatccttctgaacagtgtaagtccatttgtcattcgattgccttttgtttactaaggactagctaaatcatcggttgagacttgctagtagagcatagttgctggatgatgcacgtgatcaggcatttaatgagaggcacctctatggaaacaaacataaaaacaaaaacttgttggagaagaatataaatcctatttgttgagtctagagggcaggcagttaagaagttttctagacattgaattctaagcatcttcagatggtagagtggtaatctgatggattttctggtttatggtttgaatgtggtgatggcataaacattaatttcacagtcatagttatttcctggaacagaacacggatgatgctggagttccagtggactttctgaatggctcttgtagcaggagctccaggcatgaaggttgcctatacgtgatttgttgtggtggtaagtcttttgaagtttatatcaagttcttgggcttcagtgtgcaaggctttttcaaatcctgggggagaaagacagctacaagacaaccttgtaggttgtcccagtagaatcagtaggttgtaggagtcccagtaaggatttgggcagtcagattttaattctcagtgatgtcaagtcaagagggaaggcaaaaaattataaacatcaatttggagagatgtagcccgatattgaaggaaaactaaacaattgagtatttagtaagagtggcaaaatgggtgagatggcagaattcagtttagtttacaggtaaatgataaaatcctcaagacaatgaacaaaattggaatctgataacccacagtggtgtgttttacataaaacacaacaaaaccggaattggatgagaagagtccctggatctagggtcatcagaatgtagctattaagagttggattctgaagccaaattcaaattaggtgccttgtactttgcgcactgaatgctctcaggcaaattatttaccttctttgtgcctcagtctattcatttacaaaaggaatcttaagagtatatatctcataggattgttttgaaaattaatgagtacgttacattcaactgtgtctgccacattgctgtgaagttattaccttcctaatatacttacaaacttcataattaagaaaaaataaaaattcataaaatgaacatatttgtaataacttattataaatattgtatagttcattaaatgtattacctttagacatattaaaaataacacacccctcatccccccccaaaaaattcctgtatgcctgttttaaagcagttctgcatgttaaagctgcatttatgatatctaagaagtgttttttctcctaaatagcaggttggtaataatgtatattgcaatcgtaataatgtaagttctggttacaatagtttatctgggtaacatgtagaagttaagtgaatgaggtaataaattaaccaataagattacctttctggtagggaggaaaaacacttctgggttgaattaatattttgtacacatatgaaaggaagaagaaaaataagaaataccatttgcaaagctgactttaataaattttaattgaatggataaacattttagttaaaggtagtaatcttaacttgagattacttgagataaaaatatatattttcttaagagacatgattgttagataacttagagatataataagtggaagggttttccattaaggtaactgatagtccttaggtaaattaaataatgggaggaacttgtgttaggaaatcaacatccgagttacagttaaattggtgggagtctttccagtgcctgaagatacagagattttcaatagaaataaggtttttctgagaaattaagtgaaataaaatgtgcaatagtgattgataagcactgtttattgaagaaacgatttatctttattcttgccctttgctttttaaaacttttattgcattttcttctatttttaatacactttgttattgaagcataacataaccatataccataaacacagatagctaccactcagatcaccacttggatcaagaattaggaacgaacatatttgattttaactgcagtctcttctctcttacgctgaaaatctatgtttctaatgacattagtataattgcttatatggtaattaccttactatatacatataatggttccaaaataacagttcttgaattatttttataaaacaaaattaacacaaagatttatagtgatttctgcatttattttattattatatgtttacagacattggctaatgcttctgatgatcaggcttctctcgattaactgaagatagccttactctgcagctgtgtatttcttattccatctggagcctatgccatcagacattatgtctgccatattttttcttctgtggaaaatcagttttctttctgaagtgcttatttttacctttggctgctgatgtagatctttcatttgttcttcatcttaggctgtgccctggctctaaaaagtgttctcactgtctctttgctttcatttttttcctttcctatccctacgcccttaaatcacaatatctgtcagagttccagaagaaagaataaatactcaaaggagtcatgactattataatagttgatagtgtttactttggcctagttgtttctagatttgtctcaagaagcaaacaaaccaaggattatatatataccatcttgaccacaaaccaagcctcagattcctctatacatatgtcttaagttaccaatacatgttaactgttataatatttctttgactatatgtatacaccatgtagatgtagactatgtatactttgcatcctgctgtttatcacatgcctggcacatattaggcactgaaatagttgcttaatacatcaaaataaaattgaatagggaaaatataatttcttaagttagcattcccctctctccacccaaaagtattaaataaaaaaacaagagtttacgatgactttaacattatgatagagatacaagaaaaacaaataagtatagtaattgaaatggtgcccagaacaccctctttgttgacactaaaagtaagttcatcagaccaaatctgtactgttcagctctggggaacataatttaaatgagacactgaaaaactggagcctgtctagaaagcaacttataattttagggacgtattagctgttttcaaatattcagctaatcagtggaaatgcaatgaagcatattcttattatgatgagaagaaaggaaagagagccctttgtccactaaatatttaaacaaacaaactttgtaacagtgagagatggccaaaaatataaaaagcttaatctggaagtagtgagttgtttttcactggggtgtgggcaggggcttcatgtctatttaaggaatgctgtgttcccatggaaaaccagcacaagacaaggatgccctctcttaccattcctatttaacatagtattagaagtcctgaccagggaaatcaggcaagagaaagaaataaagcgcctccaactaggaagagaggaagtcaaactatctctgtttgcagacaacatgatgctatatctagaaaaccccatggtctcagcccaaaagcttcttgtgctgataaacaacttcagcaaagtctcaggatacaaaaccaatgtgccaaaatcactagcattcctatacaccaacaacagagagaaatctgttccattgcatctgttgcatgcagtgcaacagggagaaatcagtaatgcaatcacattcacaactgccatagaaagaataaaatacctaggaatacagctaactagaggggtgaaagatctctacgtggagaactaccaaacactcctcaaagaaatcagagatgacagaaacaaatggaaaaacattccatgttcatggataggaagaatcaatatcattaaaatggccacactgctcaacgcaatttattagattcaatgctattcctattaaactaccattgagattcttcagagaactagaagaaactattttaaagttcatatggaaccaataaaagagcccaagtagccaaggcaatcctaagcaatttattagagtcaatgctattcctattaaactaccattgagattcttcagagaactagaagaaactatttcaaagttcacatggaaccaaaaaaaagagcccaagtagccaaggcaatactaagcaaaaagagaaaagctggatgcatcacattacctgacttcaaactatactacagggctacagtggccaaaacagcatgatactggtacaagaacagacacatggatcaatggaacaaaacagagaaccaagaaataagactgcacacctagcaaccatctgatcttcaacaaagctgacaaaaacaagcaatggggaaaggactacctattcaataagtggtgctgggataactggctagccacatgcagaagatagaaactggaccccttccttacaccatgtacaaagattaactcaagatagattaaagacttaaatataaaacctcaaactataaaaaccctggaagacaacccgggcaataccatttaggacataggaacagacaaaggtttcatgacaaagatgccaaaagcaattgcaacaaaagcaaaaattgaaaaatggcatctaattaaactaaatagtttctgcacagcaaaggaaactatcaacagagtgagcagacaaactacagaatggaagaaaatgtttgcaaactatgcatccgacaaaggtctaaaatccagcatttataaggaacttaaacaaatctatgagaaaaaaaaaccctactaaaaaagtgggcaaagggcatgaacagacacttctcaaaagaagacatacatgcggccaacaagcatatgaaaaaagctcaacatcactaatcattagagaaatgcaaatcaaaaccacaatgaaataccatctcacaccagtcaggacggctattaataaaaagtcaaaaaatagtagatgctagcacggttgtggggaaaaaggagcacgtatacattgttggtgggactgtacattagttcaaccattgtggaagacagtgtggcaattcctcaaagacctacagacagaaataccatcaacccagcaatatcattactgcatttatacccaaaggaatataaatcgttctattacaaaggcacatgcacacgtatgttcattgcagcactattcacaatagcaaagacgtggaatcaacctaaatgcccaccaatgatagactggataaagcaaatgtggtacatatacaccatggtatactgcgtagccataagaaagaatgagaccatgtactttgcaggaacatggatggagttggaggccattatccttagcaaactaatacagtaacagaaaatcaaatactgtgtcttctcacttgcaggtgggagctaaatgatgaaaacacatggacacttagaggggaataacatacattgggacctgttggagggtggagggtgggaggagggagaggattaaaaaaaaataactgatggttagtaggcttatatctggatgacaaaataatctgtacaacaaatccccatgacataagtttacctatataacacacatgcacatgtacccctgaacttaaaagttaaaaacaaagaaaagctgtggataggtttggtggacaaactaggaactggagaatatatgggaattttacaatagtctcactggagccttagtgggttttagtagtgtttcaagggccatgtgtagggtgagaagacagtggatgcccaccaccaccactaccaccatcagcattcctttagctgaatagctcactcttcatctgtttcatattgggcttctgggtcacattctatttaaagaaagagtttccactcgactctgaggtccttgaatccaaagtatctctcataggtccttggagcaatcgtattggaatttttaaaatgttgattgaatggcttgaggtgaaaggaacctgttgcacagaactagttctctgttatgagtccacaaaggtcttaaattcgataaacattgtttttactagtaagtgtcttagtatcttaaaattatagtaagcttgattcttttctatcatgttggcacagttcagttagcaaataataaaatgaaacaatgatgatatgtaggtagacatattaacatgcctttgtatggagcaaacaataagaagcagatgggacagtctgaggaacgcattaacaagagtttctgaagccaactgctgctgcacctgttaacctggaaggagattaatgcagtagaacagctactgtctttccatatttcttaccacaaaaagatgttttattacattcattgtaacctcttggtaacacattcagaatacaagcttcttcctagtttccgcacatgtctttctcatgatagcatactgtctttgaaaattccatctgctttgatgatttgggctattctatcaaggcaatataaaattgtttttcttaaactttattacaggtcattgagtttcatgatctatagtgaatatttctgtattgatttgttggtatttttattttctcttctcaagctccttgtaagtggggactagcaatgtattttttaattttccgaactatttaaaatctttgatgccaatgattcaacttaaattctggttatatacaccaatgataatattttgtatctagccgatatttaatatttatcatttttttaaagaatcattcactttcatcactatcatagagatgggacaaaaaatataaagactattttacgtatgtatgacttgcttggtaattatttgctgaatgaatgaaaaatacaaaaattgatagttttgctcttacccatcttgtatatctcttccagtgctcattttgcattatgtattagttcatctttgcctttattaagagtagaaaacgccatttcatcttttacatataaaaatgagtctggtctgatacagttactcacatcttcgcttaaatttcttttcttcttcttttttttttttttttttggtggagtcttgctctgtcacccaggctggagtgcagtgacgcgatctctgctcactacaacctccatctcctgggttcaagtgattctcctgcctcagcctcccgagtagctgggattacaggcatgcaccaagccacccaactattttttgtatttttagtagagacggggcttcaccatgttggccaggctggtcttgaactcctgacctcaagtgatctgcccgtcttggccttccaaaatgctgtgattacaggtgtgagccaccgcacccagcccagtgaaatttcaatttgaatttggaagctctactaaggtagtaatgtgaactttcaatattattagaaagctcatcaatctgaaatttaacataaggtaaagaaataaaaagcattaagaccttacttcatatgagagctagaatccatgacctgaaaaataaagtagataaattcacttataaaactataatttaaactcttaacttgtaaatttggggaaattagtggtgaatgggtttctaatatatggaacatgaagcagtaggaaatatgttatgagttgtgacagatattccacctcccacgagactgtgatttttagaatcgacgtgttataaaattgatctgaactttgtccctgatgctggaaaagtggcaacctgtgactgctctaaagtaagctaaaggagctgaacaaggctgggcacagtggctcaggcctgtaatcccagcactttgggaagcagaggcgggcggatcatgaggtcaggagttcaagaccagcctgaccaacgcggtgaaatcccatctgtactaaaaatacaaaaattagccgggtgcagtggtacatgcttgtaatcccagctactcggggagctgaggcgggagaatcgcttgaacccaggaggcagaggttgcagtgaaccgcgattgtgccactgcactccagcctgggcgacagagtgagactgagtctcaaaaaaaaaaaacaaacaaaaaaagaagctgaacaaatgctggcattcatacatggtttgagaaatagccctttttcatttaagggaaagacttactgagatccagattgagaaaacaccccatcaacaataaagtggctcaggaaaatgttttatactagcacatcttcaagtttctacttaaggctattctacatgaatatttaaaaagaggagatgtcaaatataaaagcacaagaggccccgagggcttagtatctttatttgcgttaaggtttctcataaataattctatttggggatataggctctggtatatatgtaataaatgtgagtctttttaatatcagagttacccttaggatagtaagtgtatttatttcaaagaaatataaaaataaaatgaataaaatatttcaggtacctcagatcattgcaaattagtcctcaagtctctttcagtttttcttggattatatgaataatgctttgggatagaggaaactcaccaaagtatatttctgaggactgggggtgggaaaggtttcagaaaggagaaacccatgggaagaatttttctactgactgtcaagtaattcatctcaacagaagaaaagctgattttcgatcagtttaaggtaatagaatatgtcagaattcctggggttttctttgttcaatagcccacttaacctgctgcagaacaccctaggaataacaaatgaatcataaggtagagggacattccagcacacttgttttcttcaaatattgatattttccccttaaaattatatgtctagaaaagcttttgctcggacagagtctgtagggccagaaatataaataactgtcaaatataaagctgaatcgcctccacaagattttaggaacttctgggctggggaaatgtggcctgaaggaaggctgctggtttggccactctctgtattccatcagaaaaaatggtggggtataatcagaagttgaaatgctcacagtagttttaccccatggcttgtcagctgaatattgcgacaatataggaattcttcatcgcagaaggaatgagcctccctggactgatgattttctcagtttatggtgtgtgtgacgtttttgtaaagtggcaaatagttgggggcatgagctagaaggtaactttaggaggttcaaccaaccaagtaccacctgcgaattggacaaaattcaatggacaaaagaaaacttaattgtcagcttactcccgccttttactcccgggacctagcttatagcacatggttcataaaagactctataaatgattactgaatgaatgaataagtgaaagtgcacaaatgaatgtatctctgagattttaagacacttttgtgttcatgcgtcttgcctacctgtctccggtccttctgaattcataaaaagaagaaagttcattttttctggaatgactgatcttaggaaataggaataagtaattctgatgggtagaaagtgcagtgtatgaagattcagaagggtaaggccaattaatttaaacactctgagtctatgttctaacctgtaaagaaggctgataatatttgccttctctgctatggtgttcccgaattgtgctttccaagaaatataccatcacacaatatatggccgtggtgaatacagtctccaatgtccttctccccctgcaatgtgccaacagagtgatctccctaagcatacagggtggtgcagtgtaaaggcacactggtttctgtttgaattccagctttgctacttactacctccataatgtgtagcaagatacttcatcactcacctgtaaaatgatgataaaatgatacttatttctatgagaattaaatagctgatacaagtaaagagcttaaaacagtatttggcctgttttaagtgctcaatagatcctagatgttgtcattgctgttactactgctgctgctgctactactactactactacatatttgtttttggaccctacttaatcccataggttgccacaactactgtctacataatgaaatctaacccccaagtataggatactggtttctaaaaatctagttcatggctatagttctagcttcattcaccaccgttctactagcaataccagtccatctgtatttcctccaatagaccactctatttttttttttttttttgcctctgcacctttacactggatgtttattttgcctttagtcacatatccacaaagagatgttctgggctccatatgatggagttgcatacagtgctgagcttttctttcagggacatattcagaaaggatgagtttttgattgttgtcaaatttgctgttatgctgattttttttagaactgtttgggcgactaatacaaattcatccaaagcttgttaagaatacattgtaatcatcagtatttttaaaaagcgattcttcattctttaccattgtgtttcccatcccaaggatttcttcagattaaaatattaaatgggacaggcaacactttgaatgtaaaggagaaatgggaaacactaacacaatggtggcatgataggggatgaaacacagaaagttggaaccaaaggggagcaccatcgttcatatttatgtgtaaggaaaagaacagaatgtccttgggtagtttactatttcttaataattctcctcacttttaggcaagcttgccagtttttttcagtggggatcacaaatgcctatctgtctgtctgtctgtctgtctgtctatctatctatctatctatctatctatctatctatctatctatctatctacctacctacctacctatctaatctatctatcatctaatatattatgtgtgcgtgtgtgtgtgtgtgtgtgtgtgtgtgtgtgtgtgtgtgtatgtaacgatttaattgaagcaatggtaagacattacaacttcaaaaatactgttttacttcacatacactttacctctaggtttcatagcaagacaatagatgggtgtagttttagtattatttacttttatttgttaattcaaggcactatagaaatacttaatctgtttaaaccccaaacatctctttaaaatattttatgtgacgagcaaacagaacatcatgatctaataaaaatgaaaatgtttttgatgttaaatgttgaggtaaaacttttgttcagttattataaaataatgacattttgagaacctcttatttttaattttatcgtctctaaaattgagacaatcacatcttggtatcgataatttttgatgcatgatgtaatatttaaaggactttaaaaatgtaaaatgctgcataaatattattgctctgcttaacagtgtttcaaatacatttttggaaaaatagcaaagtaagagataacatgtatctaaagttctcatcccttatcaactaaatattatgaaaaccttagcttctcttgcttctccagaatgacagattagcttcagcctaccttagactaggcatatggaattggcaaacgctctccttagcaactgcaaagttcaccgcagatgcatttaacagaaatagcacagatacaattaagcaggtagaaagaaagaatgagcatgtaaaacacctacaatattccagatttcctgctcacttaattggatgattcagatacctctctttcataatgtccaggtgaaagaaatgccggttcctcttatttctctacatcaaactaaagctccacttaccagagcaaacacaagtacaatctgttatgttttggactgtctaatccattctctgtagtttcacaagaatctggtgagcttacatggcatccagagaacagggtgatgagtaaagcccttaactctacattgtctaaagaacctgatttattcaaagaggaggcagctctctcacttcttattaacagagggtagagagtttctttcccaaggccaagaggggttttagctattaatacactttctctccctccgtccctggtgtgtgtgtgtgtgtgtgtgtgtgtgtgtgtgtgtctgtttctctcactgtcaattttgagtggggtttcaaggtttaaataaggtgacaagtctagtagaaaaatctctgaaagagctatttgtagaacattaactgactagttgtgtgactttgtacaaccagcttaaggattcagttttataacagataagtttagggaaataaattgcactgcacattgccttcggtctgttgtacctcaaatagcttaggaatctgttttctcctaaaacatcttcctggaagctgggtttccgctccaccccacctcccatgtgtttatgcattcctctgctcctccccttaactgagaatcctcattagaggcctgggtaaaatgtttcattgttagagttataatatatcaataatttacattaccttaattttgtaatttcccagggcattttgaaatgttatgataacatgaaaaatgtatgactttcctcaatgaaaagttaattaacaattgcttttattcttcaatgaacagctttatggctaaattattactagttttgtttttaattagatgactaaataatgcaaaattagaccatctttgtcctgacactgaattagaccattctttggcaactcgtgtacaaactattttcatttttaaaaaaatgtatgattctgagaacaagtaaatgcaattagaattgtctttcagagggaaagtggccccaaatgatgtcaagaagccagttttatgataaagatgtctatttttatgaaataaaagtaaggagaaaaaaagaattaatacaacttcactttgagattttatttttttaattcttgagttaggctgaaggccagatttgtaattgctcgtgtatgtgctttctaaaacttgcttaaggaaaactggatggattttctaaaaggcaattaaagatttgcagttgaaaaatcatcctccctcataagtattggtgtatacagtggtttccctgcatggaggatatgctggacaatatattgagaactgcagctccaggcaaaattaaactagtgttttttagagatactaggattagcttgtttactaatttgttaaagcagctgcgtttacgaaatacataagccttaagttttaatcttagaaacaccctttcccaaatattctaacaagctcaatggtcctctgcctttgctgatatttagaacatcacgagagtctttaaaacttacagatgcctaggtcccacctgggaagtttctaatttaattggtttaggtggcaacctagtcactgggctgtttaaaagctccccaggtgactataatgcacaggaaaggttgcaagccattgaacttgtaaacaatatagcagctcccatacaaaagcccgtaaattcaaagaaaatccagccatatgaacaagaaaaaaaatgtcaacgaagcagggacttcataaacatatgtttgcaacaacacatcattgaatatgattaatttgatatatctgttttgttataaaatgtctagaaaaaaatgtaatgtaacaaaaccagcaagcaatttaaaacaaataggaaaagatgattagtagatcatatgatataatttttagataatacaggaatcggacattgaatttacgttagatttttatagacagatatacagaaaaacactcagagtagacaacaggatgttagcagtggtgctgcttaatgaaaaaatgagttatctgtacttttcttaatagttattgttgtatctttttatggtaaacatacattgtttttgtaacaggagagaaaaagtagtgttctttccttgaaccaaaaaaaaagtaggccatttaaaaattaatgaataaggaaaatacacatgaaaacttctggaataagaacaaagctgtaatcaaagaaaattaatagccttaatttttttatatttgagattaaagggaaaataagagaactaaacatttgattctgtaagaaacctttaaaaagcagtacaagaaataacttcaaaaatactatattgagaaatgctttcaaacaactaagtatgaattatctgtttacaaaattccaaaccatgaaaatagtatttaaacctctatgttcatgttctaaagcccttataatcttgattatgagacttcaaaaaaatagcatacacattgaaaactatcaaccaatctcaggaatacagacgttcaaatcttataaaacatagcagatttagccaataagagaagaagttatcatgccaaattggatttatttcaggaaaacatatatgcctactataagagaatctatttacatccttcattgtaggtaaagatcagaaggaaaaaatatacaatactttttagttatgaaaaagtattgataaatgaaaagaatctgtccctaatttaggagtagaaacaaaacttttagcaatgtaagaatagatgatagtttataagcatgaaaaatattgtctatctcaaaacaagagccaactctgtgatcaatgttgaaatattgaaggtatcctcattaaaattagaaatataactagaatgactaccaaaactgctctttttaaatgctattttgcatattctagtcagtgaaagaagccaagtaaaagaaacaggaagtataagtattggggaaaaaagtcaaattattcatattaatagatgatattgtcaacttggtactaagtaaatcaacaatgacaactattataactaatgggaaaaattagtcccaaagctcattaagaaaagaaaaaacctagaaataattaaatattaattaaatgtaatttttctaaatgctaatttctcttttaacaacctattgaaaatcaaagctatcattttccacagaagttcaaaatgtgaaattactgtgaatttatttagcatgaaatttggtgatatacaagcctttactggaaaaataacagaatatttgcatccatggacagatataattttatatttcttggtgggaatattaatattttagacatataatttactacaaattaagctaaaatctgatagaaacacataaaatttaaattggggtggcaggaagacattggatgtgacaagaattactctaaagtttatctggcagcaatatagatgaggattaatagaaaatgttgaaaaccttaaatgaaaggtcatttgcccatgtagctattagagtgtttaataaaacttctactggctgggtgcggtgtctcacgcctgtaatcccagcactttgcgaggccgaggcgggtggatcacctgaggtcaggagttcgagaccagcctaaccaacatcgtgaaacccagcctctacttaaaaatacaaaaattagccgggcatgatggcaggcgcctgtaatcccagctactcgggaggctgcggcaggagaatcgcttgatccagggaggcagaggttgcagtgagctgagatttcgccactgcactccagcctgggcaacagagcaagactctgtataaaaaaaaaaaaaaaatctactaaaagtctatacaaacagattagtgaaacaaaagagaaaatcccaaaatatgctcaagtgtatataataaaaatggaatttcaaatcagtggatagagatggactatgaaagaaatggttttgataatcatgttaaaaggcaaaaccctgctttacacaatgcagtgaattaaatttcaccttgaacaaatattcaatcataattaagcttaagaagcccaaagaacaggaagaacgataggtgaatatttctacaatgaggcgatggtagagaactatgtagaaatgattttaaaaacccaaaatttaaaatggaaaacacatagataatttttaaaatctgtacattaaaaaccagtaaactgaaattgaatcttacaaatcaattcagaaaaataaatgcattgcctaattttaagcatacaggaagaaagtgttagacctggaggtcattattttaagtgaaatgaaccagacacagaaagtcaaatattgcatgttcacccataattgtgtgctaaaaaatgtgtacacatgtacacagagagtggaatgatagacaatggaaacttagtagggtgagggggttggagtggagtggataatgagaaattaatgtgtatgatatatttgggtgagggacgctctaaaagccctaacttgaccactacacaatctatgcatgtaacaaaattacacatgtaccccatatatttggacaaaaagaaaataaaacacatccaaaggtatatgaaaaaatgttcgatctcatttgtaaccaaataatgaaaataaaaataacttttccttgtatactttgtatgcttctgacagaagactgaatcaatttatttcatgagagcagtttgcaataccaatcaagagaaagcgtgcttacacttgactaagcaattgcatttccagggaaattatcgaagaaatgcttacatctatgtgcaaagactgagttgtacctatatttattgtttaattgttattacagtgaaaaatggaaacaacaccagtattcatcagtaggaggctactaaaaaatgatatatctctaaagaagggaaatttaaaataaaattttacaggtgattgcattgatattaaaggtaatccaaatacatacatgaaaaaataaagcagactgtaatacacagtatgtatacatataatgctgtattatgatcccgcttatatatgcatatatattaaaatataaatttttaacctctgggaaatgcattcctacctaattttaagtctctcattttttcttattggaattttaaaaagtgtacaatgcttattaatgaatataaatttgtttgaatcaatgttttcaatttttaatcaaattatctgtacatgattcaagtaatttttacttcataagttcttttatttaaatatgctgcattcctctctcatttctcactcctcagaggcagatatttgagtcattctctttttctaatgcgtgacaaatctgtaataacatgtttatatctctaattcttgattttctcattttttcatggtctacagtctctcttatgagagatgaaaaattatctcatttatatctaccccatgtatttgttctattaactaatttttcttttacatgaagaccttaaatgttaatttttttcttcaaaacagtgtcaaaagtatgtcttaacccttcacatgataaaatggggattttagtggtcctccatgtttcttcacttctcctactgaatttcttctcccaaattctgtaaagtctacttttaattttatgttgagttgcattccttctgtgttctctaactatgattaggtctcgtgttttgtcaaagatttattctaaaaattgaaaacatataaacagtatgtacactattattatagcaccataaatatatttcattgcagagtctattaccgtgttgggcttatatttcctttcctatgatttccatggcaatttacctctgctactttacagaaaatttcaagattcaagttaaaatggattctctttttttttctttttttgttttttgagacagagtctcactctgtcacccaggctggagtgcagtggtgccatctcggctcactgcagcctctgcctcctggattgaagcgattcttctgcctcagcctcccaactagctgggattataggcacacaccgccacacctggctaatttttgtatttttagtagagatggggtttcaccatgttggccaggctggtctcaaactcctgacctcaggtgatccacccgcctcggcctcccaaattgctgggattacaggcatgagccactgctccagccaaaatggattatcttttcttacactcagtaatctctcaaattcaaataacgacataggaaattcctaagtctattgagtctttatctaccaaatctccctctctttcactttctctgtctctcttatgtacacgtagacacgcacacactcccttctcaaaaggtaagagaataggatggtttgtaaaggggaaacgtctctggaaacacccacactttaataatgtcttaactaatcacattgcttgggtgtttttgttattttgtagtttgcggttttgtttgttttattttctgataacctgcagagtaggaaagaagagagtccagaaacttgttgtaaagctggacttcaagttggaagaaatattggaaggaccttttaaaaagagagttgtatgatatcgaagcagcctatttccctgaccccttcccgggactcgtgacagggttgcctcatttacctagaccagttttcaactccttatgggagggagcatgcaagtgaattccaggggtttggggtacgaatgatcctgtcacccaggtactgagtatagtacccaatagtcagtttttcaacccttatccccctccctccttccccttctagtaatccctagtgtctatcgttttcacctttatgtccatgagtacccaatatatagctcccacttacaagtgagaacatgtggtatttggcgttccgttgctgcatgaattcgcctaggataatggcctccatcacagctgcatctgtgttgctacgaaggacatgatttcattctgttttatggctgcatagtattccatggggtatatttagattttctttatccagtccaccaatgatgtgtatctaggttaattccatgtctttgctattgtgaatagtgctgtgatgaacacgtgaatgcatgtgtctttatgttaaaacaattttatttattttggatatatattcagtaatgggattgctggattgaatggtagttctgtcttaaattctttgggaaatctccaaactgccttccacagtggctgaactaatttacattcccaccaacagtgtataagcattcccttttctctgcggcttcaccagcatttgttgttttttgagtttttaataatggcctttctgactggtgtgcgatggtatctcattgtggttttgatttgcatttctctgacaattaatgttattcagcattttttcatatgcttgtaggctacttgtatgtcttcttttgagaggtgtctgttcatgccctttgcctgttttttgatggcgttgtattttgcttgttcagttttttaagttccttgtaaattctagatattgaacctttgtgtgatatgtagtttgtaatgattttctcctgttccgtaggttgtctgttactctgttgatagtttcttttgctgtgcagaagctttttagtttaattaggtctcgcttgtcaattttttggttttgctccaattgcttttgaggatttagtcataaatgctttcctaaccccaatgtccagaatgatgtttcttaggttttcttctacaattcttctagtttgaggtcttacatttaaatctttaatcatcttgggttaatttttatacatgtcgaaaattagggatccagtttcattcttccacatatggctagccagtccatttattgaacagggagtcctttcccattgcttatttttgtcaactttgttgaaaatcatatggctgcaggtgtgtggctttatttctgggttctctactttgttccattggtttatgtgtctgtttttgtgccagtaccatgctgtttttgtttttgtttttgctcttatttaaatgttataaaaattgcctatatttaagatgtataatgggatgttttgatgtgcatatacgcagtgaactgattactacagttaagctaattaacatatccatctcttcacatagttattttgtgtctgtggtaagaaaacttacaatttactctcagcaaatttcaagtatacaatacagtattactgactatagtccctatgctgtgcattagatctccagaacttattcattgtatgtaactgaaacgttataccatgctgattcggttgctgtagccttatagtatagtttgaagttgggtaatgtgctgcctctggctttgttctttttccttaggattacttttgggctcctttttggttctatatgaattttagtatagcttttttccagttctgtgaaaaatgatgttagtggtttgataggaataacatttaattcgtagattgctttgggtagtatggccattttaatgatattgattcttctaatccatgagtatggaaagtttttctatttgtttgtgtcatctgtgatttattttagtagtgttctgtaagtcttctcatagagatcattcacctcttttattttttatggctattataaatgggattgcatacttgatttggtgcttagcttgaaaattactggtatgtagaaatgttactgatttttgtatattgattttgtttcctgaaactttactgaagtcagtgctatttttagatggatatatgagaatatttaacttatatggagagtcatagaaattacacaatttgtatttcatacatcatccacacacatgctttctttacttaccagaatagtggaaatgctgcataaaatgaacttaatggtttttatttcctttcttcataaatgtacagtttatcaagaagatgccctttggcttactgacgtgtaaggagggactaaaaggaaaggaaaaagaataggtagctctaacttttcctttctgtctacatcatcattttttattgcaaggtggttggccaatataaggaaggaacaccactaagaaaagatattatgtggttttttggtcattagtgtttcttagaatgtcactcacttcttcctgcatatatatatctcaaatatatatatacacgtatatacacatatatatacatatatatctcaaatatatatacatatatatctcaaatatatatatatacacatatatatttagaagattatttggtgaatacactattagaacaaaaagaaagaagtattagcgaagtgacagggtatttcccaactcagatatatgatacctgctaatggactgttcgtgattataaatgtagtatatgctcattgtagacattatgaaaaacgtaaaatcccctataattagacctctatttgtgctaggcacatgatgacttttcttgctctgcaacaactattttttttctcttaaagtttataatgttgtcagtattgtcggatatcctcagggattccatcatcttttcttaattgtggttaattacttaaccaattattacaaattattttcctataatttattgctcttagtatcaaacaattaaacaccctaggaaatgtcttattacttgatctatgaactggtgagaatctatattctacataggggcttgttttctggttttaaatctaatacagtcgtttggcaaataaagacaaaaaataaatgttgtctacctacttttcaattatccaagtagtttaaaataaaaacatccttactgattttttaaactcttatataattgcctaattctacagtaactggggttggtagtaactaaaacctgttgtattcctagtgatgcccaatgagccttgggaaatgaataggtgggtatagtccagttgctagaaaatacttgcttgttactgacttatctgagaggaaataaacactttcatttatcagggacagagtataaagtgttcctcactgaagcatttctaaaagctctacagtcctttgaatactgataaggactctgaaatgcaagggaaaatatgcaagtaatctggactatcacaggttattttatgaactgctcatatttttactcctttgataagtattatttcccccaaccccaaacccgataaattcgataacccttttcatatataatattatcagcaaggcatcttagagtttcctttaaaaaatgtaaattaccaagagaaccagaatgattttggggctcataatggtagatcttaaagagagtggaaagatcagtagttttcgcattttgctacacattggtggagtgtttacaaacagtgatatctgcgttctatttccacagagtctgacttaagtggtctgtaatccgagcatctcagtttgaaaagtttcctagataattttaatgtgtatccaacgttgaaagccagagtaaaatgaaggaagttctggggcctcagataagcaacttcactacttttttcaggttctttgaataattgacatcatccccaaattcaaatcgttgatagtcatgatgagtacctgttttactccagaaatctatataatattggttacctcagtgcttgctcttaacttccataatcaaaggaggaagagagactcatcgtgttcagatacaggttgtgtaacgtgtgtctgtaaaatactaatgtgattgacttcatccatccattcacctatccatccatgcatccatccatgtatacctcgtgtacctccattcgtctactcatccaatgtctctgtctaggctccaggactgctgccttaaggttgtttaccaactcagtaggtagtatgttatcctcaggctttggaaacaggggggtttagttaaagagcaaaccaactcaacatactagattaacttgaaagggaaaagttatgcttagtgcataaattctttccctcttgtcctttcaaatccatttttcattctttaccactgtgctttgtgtcctggggactgccctttaggaatggcatcagagttcctttgccctacagtttccagttgagacaggctgcagcaggaggagtacagtggataagaaaagggtggagtatttattttcatgtggccccatgggatttccacaggttagctctgaacagctaacattagaccagagcttctgctggacagttctctcttgcatttctattgggtctggctctctagttcaggaaacgtccttcctcttaacccttgaggtctacagttaactctccgtcatcccttcttgaatttcctaacactgagcatatctctgttgataacccctttagcaaactggcctcacataccccgagattgagaaatcaatcctccagtttctaccgggactctgattgagttaatgtgggataatttgcttacactaccctcttataaagtgactatgtacattagcatattaactcctttgaggattttcatttacttttgttattaaagcattacacgttttttgataatgtgtaggagactcaatcatagccagaagtgtctcagacgcaagcacctgtaatgattcccttatatacagttttatcccaccagaaattgggactaggcacaagtgttctaggtaacatttcaggatcctactgtcataaagattattatggcacaaaaactatttggctagaagtatccccagactcctctgtgccacattatcttcctttatccagttatctgaggatgtgcttgcagtggcagactagcttttggggaaattttatttcaagaaaaaaagcagggaggaagaaaagggtaagaaatgaggaagggaagaggcccatgggctaggagtgggctgtcctgtttctgggaaactttgtgaaggtttcaggagtagtagtaactcatggtgaatgaaaatgagagggaattgttggcttttaaagtaataggatatgcccctttatgatgggattaagagatacaagtaagctgggcgcggtggctcacgcctgtaaatcccaacactttgggaggccgaggcaggcagatcacctgaggtcaggagttcgagaccagcctgaccaaagtggaaaaagcccatctctactaaaaatacaaaattagccaggcgtggtggtgcatgcctgtaaccccagctactccggagtctgaggcaggagaatctcttgaacccaggaggcggaggttgtggtgagctgagatggcgccattgcactccagcctgggcaacaagagcaaaactccgtctccagaaaaaaaaaaaagagatacaagtaaagttatgaaatcacctgtggtttctagacagttttttttgtgtgtgtgaaatattaagaacagaatacatgtgctaaaacattttaaaagcttaataaggtcttttaaatcttgcctcttccttttgctcgtctaatattacctcctatgtccacccccacggattatttacatttaatgctttctagtgaaatcattaaaatgagatttatggattattcataataggcaggatgaaaaaggaaggtgaggcgacagtgatccttccttagctgttaatggataaggagtttcacagcaagaggaaaaaggcataacattagtattaccggttgtctaagggggagagatagaattgtttttttttccttgcattttctgtactctactcttatttccaaatattctttaatgtttgtgtgactttgtgacttctatattcagcgcaaaaaggattaaagaattaatttaggaaatcaatttacactgagtgtctccagtgccagagagggagggaaggacattcgtagctacagtgttcataatagcaaataattgtattatggtcataccatggaatattatatagcagtataaataattaactatgatcacatgtaagaatatgagaaaatcataaaaacataatgtagaggtccacaaacattttcttaaagggccagatagtacatatttcaggcttctaggtcatattgcaaatacctaactatgttgttgtggcatcaaagcagccatagttattatatgagtgaataggtgtgagtgagtctaataaaacttcatttttaaaaactgtcagggaggccgggcgcggtggctcacgcctgtaatcccagcactttgggaggccgagatgggcggatcatgaggtcagcagatcgagaccatcctggctaacacggtgaaaccccgtctctactaaaaatacaagaaattagcggggcgtggtggcgggcgcctgtagtcccagctactcgggaggctgaggcaggagaatggcgtgaacccgggaggcggagcttgcagtgagccgagatcgcgccactgcgctccagcctggggaagtgcactcactccagagccggggagcccatgggcggtagtgtgctgacccttgtattagacaacactccagaaagctcaagcataggaacacctaatgaaaatattgttttggcatacatgcatgtgtgataaatcgaaaaaaccaacacaaaacaaatgagcaaacaaaagaaatcaaaggcaatgatatgacaatccccagattctggatggtagttaatcctgggtaaatggagggaggggtacaaaagagtgaagaactagtgtaggagcacataggttcaggtgtgagttgttgctaatatttcagttattgggatggacatatgtttgttttattattgagctttgtaatttacatatccattacatatattcttttatgcatcaaatatcacattacacaaagggaaatcataaaaattggggaaaaattggaggcaagcatagatcttggggcccagtgtagcatgcttttttctatttttaaatttaaaattgtttttagagatgcggtatttctctgtcacccaggcttgaacccctaggttcaagcaatcctcctgaatagctgggattacaggtgggtgccacttcacctggctaactaaaacaaaattcttttaaagatatggtctctctttgttgcccaggctgatctctaactcctggcctcaggtaaccctcccacctcagcctcccagggggattataggcacaagtcagtgtgcctcacttccttcaacattcttaaatacatcttggaagcacagtgtttattaccttgtttctaaaagagatgcatctattgtaatcatatttataatgttcttatatatggttttcattagttttactgaaactctcaacctattgttttttgatgatgactaccaatattcattgattcactgataatctttgtaatgtccttaactcttagggattagatgacattaaatctttatcaagaagtggattttgttacttaagtattttagtagcaacaaaattggtcacaacgacattccactgaagcagaatagtcagaaagcaatccaagccgcagaaataaattaggttgagcaagactacacctaatggcattgagataaagaccctactcctgactcactgccccgtgttctagtggtgtgcctgctctgcaattctccttaagttgatgtgcatctatctctttaggaccagggggtatttagtctgtaatggcttttccggcaacgtgtctcatttcagctgcttcagttgtcgagataacactctcgtcactgcctctctgatggtttcccattcaacagcagtcatttcatcttgggacacttttcctcacagtcaacagtttttcctttgtgtaattaagtctcatttttttctggatagatccatttgtgccagaactcttctgctgccttgaagcctgcaccattcagttatttttagtgttatctctttcctttcattagcacagagctaaattgtgcatattttgttctttcagctttatacagattaagatcttctagctccttagtcattcattttagctgttgcattgaatttcctacagttcatttaaatcacccagttcagtttaatatgcccagaataaataaagcatcattttttttcacatctaatcacctaccccgaccaatggcaagtgtaaggattataaacctttgtgactttgcctgtttactcccttagtaggtgagctctgagccaaaatataaattcattaaagtttttcttaatatctctagtctctacttctggctcccttccctcagggtattatcccctttacaaatatttttttgtgtctttaggtttccatttgttttttaaaaatacattcttatcaaaacgggaaaatattttcccatttctttcataaaccatgttttctcaatagttatctctaatcaaatacaagaaacagggaaataggtagtgccttacaaaggaattttagccatatacgtttggataaggtgaattttccatatcctggagatggttttgagtactcaggaggctacatctgaaaaaaaatatatagttattctctatctgggagtcaacttaattcttttgatggaaaaatagaggctgtgaatccccagctccagctggcagagatcactttgctcagaagttttgcacgtaaaaagaaacttcttttctgggatcactgatttatttcagctgtaccctgaaactggtagtcagatacaccctgtaaccagcagatctgatattctccagccttttcgggcttgtacatcaatcgtttaaactacactataatggggatcatttgccaaagctcattgccattctcttctagtcataccaatttataattacttttctctcaatatgtacccacgactctcctttcttcacccttatgatatttattcaaatattaaatgttgccctttttttctacctttattccaaatgccttagaggtctggcgtaaactatatggctataacctattgcatttttaccccatagatggaaaatgtattggtgaattgtttataaggttggaagttcccctgaaaataaaatccacccaccccactaggggagtacggaaactatatataatatgacacacatcgctattacttttattacatatgcttattatttattgttcaaattttcaaatatggtcctgcacacaggcaattttcacaaaagagcagtatcagtgttaatcagtttgaaacaggaaaggatttgtgaccccaccttacaaaatacaattccttatggttacaaaatctcattcaaatggattctattgtagccatatcaataaggaaactgatctatcagccaaaatcggaaatagccctgataaagtagactgagcttacattcatgcacagatgtttgctcattatttttacttgataaggacagatacgtttgtgtttagcataatgcgtgtgtgtatatttgaatagattttctagaccctcattttagttctagtaacaattgtctggttctgaatagggactttccactttacagaagcaggcaaaatttaatttgtcatagctaccactgaacccatttcctttatatactcaatctgctttgacacagtagatattggagtttcaaaccttaaaatgaaatacagctttatgatgaaatataagttgatatgaatactttcaatatacctatattctatgttacactcagttagctggcatttggtcttcactcatggacattttaaaaactcatacattctttagtgtttgataatgtgacaaatcaaccccctataaaattaactttaaatcaattgatacgttagcatgtgagtatatgtgtgtgactatgaatacatacttatataagcacacttatatgcttatacgtttgtttgaatctctcactgaccttagccataaaaacacttttattctgttgatttatacctcagcctacatgtgaacaaaagattcagcaaatcagaataacacagttactctattttctaatttatttgtaataaatatgcattacctgcataacgtttacatcaatatgggcatacattacttatgcaatgtaatgatctaaataacgcaactatcgacagtaaccacgcactctccccctagcaattacagaatacagtttctctgttgcacaacatgcctgactatcgtaaatttagggttatctccttattaggattccatttacactcttaatgaatcatatttattttatagcagcttattagtaaagttgactgccaagatataggcaatacatacaatttcctcaaaaactggggctttcactgttaatttaacaaacctatatgaatccatataatatatgaatcatatgaatatatataatatgtaataagataaaatgcataatttaacatatatgaaatatatatagtattaattgttaatatgtattaatatagtataaaataatatatataataaatgtataatatataatatatgaatcatataatagaaaaatatatgcatagacttgagttaggtgtaaagaatggaaaaattaaaaaatagtgcacttgatgagttcacaacctagtatagtgtgtcatagagaatgtagcattttgtgtatgcaatagtaaatatatataatgcaaaagaaatgaatggttttgcttagggtaggaggaatggggtaatatttgagataaatctcaaagcatgtaaagatttatcaaatgaagaattggggttatggaggagtaggggttgcattccaggagggagggaccaacatgtacaaaagcttaaaggaatgtaatttcatagtatctgggaaggacaatgggtagctatatgtttctgaaatcttgaatgcttgggtgaaataccaaaaatagggctagaaaagcaggttatgattagattgtgaaggcatttaaaagcgtcttgattagttgggaaataatttctacaacgttttagttgtataaataacaaaagcttcttttaatccagatacttagtggaagttcctctttctctaagtagaatactagacctaataataataataataataccgtatcatatatttttattacttttttggttttctgactactttcaagtacagagatggtccccgacatacagtagttcaacttaacaatttttcgactttaggatggtgcgaaagtgatactcatgctgtggaaaccatactttgaggacctatacaactattctggttttgactttcagtatagtatttaataaattacatgaaatattcaacattttattataaaataggctttgtgttttatgatttttttcccaactgtaggctaacgtaagtgttctaagcatgtttaagataggctaggctaacctatgatgtacagtctgttaggtgtatcaaatgcattttcaagtttcaaaatttccaaactatgatgggtatatcagcatgtaacttcattgtaagttgaaatgcccatcaaagatagactggataaagaaaatgtggcacatatacaccatggaatactgtgcagccataaaaaattatgagtttatgtcctttgcagggacatggatgaagctggaaaccatcattctcagcaaactaaaacaggaacagaaaaccaaataccacatgttctgtcttataagtgggagttgaacaacaagaacacatggacacagggaagggaacatcacacacctgggcctgtcagggggtggggggcaaagggagggatagcattaggagaaatacctaatgtagatgacgggttgatgggtgcagcagtccaccatagcacgtgcatacctatgtaacaaacctgcacgttctgcacatgtatcccagaacttaaaatataataataatataaaagaaaagtatctgtgcttgatgggttttgatatcctcagtaactatggccaattagttgaacatggcacagtattatccatttgcagtagaggaaacaaaggagaaaccagaggaacagtgagagagagagagagagagaaagctgctggtcatgtcctctttccagcatgtcaccctccatattcttcttcaaatcaaaaaacgtagaacggaagggagcttagtagcattcagctctgctacactgcacaccagctatacacacaggcaatcaatatggtttggacacagctgatataatttggtggagctctaattgaatttttccccttcttaatataattacacctacagaacgtctccaattaagtgtccccccatcagtctcaaaattaaatataccaaatggaactcattatctactcccacataaaccagctcttcatgactctttcccctttctattaagcaccactgcttccaggctcctatatctgaaatccctgaagtcgcttatttttgtattcctttctccatcccgaaatccattcagtcactgaatgctattgactaatgtttgaaattatatctatgcataccttcctttacgttatgggtaaatgtttttggaatgtgtttaaacagaacaaggaattggtgaacaaaagaataaagccatgcataaacaaatgtttattcaccgttttcattatatttgtttgtagtactgcaacctaaagtttgtaatgtctgagaatatctgattgtaagcaattaccccaaccccatgtaagttaacagtgttataactggtacgtctccttataggtgaatttgttcaaagttgcttaattatattttaaaaatctcttattttagaaagaactctcaattgctttactctgaataagataatactgtttagaagacaaatcattgcaagttttacatctgtaagtaggttacctgatgaaacggattgaaaaactgaaggcaaatattgaatgttagattattcccaggtatctgacttcatcttcttacttgctaggtgtcattgttaatgataatttaaaaaatcacacatacctacgtatccacatatacaaaacagtaagcagtcatgctattgaattcacaaatatacaccaaaagacaaggggaaaaatataaacaacagctttcttactagcaagcagagtgtggcgtgaggtcaaatttttatgacgaagagcatacatattcacaaagtaatttatctcaacttatgtagctggaaatggagttgatgggttctgaaaaaagcttctagatgacattaaaaaaaggggttcttatgacaaagaaaaaaattacctcaaagtagctttcaaagagatcgaataaagtcatttcatgaaatgcgagactaaaaaacatgccagcatttctaatatttctaatgttttatatgatataaatatgaaatataaaaatatttaatatttttatcatagaaaattaatggcatcaatttcttatcaaaatcatgcatacaattgattatatatatttgctaaagtcctaaaattttgtgtatacatgttggcctaaaatatttttgagggctcacaggcatattttcttttgggaaaatggaaactgcctaatacatgagatgatttatatacatgctgcattttacaagcggttagggaaacacatgtctattttttttctaaatcaaataatccgtgtgtgcaccatgctaccttgaatatcagattatcagatttaccatccctattagggatataaatgttccagaagaacataagagcaaatttttagaaagattaatacagaatctaaagattgaagggataagatgatttacattaaatctgtttccaggatatcctagttgggaaatcaacctaaatacccgaaaacttaaataatccaagacagtatgcatttgcttaacagactttttctccatcatttgtctgtgtttagtaagataaaagaaagacttgcggccgggcgtccgaggcagcgggtcacctgaggccgggagttcaagaccagcctgaccaacatggagaaacatcatctccactaaaaggcggaggttgtggtgagctgagatctggccatcatactccagcctgggcaacaagagtgaaattccatcaaaaaaaaaaaaaaaaaaaaaaaagaaagaaagaaggaaacttgctacccctcagtaaacaagttatatttccttcataactttcttcctataaggcaataaacaaatatttattaagaacctatcatgtgccaagtaaataagtactctgtcaaaacaagttagattcagagtgggctggaatgatttggacagaagggaatgtgagaaaggctagataagatggaaacttttctgccacaggcataccttcccagtagacgaagtagagatacaaataatgtagcgaagggtactatggaataaaaaagtcaataaatttatttatttagtgattacagctacgatttgctaagcaattaatatatgtcagacattaagccaagacctctgcagatgatgccatgtttagatcttataacaacctagtaaatgtgttaggatgatcaaatccattttattttatttaaattaaatagttaattttaatggatagaaaaaattgtttatctttatttcattcaacatgttgttttgaatatatatatatgaatggctcagtcaagctaattaacatatttattacctcacatgcttatttttttgtaggaagaacactttttttttttttttttggagatggagtcttgctccgtctcccaggcaggagtgcagtggcttgatctcggttcactgcaacttctgcctcacaggttcaagcgattctcctgcctcagcctcctgagtagctgggactacagcctcacgccgccacatcctgctaattttttgtgtgttttagtagagacggggtttcactatgttgcccaggctggtcaggaactcctgagctcaggcaatccgcccgcttccgcctcccaaagtactgggattacaggcgtgagccactgcacccagccaagtgaaaaacacttaaaatctactctcttagcaattttcaagagtataatacattgttatgaaccacctgtagaatcaacatgtacaatagatctctcgaacttatttctcctgtctaaatgaaattttgtattctttgatcaatatctctgcaagcctcacaccctcctcccagtctctggtaaccactattctactctctacttctatgagcccaactttttagataccacctataataagcgagatcatatgttatttggctttctgtgcctggcttattgcacttagcaaaacttcctccaggattatccatgttgtcacaaatggtagattttcttctttcatgtctgaattatattccattgtgtgtgtgtgtgaccacattttcattatccattcatttgttgatggacatttaggttgaatccataccttggctattgtgaacaatgctgcaatgaacacgggagtgcacatatcttttcaatataatgatttcatttctttgggatacatactcagtaatgggattgctggatccatactcaatttaaagatatagaaaacaagccataaatatttatgtcccccaatatccaaaagttaatcaatggccaaatcagcttaatttgtctgttttgtttttactatcaaacttaatacattcaccaatgctctttttcatagttgtagccttttcttgaagattataacgtttagtagtttagattgttatgtagacatgtggtgattaaagtaactcctgcaattaatttaactaattttagttatcatgtactacacttttacatactatttccctcaaaaatgttaaaaagcctttcttaaagcctttttagcagtgccttttatatttattcgtgttactgtttcatcaattgctttagtttggtgacagtttcatgtagttcatttactggattcaagttacagtccagttacttgaggggcccaaaagttaaggacttctgaaagtgcgtgaattgcttctactcactgatgcatcccaaacattcagatcttgttacctgaatcaggggttctattctttaaagttccttggaggatactatcagaatgaaaagactcaaaatagaagtcttccggaatacaatgttgtggttttaaacttaaaagtattgccagtacaacgttagtatctactgaggtggtcacactcattccagcaggtcacatactgagaactgcataggctttgtatggtaggccaaaataactttcagattgagtccatcaattatttttctaaaaaaaaaaaaaaaaaaaaaaaaaaaaacccagagtttttgaaaaacctacttagtcatttggaaaaatactatgacattgaaaatcatattcctggaatccctaaacattattaccaaaaccatcggccacagagctgtcttctactttttccccaaccccactaattccgagtgtatctgttcttaatattcaggttatacttaatattccatcttaatattttattttaaacacgttttatgctaaaaatttacacatatatttataatgttctttctttggggatatgaggattctactgctgacctactgctgaagtactaaaaaatagtacttcagtgtgtacagtaatagggttgagcaatttattcatgtcccagccaatttccaagtatccacacacatttcattggcaaagtattcatatccactcatcagagtttgtaatgtaaactgtttctaaagaatattttctcactctttcagaggagaaaatcagtgtattttaaaacataaagctaataaattccatcacacagaaattaacttcaatagggctgtggtttgaaatatgttgtaatccactgaaggaactcaggtaaaactagtaggttagctaatatttattttttatttttatctttaagggacaagatctctctctggcacccaggctgaagtgcagtggcatgatcatagctcactctaaccttgaattcctgggctcagatgattctcccacctgcacctcctgagtagctgggacaagtgcacaccacgccctgctaattttctttttatttttcgtggagacagggtcttgctatgtttcccaagctggtctagaactcctggcctcaagcaatcctcccgcctcagcctcccaaagtgctgggattacaagtgtgatccatcatgcctggtctagctaacatttttcttttttcttatttcataaaattgagactcactttgcatccatagacttatggaaacattttgaatccagatgccgtagccatttttttgtttgttttggtttgtttttcaatatcaatagaatcttttgtaagcaaaagaaagcaaggacttctttaataatttctgatttttatcgtggcatttcctcactctcctcatgccagcatagtccaaagttgctatttgctcaacattattcaggtacttaaatgtttaaacttgatagtttttaatgcatctataaatttaaacataattctggaaagcttcattttctataattaaaagtgataatctatcttattttaaatgtatttctgtcttgggtatcttttcctaattaaaatttaaactcttattttacaatgagacgttacctcatttatttttcattaaacaaataaaaccagacaatccctgaaaaacctatgaagaattatctttttaaaaatataacaaatccatgtgatgaaaactatctttttacatcaccactacacagaaagtttttcatttttttatgtaatcactattaataaaatcatccatgtaggacaataggcaattatcgttaacacctatagcaaagcatagataaagttgattttttgtttttgtttttgttttttttttaagatctcacttctgttgcccaggctggagtgaagtggtgcgatcttggctcactgcaacctctggctcccggggttaagcgattctcccacctcagcctaccgagtagctgggattacaggggtgtgccaccacacccatctaatttttgtatttttagtagagatggggtttcgctataatggccaggctggtctcgaactcctggcctcaagtgatccccctgccttggcctcccaaagtattgagattacaggtgtgagccactgcgccccaccctgacaaagatgattttactttatcttaacctcatcctcataatggggtttgataattacatttcatattttgatcacttaaaattatttttgttagtagcattagtattttgtacatgaggaaaaggtgctatgtaaccatcaaagtacagttctctttctaacggtaaaagtggttgtgcaaaatgtagcagttaatgtctataaataggagacatagaattctatgtttctctcaagaagaatttctgttaaaatataggaaaaatatatcaattcatatttggtatttatgtagattatgttatagtactcctattttacttttgtaatttaataagggaaaactttttaaaatattcattcagtgagtaactttattgagactctacaatacagtgtaagatttatataccaatactacaaccattttactgacagaaaaataaaaatctagaacagtttcagaaatgctgcctttttatgctgttctccccaaagcaggggtccccaaagcaggggtccccaaaccctgggccccagaccaatcggtccgtgacctgttagaaaccagggggaacagcaggaagtgagccccgggcaagcctgagctctgcctcctgtcagataagcagcagcattacattctcataggagcgagaaccctattgtgacctgcgcatgcgagggatctaggttgtgtgctccttatgagaatttaatgataaatgttgtaatgtgcttgaatcattcccaaaccatctccccagcccaagtctgtgaaaaaattgtcttccacgaaaccagtccctggtgctaaaaaggttggggaccacttccctaaagcttagggggtaggtctaaatattttctcaagactcctctaagtaaacacataaaagcataattttaatgaaagcacttgtatattactgcaaatgtgatacctgaacttttgtttgcttgctttcttgtttgttagcttttgagaatacaattgtttttattacttagagagtatacattgaaggaaattataagaattttcatacttgaaagggacaaaagaatatgcaataggaaacagtaaaaaaaaaaaaaaatcatgtcagggctttcaaacctatctgcagaattcctttcaagtttcagtcctttgggggagccttttagctctctgcaccctctccttctgcttatgtgtaagccttggtgatgcatttaccaaacccttcatatctgtaatcatgaggtagcttttctccttcattgtaaatttagggatagtagaaactgccttatttaacattgtatctcttatataaccttacatgtaccatacatacatagagtctatgggataaataaacgtttatacaaattaaacatgagatggatgaagagataaacggatggatggatgaatggatggatgggtgcatggataaataaataaatggttggatgaatatgcttataattatttctatgtaaaatatttttagtgttaatgacccccaaagtgctcttaaagctccaattacctagttaattgcacatagtacaaaattcatagaggtaaacaaaaaagaacgcataaagaaaattgtttctcctattatgttagctagcctcctagttatcctccttctctcttactgggggtgctggcattgcggttttctgtgtattctttcagatatctgctgtacatacatgcgcatagtcatacacatggccacgtatatcagttcaaatctgtcaggaaggtatgagaacatcaatttcctcataccataaaaaacgcagtatactaccaaacttttgatctttgccaatatgattggtgaaaaactatgaaactatgtcttttagtttgcacttatctactcaggaatgaggatgaacatattttcaaatatttaagagcaatttttgttactttttctctgaattctgttcgttttctttgcaagttataatattccttccaaaattgttttataaccagttgacagatgggaaccagtctctaggtggtatcagaaacagtgttatccagcatattcaaacctaccaacttattcgatttatcactatagctaattgtttgagtagttcatacatttatttacactatcaagaaaaacagtttcaacattcttgaccatatttaaaaatgccttttaggctacaaaggtagattgaagagagaagttccaaacagtaatgaaggcctctattccatcccagggaatttgcaaaggctctttcctggacaaacttgtgctattattttgcatgatggaataattttcatccttcaaatctgtttaattgcacatccaaaaaaacaccttctttgactatgaaatccagactagttctctctccttccctggactctctattttaggtactttctatctgaacatcttgtttatttcttcaataacacttattatattgggtgattatgttattttgtcatttatttgctattccctacaatagattggaagttccatgagagtagtttccttgcatgtcttgtttactgttttatcttcactgcttgatccatagtgtggcatgaagtaaacattcaacaaatatgtgcggaaggaataaatgaacatacacatctaatttctggtgtgtttatcaaaaattcaattgtatacttctggtagactgaatttaattcaattgagtttttcccatgtgtgataagaaggatagggaaagggacagatggaggatgagagggtaggagagaagaagagagaaagagatgggagggaggagaatgtagactctccaaggagcctaggctttttactgcatttatttattcacaatttactgcaaatgaatttcacagacacagaaactgcaagcttagacaccatcattgctctgagacaaatgcatccagagtgtatttgaagttcagatataattgatagataaatgtaaagctgggagaaatttattaaaaatgattggtaactcataactttcaaggaagtgaattgtttaaaaaatgtacataatacttgggttagatactgtgtttcttagttaaaatataataatatatgtatttcaatagatcatatatgccaggagacacctgggcgtattgactattacataatagtgattatctttatccatctagtgtttgattgaggacggaggttgatgtatcaaattaaattaattgagatctaagaatgacatcaataaacaaaatgttaagtttcaatcttcctttttgcatatgtactgctttaatctttcggctattgatcaccagttatgtttgcaaagatcacatttaggctttcctttacagagagatttaacttaccctttaaaccatgagtcagtgcttttagttttggggatttagtttccttaaagccctctgagggaaagaagggtatatatagttatatatctccagagaaattgaatatcaaagtctatataacatgtaatttatcaatgattattaactcctgcacttgcctgtgactgcctgtatttggtgatgaagaaaatatagaaaagtagatgattagaatagggaacctaggaaataggaattggaatgtagataatctacagaacaaatggtatcttcttttatttcaattgtcatttgaaaaactttctttgaagagtaaataaaatataacaaatcgggactgaattcagtagaatagactgaatactactaaaacataaaaaataaaagagctaaaaggtaactttaaggtgtagctttatgttcttacatttatggcatgagtgcaaggaaaggctcaacagttacatgcatccatttactttatagttgaatagtaaaaaataatgcagtgaaaagtaatacttcctagggatgttcttagacatgcaacctgatcaaaaaagtataaaacaggttggatagtatctctggaatctcccattaataccaacaatgccttttcatcaaccaacactatttgccatagtcttctcaattctatctggacttcctgattttgatcttttcaagccaatccttttacacactgctctcagacttagtcatctaaagggtctttgatgatctccattgtcttaagttagaagtcctaagcctggcctacaaggttctctattttttgtcattttcctattttgacttatttcctccactctttgactgtcctacttaaactttaaggcagtctccttagacctggaatgctgtttcccactttctcaacctaccaagcttttgaacgtcctttgggacccagacaaaatctgatctttgccgtgatacatttcattaattctctgaggtggaattagtctccctttcctttgattcttctgtagcacctgtaagaacctgtacaatagcaggtatcatattgcatggtaattattttccaaatgtccttctcctcattccaattatgtgtacttcaagggccaggacattgaatcattgtgtgtatcctatgctggaaatatattaagcttccatagagttctcatgtaaattattgtgaaacatttttaatgctatgaagaaagcattttaaatctgtttaagaatacatgttgaccgggtgcagtggctcatgcctgtaatgccagcactttgggaggccaaggcaggcagatcgcttgagcccaggagttcgagaccagcctggacaacatggtgaaacctcatctctgcaaaacccacaaaaattagctgtgtgtggtggtgggcacctgtaattccagctacttgggaggctgaggtgggaggtttcacttgaggcgggaggcagaggttgcagtgaactgagatcacaccactgcaccatctgggcgacagagtgcgaccttgtcacacacacgaaaaaataatacatgttgaaactttgggaaggttttgaagcaagttttgattaaataggacttagatttcaggagtcagttttatcttcaatgcactcaaatttttcagataataaaattatttaatatacagtcatactaataatatagacccttgcaatagataagttggtgtgtatgcgtatgtccaacagaggattcctacagtcacatatattttagccataaaataggaaatctaaataagcacctttgtcttagacttcagcacaataggtcgaaccttcatttgaatgtgactagggactgccaagtccctactgcctatctctaccaaaggctgatctggaagtgaacccttttctttctttttttttttttttctagcagatgaatgttattgagtttatctgtggtctagtgatgatacctgcagagcagcttcatttttcagagtcattcagaaagctatcataagcttcttccttcttgtcaggcagagcaaatcctggcatgacaggatgtactgggagtctccgatagtgggaactgacaaagatgtgccttcagcactcccacaaagccatattgtctttctggaaatgaggaggatttattcagcaaatctaagtgtaaactaggagacccatcagataaaatccatacaacaaagatcaccaaccattttttcttcttctgaatagagccagaagatgcaatttaccttcttctctttttttccccagaagtgacaatatagagttagagagaaattatagagcggagattttgaaattcagtttcctccccaactaccagttgaaaaagcatagccttaggaaatgttctcatttgatttcctatgttttataacatgttatgtttgtgaatttgtgtgtgatgtgtggtggtggtggttccaaaatatctaagatatatagtaaatgagcaaacaaaaatagtttgtagcttttgatatatcatagttgtacatattttcgtgttacatgttgtattagttcatttttacacagctataaagaactacctgagactgggtgatttataaagaaaagaggtttaattgactcaaagttccacatgactggggaggcctcaggacgctgacaatcttggcagaaggtgaaggggaggcaaggcacatcttacatggtggcaggagctgggggatgtgggggggggggaagtgccacacttttaaaccatcagatctcgtgagaactcactcactatcacaagaaaagtctgagggaaatctgctcccatgatccagtcatctcccaccaggtccctcccctgacacaaggagattactatttggcattagatttgggtggggacacagagccaaagtatatcacatgtaatattttaatcatgtatatactgtataaatgatcaaatcagagtaattgggatatccatcatctcaatccttcctttctttgtgatgggatcattataattattctcttctagctattttgaaatatacaatgaattattgtttattatactaccatatactagaaaaaatgctctttaaacctcatcagaacacttgctaaattgtctttctatatgcttatgacaacagtaaaaaacaaagatcacatgtccaatattactgggctgtgcttggaaaaaaatattttactcttttttaaactttagccaattatatcttcaatagatatcaacactaatatcacatctttaaaaagtttctatgggttttagtaaggtatataaaaccatcaaatatattatccagagagacaatatattgacatttaaaatatgttcttactcatttatggtatcacctactgtcagaggtaaagtaaatttaatgatgtctaaagggattacagttgcttaaattggctagagttttatatgatttatattttcattcttttctggacattggaatcaagtagtaaattttgaaattttatattatatttttacttatcctgtttacagtatcacacctgactcaatttagagtagaaaatatttctagttacccttcgtcagaatataaacatcttttcaaattcatttcagcattttaattgtgttaatagaaatagttcaaaaatatagcataaacctcagcatgttctattttggagagaaggaggacaatgattgttgactctgatggatagtttcccaatgtgaaaagagtaaatttttcttcataataatattttatttcatttcatatggtactctaaaataggcaaaatatacctttacctctcttctgaatactagaagtagaagtaaatgattttattattgacattattaattatactatatttatgttgatatgatgccttacagttcatcaatcattttcatatattttaattcatttggccctaatagctgtgaccacctcccagaatagcccagtcaaaagaggttgaaaagaaaaatcatacaaaatacccatgaagtttaagaatttatggcacttgaaatatttgcccttagacaatgttcttagtatttctgagcctcagtttttaatacatgaataagaatactttaagtattattcttccacataatgggaataagaatacttactccatgaaatgagaataagaagacttactttatgtagctactgagggagtcaagtgaggaacaattactaatgccatgacacagtgtagatgctcaatactcatcattcagtttccccttttgaacttaaggccagaaagaagtgacttcagtggtggtactaaggagagagggggtgatttagccttcgcttaacattcatcagacctcacaccaagccacaggaagcaaatatacaatctctgaaaatagggaaacctacattcaagacaaatcctgtgtgtacctcctccccttcctctcccagaaaagatggctatgtctgaatcacaaaatgtaagcggtcgcctaaaaattcagaaatcaggataaattatattttacctcattttaacaattaaaatcaatgcaaaataattcatatgagcaaaatattaaaattttaagagaatacaagatgtaatcttgcattcgtgccactcatgttctctggcctcatccttatctccacttaaccaccaactgaaggactagaaagttggcaatgacataaagcacagcttcctcatgccatcttcccatgtccccccaactttgggatagtaaacattgcctgaatttataatcctgtaatatttttaaatgttttatcagatacatatgtttcaacaatatttgttccagtttagtgtagcaggtaagactgtgggtttcagagcatttccacctggatttgaattctgtctacactaattactggatatctgaccttgggaatgttactgaagttctctgagcctcagttttctcatccaaaaaaaaaatggggacaataatagtaaatatgtcatagggctattgtgaacatatgtgagaacattaaaaatatttactgtatgacacaaaatgttttagtttgtttttatatttaaatgttattaaaaagatatttgggactcatattttcctcatgcatcatcccatccctagaatttatcttgattgttttgtgtagcagtcgtttctttgactactatgtaatcaggttaactgtccattttcctgccagagggcatttgggctgctcgaagatttttcgtttattgtgttattttgggcagtgctgctaggaacattctcctcatgtttccttttgcaaatgcctctctgtttttgatgttgcagatggattttaccttgccatggcatgaaatccaaaggctgtacccacagattccgatatttatctcttgcttgtccacacctagtaataaactttagccaaagcaaactgttgcttgttactatgagcctaaagtcgctgtgctggtccctcctgaatccttttctatgagtcgcttagtactcttgctctcaagctctggtctgtaccgagctgacagctttttttatttctaggactttattgctgttttaaagtctttccactctgaatctgtacctattcaccccagagttagttgcatttctctgtgtctctaacctgagggtcatgagtctgactttgctcagtgaaggcaaatattttcttcctctgcagtctgtgttcattttgataatgatgcttgatggggggactaagcatccccctgagaggaaagaatctcgtttggattgtaatttgtcacagtttgtcttagtttggatttctttaaaagctaagcctgaggcgaggactagagagcaactagctcatttggtagctgatcacagggagcacaagtgggaggcaggggaagtaaggaaaaacgggggaaaacaatagtgagtgtattattcagctggctactgcagtgggaaactgttgttcaatcctgtgaagacccctctgaggaatgctgtagaatgtactcataattgtccctctgaagaataagaggctggggaatatgtctctggttcctgtgcctcattaattatttctcagggacatcaggtcccctcctgtgtgttggatgagtgagtttctataactttggacaaagtcgtgaggctgaaacacagagaagcagtgggtgcttgacctggtgggctgttagcatgcccgagactctccattacagggctgatcaagccagaggtaaaccaacagagtgggcagtgtctgctacacagttccaactggatttcccaattacctagtgctatggtcttctttgacaacgtgtctcaagaaggtaacctgtagctctagcccactgctactgaatgtttcatacctggtatcatgtggattataactgtagtatttcatttttcaggtattgtagtatcgaaaagccctatagcctgttttccttagtataaattttgattaaattatgcaagtccactttaaattcacagtttgatgttatgtacttaggaggcactcaataaatagttcttaaagcaataatttttaaatgactttttgtattatgtagacacatattaactataatagagcccttcggcaggaaaactgtttcttcaaagttgcaaagtgactgacaacgatatatataactagaagcttcaagaaaaatgttaccaggggccacttttaaactagggggaaaatcgtttttcacaataagctatcccatctcctccctactgaagcctctgatctgctatgattattaaaccctcatcttttagtgcaagaaacccagcaagctgaaagggaaatgcttttcagatttaaaaaacaaaaacaaaaacaaaaataaacttaatttcttttaggttgatgttgttatactaacttgccaatcagttaaacatgtatctgtcttttaaaaatatcttattacataagaacaaaagattttaagacatacagtttcaatcataaccaaatgtgtttattacttcgaattttccacagtaacttgaagccatctatgtacccatctccaattccatcgcttccccactaccaccagagataacggtggtcgtgaaatttgctttgttttatagtcttgctacatatatatgtattactaaaagagaaatagtcttgctctgcatgcttttgaacttcgtatagttggaatcatattgcatttattcttctgtgactgtttctttcaatcagcattatgttgctaagattcatccatgtctgtgactgcagcattatgtcatattccgtcatagaaataacccacaatttatttatgcatactactgttgatggatactagggtcgtttccagttttaattcttttcctattacaaacaaggttccttgtatacatgtaggagtgggattgctgggtcacagggcccatgtatgtgccctctggtatactctttggctcctttacactgctctactgtgtaccactgggagactgacctttgtagactgtgtgtgccaggcttccatttccaggtgacttccagctctctttggctgatggtgaaggattggaaactcagggaagacacaagagtgcttctcttcctctctttgtgtttcaggcagtatctttggcaacagctgcatatgctttgatgtcccccctccaaccagataggcccactatagctgcagcttccaatgaatgatctcataacctcattcactgaattcatgcaccctgccttcttctttcctcctcctccccattccttctcctcttcctcctccccatcctcctccttctctctctctctctctctctctctctccccttctctcccactcttcttctctcctctcccttcctctccctgtactttaagggtaatagtggcttcctgtggttgctaaactctgagtcactttgtcctccacagcttgtcaactctgttcttctctcatttgtttcaattctataatttaagctttctgatttaaatatcaaatgactttttgtgtctgcttagattctgactgacatgatgtatttctaagtttccaagattatgccaaattatttttaaaattggttacaccaatttaaattctcacgaacttaaaaattctgcttgctcccaaattctaacacttgacaatgtcaaacttaacttttggctactctgttgagtataaaattgtttctagctgtggatttactttgaattgcattaatgaaaaatgagtttgggcattttttcatggttccattggcaagttttaaatgcagacaattgtttagaatacattatttttatttaataaaactcattattaaatgtatattcctttaaggctgtactttgatttagtgtaagtagtacacaatttacctcagttttccgttttatgtattcactcatttaatttagcagatatgaattaagttctacaatatactatacagagtttaatgtgaaagtaagaaatcagaacatgttatggctaggataacttgggagcacagccttttgaaactggtttagtgttaggatacacatttttgtgtttacctctctttcccaccgccagtttcaccatcattcataagatcaatgactgtggtacattacaaatataatgtgaaattgtttacaagatttagtattgttcaatcattttgcaggcactatcatggaccttcagtgtcaataaaggattcagaggttccagaaaattctaggctatatcatgccttgagaagtcctatctaataaatatatagaccacttttagagtgtaaaggaattcgtaaaatgtgtcagcttaaaatattgaaatagcgagggtgacttttcctttccaaactgttgatgaagactgcagacagggataaacattagctctgtgtggacaggatagtgtctgttgtctgagattctggtcatactggtttaatacccataattgaaagagctctaagacatggctttgtggagaaagaaagatactacttgagagaaagcaagttcatatttccttttactaataagtgttcagattcctaaaatactgtaacagtaaaaagatattttgaaactttctaagaaagtgtgttctagggcggggcgcggtggctcactcctgtaatcccagcactttggggggccgaggcaggcggatcacgaggtcaggatttcgagaccagcctggccaacatagtgaaaccccgtctctactaaaaatgcacacacagaaaaattagccaggcatggcggcgggcacctggaatcccagctactcaggaggctgaggcaggagaatcgcttggcaggagaattgggaggcggaggttgcagtgagcccagatcacaccattgcactccagcccgggtgacagtgtgagactctatctaaaaaaaataaaagaaaaagaaattgcattctaggggtgaacatccacatgtacctgggatcaatccttccacagtcatatcttcacatcataattctaaccctaaatcatcaagaaaatattatgttagacataccatacataagaagggaaagagagctgtcctacataatcattttcatgtaaacctttcatccagaagttgaggtgttctgtcatccaaaggagtagctctcagctgtctggaaaacctttttgttcagaaggacatttgttgtgctttggtttaccttgggttttattgtgccgcgtgtgtgtgtgtgcaattctcattctattaaattattgtgtgattttgatacatttatgtcagggattagaaattttagaaatagattatttctggttttctgatcaatgtgtcctgtctatgtattttgtctttgtgcaaaggaataagactaaaacacaagttatatgcctgagtctacaactgagtgttgtaaaccaaaattccaaatgaaagaaagatatggggtggatggcaggattagagaattgaaagagtgaagaacaaaaggcttgcagacatcagtaaaatatgctttcttagttaaaaatagtaagaatgttttggaatattttacattaatttcgtttcccactttttctttacttttgcacaattaatgatttagtttttgagtttcaaatatttggccaagcttatctactgattgaattcaatttcttactggatgtgtgtactgcttttttgttgcattcatggcataaattttgtggacgcatttctacaaaaaccgtggattcagcatgttgcagagtactatggcaagaaaactgagtaacagactaagctgagacttggtagaaaatatctgttctcctacaaggcttgactctctactgttacttcaagaaaatattatgttaactatatgtgttatacttaagaaggcagaaggatactcactcctctgacgtggcgagatactcctcattacccccacggaaatactatctagattgtgaactcatccatagaatgactacatatgattcattttgtgatttccctaatatgtattgagtttaaactacattgaattccctggagtttgactagaaggttgattatccagtagagtttcttgtaagaaattcttatagcagtgaactattctttatggcagataaatcctacctgtgtatactgattttctttcttagtaccatagttatactcaggttactttttttttttttttttttttttgctcatatagacaagactacataatcctttttagaaagggccaatatcctatttggaataaaaacaaaacagttagatggtaccagggtcaccttaaattaacttatcagactatcaaccaaatcgaaatatgatttcagatgtaattaacccatttgcctagtgagatgcaaaggtgtgaggatttcttgaacacatctttctcttatgtagcaaatatcaacctcctgataccttttgtagtcagttcacataccatgacaatacatcctaaattttcaggtgtgatctaaccagcataggttcacataattggcatgacacggaatttttaaaatatcaactacctcaggaactttattcatgtgaatctggaagatcctttttggtatttgagccctttcatagattcagatgtcaaagtatttttagaatgggtctgtaaggcatcattattttgtaattataatcttattgattgacagcaaatgctgtgttccatgaaaatgttgcattgaagtgatcccggttagtgctaaagacagactgcttagatctaaagtctcatgagaagaaagaaagaacttaaaatcattttaaattcaccaatatgacgatacaggatctctcataaaatgctgaaaggttgtttttgctgccagacttttagcacttccgttttacgttcaaatgttgtaaaggttgattactcataagttaaaatgtttggtgcaaaatgtactttaaaaatattttcagtgttttttggaaattgtagacatttgattttgaaaagtaggccagaaatttggaagactacaagccatatgatggctgatatttcccatggaaaatataatatgcagctgtgctctgctgcatggtagaacaggagattaaaatatgagaaattataataccgtttgatgatgatattaatgtcactgaatcaaataaagtatgtgatatatcataagttaatagaacaacacttaattattgattagagcctacatcacattttaaattatcggcatgtttggtcttgcaaagggtcaagggtgactcgtagcaacagaactattctcctttcaaaaagttagcagaaagttaatatcaaattctatgaggtagagagggatttgggctgaggtaggtcaggaggaacgtaaagagatgtgtcatgtgtagatttgtgagctgtgggcacctgattttgtgtttaacagtatttacgaccaagataagtgaatgaagagctatgttcttatgaaccttaagtttattttgctaaaataagtaagaaaattcaaattcaaattaagctatatagtcttgcaaatttcaggtctctgaggggtgtgcattaataagtattcaaaagtattttgtcatttaattactattatatgaatttttatgtaattgaattattcttgaatgttgagaaactgtctttactaggctaaaaattcccttagtgatctcgttacccaattcctttgtgttccactctcagtgtctgaattgtcaccaatatgtggagtccaaattatgaaatacaaagctttaccagaattctgatgattttgaaggaagaaaattacagcaaattttgatcaattctctcctattagtgattaattcaatgaaccgcttgaatttcttatttcctcgtagaactgtatgtacatgaaggatagatacaatatttagtacaatctatagtgagatatgaagggaaggagattatgagaaaagaataaaactttattataaaaatgcttgttcataaagatttgacacaaaatcaatatgataagttttcagaaaatcaaacaatgaatttcgtatgaaacctcacattggcaaagcagttatgtgaataccaatattttttaaatctaaaacaaagcattttgaagtagtttcatgaataatgtactgaacctgtttcacgcaatgaaatgaacatcacagtgagaaaattattccacaattgtaaagttaagtgaagcttgcattataaggccaataatactcaatagggtattttctcatgaatttacactatagaatgtttttattctggaatttggatgatatcatagtcattcaacaaatacagagactaagtgatttttaaaatctttcaggaaattagttctttaatttcatctacatgtatgtaaaataaccaaacctatgtcttatgcatataatgtcattctaatatattgttcatgatcataatatttatatagaatccattttgcttggccgattgatttggcttggcctacaaattagtacagtccctctcaactttgacacttctgtgtaccatcagctccttcctggagtactgaaatagcatcctaactgctctctctcatgtagtcttgaccccatctataaatcctaatttcagcatttggagcaaccttttagaaagatcaattaaatcatctcacctcttcattaaaacgcctctcattctaccaagagtaaattccaaaccttttaaccttgacctacataactggaccatgcctccctcgcccatttcaattcagctttgctcttgtagctccaggcaagctagctctgtcttagttcttgcatgtaataagctttcaagtccctcggtgtctacttatttactgttccctctgtattagtccattctggcattgctgtaaagaaatacctgacactggataatttataaagaaaagacgtttagttggttcacggttctgcaggctgttcaggaagcatagcagcttctgcttctggggcggcctcaggaagcttctaatcatggcagaaggcagacggggagcgaggtgactcagacggtgggagcaagggcaagagagacagcaagtggggaggtgctgcacacttttaaacaaccagatctcgtgagagcccactatcgcgagaacagcatcaaggggatggtgctacaccattaatgagaaacaccgtgatccaatcacctgccaccaggccccacctctaacattagggattacaattcaacatgagatttcgtggggacatgaatttaaaccatatcactatctgactggaatgtgctttgctcctgcttctacttccgttttctgagcaatcagacagttattcattaactcattcattcattcactcactcatttgttcatttatgtattaaattattcagtgattctcaactctgggtggttttgccgtccaggggttatttcaccatgtccggagagattcctagtggcataactaaaagaagagatgtttgctactggtgtctagtgggtagagaccagggatgttgctaaacatgtaataatgttcaggtcaacccaccataataaagaatcatcttgtgcaaaatctcagtagcaccaagattgagaatctctgcaatacgtcaacaacccttctaggtgccaggaatatgacagtgaaccaaatgaatatggtctaaactttcacaaactaatccattaaggagaagatagtcaataagctggctaacaaacaattaaatgtatactttcaaattatgttgggtgctctcatggacaaggggacaagagagtggccagtgaaacctaatttagagcaggtggtgttgggggaggtggtgtttatgctaagacccaaagaatgaaagaaagactcagccccaacttatatatatagtaaacatttattgaatatcaatagcaaaaagttgcatttttctcaaccatgtctttttatggtaactggaaattgttcaaattattttttagaatcttttaatcatagattctttgctaaggggattagtctagcatttttctcttgtgagcaattaagttctcaccaagttagtgaatcctatgtcttatgtacttcctacttattactatgaaattatctaaaaaatgctcatagggttcctaatgtagttgaaaagcaaactgttgctgcatctctaatcagtaacaaaacttgtatttctgtcgcaaaataatgtaaaattttatagtactttttacatatttatttaaaacaattttaagtaagattgtttctttgtggaaggtcatatggtcccaatatagggatgtgtacagaaatacatatatacatacaacaacacaatgttaaacctagcaaaagagtggagtctctttcttttatttttcttactttttgagcaacgagacaagcaacatattatgcctagtcacttgaatcatacaccattaaaacattatgggctgagtgcagtggctcatgcctgtaatcccagcactttggaaggccaaggcaggtggattacctgaggtcaggagttcaagaccagcctggccaacatggtgaaaccctgtctctaccaaaaatacaaaaattagccgggcgtgtggtggtggatgcctgtaatcccagctacttgggaggctgaggcaggagaattgcttgagcccgggaggcggaggttgcagtgagcagagatccgccattgcactccagcctgggtgacagagcgagactccatctccaaaaaaagaaaagaaaatatgaaaagaaccatttttaatgtcaactactgctttgatgctaatgtctgtcagttcagtgtctatgacttaccctttattctgctcaaaaccttcttgaattttccatttgaatatcccacaggctcttgaccccacttatccaaaattaaacctatcttcctctctactacacctcttcttataatctttctcttgctatttctaaacatttagtgggccaaataaataccctaggagacatgacttgaaaggggtatgaagtttagataatgttcggcttcttgatctgatactggttaaatgggtgcattacatttgtgaaaacttattgagtcacttatgacttacagattttctctatatattttatattttaagaaaaaagattacatataaattctagaagccaagctacacctttccctcttattcatccagcacatttactgagacagctagattttcataatgactgtccattgttgaatatttgctatatctttgatattgttatccattattaacttccttacctggtttgacagttgaaaatttctgtggtgcagctattattatttccatttcacatatgagcaaaaagagacttagagtggttaagtaacttgtctaagttcacacaacaacaaagtggcaggagtagagtttgaattcgagtcaatatttataatcactatgatatcttgcttctcgtgttccagtcgcattaaaactatgaatgccactcccactccttatccatccttactacctggcttcactttagatcttcaggtcttctttcctatattataatgataatatcataagaaatccagtgcagtttagtctattccaaaatcagtctaaatactgccaggattagtgttcattccacaatataaatctgattgtgtagtttacttaaaatccattaacacagccgttagcaaccttagctacatgtgaaaatcaccaggctccacccaagataaattaaatcagaatctctgggtatgagggactgggagtgagcattttaagaaagctccctgggtaactgtaatgctcagctaggcttggaaaccaatgctttaacgtttccctacagcttttattataaaaataaacccctcagcattgcacaaaatgccctttgtaatttggtttttgccttcctctacctcgcctcctctgctgtaattcccttcttctcccactttttccccaccctacctacatacatttcattgcaattattcaaaagtctttgtttcttctgaagagttatgatttttataccatacccttacacataccagtcttcccctctaaatgcttagttacattatctttgtacttaatccttttagttgctgataataaatgaaaatttctttttagtttctttttttttttttttttttttgagactgagtctcactctgtcgcccaggctgggctgcaacctgggctgcaacctccgcctcccgggttcaagggattctcttgcctcagcctcctgagtagctgggactacaggcatgagccaccaagcccagctaatttttgtatttttagtagagatggggtttcatcatgttggccaggctggtctcaaactcctgacctcgggtgatccacccgccttggcctcccaaagtgctgggattacaggtgtgaaccaccgcacctggccaaatttctttatagtttcttgacttgtttttaatttagaaaatttcccacgtatatagacaccatacaatttataatgtaaagctgttttcctatatcaatcatgttttaccttttttctctttctcctatatatgctgcttcctggaagatctaggagctgacaagtgtctttttatcttgctttgcaaatctaatcttttgccatttctttttatagaaatgaaagcttgtatcatgcatactaaagatggcttcttctttgggctgtagggccatttaatgagttatattgaactgaatgctttataagagttcaaattagtacattgggatactcctatgccagggatggattaatatatctgtccacatatatacacaaaaatgtgtgttgctaatttccaaattagagaatacttattttgaattatcagtatctatgacatattttgcatgtggtatatatttggttaattaaactgagttaccacttgttttatcaaaatttggtgtctttctaaatatatcatgaatatttttcttctaatgcacctcgctttctgctggaactatagaaacactttgtaaatttttacttgtgaccactcgaacatttacaggacattttacctgaaaattttttctgagtcagtgaagaaaatgtccatgtttctgcgtgtgtgtgtgtgtgtgtgtgtgtgtgtgtgtgtgtgtttgtgtgtgtgtgatgcttgcttatgaggaatttattttggctatggttctttattttgctattgcactcttaacattcgtatgatatgtattattaccctataaatacttacacaatatattcttacaaaaattaatacaaagattggccaaaatgtaatagcatatgtttttgtaaatagaatatccatatacagtcataataaaactgaagagcgattttatacttttccataaagccaaagattaagggtgtaatcactgcttataatttactaggaaactataaaacagataaaagtagatgaaaggatattacaaatatctcaataagtcgtcctccgcaactgaccccttgctttacacatgttcagacactctatactaaactctgtttatttttctattttataattttctatatgatcgtaattcagcgttttcctataatattattagtagtgctaccaacagatattacattttatgaaaaattttaaaaagggcacatgttgcataaaactaggttttgaaacagctgcttataatgctgatatttagcacatgactaggtggaatatggactttttaatgaatattttttcaaagttaggtaatttctcatcagtcagtttcaaaagcaaagttaaaatttgtgtttcaaaaaactgggtatgtttgaaaattgtatttaataatggattttgagagttctcaatagcaaattgcttggctgactgtagtttaagaagtaataattttgaagagaagttgaatgcaggtactttcaaagtgttgaaatttttaaagaagaaaattaaccttttcagactgtacacttgttcatcttttatattcttttccctttaaaaaagaattgtagtaagaagggagattaccttctgtcattgatacaaattttccacagtataaatgctgtttatcacatttgtataatatacacttcctatcaattttaaaaattacatgttactactatttaactctgacttaattattttaaatataaaataattcattcttttataaataatcaaaactatagttttacttttctttcaaaatataccactgactacattacagattagattttttttagtataccaaacatattttcatcttttggagttattggaagagtagctgcttactgccttacattttagatttctctatataacaagcattttcatcattttggcttattcgagtaattcttaataaataataatacaatatttacaaatgagatgtcatttgcaattttaacacttcataattttaacaaaatatctttactttgagttttttactttccttttggtgtgacattttgacctccaatgtgatcttcatttaaaggaaatatcaacgaaaattccttttttttcatttgctatagatgtacatataagatttacatgtgtaaggaatatagagcaataatgaattgagctattcctcataatcacttcacttaagaaatagggggctgggtgtggtggcttgtgcttgtaatcccagagttttgggaggctgaggtggtaggattgcttgtgtccaggagtttgagtccagcctaaccaacatatcaagacattaagtctatgaaaaaattaaaaaattatctgggcatagtggcatgcacctatagtcctagctactcaggaggctgaggcagttgaatggcttgagcccagaaattcaaggttagactgagagctatgatagtgccactaaacttcagcctgggaaacagagtgagggcccttctcttaaagaaaaattgactagaatatgactaatactctagaagccctcctccacatgccacccttcccaaatgcaccactattctctcttcccaattttcatttttgtatttattattcctattcataccaacacaattttaccagatgtgtatgtattttcagcaaatatttttagtttattatgcacttaattgacactatggaagaacagcttttaagatattattccaacttagggaattttaaggaaataagacctttgtatataaaaagttaaataggaataccgatttgcttttgattagtgttaaatcacataagtttaaatttgtaggagatcatagagatcagaaagcccagtggttcacaaactttcttttttttatcaacaaaacctcttttaaaaatatatagcataaggaagacggaaccataaaactgaaattacagcagctcaactgaattgtgagtttcaactgaactcaatttcaaacccacaaataagtcaaactcttactttactgagaatatatttggaccacacagagtttaaaaaacatgtttaaatttatttagcttatttataccagaaccaatataagaatccataacattctgcattagaattaagtacaaacactttttctttctttctttttctttttctttcttttttttttttttttgagacggagtcttgctctgttgtccaggctggagtgcagtgacgcgatctcggctcactgcaacctctgcctcccaggttcaagtgattcttctgcctcagcctcctgagtagctgggactacaggcacgtgccaccacgaccagctaatttttgtatttttagtagcgacggggtttcaccatgttggtcaggatggtctcgatctcttgatctcgtgatccgcccgcctcagcctcccaaagtgctgtgattgcaggcgtgagccaccgcacccggccgtagaattaagtacaaacactttctatgatattatactaaattaaaaacaggaactcaaaatgatacaaactgaactgaaataaaataaaataatacagtgaatggagtccacaattaaaatacctgcaaggacctgaaagggaatggaaataggtgaagcaaagatctaaatgcatacggacattgtgtaaattggaaagaatactggcaaatggcacgcctgtgcccagtctaaaatgggcaactgctaatcaattcagtctagcagtgtccatgtcagaatgtagagctatttttggccatatattttatttttcaagaggaacttaagaatctggagttgtatgtaaaacatcccagtgcactatatatttgcctcataagttgagcacttttttttatgtgtgcatgttgtctactggtgaatcccaagcacttggaacagtgcctgatatatagtaggcagtgatgtatatttggtgggtaactggaaaaaggttttccaattaaaaattctgtgcaagcctgaggtaggagttgggcaggacttatttcccattcccagaggataaagtgaagaaactggcaggtaccagcaggcagcgaccaacggaagtgagaaaaacagcagaaaccagcagatggcaacaaaagtgatccccagcagccctcattgcatattagcagaagccactcccaccagcaccatgacagtttacaaaggacatggcaataacccagaagttaccacccctttcctagaaagttctaaataacctgtctctcaatttgcattaatctgccacttaatttacatgtaattgaaagtgggtataaatggatataaatacagtagccagcagcccataccctgccaactttggaggcactgcctatgagttgtccctatttcacaaagcgcagtaatgttcactaaaacatagctgtttaacgccactggctcgcccttgaattctttcctaggcaaagccaagaatcctcccaggccaagccctgattttggggcttaacctgtcctgtatcaaactagccaaatgtatctcaggcctgaattagatcaatggctaccagttcaaatcttttgttttagatattagagaggcaggaagtgactctctactgtgtagcatgatactcagagcccaggaacttcttcagaatcccagtttgacttccaaaacgccagtgtcttgcttttatttactcttgtgggtggcagtaagggaagggagcatatctccttagcaaaacatctcatcagaacacggtccatagcacaaattattaattaaagacttacgtggaggctcaaatatagagccaaagcataaccatttaacaattatccttcaaagcaattttattcttggcttttggtggaaaaaactcttaaaaataaaatgataattctacatatgggatttgtgatgctatttagcaaggatatgctttattgcctgacatcccctttattttggcagaatactatgagattctcattacgtttccatttgctgcggaaagtggagaaaagttcagagggggaagactaattaaaaaaatggttgtctactaatccattgaactaaggcttcttaacagtcatgctcttcttaatagtatgaacacacattttgtattgattgcagagaataaagaaaaagaaatgacttgttttgaacttcaaaatggaaaaaatgaatacaaaatccagataagcctttgggcataccaactttttcgacttgtattatataacaacagttggcaaatgatttcaagttgctaaagcatagaaaatgatatttatttgatgaaagctaataaatcagacagaacaattaatggataatttggattgaacaagtatgaaagattccaccaataagaaccctcctacctaaaactatgaggtttttaaatgaaagactctcctaatgtcatagattttctctacctgtgctttatctgaaaataaaaatcacagcttttcccttcacctcttcattctctactcctccttatatttcccctttccttcttccttccttctccttcctttactctttgttctttttattcctgtttgttctgattacctgtgatgttttctaaaaacattaaaattttggtcaccattaatattttttacaatgaattaagaaatttatctcagaaactggatttgaaccaaagccttgttttgaacttctaataagtagactgaggaacaagcacgattttaagggcatatttaataggcaaaataaaaaaaacgcataaaatgcccagtcgttgatgaaaaaaatatatttttgtaattgctgttattcaggtgcttgaaggcccatgttaaagtatcactggagaagataaaaagcatacttcctcaatgtgaaaaccctcaaaagaaagggctataaacactttgtcctgaatatttgttgtttcaattgctgacgtttaacttttcatctgacagcaattcaagttctgcgtaccacagtgttgttgaatctttgaatctgaaaaatattttccttgcagctgtgataataatgtatctcctgataatgcatttaatgtggcaaagacacttttcttaaacacagtgaaaactaagtgttcattttgtcattgtaaaatgagacatgtttagttgctccaaattttaacttgggtaaccttgagacatagttgcacatttaacatcctatattttgcttgtcttgcagtcaagtgaattatcttagttactggagtgttacgtgacaccaattgttttgttaccactgctttaaaaatagctctatccctagaccccatcagtagtgtgtcttttagggccccgatttttttctaatctataggttagccctcaaggcaacgtggcctctttctgtttacttctcattattcctgtaattccaattctacatgtgactctttgctttattttaaaacagttgtgcattgctgatgagccttgaagtcaccaggggtggctggtgtcaatagtgagtctgtacatggctatttttatccataaagcagtttactttctgtatgatgaaaggcgttaaagtaaaacctgcctcctattataccctaggggtgtaatcaagagggatttgatcatagcataccaattaagcaggctacagcagactgctctgggttgtactaaggagtagggtgttctccacagatttttgaaccctttattgcaaaagcatcagggcacagcacatctaattcttttcatcgcacagctgtgtacataaacctctgtatacagtttctgctcagaggctgtgctcttagatttaatttttcttataagtcattacagccgtgatcattcatttaaacctcggcaagataagcattactagttcccagtaaactagatgatctcttcctctagactgtattttctcttatgaacaattataagattacaagactagcaatgttgcttatttacactacactacacacacacacacacacacacacacacacacgttcattccaagccagcagccagctcagcatccttgaaagctctcaacctcagccgaatatataaatatcagaattctctctaccaccctcaattagaaaatgttccagttctgcttttaaacttccactccaattcttcttgctaaggcctggaagcctcaaggtttcttgtattgccttatatacacctggattattcctctctgttgaaaactatgtcccattggaatgggagtgtctgaccagctggtgcccaagaatgctctcagaaaacgatcttccacaagccagagccaaaacccaaacccttgacccttatcaaccttgacgcccaaaactccaggtgtggattagcacagtaacccgcaaacccactcctacacgaaggaagatttttctagaacaactacagctctccttttatatttttgggtaattcagttatgatgaactgaaccagaagtataaagtatttgctcagttcagttcttaatctttgtcatggtattacaatactaaaccacttgctttgtcactttcatatagctcataaaagaaaatattactgtataaaatagattctgtagtccttcacttgttgttatggactgactattcgtgtttgccccaaattcatatgctgaagccctaacccccaatgggacgatatttggagatggaacctttgggaattaattagggtaagataagcacatgcaggtggggctctgatccggtggcccgtgtaaagaaaacaccagagagcttgctcttgctttgccatgtgaggacacaggagaaggttgttgtttacatatcaggaggagagccctctccagaacttgaacacgctggaacactgacctcggacttaaagcctccagaactgtgagaaaataaatttctgttgtttaagctgcccagtctatggtatcttgttacagcaggctgaaatgagtaagacacttgtattgtccctgcggttgacatctgactctgtaaaaacacccatgcatacacacacgtacacacaaaacaacaacataaccagtaagataggtaatcaagtatatggtaaatgcacctgattgcaataatgtgcgcatacccttagaatgaccctgtactgcagacacacctgaatgtgttttccgagctacggaatctgggagtagcccagcaagagagcccttccttgtctatgaggaacatctgagccccaagtgcatcccgtggaacacgggccatacatacagcggattgaggccccgagttttgggttggatgaaggttgccaggtgaacgtcattaagggcagagggttaagtaaaaatgctatataaactgcatgctgcccgcaagcagcgttggtttgcccgctcatcccaccgccgccatcactaccactgtgctgcgaggctatcttgtccagtctgccaccactggatcgtttctacaggtaaggcacttctcctgtccagcccaccactactgaattccctcccctgtatgtaaacctctaataaaacccaatgcctcgtttgctggctatgggtttcttcctcagtctcttgaacctgatgccttcgctattgagggttataggggttcagtacaacatcatgatgtgaacaaacgcgtttatttgggcagatgtattggtcagctctcaaaacaataatatcaagtaataatcattacctccaacttaatggttttaaatagcattaattctcatggtcatgcggggtttggctgacctaagttgatctagatttggttctgcatcaggctggtagttgctaggcttggctttcagcggcaggtttggtttggatttctttgatgtgtcacgtccagaggcacacactggaatggcaccggccacccagtgcatgttttcataggttgtcactagatagcaagcccaaacatgccagcccatctcaaggctctgctcctgtcatgttttcttaacaccccgttgaccaaaggctatcacatttcccaccataggctagatatgccatcctattaagtaggaatgagaaagtggggaccaataaatcaacctacagtaggaaaagtaggggattatttagtagcacaaacagatgagtttcagtgggcttgctgcttttttgtggatatggaagaaatacctaaaaaaaaaaatttccagctccactacaatatttaagaaaaaacttaggtgtgttcatagtttactactttgcttaataaccccactgtttatcacagcaaatttaatcacctctgaggggttttaatggctttgataagacaaagagtaaattactgaggaggaagacggtcactttcacatcctgagagatgctaactgtgcaaggtaattcacatatatcttgtaaacatgtttgcaaacatatataggagataggtggtattctcattttttaaggaaagaaatggaagacatgagagaatgagtaatatgtttaagaggacacagctggaaactggtataatctggctctaaatacgggcttttgtgttacattgaacagagataaattcagcttatgttaaggaagcatggggtaaaaaggtcaagaaactgaacaactgaataaccaaataagtaggcgaaaccatttggttactcagttgtctgaccaaccgaataatcaaaacaaaaatgtcacattagaaaactacgatcagtgtaattttatgaataattgaactattgagaccatagtgtagcagctgatctatcacgtcatgggattccatcattcattctcatgaattaactactctcagtccttgcttttagcattacctctactccctaatgatacatgatttttactctaacataaacttcccaggagaaaatgtctgataaatatcataaaatcatgaaaatatctgataaagtcatcatcctgcatcatgtgtgggagacttaagtttgtaactcttcccattcctttaagttggttttcagccttgcttacacgatcattgtggccagagagacagaatgtgccaagcgtgtaggcctgagctgggaaacaatgtcaataagtaatacagtataggggatgagaagtttgccaaataatacttggtgtgtaatgttatgaaagaaagggggcattagaggccgggtggctcacgcctgtaatcccagcacttcgggaggctgaggcgggtggatcacgaggtctaagagatcaagaccatcctggccaacatggtgaaaccccgtctctactacaaatacaaaaaaaaattagccgggtgtggtggcaggtgcctgtaatcccagctatttgggaggccgaggcatgacaatcgcttgaacccaggaggcagaggttgcagtgagccgagatcgcaccgttgcgctccagcctgggcaaaaagagtagaactctgtctcaaagaaacaaaaaacaaaaaacgaaaacaaacaaaacaacatggcgtggggggcatcagaaacacacaatggtacagatttaaaagctcctcgggtgatgctaatgtgtagccagggctgaaaacctaaaagaagaatgtgcagtaatgttgccagtactggaaggaagtgtctgagttttgtctagtgactgacagaaggctatgaaactgtaacagttgtaaggggttgagggaaagccgaggccagatcatgtggatcatgtgcaaattgtaggtaaaatgtaaagctgtgagttctgtggcctcactgaggaagcatttctctgcttttcaggaagtaacttggagttgagtgctctatgatttccaagttgtcagctaacacattgaataactgatgaattatggttctgtggccttcatttctgtgtcacgtggctatactgttcattggcatatgcaggcagtaacccccaaactatgacgcgagaggatggcaggattccaggtctgaagagaaaaaatgattaggctggggaagaatgatttgaggaacctcaaatcagactatggcagcaactactaggtgtagggcttcatgccatccagccttggagttgtcagttttctattaatctttgctaacaataaaatactaatgggtacataatgtagtgatttacagatgatagactctccttatgttttcattttgtctcaacagagtccagcatatttcatccaaattttactgatcagagaattgaggtacagacagaccatgaaggtcatgacagttggaaagtgttggagtagaataaggaagcctgatttttctcatttgtcctacatcgctttattagattgtcttctccagccttacctccccgccttataattcttgattttcatgaaacctattaaagggaaagaaaaggaaaactagaaaatttaatttagatcacttttaaaaatcactttgcatcttggactgttgtcataagttataggattaaatcctaatgattctaatgttgttaggccatcttaatttatatgatccacttacctctcagtcttctctcactggctcactcacctgccctctgtatatgaggggattgagaaaagtctgtttttcattatgtgtagatacacagactggtgtgtatgtagcaggaataaatgttcgcaaaactcagatgtggaagaagtaactctgaatttttgccctatttttgaactgtactccaggccagtgctgtccaaaagaaatataagctatatatgtaatttaaactttttgagtagccactttaaaaagtgaaaataaacaggtgacattaatgttttatttagctaaaatatttcaacatgtaatcaaaaaagacttaatgagacattttacgttagtgaaaagaatgtactaaatcattaaggttggaggatattttacatttacagcacatctgaattcagttgccatattttcatgggttaaagtaaacttgttctcccaaaccaatgaagttatggttaatggaagaatattaaaaactgtttgttttcaatataaataaaattgaagcaaaaataaagcaaaatgaaaatttggcttcctcagttatgctagtcccatttcaaatgttcagtagccacatataactagtggctatcttactggacaacataaccccagatcatgataaaacgttctgatttcccgaatttcttttttttagacaatctgggatgtttcgccttcttaccaaagaaacaaaaaggtgctggtactttttgtttgcttgtttttcagcagttgccattgaaatgtgtttcttttggagttggataggaaaaacctagattcttcctccaaggtgtagtctcaactgtgccccaggcatcactgtttatgatggattaagggtgtggcttttcccagataatgagtccccctcccccaccccccacaggccttaatatctacagctcctgtcaatagactggcctttccttccccgcgaaaagtttgagtcctttaagaatctaggtctaaggttaatttcaacgaaaggtttattttctctttctgcgaggacctatggaactacccagaacatataaagcagtccacaaggctcttcaacagcttcgtaaccgggcactgctagttcagaaactcactgacttctgaatgtccatttcacatttgcaggctgcttctctgagtcctgagctcttgtctcaagatgacttggctcttaattgttgtctgatttattaccggtttgctttgcagtttaggtgctggacaatgattcttagaaatccccacataaggatctacatgcagtggcagtgaatctcaataactgccttttcttgaatctgaacttaatttatatataaagcctactttccggtagatcctgcatatttcatctcagccaatttaggactgagatgccccccctttctctggggttttgtcttaaatttctggaggggacctgattgtcacgcccctccgagtgaagagaccaccaaacaggctttgtgtgagcaacaaggctgtttatttcacctgggtgcaggtgggctgagtctgaaaaaggagtcagccaagggtggtgggattatcattagttcttacaggttttgggataggcggtggagttaggagcgatgttttgcgagcagggggtggatctcacaaagtacattctcaagggtggggagaatgacaaagaaccttcttaagggtgggggagattacaaagtacattgatcagttagggtggggcagaaacaaatcacaatggtggaatgtcatcagttaaggctattttcactcttttgtggatcttcagttgcttcaggccatctggatgtataagggcaggtcacaggggatatgatggcttagctcagagtcctgacactgatacagtgccaggatttgaaggcgggtgtggcttacctgatttcatgtacaattcatcccatagggaccttgttccttggcctcaagttgtaggccctttcatatctctgtacggtcaagaaacatggtggttcccttgtcattcttcatcctccaaaaacccattgagcactgtgtttgctggaggcatgtgggaaattattctactgtaccctatatcctgctgaagtgcctgggtactgggtggctagctcatgtccatttgctaagacacatgctcacgattcttgcctgggtctgacataactttggagtcttgttgcattcctgggctggactctggaatgggacccaattacttctgcacctggatacccccaaccttctctgttgtggtggcggttctttcaccatcccctcctctcaggaacacactcttgtttctactttacattctccatccagtccaggaaaatagtatctaggctcagagacggagaaaatagtgtctatatttcacatttttttccaaaaaaaaaaattataattttccgtgcctggacttgagaatttgaaaactccaaaatcctccaggttcaaccacattgttcccaattacaggattttcttattaaagttgaatagtgttccattgtgtgtatattccacatttttgaatccgttcatctgttgatggttacttaggttgattccatatcttgtctaatgtgaatactgccacaataaacacgggtgtgcagatatctacttgatatactgatgtcatttccttaggtatgtacccagtagtgagattgctggattgtatggtagttctatttttatttttttttgaagaacttcctgctgttttccataatggctgtacctatttatgttcccattaagggtccaaggtttccctcttttccatattctcaccaacactagttatcctttgtctttttgagaatagccattctgacaggtgtggggtgatagcatattgttttaatttgcagttacctgactaatgataagcattttgtcatatacctgttgtccatttgtttcccttaagacatgctcgttgagacatggacacggggaggggaacatgacagaccggagcctgtgggggtgggggcgtagggagcaaggggagggagagcattaggacaaatacctaatgcacacaggacttaaaacctagatgacgggttgatagatgcagcaaaccaccatggcacatgtatacctatgtaagaagcctgcacgttctgcacatgtatcccagaacttaaaaaaaataaaaaataaaaattcagttccttaatcacagttgccactgtgattttactttgtcatattttaaaagcttttttatttcaaaaaaaaagtctgttgaggtcctttgcccatatttaattgggttgttgtattgctattgagtttaaggtttcttatatatttttggatattaatcagagtgaagggacaactcatggagcaggagaaaatatttgtataccatatacctgaaaagggattatttccttggctgtgcagaagctgtttaggttgatgcaacttcatttgtctatttttatttttgttgcctatgctcttgggttcatatccaaaaaatccttgcccagaccaatgtcataagcttttagttgatgtttttttttttttttttttttttttttttttgagacagtcttgctttgtcacccaggctggaatgcaatggtgcggtctaggctcacagcaacctccaccttccgggctccagtgattctcctgcctcagcctcctgagtagctgggactacaggcgctcaccacaacgaccggctaatttttgtatttttagtagagacggggtttcgccatgtttgccaggctggtctcaaacccctgacctcatgatctgcccgcctcaacctcccaaagtactgggattacaggcatgagccacctctcatagtccatgttttcttctagtagttttagtttcaggttttacctgtaagtctttaatccattttgagtcgattcttgtatataacagataagggtccaattttctttttatttatttattttttttgagatggattcttgctctgtcatccaggctggagtgcagtgatgggatctcggctcactgcaagctccgcctcccgggttcacaccattctcctgcctcagcctcccaagtagctgggactacaggctcctgtcagcacgcccggctaattttttgtatttttagtagagacggggtttcaccgtgttagccaggatggtctcgatctcctgacctcgtgatctgcccgcctcagcctcccaaagtgctgggattacaggtgtgagccaccatgcccagctgtaagggtccaattattaatattcccaattgaatggaagaagtaaaaggaaacaaaattaaccatattctcacttaaagtcattgttatcattttggcatatttcattgggttcctttttacccgaaatgagggttttctgctatttatttagatgtgatcgtgctatatttatgacttttcacccttttttactatcacataagtgattttaggttattatagacacactttaaatgttcacataatgaccacttattctaaagttaggcatttagttttttatttttgttgttctaaataacccagtagaccattttgtttccttttagacagcttccagcgcatgaaattattaggtcaaaggatattacctttttttttgagacggagtcttgctctgtcgcccaggctggagtgcagtggcgcgatctcggctcactgcaagcttcgcctcctgggttcacgccattctcctgcctcagcctcccgagtagctgggaccacaggcgcctgccaccacgcctggctaactttttgtatttttagtagagacggggtttcaccgtgttcgccaggatggtctcgatctcctgaccttgtaatcttcccacctcggcctcccaaagtgctgggattacaggcttgagccaccgtgcccagccaggatattaacattttttaaagggtctttatatgtatcgcaaaaatacttagcaaaattattattattattattttttaccagtttacactgcccaccaagaagctataaggacacctaaattgtcacataaaactgtgtatggataaatatctctattttataaaccacttggtataaccaaaatcctgcttttgagatattaaattttgaagctaacattcttagcatgtttttaaaataatactgacttcatgagctaatacccataatgataaaatgattttatattccaggaaagctgccatgtgggattgaatgttttatatatgatacacttttatctacatatgttgttatacagtcattggtacctttttattagatgaatttatttcatattcagtttccactgaattgtattcagcttgactacaaattagtcaagcagaataagaatgtgagttttattgtgactaatatatatttggagtctagatttggagagacaaggggtgagtaaaactgtgtgcctactacctgaaaggaaaggttttttttttttttttttttttccccctcaagggaaacaattacggagactgcccaggcatttaatattttattgaaatattctaaaccctcaaatttcgcttctacattttatgtgatgcatcagaaaaacactattttatttgttttataattctccaatagggaaatttcaacacattgtaagtttctttatttaacaacatcatctagcttttaataactgactttcatacacatttttaaaagcaggctaatcgttatagcttaatatatttttcatgagatttagtgataacatgatcacttataccagtagtttatctcctgaatcattttaaaaagtaatgtgcatgttttctttatatttatatacaattgggaagcttaatatttatgaaaatatgattgacttttttttgtcatttctcttcaaagccttaggctttgcagttatcagtagtgcagttccaagatgcaaagtcataaacttacctttcattctctttagtaggcttaatattttgaatctagccataggaagcagcctgaaacctctaatcgaaatcaaagataacaccacaggggtacaatatctctaatttgtcttggaatgatgcggtagcttcccttgactgctgtgattaaattcattctggtttgttcagttaatgagattagcacatcttaacccataggaaatattgtctttatgggcctatgactctgaacagattagcatcatgatcagaaaaataatttttaataaatgattacgtgtgagtggtgctaggctaggatccctacaaatctggcaagagcatattccttgaccttcagcattatatgactttataagacacagcattttctcaggcatgggtataaatacagttaaatatgtactataaaactaaagaacagcctgaaatttaagaactacaagaatttgtgcttgtcattaagctggagataaagttaacatcctgagaagatgtaaaggcgacagtgatacacttctccttgtttggtaggatcatttccacacttgtctgtacttggaattgtaaggtgatgagtcccttaatgatttcttattgcaagtttgaacctagtgtatttcatggtaatagactaaggggaatgagtatatgaaatgagttccagtgtattgatgaaacttagagttgcgtagagtggagcatagcttagtagaaacttgagcaagttactgtagcacatggtcctggttccaattccagcaacatctgttagttttaggacttggtgcaacttgttcaaattttctgtcagactctccattggtttaaaaaataaaattcaaaatattgacaaatattgccttcctgaattttttggtgaatattaagttagatgatgtatataaagtgcctggcccatagtaagggctcaataaaagtagctgttggtaccgcttttaactaattgttgttaaattgattggttaattatatatttccctgccacttaactgtcactcaacagcttttcctcatttcctgcctacctgattggaaatcattatgttgaatatgtctagaattatcactgggcctgctgtattccctgggtggtatgtttgtataggttgaaccactaaagaaaatcttttcggatgagttactttcctatgtcaccctactatttcctagtgggaactttaagttccttcagtctggggtcaagactagtcttagtataggggacattgggaatattgaggatggcatgtttaagtaacattgtatgtattggtcaagaaaaaacaggcaagggatagagtacatcaaaaccagaaaacctatgtacttacctttccatttctgtctttattagatatgttgagtttatttcaagtgcctctatagaacatctacagaacattaatattaagaatatcatgaaaagggatacatttttaagagcctaaattttggataaaatggaagtcattttcttttttttttttttttttttttttttttgaaacagagtcttgctctgtcacccaggctggagtgcagtggcatgatctcggctcactgcaacctctgcctcccgggttcacgccattctcctgcctcagcctcccaagtagctgggactacaggtgcccgccaccatgcccggctaattttttgtatttttagtagagacggggtttcaccgtgttagccagggtggtctcgaactcctgacctcgtgatccacctggctcggcctcccaaagtgcggggattacaggcgtgagccaccgcgcctggccatggaagccattttctaacaacaaatttaatttgtgaaaagctggtagcatgttaactctagaatgacaattttttaaaaggaaaattccaaagttaaagggaaaaaatattggggtagtgccagctagtatcaggatttatactttaaaaatgcataagaaagaagcaattaccagtgtccaaataagaaatgagagtaatagaaaactcagatttcattgtattataaatttaataaataagttacacaattgccgttcagtgcctgaaattgatttttctttttttgaggtcaaacttcaaccatgtatatgaaatgtaagagcaactttctaagcagaattaccctttctgatttccttgggttccttttggttctttaatctgtatgactaagagtgtggattggctgacattatgagatgcaattaatttacatgcttaagttaggactataccatcctgtttccatccattcttgatcacaagcatattacaaatgctgtgctggattatctttactattaagacatactgcagaaagccctgcaggtaaagaaaacaatctagggcttaccttagaggcaggaagaattgcatgttaagaaagctgcatacactctggctttttgctctttgagtttagctcaatgtcttcctaaactttggtgtgcaggaggtgactacgcagtatttaaaatctaatccatattatgtgtatagtatggatggtatagcaattttccaggtggatttttgacaatattttattttttactattcatgttgactttgaaaaataactacagggctagatttgattcaactgtccatggttagaatttttaaaaaagtttttgactctaatacaactgagttccatctacagaaagaatgcacatatggatacggctgtccagaagatcaaatatccttgtactgaagtatatctatatttagtcattattttataaaagtagtagaaaacaatagtggaatataatatgtggtctttggaagaatgagaaatcatccttacccattaaacacagacccaacacttaatgtatttccattttgatagtgacaagttttgggtttgggatgatgtgtcagccagggtcagttaacagacagaaaccacttgagtgactgtagcagaaaataatgtaacaagaggaattgggatctaggtattgaaaaattgacaaagagaagaggtagcaagtgcacaaagtagctaccgctcctagggctgggaagacaaaaggttagaattactaacacttagaacccttgaggaaggactctacaaagctgagctcaggtctgagtagggggctgctacgtggctggtgctaccctctctgggatagcaggaagggcccaatgggactgaggcccggacctctgccagccaggtggtgctggtatttctgcagcaggggcgatgaagctgattctctaagcttttgaaaaacaaaacacaagctaaattgaatagcttgttactaaaaagtgctgctgcaggcatgaagaagcacgtctagggaactgctaataaggacagtaagtgcatgggaagctagtgtgaatgagtaaatcctttgtccctcctccaggcttgcagtctccctctattgctccctacctttagattctgagagtcagtcagtaaagccagaagtacggtttgcagagtctttgcctcagcgttgcaaagtagggtttagaagggtgtgttggtatggctctgaggaagataaaatctctaaccagcatgagtgctaatatgtctaataagatatatggaaaataattattaagtatttgactgaatttcaaggattaaaaagcaatacttaaggcaacaaaaacatcttatatttccattaaagcataatttttcttacagctccttcacattggcaaaattagtttgccctcttgaatttttcaaagatgtgaattatggcaagtaataattgctgcctactattgaatatctggatgttgtagaactgccattgtatcatatttaacttatttttgagagtgttagatttcctctgatagaagatattttttacttttccaagattaatagtagaaatattgaacatcaaatcattttacagataatactgtcctaacattgcgtaagtatacaattattcatagactcagaaatcataattgtcttcacagaaagaaaccagttcagaatactttaagaactatttggaatgttagatttaaaatattctgtagccaaggtaaagcaagttagctaaaattccttttgtttctattgtttttagaactagcttcaaagagaaagaatttgataaatacttagtgtccaataggctctttcatacagttcaaagatgtagactgacactggcatctacagttcctagctgtacttactctggtattttttgccagctgccttcgtggtttctgcttcatacctgtttgtattcataaataactcaatctaagatttttagctttttaaaaagaattgcatacaatcatcatcagattacaggtttgaaagaaatcttagtttttttctttttcttttttttgagatggagttttgctgtcgttgcccaggctggagtgcgatggcgcaatatcggctcaccgcaacctccgccttctgggttcaagcgattctcctgcctcagcctcctgagtagctgggattacaggcatgcgtcaccacacctggctaattttgtatttgtagtagagatgaggtttctccatgttggtcaggctggtctcgaactcccgacctcaggtggtcttcccacctcggccgtctaaagtgctgggattacaggcgtgagccactgcgcctagcccagaaatcttagtctttttaactcagttttgagattctgccatatacctggcactgtagttaagagatggcatataaatgggaaaaataggtatttcaaaagcaatcaaaagcaattacaagactatatagtatgtcctaccacgggggtatgcatgggagcagaaggaagaagagacgaattttgcttggctagggttgtattggggttgaaattgatatcaactatagactagaaacttaaagggattttcatgccaacaagagtacaacaggccattcaagtccatctcttccaaacattgattaaacatcttttataggcagacaatcagttagttgctaagaagactaagctgaaaaaggcttttttttttttggccctgttggagctttcagcctattggctgattaaaaaaaaaaaaaaatgctgaggagtatgaagtcacaaaccaattgagttcaggaaccagtaagtagtttgacatgaccgtaatggaggttttgggatatgggcaattggcaaaaaattgaaaaggatgcgggaaaggtggactggggatacaatgtggatggatgattccttgctcaattgagatgaatgtgttcaaaaaaaccaggaagtttttttttatgttttgcatattagaaagttacatttggtggctatatgcagaatcgtgtatggggagagtacaggtgtggaggtcactcatgaggctaatgtctattcaaatgggagaagaggaaggtctgaaaggcaatcactattggaatacatgcaagtacatctagcattgttctgtctttctgaagatgtggaaatgaagctctctcagaattaaatgacaacatgccatggctgtttgttagagggaatggaagtagagattgaaggtcttgatttccagctgatcatcctttttatggtaccataccactcacccagcctgttgaactggaaaagattatgaacatcaggcattaacctaccaaagtaaagcaaaacaaaaacgctgaacttctccatatttttaaaaatatgtgacacatatatgtttattggaaattaaaatacagtaaaggctctttaactgtcattcaataaatattttttgaatgaacgacgatcacttgtcaataactggtattaaaaaagacaaatattaatggtgatctttattcaataatttcataaaatgggaacaaagtggtaatttgccagtaggatgaggagggcatagcagaggttgtctaaccttttggcaagggcaaagtcaaactggtgaataagcaacacaagctgtgatgagagtcatgtgccatatgtaaatggtgactctttcttcctccaatgctgtttatcaccacaggcttcccagcggcccaagaacagtctgccgcagtcactggcattaataaatgccatctctacctgaatgcccttcttttcaaatttttaccaaaaggaagatagtagactttcagttttccttctggctgtgagaggcatagggagaataacggtaacagatgcaggaataaaaaggcttgatacacatggatattatgtcatgagggattcaggagtttatattaatatacaaatattagttgttttttttttgtttgttttttgttttttgttttttttttgagacgtagtcttggtctgtcgcctaggctagagtgcagtggtgctgtctcaactcaatgcaacctccgcctcccgggttcaagcaactctcctgcctcagcctccccagtagctgggattacaggtacctgccactgtgcccggctaatttttgtgtttttaatagagatggggtttctccatctcggtcaggctggtctcgaactcctgacctcgtgatccacctgcctcagcctcccaaagtgttgggcttacaggcatgagccattgcacctggccccaatattacgatttatcctgccctacctcaccactcttttcatgattagagatggaaaaatttgatattatttaaaaatcagtaagattctatctaatcaaaccattggcagtataattcacaacttttttagagattttctaaagtaatacagatactgtagtattgtagttttgtagtatagctacaagaaaatcatactgtgctctgaaatgctatcttagtaacatattgtgttaatggattataatggtaatcaaaacctccatagagctacaggtttgaactctaacattctgtcgaagttaaagattaatcagtttaacaccatattatttttattatttttgagacgtagtctcactctgtcgcccaggctggggtgcagtggagcaatctcggctcactgcaagctccgcctcccaggttcatgccattctcctgccttagcctcccgagtagctgggactacaggcgcccgccactacacccggctaatttttgtctttttattagagagagatggggtttcaccgtgttagccaggatggtcttgatctcctgacctcgtgatccgccctcctcggcctcccaaagtgctgggattacaggcgtgagccaccgcgcccggcccattcctagtattttcaaatagaaatctgatgcctttattactgtaattagaggaatgcttatgtttcaggttgggttttggtaaagcccatgtggagaggagaatttgcatgaaagtagtttaattaaggaaatgttctcagggatggcaagtaggtgagcaagagaagtagaataggaatggggaagaaatcatgcaaggagcaatcgcaggcaaagtgccagcctcagtctggttctgcaggaaaacctgggcctaaactatgcttcagcttgttgcaacttgatacagaaggagctgggcttttgtattccagtagtcaccagtcattgccttaagactaccctaaggtgacataaacaccaaggcacttccggatctctgtttttgttggcaaagcagctttactagcctgaagacagtcatctaaagagatgtagatacagaagttttgagaagcaaagaccacaaaagccaaggaggtgggcacgcagaagtgttaatggaatcttagtggatctggataaaacacgattttttggctataacctctaaagggctaactttcagaagattacgtggacccaattaagcacttacctgaataattttgaaacatctctaattgtactatagctagagttaaaagaaaaaatattttctaatataaacaaaaagttcagaattatagcattattaaagaagcttttttcaaatgttagcattcctgcttcttgactttacatttttccggaacaaaatagttttccaaagagtatacttaatgacttgtgcagatgaattctaaatgataaccacagggctcttggacaagggatcatttaaattttgagttcttgtcagtcagacatatcaatccatatacatttccccaaccagggtgtcagaagtgtagtcaagtgagttttgtaatgatacttctttgtttacatctagctgcagaaacctcttaagactgattctgcatcagaataattgctagagggaaaagggaagctgtgattatgaaataacactgttatccactggcacccctttgtgtctatcttagttgaagctttgaggcacttctgtgtctattatttgattttaattggcaatggtattgattataaatcatttgacagaatataatttttatcttaaagtttaaatgtacctagaggctacaaagattcctgcgttcaatgaaaacattaaagtaatagtgtaagtagtttaaatgtgccccatttggcacagattagtgtcacctatggtacaactcagtcaaaaagtgaatgtagctgaaaactgaaactgttcaacagctccaaatttaagaaacacggaacattcactatgtgcaatagacaatgctagttttagtaggggattaaaaaaaaatatctttcagccaggggctcataaagtagtgaggaaacctacaacaacttcaagtcagataatgacaatatgtcattaagggacatgaacaaatgaccgagagaccgcaagatcaggagggactttttttggagttggttataaaggaatggcaaggcacatgggaatcaagaattcattcaaacagagccttgaagaaaggtgttggtggagtggaaggctagaacacaaaaatacaatctacagaataagaaagcactagggggcaactgtggttggagtacttacaagaacggtttaggaaaataactagttgtactacatagactaaattggataactgtcaagatttgaggattataggtgaagaaaccattttagagtttattataactgacattttgtatctagagacaacagggatatcagtattgatgtaattaaaggatgtggcaagaatgaggtgaaaataacttatgtcttagggctgaaaaattgagaggatggtggtatcattggatatggttagaaatagaaataagcaaaactatgatggggaagtgatttgtatttgggatatattgtctttgatgtattgatgggatatccaataatctccggaaaatatgtctggatctgaggagggaaatcagtgtgtgtttgataggtgtagcagtgagaaagtatcataggcaagataccacaactaaagaaaatggtttgggggtaatcaatatggagtttaagccatgggggcagatgatacggcaaaaggatattatacacagttaaaaaggaacccaaaaccaagtcttggagaattcacatttaaatacgtgcagatatagagaagccagcaaagaagtgttaggagaagtcacaggaaactgtaaagtgtctggtcacagaagcagcaagaaaaacagtttttaaggaggtgactacattgaccaaaggcagtgattgaattgaaatttacttggggtctgagaaaagaccattcggttttctggttgctttgactaattttaaagtaacaatttcagtggagtagtagaccataacctataaatgcattgatgtatttatttattcattcactcactaattcacttatccaatagtcattcatttattcttcggtgcttacaaccgggcctggcactggattaaagtgaaattagaagtagataaactggtagagatagccaaaacatatctccctacagaagggaaaagagcagaaaattatcatggaaacactttgcatagagtttctcacagcaggttgaaagtatcctaaggttatagcagtgtaggctggaggaaaaggagaaaatacagactaggcaggacaggcactggggaaattcaggtgtaactaagaagagactgagtgctgggagacagggtgtaatctgttaaatagaaacataggcaatagtaaatcagggaaccagaaagagttcaagagtcgatgaagagggacatgtatcaaggtctcgatcgagagggctgtgattcaaggcagagcctccattccagagggagcttaggatactcttctggttttctattactatgtaacaaaacaccccaagtacagtggcttaaaataacatctcttttatctttttatctgattttgtgaatcaggaattcagccgtgttcagcttattgatttttctactctgtgtggtgtcagttgacatcacttggcagaattcagctagtggatgtgctggtctggagggttcaagacagattcacttaatgcttaatgccattgtgagaatggctgaaaggctcagttcagcagggactgtcaaccagaggacttgtagatgtcttctacagcatggtggtttcagggtagtcagtttttatgcatggcatcttagggctcccagagtgagtattctaagaaacccataaagaggctaaaagttactaataatgatctaatcttggaagacctataacatcatattcgttgcattctacttggcagacaagttgctaagacaaatccgagctttaaggggagaattagatgctgcctcttgatgaaagaagtgtcaaataattttgtggccatttctagtccatcataactgctgtaaatttcctcctcctaccatggtattgagtgatgcatatctcacaggaggagagtgtgtcagtgactctagctgagaagggcagaagaaagaagatccttgcacaaacaagccaggcgagagagaaaactggcagtttttaggaaagaaaagagatgcatcttggcaggaaacaattgatggtagccagagttcaaggctcatgctgaccgttcattcttctacattttctaagctcaatctttgtatcaatagagaatatcagaaaacttccttggggaatcttactttggctctctgtaaaaatgaacttgtcgcaatgttctaccctcaacaatgggtgaacacagatttaagaaaaagacatgaaaagcttatctgttcttttgtgaaagtgccaaacactttctgttaaggttttcattgttgttaaagtgaaaatttggtatgacagctgctgtgagggatagacttaaggccttgcaactcaaattatggtctgcaatctaggagcaccagttgaggttttgttagaaatgtacattttcaggcgctatcctagacctcacacgagtctgcacttgactaacatcttcagaggtttcatgtgcaaacaaatgttgagaaactctgatctaagggatgtttcattattcagatcattgcaaaggacttgttaggttcctgttcttggtcttgtccctgtggacttcagattgaaaatcttacccttagcttaggctaagataaaattcctttccttttatttgatggcaattatacataacatgtcattacttgatttttattcgactttggagaagcaaagggttttggctaatttttagtaactattcttagcttttacaatgttatcattttatgtttgcattttttcctagccttatttagattctagacacagaataggggactgtgagtgctgagagtatccttagagaataaccactgtaacctacttcattttcatataagaaatgaatgctcagaaatgtgccttgatgtactcatggctacttaatcagtggtaaagctgagcctagaattatttcctcaaaattgtagtcctctgtacacttggatcagaattaacaggcaatgcatgtcataacgggctcatccaggtggttctaatatatactaaagtctgagaaacaggcctgagtgtagcttcaatgtctgctctctcactctaatgcctactgcctgccatatctagatgcctgtgtgtatgtgaacgaggagggaagagaattaaatcctagagatgttggtagccaattatctcaaaagcacatatttaggggtcagcttttaaaaggaggaggggggcttattcccctgacatttgagcaaagcaggaaagggtcggtgatgaaatgccatgtgtcctgaggacctacaggcctgggttatatgaccacttcaggaattgcatagcaatcaaaaagggaactaaaagaatcggaggctgggtaaaatcaggactaacaattgataaagcaattatgatcaacagtgagtgagagaaggagatttacctgatggtgaggtggtagccaccactaagattagtttaaataagattagccaccactaagagttttaaaatgaatgcatgaggcactggagtcttccattgcttctcttgccctccttgatgtcttctgacaggagccatagagatctttataaaacacaaactagatcatatctctcctacccaaagcctgtaaaagcatctctattacatttagtttaacatctctactgtggcttaccccttatccttctttgcccactaacttcatttagcatccacttcccctacttccctttgtgcatcttgtgcctgctatctgtaattcttccctttttataaaatctcctttttaagatcataccttgaattgtatctcttcagaaagggcttcctatagcttagccttaaaattctttttcagttgactttatttctaccttagcatgtaaaatgttgtcatctcttatttgttgttcatcttcttgagacagtaagctccagaaatgcagaaactaaatcattattcaatctaacctcatgtgatatctgtcacattgtagataatacttgaattttaaaaaggggacagaagtttcaagaacagtatactgtggtttaagtgagcaattcactgtgtgtgatccatggggtaggatggttcgaggtaggtgagaaagcatgaactggccatgaacatggacgcaaattgatcaaagtcattgcagcttagcaggtcaaaaagctgtgaggtcagagcatcagttaaaatgttcaatggtagttggtcatgatggcattagcaacctttaaatttaaagggacttaagtcacatccagaaatcggggatgacaagcctatagtcatcctctcttgaagtcttctgctgatacaagtaatcattcagtctgttggtctctatccccatgtcaccaccaacgatgactgggatccagtcaagcccttggatatcatgtcctctctcgtgtccttttcataccaatttaatcatgcctggagtgcccagaagcatactttcagtctcgcctgctttgacacctgactcattcatgccttaacctactgtgctagtgttatgatggggagggagggggtgactgagtggatttgacctcccaaaccatattctagcaagcaaggtacatcttaactctggaattcttctaaacctatatagggtttctgaaacttagtctcagagtgggagtggaatgatacagtactttgtcagaagctcataacaacgactgtgtcttaccataatccattacaatactgttcttgttccagttgaacagctggaagttgaaaaacatttcctttggaatgagtcaaactgtatcttacacaatcttcccagctcttatttacgagatagataatgtcattggtgctcaatatactaaggatttttcaatgcagggctctaatcttatcaatagattccagggaattactgagaaacacattatttgatccttgatgtctctttccttgtatttttatagtagcacgcttgaggaagtacacatatatagcttccaagaatgagggaaggcatcagttaatatgttaaaatagaaacctcccacttgatcttaagtatggggagggcgggggaaggagacaagccttaagcctgtttaccattgcaggtaaacaaacatgaagatcaaattctaagtaaggagagtttgttatggaatagctgagactgagggcataaagacaaccattcaaattattctagggtttcagaagacactgaagaaagaatagggagatgaactgttggtgaagcagagaggaaaaatagaccaagattaagagaaaaaaaacacgggaaaagattgcaggttggaggagggtgggtctatccaaggctgaggtcgaagcttacggcaaggatgcaggggaagaatgttttgttaatggtaaatagattgcaaaaattctgtagtttgcctgttcattctgatgatgggttttgtggttttttttttttttttttttttttttttttgctgtacagaagccttttagttctatctcagttgttaatttttagttttgttgcaattgactgatgtttttgtcaggaaatcaaaatctttgcctgtgcatatatcctgaatggtattgcttagattttcttacagggtttttatagttagtgggttttgtgtttaagtctttaatccatcttgagttaatttttgtataaggtgtaaggaaggtgtccagtttcagttttctgaatatggctagccagtcttcccagcaccatttattaaatagggaatcctttccccattgcttgtttttgtcaggtttgtcaaacatcagttggttgggtattagatgtgtgatcttatttccaagatgttggttctgttccattggtctatgtgtctgtttttctaccagtaccatgatgttttgggtagtatagtctgaagtcaggtagcattaggcttctagctttgttatttttgcttaggattgtcttggctatatgggctcctttttggttctgtatgaattttaaaacagttttctttttttctaattctgtgaataatgtcaatggtagataaatgggaatagcattgaatctataaattatacagtatggccattttcacagtattgattctatccatgagcatggaatgttcttccatttgtttgtgtcctcttagttccttgagcagtggtttgtagctctccttgaagaggtggtgcacttagcctgttagctgtattcctacttactttattctctttgtagccattgtaaatgggagttcatacatgatttggctctctgtctattgttgtaggaatgcttgtgatttttacacattgatttttgtatcctgagactttgctgaatttgcttgccagcttaaggagattttggggtgagacgatggagttttctagatacacagaagagacagtttgacttcctctcttcctatttatccttgatttctttctcttgcctgattgccctggccagaaattccaatacagtgttgaataggaatggtaagagagggcatccttgtcttgtgctggttttcaagggtttgtcataccaaaacctacagccagtttttgcccatctagtatgatattggctgtaggtttgtcataaatagctcttatttagagacatgttccatcaatacctaatctactgaaggtttttaacatgaaaggatgttgaattttatcaagacttttctgcgtctattcattcctttgcattcttttttctctaatcttgtctgctggtgttatttcagcaagataatcttcaagctctgaaattcattcttctgcttggtctatttggttattgatacttgcggtagcattgtgaagttcttgtgttttttcagctcccttgggtcatttatgttactctctagactgataattcttgttaacagctcctgtaatgttttatcatggctcttaacttctttgcattgggttagaccatgctcctttagctcagtaaagttcgttattactcatcttctgaagcctacttctgtcaattcagccgtctcagcctctgtccacttctgtgcccttgctggagaggagttgcaatcacttgcaggagaagaggcactctggctttttgagttttcagtgtttttgttttttgattctcatcttcatgagtttgtctagtttcaatcttggaggctgctgacctttggatggggttttaattgggattttttttgttgatgctgttgttgttgctttctgtttgcttttttaacaggtccctcttctatagggctgctgcagtttgttgggggttcgctccagaccccattcacctgggtcccttctgcacttggaaatgtcacctaaggaggctgcagaacagcaaagatggctgcctgctccttcctctagtatctctgtccctgagggtcactgaccagatgccagcaggaaccttcctgtataaggtgtctagcgactgctgttgggggtgggtctcacccagtcagggtgcacgggatccaggacccacttaaggaagcactctggctgccccttggtcgagggggtttgctgtcctgggggaatcccacttgtctgggcttcccggattctttagagccagcagggtaaagactaagtccgctgatctgcggagaccatggccacccctccccctaggggctcaggtccaggggaatcggagttctttccctaaacccctggctggagttactggaattcctgcaagcaggccctgcccagtgaggagggatgggtcagagtccggcctaatgaggcaatctggccattatttgccatagctggtgtgctgtactgcagggaattcctcctgggttcaaactgtccagtctccctcaaacctgaaggggaaaaatggtggactggagctgcagtgatggctgctgccctccctacaggagctcagtcctctcagtaagccggtagccaccgtgatggctgctgcccctccccacagcagctcagttctcttaggtggcagttctcttagatgccgcccctccccgggagagctcagtcatttgctgtaacaggcagctgcagtgatgatggccgcccccgcccccggaaactgagcagtcttaaggagtcgtctccatccgagtggcctgcgagaatctgcacagctgtgttttgagacccaaggccctgttggcatgggctcgcaagtgggatctcctgatctgcgggttgcacagatctgtggaaaaagaaagatttcccaggcagggtaggacaatcactcactacctcccttggctgggagtgggagcttcccttgtcgcgtttggctcccaggtgggccatggcaccaccctgcttttccttgcgctctcatgccaactgcctagtcagtcccagtgagagaacctggacacctctgttgctggtgcaggattcactcacggttttggttcttctcagtgggagcctctgactgcagctgttcctagttggtcatcttggcctctctccatatttttccatttttgatgtaactttaagtttttgcttaaattcccatattggatattacagtctaaaatcaagagaaggttaatgtggaccgagccattatttaaatttaaggttcaaagaggtaggtcattcagccaggtgagtgagcaccaatcttttaaaaagttggttaactatttgatagtttccacttttcaagctgataatgatattttaaaccaaggtcatttcaatttccttttggttcaatatttttggaaagttgctacctctttgaaataaaaatattttgtacaggattgtttacaattagcaaatgtttgctgataaagatgaatcactgaattaggtaccttttgtagttatgtaataaagctcttggtaaaaacttctatttaagcagttataactaatttttcctattgaaatgtcaggtacctattaagattttctcatagggcaattttaaattttttctttgagctttgtaagaaaaaaattgtcaactctactttcctttggctcttattcaactttattttaaaatgcatttttctagaaacactaactaaaggtgacagttttagttcacagggaactatttttgatttactatttttgttttggaaatgtctgaataaaccactggaaattatagcttataatgaagaaaacaagataaacacactttttatctaaagtgacagtaaaaatctagcaaatgggagaaaaataaagtcaacttttttttttttttaacttctccaattgaacgtcaaatgaacatattgggcaaggaatacaaccttagttgcatttacaatacagtggctacaacagaagagttaaacactaagtcttacgaaaggtagctttagaaatatttgaaagttggccgggtacggtggttcaggcctataatcccagcactttgggaggccgaggtgggcggatcacgaggtcaggagtttgagactggcctggccaatgtggtgaaaccctgtttctactaaaaaaatacaaaaatcagctgggcgtggtggcatgcgcctgtaatcccagctacttggaaggctgaggcaggagaatcgcttgacactgggagacggaggttgcagtgagctgagaccacaccactgcgctgcaggctgggcgaaagagtgaaactctgtccccccccccccacccccccacccccccccaaaaaaaagtgtgtgtatgtatatattaaggttgacactgtatttaaaaaatttctatgaaactgacaaaactattgcttcgttaattcttttttgcaagattgcattggaggaactgcatggaatataatgactgtgttcttttctaatagcacatgagtcagatctctagaaactgacttttgcccatattcaatttcagcagtaaaataatttctagcttgatatttctcataaaaactcctagggctcttttaaaaatattttataaatatctttataatgtggcttaatttttcagacatcttctgtgtagaaacaaatattcatatgtatgtacacatattagctattgctgtgtaataagccaccttgaaactcagtaggttaaaacaaccaacatactatttcaaatacatatgttagccaggaagttcttcaccttactgctaggattactcgtgtgtctctagttagctgggggttggctaaggggctttgctgatctcagctcagctctgcgaaatgtctggctgtctgctagtctgggaaaacttcatctgggacaactagggcaacttgactcggttccacttgtctcatcctcctgctgtctagctctgatgtgctcttacggtaaatgcagaggcatgaacaagagagcaaaagtgttcaagcccttttgaggtctacatttgggagaggaaatgccagcacttcaattgcactctgttggtcaaaatgagtcaaatgccaacccagatttaagaagcagggaaatagataccaacttttcatgagaagaacagcaatgctacattgcaaagggtatggattcaggaaaggatgaaatactaggcccaattttgtagttaacttaccatttacagcagttgctcctggacagtatggcttccttgccaaatatttttgcatgcaaataattggtaaacagtgccaatattggtttttcctaaacaatactatgttaaagtgtcagtcaaaatatgaattaaaaaatgcaaaacatggtaagagcttctcaaaattagttatgtttgaaagggtgaaaagaaaagacaagcagacatttgcctaagcagctttgggtggttaatcaagtcggtacactcggatggggtgtcttgtacctctctagtctcatgttccatccgtccacttacgttccaagaagtggcttatagttccttgaacagtgcgtctatttcatctgatccttagcatgtgaagtttcctctgcttgactttatcttccctttacacttctacctgttgataacctgttcaaccttgtatattctattcagggattttcactctgttgttctctccagtgaagatatcttttatttgtgccagcaccatacttacgacaaaaaaatcactattaataggattataacaccatgctataattatattcgcttaaatgtatatttccttcctaggctattacaaaagctgtgaaaacagtggcagtatgtttttatcttttatcttcccatttttcttaggacagtatgatgcataatactggttacatttagttgaatgactatccccctcgtctgacacataaggaaaataagccaagtgctatgtaatttatcagtgttcacacaactggcaaaatttaaattatagaactgtaataaataaaggcctatttgcttccagatactatattatttaacttacaactacaccgaatctcacatggaagactttcaagtaaggaactggcacttttcagtggatcttaagaaatggctacactaaatgccctagttaaactttttcttctgtttactactacctcatttaatccttatcaacttcaaggattatatttcttatattttgatttatatagccttaagtttttgttgaatgatatttcttctttagttaatataaaaagccacatttttcaaatacattagagtgaattatacattcgaacaatttgcagtgtgctctaaaatagtatttagtaattgagtctgctgagcacactggagtcctgaggagttaatgaaacccccgatgtcaaatgatataacaataggaatttgggactttgaagaattttcctaatgtatatatgtagaattatcactgttactatctttccattacaaatgggacctacaattaggagcaattttattggcaggctatataactgtatctgaccttttggaaatgatagaagaaagaaaagatatattaaactatctttgtagaaaagatgacgtaaaggctcaagtaaaactcacctaacccttgcccctgaatgtgatgatagtcaagcccagcttaaacagcagttgcaaagtaaagaatggtgtagagatctgtagatacactgcctaagtccaaattagtatctagcacttacttgctgtgtgaccttattcaagttacttatattgtgtctgtttcatcagttgtaaaatgggggtgactgtgaacattaaaacaacccacaaaaagtacacagaagtagcgctgacataaaccagtcgatgtgtgtaactcgcatctttctgatacatgaggtagagtcatataaaaattgtaatatttgacaatatttgacttcagaattggaaattgcataaagttggaccactaaaaggaaataaagcatagcagtgacagacgttctcctttaaatattttatcctctgtgacttttgacagaagatcttctttaaatattgtatcctatgtgacatttatcttttctgtgtttccaatttctttgatttggaacttcctgtagacagacccttacaggcatggaagaagaaagaatgaataaaccaaggatgacttcccagtaggtggaggatgggaataattaggaagaagctgtgtcttgtcacctatattgtccatacacaactgcaccgtagggtaattgagaaattataagaatggtaataaatacgttttacattcattaattaaagtcatctttggatgccctttgtccataatgtttcctctactagatctgaagcctaaatatcacttttcttctctgcaatttccctggaactgagtactcatagatgtttgtctagtgagccattccattatgtcatggtatatgtgtgtatttgtgtgtgtgtgtgtgtgtgtgtgtgtgtgtgtgtgtataaacacaatcttttttttttttttttgagacggagtctcactctgccacccaggctggagtgcagtggtgcaatcttggctcactgcaacctctgcctcccagattctctcccaccttagcctcccaagtagctgggacttcaggcgcgtgccaccatgcccagctaacttttgtatttttagtaaaggtggagtttcgccacgttggccaggctggtctcaaactcctggcttcaagtgatctgcccttctcggcctcccaaagtactggggttacaggcatgagccactgcgcctagcctatagatttcttttttgaagaatcagtgttatttgcatgctttgaaacaaagtgcttcatcttgccaaccttgtaccataccgtttctgtcagaaaagcaaccattgggatagattgtaattagccttcatttccatcactggctatctcaaatgcaaatcatgtatctatgtgaatcaaaagaaaaactggatttaggcctggtgcagtggctcatgcctgtaaatctcagcactttgggaggctgaggcaggtggatcacgaggtcaggaggtcgagaccagcctggctaacaaggtgaaaccccgtctctactaaaaatataaaaaaattagccaagcgtagtggctcgcgcctgtaatcccagctactagggacgcggaggcaggagaatcgcttgaacctgggaggcggaggttgcagtgagccaagatcacgccactacactccagccaaggtgacagagtctcaacaacaacaaaaaactgggtttaactttcagaatgttcaattttataggggatatttaaaggtggtgtaattagtataatcatggattgtaatcattccacaaattttaaaataactttgtgaattacattaatacataaaaatataagataaagcatttaccataattttattaatatttcctttagaatacctggtaaaatgaatgagtactgacctaacttaaagataaaacaattgagacctagctttagaagttagttttattacaaaacatgttaaggatagacctgatcagacaatgaatcatgctgactttttgttaagcatacttctgggttcataacatcccacttacatataacaacttgatttccattaacgatggtgtggtttcctatttaaagttcgaatgcacatctgtttgaatcatttctagtgtacttaatagagtaacatacatattgggttctagttaagatgctttataaaatgccaaataacattttatatctggagagattataaaaacttgtattttgtagctttgctcttgaacacttgctagctgcaaggaataacttggctttttcttgatgatcttcatagccagattttcgtgctttttttggtagagagaagtctctacaagtatttgacgctaaggaataatgaataaatacctactgattttatctgctaaggtccacaaaacattccagtattttgatatcactattaaagaagacgacggtgttccagtgatacatatgattccttacaatgacatcaccagagatagaaatatgaggcatgggaagtaacacgtaggccttcatttattttctgatatggacatccctggcattgatctccttggctcaaaggaaatttgcttccatgtctagggtggtgaatgtctttggcttatttctttggccctactctccacttttgtcttccttgggaggctgatgtctgtggactacatcaacaggctcctttgccctctggctactagttggatttggccaatgagagccttggtaagagagggagagaggaaagaaattccatcacccaatatcaaagctcctgtcagataatcttctcttctcagttctctctctatgtagtaactagaaaccactctccttcttttcattcttaggagtctaagagtagtagtgacacttctctattactagttccagtggtttcattataccttccctcatttttataaacagtcccttattaaactcttctcagattaccaaagtcctgctatggccatataaatttcaaaggagagtgtcattctccacctccaggtgataacatttaacaggagggaatgtaatttatttaatgtttttattgagcattttctatgctaggtaccataccagacatcttacatttattaacccttttaattctcatattttgaagttggtcccttctgttactttgaggccaacattacaaggaaagttatagacgatatggattatttggcttagaaagtttggaataaacgtgtgatagctaacacttacagaatatatcttacaaagtgccatactaagttcacttaaatctttgcaatatcaccacaacataggtaatgatacatgctctttctatagatgaaaagagtaaggcacggagaagttacttgcccaagatcacactgcagagctgggagttgaacccaaggcattctgggtgtacagtcaacattcttattcatggcatcataccattcccccgtgttttccaaagcatattttatcagtgtgacttttttctaaattccctctgcataaatctaatgtatttcagtcactagtattctaactcaaaatacaaaaccagcatttttctatctttaggtgactcctttcaagagaaaactaacctatgatgccacaagtcgtcatagtggccattcttgaggggagcttccacatagggggtgtgaggaagctgctagggtgttgatcatattctgtttcttaaatctcgatgctggtaatataaatatgttcggtttgtgacaattcattgagctgtacacttaagacgtgtactttcctctatgtatattattccgcaacagaatactgctttattatacaataccttttccaactcatatttaagaaaacaaaaaaaaaatcaactcggaaagcttcctatttacatgaaaatgggttgccttatttttctgggagctggtcagcagcgttcttcagtaagttttgaatccccagttttgcaattctttgtggtatttgcgatatttttggtgtttccaatgtctagggatttgtaattgcagaagtatcttgactttcttagcgacagttatgtccatggcttgtcctttttgtaatcagaaggtcatgctaaattatccctgtgttctttactttctactgaaacgtattgatccctttggattttcaggttaaaagaccaatacaactctgaagaatcagaaaccacttaaacaccttcacaaatgcatttcctttctcaaatttttttactttgatttgttccactttgatttggttcactttatttatgccacttgtcaacctacctatctgtgtttctttttgaacactgtttgtgcttccgtatttctttatttcatactaaaaaggatttggaaggaatactgtctcgtttttaggtcctttcgtgttgtggtttgggttaacaaagacaatatatatgcagatacattaaactgagtaatatcagatatccactcagttcacttgataagggaaatcttagtcataaaatgaactgaagacagagagctacagggtcgcctggcccaaggaggaattcatgttttgtgtgcttcacaaaatagttctcatacacttgaaaaggaagccattaaaggttgaattttaaagaaaaaatattgttcttaggatataaaatgccacctgcaacaaagacatggtgtatgttgaagatgaaaggggagaacaacaaaagaatacttaaaaatagtcaaaagaacaagaaaagggaggaaaaagcaagtttctaagtgcatcctctgtaccatctgcattcaccagttttagtaattgtatagggaataatgccttcccctattgacttgcactcccacagggatgccaaactaatagaaaacattttacatgtattctgcactttctaatataatatttttatattatcgaaaagactttaacttgtgtgtgtgtgtgtgtgtgtgtgtgtgtgtgtgtgtgtgtgtgtgtgtgagatcttgcttcgtcacaaaggccggagtgcagtggcacgatctcggctcactgcaacctccaccttcctagttctagcgattctcctgcctcagcctctcgagtagttgggatcacaggtgtgtgccaccacgcccagctaattcttgtatttttagtagagacatggtttgaccatgttggccaggctggtctcgaactcctgaccttaagtgagccacctgcctcagcgtcccaaagtgctaggattacaggtgtgagccactgcacctggccgagttaaacgtttttacacctagaatttggtcaaagaaagagatgcagacaaatagtgttaaaatgaaacataaaaatcaatctatatttattgagtgcatacgatttgccaaatctgtataacgttcctatgtgttgcagttgaacctcacgggagtgctctggagtaataatttgagccccattctaatagtgaataaattgtgcctcagaaaggctgtcacttgcccaagataacacagctagtgagtgagtgagagacctgagttcagaagttagctatttctgcttctgaaacttgggttacttttgctatagtatctataattctatagagtaagttgcaggcaggaaaattagaaccatccaagagaaatagtatgttagattttacctggggtattcatactacagggagaataaaactgagcaccgaaaggtctataaagttacaggctaaatgtagcacatttcactaaaaaaaaaaccacatcagaccgtgggaacgggggtgggggagatttttactcaaaagtacttaaaattacttttacataagtccaggtgtgatggctcatgcctgtaatcccagtactttgggaagctgagggaggcggatcacaaggtcaagagatggagacaagcctgaccaacatagtgaaaccccgtctctactaaaaatacaaaactgagctggacgtgatgacacatgcctgtagtcccagctacttgggaggctgaggcaggagaatcacttgaacctgggaggcggaggttgcagtgagccaagattgcgccactgcactccagcctggcaacagagcgagactctgtctcaaaaaataaatgataaataaatagttttacgttgaaacaagcatatattaaaagaagaaggcaaaatctctaggaatttttagcataaagtatatgctttcaaagaaatttaaaacctgcaggcactgtgtaatttatactgccagactccagggtaaattccttcaatttcatttcctggaaggatgctctggtagaatattctgagaagcactctattagagaatatggtgaatatgactaatagaaattggatttcaattgtgatactttaatatatcattgactctgtgagtttcgaaaataatacgatagcaggaactgtttctctatcacctcactgctttctctctctcggtgccccagctaggtgtacatggaatcccctacctgacctataatcctttactccctctccattttggttacctccagttttaaaagaagacttataaaagaccttggtctatgtatttaagtttggcccacaaagcaagattctgtctgcgtttttgacctttgcctagactttgtctccaaacccaaacgtagtccttgtgtcttggatgctatatgatcctgatggctttgggattcatgttttattctgtactccaagacttctctcacctttcccagtctctgctcctctttttgaataaacagcagtttatcacgcacatacttcttggtctgacagacttcaactttctaccctggattttttcttttcataaaaacaagtatctctgtcagttaacagttaactatattttcttcaacaatggacacattgcagtgcataagattattttttgatgagtttaaaagtcatgctttgctcagataagtgtgaaattttgctcctggccaaaggagggaaaaaaacacatcattttaatggcattgtataccttcattcaatttgaaaaacaaattattacactcaaaataccaaattattccaggttagatatgaagttcttggcagcactattagaaagtgtaaatttattttcttattactagagagctttccttaaagtttcattaaaatggcactgttttaagatttatgtgtatattatgtatagtaaagttgctttgttttagattaaatttatggatacatagtatatttagggggtaaatagatatattgatacaggcatgcgaagcataatcatatcagggtaagtgaagtatctgtcacctcaagaatgtatcctttctttgtgccacaaacattccacttcaaatttttttttttttttgagacgcagtcttgctctgtcacccagggtggagtgcagtgatgctatctgggctcattgcaagctccgcctcccgggttcacgccgttctcctgcctcagcctcccaagtagctgggactgcaggtgcccgccaccaagcccacctaattttttgtatttttagtagagacggggtttcactgtgttagccaggatggtctcgatctcctgacctcatgatccgcctgcctcggcctcccaaagtgttgggattacaggcgtgagccaccgtgcctggcccaaattcttaaatgtacagtaaattgttgactgtaatcaccctcttgtgttgccaaatagatcttactcattctaactagatttttgtacccactaaacattcccactcctcctgtccccaactacccatactacactctggtaaacatcattctactctctgtctccatgagttcaattgctttaatttttagttactgcatatgagtgagcccatgcaaagtttgtttttgtgcctggcttatttcacttaatacaatgtattccagttccatccacgttgttgcaaatgacagcgtctcatttttttttatgactgagtagtactccactacgtatatatgtaccacattttctttatccattcatttgttaatggatacttggattgcttccaaatcttggctattgtgaatagggttgcaataaacatgagggtgcagatatttctttgacaaactgatttcctttcttttgggtatatacccggcagtaggattgctggattatatggtagttctgttttcagtttttttgaagaacctcaaacagttcttcacagtggttctactactttacatccccaacaacgatgtaccaaggttcccttttccacacagccgcatcagcattgatgttgcctgtctgttggatataagccattttaactggggtgagatgatacctcattgtagttttgatttacatttctctgatcaatgatagtgacaaccttttcatattcctctttgacatttgtgtcatctcttgagaaatctctattcaaatttttgcccttctttcaatcagatgattatatatatttttttctatggagttgtttgagccccttatagattttggttattccttgtcaggtgggtagttggccagtattctctcctactctgtgtgttgtgtcttcactttgttgattgtattccttgctgtgtagaagctttttaacttgatgtctcatttgtgcatgtttgctttgattgcttgtgcttggtagggtattgctcaagaaatatttgcctagaccagtgtcttggagattttatcccaatgatttcttgtagtagtttcatagtttgaggccttagatttaagtctttgttccacttagattgatacttttgtatatggcgagagataagggtctaatttcattcttttgcatatccatatccagttttctcagcaccatttattgaaaagatggtcttttcttcagtgtatgttcttggcacctttgttaaaaatgagtttactttaggtctgtggagttgtgtctgggctctattctgttccattggtctatgtgtctgtttttatgccattagcatgcatttttggttagtatagctctgtagtataatttgaagtcaggtaatgggattcctagttttgtaaacaaggatcatttgattcttccttttcaatctggatgccctttgtttctttctttgatctagctaggacttgtagtaatatgttaaacaacagtagtgaaagtgggcatccttgttacagatcttagagaaaagtcttgtagtttttccccattcagtatgaaattagctgtgggtttctcatatgtggcttttactgtgttaaggtatgctgcttctatacccagttttgagagtttttatcatgaaggcatgttgaatttttatcaaatgctttttcagcatctattgaaatgatatggtttttgtccttcattctgttcatacgatctatcacattgattttttgcatatggtgacccatcttggcatccctaggacaaataccacttggttataacgaatgacctttttaatgttgtgttgaatttggtttgctagtattttgttgaggatttttgtatcagtatttgtcagagataatagcctgcagttttgttttctggatatctgtctggttttcgtgtcaggctaatattggcctcacagaatgagttcagaagtacttcctcctcctctttttcacaatagtttgagtattaggtgtttcaatgtttggtaacattcagcagtgaagccatcaggtctcgggcttttcttcactgggagactttttacatctttgatctcattacttgttgttggtctgttcgggttttgcatgtcttcatgacacaatctaattttgagtttggtttgctattctagttctttaagatgtattgtttctcttttttttttttttttgatacaagtgcttattgctgtaaactttgctagtactgatttatctgtagcccacaagttttagtatgctgtgtttacagttttgtttcaagaaattttataacttccttatgaatttcttcattgacccactgatcattcaagagaatatagattaattcccttgtgttttgtataattttcaaaattcctcattactgatttctcagttcattcaactgtggtcagataagatactttatatttcaattttttgaatttaaggcttgttttgtggcctaacatatggcccatccttgagaatcctccatgtggtgatgagaggaatgtacactctgcagctgttggttgaaatgttctgtaaatatttattaggtacatttagtctgtagtacagattaagttcaatgtttcctagttgactttttgcctgatgacgtccaaggctgaaagtggggtattgaggtttccagctctctttaggtctaataatgttgctttatatatctgggtgctccggtgttcggtacgtatatatttacaattggtatatcttattgctgaaatgattcctttattatatgttgatctttgtctcttcttacagtttgtcttgaaatatattttgtttgatgtaagaatagctactcctgttcttttttggttgctatcgacatggaatatctttttacatcccttaattttaagtctggctttgtaggtgaagcgtgtttcttgtaggcaacagattgagtcttggtgtttgttgttgttgttgttgtttgtttttttttttttttttctgtcactgtgttttgattggagagtttatttcatttatgttcagttttattattaagaacttattcctaccattttgttttctggttgttttgtggctttctcttccatcctgtcttcctttttagtgaaggcgatttttctctagtggcatgcttttatttcttgctttttaaattttgtgaatcttagtatatcttcttatttgaggctaccatgaggtttacaaacactataacccattatttcaaacagacaacactggttgcataaacaagaaagcaaagagaaaactaattaaaaactcaaacttcgtctcttttaatctttttgttgtttgtttatatctcattatactgtctatgtcttaaagttattagagttatttgttaactgaaagcttcctttttttactcttcttattcaagatatgagtagttcatacatcacaattacagtattacaatagtttgtgtttgtctgtacttactgagttttgtgccttcagatggtttttctggctagttaaggtcctcttctttccagttgataaattctctttagcatttcttgtagaacaggtctggtgttgatgaaatcccacagcttctgtcttggaaggtctttatctttcttgttggaaggagattttcactggatgcactatcctagcataaagggtcttttccttcagcactttaaatatggcatgacatgtcttagcctgtaagttttctgctgagaagcctgttactagttgttgttaagctttttggaatgtatcttttctcttgctgcttttaggatcctgtctttatccttgacttttgatgcttgccatctaggagccaaggcctgaagttgcatctttatgaatctatctggtgctctcttctattgtggcagagctggcacccaagccacaatacaaagtttgtcccattcttcctttcccatttcataagcagaggaatttttccccatggctaccactgcctcaggctcatggtgagtactgcctggctaccactgatgttcactcaaggcccaagagctttttagttaactaggagtaaacgctgcgaggcctgggtctctccgttctgtgcagtgggttctcctcaggccccaggtgagtccagaaatgccatccaggagccaaggcctgcaatcagagaacccaggagcttgcttgatggtctacctgactgtggttgagctagtacccaagctgcaagacaaagtccactctattgcctctcctttccaaaagcacaaggagtatatccccatggccaccacacttgggaatgcattgggccacacccaaagacagcatggctctgagtcttacccaagacttggtgaatactgcctggctactactgctgcttattcaggacccagggactctttagtcagcaggtgacgaattctaccaggactggattcttctcttcaaggtagcaagttcccttctggccctgggtgtatttaagaatgtcactcaggagccagggcctggaatggggggtctcaggactctgcctgatgccttatcctactgtggttgagcttgtgtccaagttgcaagacaatgtcatctttactgtccctatcctctcctcaagtggaagaagcagtctctctcaaagctgtcagctgcactgttaggggttagaggatggggtggtacaagcactggtgtcttactgggttgtgtgcccaccaagtcccctgacttcgagtccagcacgacaccaagacttgcccaggaattgcagtttttgtagcctagactccctttgaagtttatttaggaccccaaagtgcttgagctcacactggtgagactagctggaactcagcttctaactgctgagatgggtgatacctccctggatagggctggtctaaatgtgccctctatgtgcgcttgatgaattctgccctgtgttgcttcccactgtgacagggcagcactgggttccaatgcaacgtttcacaatcctgcgccctccctcctgcaagcacacagatcgtctacatgagacatggcctctgccaggggatgggggaggggtggtgttggcaattcgtaactgtctttcctaccatcttcagtgcctctttccttgatatgatattaaaatcaagtactgtgattgctcacttgatttttggtttttatgtaggtgcttgcttgtgtggctatctgttcagtttggtgtttctatagcagcggtagcgggaaagatgattgctggaaggttccatgtatttgaccgtcttgttctgcctccctcctagtaaagctattctttaaaaattctagcatgttagggttttgtgttatgttctttttcccatggaatttgaaaatggatctatttgagtagaatttcaaaagaataactcataatttttgtctaagtatatatgtggctggattcacaaagctgggcacacagggactggttggttgccgcaggtatcattgttccctgcttgaagtacccgggcatttacaggtcttgtcattgacatggctacctggttgtaggaatagtctaaatcctatgtttttaatcgtggaagtttaagggatgtcttttgcctggaaaccagggattttcttgacttgtgtgaaattcaaagtttatatgtgatccaaggagtgtatgtaaagagcacagtcacccaaaggctaatgttagacccatcacctgacgttttttggaaagtatttgttgatcccaaggcttgtgagagctcccactgttacatgttctttagtcctttctaatgcttctatgtaatagtaccttttaggaatattttctttgctggactctaagttctatagggtctgggcctatgtctgatgtactagcatatgattcagtacctagctcaggtttattcatgctcaatatgtctttgactgattaaattagggatttccagataggtgatgaaaaagctgggaattacctcatgaggggattgtagggttttaagcagaaaacgatttggtgaagtatgacaaaagaaagacaaatgttagaaagataatcaaatagtaggttataaaaggacaaggaagcaacataagattgaaagaacaagaacccagaattagacagatctgagccataattttggctttaccccattctagtttcatgacaaagagccacatactcatcttacatgagatacttagaggttaagtatgttactgctaatctcagaaatgccacaacggttatgaaatccactcatttaatagtgtgtctcatgagtatttacgttaaaaatgttaaatattatttattgactattatttttccttagtataattcctgagcaaagaactgagtaaaatagatgaaaagctctcacagggttgtttcaaacctaattaaacccgatattcctaaaatttgagttatccagtatgagaataggtcatagcatgcaaaatgtgtatgcacagcaagcatgttttgagtgataaggatgtcgaaccactctgactggtatattccaagaatggttaaactttatgtacccacccaggtagattgtggtcttttgcttctttgtgtatttacttttccctttacccgtaactgccttgatcatgcctgtattttttctctccttcatagaatctatattcatttcagtgaattaattagatcatttagggtataaatctcttactcttgctattcaaactaattcaaatagacttgacctatgataaaatttttaaattttttttgtcatttgaactttccttttttcatccgtcatcttcggcagattaattatgcacactaattatccttaaatatagctttagttttcaaaaggggataatcgtgaaaatgtatcattggaagtgtgctttgttaaattgagtgtattttttttaatttcagtttgggaagcagcatattgagaacctcttcagtgacctacaggatgggaggcgcctcctagacctcctcgaaggcctgacagggcaaaaactggtatgtgacttatttttaagaaagttaactttaaacttagtagaatttcagaccagaaactgacaacatagttttatgacatctagtagaatgactaggtactgattgaaacagcaatacctattccttagtaaagcaacctcgtatgattttcatttggcatactctaccgcctgcagaaaaagtaaaaatttcagtaatacaatttatattaatagatattattcagttttactacttggtatctatcttatcaaatatcttaatgaaggcttttatacataatgacttgagaaattatctttgtacttttgtgtatttttgaagttattttacaaggaacctgtatgagtttatacatgtgggatagcaaaataaggtacaggcattatagtgtaatacgtgatagcatatgtgatgaaaatatcacttcctcttgaactattatcttgtctaacttcagagcattcctgtgaagatacatgattgatatacatgattacagatcagtgaagtcatgttgatcaaggtcttacactggggggggaaagaactcaaattgaaatcccctgactgaaataatcgtcttagattgctattctaaaaagtagagtttaagcccccagtctatagtcataaataactgttctacctatcaaattctgctaaatcatagccttcgtctcttatctttgcccttcattacaactccccagcacatgcacatacacacacagacacacacagattttgtcatattatacaaactgaagctgtcgttcaaagtcagttagcaaaaatcctatctaccccagcctgcctcctgtaacacttaacgctaagccactcttttctcggtatatattgtcagatatctctgggtttttgcctgtattattttacttgcctgtatttctttttgtacttctgtctaccccaactgtctgccagaaaccttgatttcacctcagtaaagcttttcccaaattacctttgctaatttttccctcccaaattccacagaaggcccatttttgtcttgtttttagtgtatgtatgactgacatccctcctcaattaaattctgaagtcctatacagaagagacatacctatgctttcattttttatcttcagctatgtgagattaatactaaaacggatccatttttttcaagaagtctgaacttgtactaatagaagaacaacttgatgacatattgaaataataactttagtcaagggggaaaatcagatttaataccttatagctgaactgtttgctgggcgccaatttgaggtcatcatgtaaacttggtcttaatttcactagttagagatagatttgtgtgtaattcatctcctatgactgtgaacaatttacatatatatggatacgtagcatatgtacagaaatcagtgtgtctgtgtatctcgtttctcctgtattctgaagtcagtcctactttgttaccgaatacagaagtcccagtgtcttccaaatgttcgtgaaaaatctttcaaagattatggcttactcatcttgtcctggccctctgttaggaggctgttgtctcttcacttccaggtatctgcgtgatcacttctcctgtgttgcaatcctctggtcatttccctgactgagtcaatccatctatcacccaaagcaatttagtcagggttaacaaatttcatacataatgtttaagataatgaatttcagatcctttcgtaattcataagcatgatttgggtgtttatactcagatatgagataagcctttctctaaacttatgatgttggcacactacccatttgatataaagaaaaaaccactaatttcggcaaaattaaaaaatccacatgatttgcatttatgcatatacatacatagacgctaagacaaaatgaacctaattagtaatagcattaaagaaaaaaatatcaaacaaaatatccatgagattggccagtataaggtaagctagtggtagggaaaaatcaccaaacatttacacatggcagtgtagattacataatttcagatactgctactaacagaatccattcaccattgtttgtcctaatcacagatctgtcagccctggtctgaggattttgcctttctcataaagcagaatcacctctaacaaatgctcccgatcccagaactccaattcgctatgccttgtcttgaattctaatagtttctgtagagatatatcttctactcctaatgggaggcatgtatactatagaacagaaattttagtattctactcagaagcatctgcatttggattattggctcaggacatccccagggttaaaaggaaggtacttgccttacaatcataaaataagaaatactccccaaggagactctaataggggcagattttaagttcccacttcaggatcagaaactgcagctttttaaaagagtagactatgtttggttctaatacatatgcacatgtgtacatttaatgtttgaatatgatacaaaggaaaattttgctaaatcttgtgactatataattacataattgaaaggaaatatgtggctttggtctaactactaggcagagaactgatttgagtaattattttcaaaactttaaagtcctataattaccattaaacttgtatactgtcaatctatatatacacaagaagattggttatttgctgtttttctttcatgtattttttttttattttgatggaatcttactctgtcgcccaggctggagtcagcgacatgatcttggctcactgcaacctctgcctcctgggttcaagcaattttcctgcctcggcctcccaagtagctgagactacaggcatgttccatcatgcctggctaagttttgtatttttagtagacatggggtttcaccatgttggccaggctggtcttgagctcctgatctcaatgagccacctgcctcagcctccccaaatgtctggctgttgcttttttttttttttttttttttttaaatctaaagtcttatttttttcctctttttggtggaaagtgggagaaatatcagaatgtaaaccaacatcattctgacattcttggaggaaaatctaagaggtaaaaatggagattctggttcataaggttagccttaatgttttgtgaaatcaaaggaacaagatgtcaatactgtgttataaaggatatcaggcaagttaccttggagagtaagatggctttagcttaatttgggttgttcagcaggcagtgcaaatgataaggagttctagggtgaggaactacttgagaaagaccaggagctttgctggaaagtataggagttaaatgcaagacacagaaatatagatatttgtttggtgcatgcacaaggtagttagagaagaaggaaataaatttgcaagactggggctctacagacacagacaaaagtttgggtcctggctccaccaattattagttatatggtaatctatatattagatattttaacctgaggttcacttctgtacaatagggatgaaactaactgccttgcaaggcggggattaaaggtagtgcattcaaagtacttggcacatactacgaagtcaataatatttatgttggaccaactatgtgacaagcaccaatcttagtgctttatgcatatcgacacactgaattctgccagaaaccatatgtacaatggtttgagcaatatgaacaataagtagtgccctggacaaggtctggatcctgtgagacagcatgcttcatgtttgagtgagggctttgacctcaaatgcagagaagaaagtatgtcgaattctcttgtaaatcagagcagttgttattgagagcacatgttgtaacttgtgtatgcctcttgctaatattttcattaagtccatttttaacagatgagaaaactggtatacagggagattaaattttttatgtaggccagacagcacaaaaacagcagagctgacaattgaacccaggcagtcagctttgtagctcttgcccttaactgttacctataatcacccaaatgtttaggtgagaactttgcaagtggtttgcattggcagtgggcttacttcaggaacgtcattgttgatggtatgaaggaaggatgaaaaaaatggtgagtgagtggagaagggaaagaggttagatttctctgggcaatagctaataagggcttgtagtaaggtaaaagaaatgaaaatgagagtaaataaaacaggttatcataatggtagaatttctaaaactctacaacttaataaatgagttaatttgtatattacaatgaactatgcagatgttggtttaaaaattacaggataagatacaacttttgggattgagaataaaattagggaaccaaagtgattgaggtttagagcttcagtgacaaggacaattaaggtaatcttcacagaaaaggtttcctttaaccctatttggcattatataattttgctagagtcaaatctcctttagatttttctaaaaagtttgggaattgtttttctatcttactagaaaatgtttttatgcatgctgatgtttctgtcattggtggtcatgcagtaatccccaactgggctatagaatgaagaaacaatcataccaaaataggctttgtaaagaaaaagtgttgccattcttagagtggttggtttatgctaaaaacgtaccaggccaaggacaattagcgcaaagtatttagattcattatattaatgcctcacaggctctgttcgtttacaatattcaagcttaatagtgaaattataaatggtttcatttctagtagattgtcggtctctctgctggtcagtgaacactcttttgttttgttctcagccaaaagaaaaaggatccacaagagttcatgccctgaacaatgtcaacaaggcactgcgggttttgcagaacaataatgtaagtagtaccctggacaaggtctggatgctgtgacacagcatgcttcatgtttgagtgagggctttggccccaaatgcagagaaagtatttcaaattctcttgtaaatcagaccagttcttactgagagcacatgttgtaattcgtgtatgcctgattgtggctaatataattcaggaagcaaatgcatgctgccacagagggaagggaaaagacatagacctgacctgataggctgctccctgttttcagattttacttcatgaagctgtgtttggtggacaaagtcctgcagtcaactcggtttcttttcttactttgcttttctttttcttttttcttttcttttcttttcttttctttttttttttttttgagatggagtctcgctcttctgtcccaggctggagtgcagtggcgtgatctcggctcactgcaaactctgccttccaggtttaagctattctcctgtctcagcctcccgagtagctgggattacaggcacatgccactatggccagctaatttttgtatttttagtagagacagggtttcaccatgttggccaaggctagtctcgaactcctgacctcaggtgatccacctgcctcagcctcccgaagtgctgagattacaggcgtgagccaccgtgcccggtgaactctgtttcttacggcagtgttttgtgcaacaaacggatttttctataccaaatatttatgtactaaatgtgttcaaacctgataatgatgtttgtttaaatcaagccaacacttattaaacgctgtctccaagcatataaattatacagaaacatcactatttttacttggggtatgaatggcagatttgtttttttggtttagatttaactggattaaaatacgtgtgttgcattagaagaagtaaacagtcacagctaaaccaagtaggcaggtcagaggaattctaatctcctctgaaccacttggtgactcttcccctgtgtcatggcattggaggcagccttcctttcttattaacatcctaaaatctgtctaatcgaccaatacatttcaccaggcacttagtagctccctaattacattacctctctctttcaaagataaactcaagtacattgagtacgttgatcacttactcttaaaataaccataagcagggatagattaataataacatgtactcccccaaatgttgctcagcttatctggcagggagatgacattacataagatatggaaatggaaactgtgcagcaattaattggctgattttatgaattcagggtcattgtcacctttaacctatgaaagttattttacagagatgtttgtcttaggaagaaattaactagatttttcactccgcagccagaataatctatgagctgattttcttgtttattagtccgatggactctttggaaatatcagtgtcattgacattatgagaattgttaacaatattaaagttacacaaagaaaatgtctttgaaatatcaaaatatcatattctgtttcaaaatgtagcagtgaagaaaagagcggaacacagaattattagatttaatttatttgtagcttgactgtccccagcaagaaaatgtcatttaaaaaaacaaactttgggatatcctgtaaaactcaatcctgcataaagaaaatgcggtacaggtcgggcgcggtgctcatgcctgtaatcccagcactgtgggaggccgaggctggcagatcaccagaggtcaggagttcgagaccagcctggccaccatggcgaaaccccgtctctactaaaaaatacaaaaattagctgagtatgctggtgcatgcctgtaatcccagctactcgggaggctgaggtaggagaattgcttgaacccagaggctgaggttgcagtgagtggagatcgtgccactgcactccagcctgggaggcagagcgagattccatatcaaaaaaaaaaataataataatttggtacatatacagcatgaaatacaatactatgcagccacagaaaagaattagatcatgtcctttgcagcaacatggatgagtctggaggtcattatcctaagtaaactaacacagaaacagaaaaccgaataacacatattctcaataagtacgagctaaacactgaatgcacacgaacacaagggaacaaagagccagcagcagctagtgctggggaactttgagactcctacgtgataaatcatgaaagggtgtatggggggggtcttacttgcaagtatgttttgggaggttttttgggcacacatgctctggttgtacatgctagcacacataccacatctcattggcatctaaaatctccacccaggggtgtgtgggtttttttgtttgtttgtttgtttacactattacaatgagcaaaagaatagggcaagtttttggaggagtgtgtgcatgcttgtcagtggggaaaatccctagcgtggttatctctggcgagggcctgagaagtcccctttggggctagaggagcccaaccacaaggctagacataatcagtgtggacagtgtgtgtattcattgtccgtttcgctgattgtcaacaggcagcactgactcagtgaaacagcatcttcaggacttcttttctcaatggggctcccttgcctgctcatttctggctatctgcctactccaagggaaccagaaaaatcctggcaataaaacatatagaaggaaatttatatgactttgggataggcaagtatttatgatacctgaatccaaagcatgtttcaaaaagagaaaagttaacttggacttcatcaaaattgagttattgctatattctggatatgagccctttgttttgagttgcaaatgtattttccttttctgtggattacctttttactcacttcaatggttaatattaataaaaacaagttctccacttggatatagtttattctttaaaactttatatttttatgacctgttgaagaaatactggcctacccaaagccattatgatactatattaggttattatctatagaaccattatcgttttaccattttgtttttggatctgttttacctgaaattgattattgcatatggtgtgaggaataggttaagactcagtatttattttatttgaagtctaattaacacaccatttattaaaaataatgcttcctcattgcttcacagtactaagtgtgtcattaaaaatttgtccgtacatatgtgggtctgtttttgcacttcaattctcttgcattgttctctctctctctacacacacaaatatcatgtaatgtggagtaatgtagttttataatacagcctagtatctggtgaactaggttctcccactttgttcgagattttattggttattggccctttctatttttgtatttgttttgtaatcttttccatttacatgtacattcattttaagtatgattaacattgagttaaatctatagagaataactgacacatttacatatggagtatcccagtcttctgtttttcttgattttttttttaaattttaggttttctagaatgagaaactgaaattgaacaggaacacaaaaggtgttcacaaattcaagaatcatatttaagaaatgtttaacctcagcagtaacttgaggaaatttaaattagagctgtaatgagataccagtacaaaattaccaaaatgactgaactagactactaatgccaaatgttgatgaggacatggatcaactggaaatctcacaattaacttctggaaatataattcaggcaactaattaaagagttgggcatgatctactaaatgtgaaaatgcacatttcttaccacccagcaattctattgtagacatacaagttacagaaatacatttcccagtttgccaaaaacacatatatatgtgagaatgttcatagcagtttcatttgtgatagcccaaactggaagtgactatgatacattctcatgatgggatattacagagcaatgaaaatgaccaaatgatagctacacacaatatacaagatgaagtcgttaaaatgtatttgagtgaaataaatcagacaaattatacctactatgatttctttcaattaaatttcaaaaacgggcaaaatgtttccatgggtttaaaattgaagagagtggttaacttttggaaggagtaagtcagtaaaacgcataagagaatcttctgcggtgctcactgttccatgttttgacctgatagctgttacacatgtgtatttactgtaagaaaacgcatcaagttgtacacttatgtatatttttctatatgcatattccacttcaattaaaagaggaacttatgaagggaacttaaaacctccgaaactccacgggccatatatagaaatctgatcatagaccccatgttttctaatgaaattattaaatgaatataagtgaatataaaattagaatatgatgtcatatgaatctcttcagggaaggccacatttcttacagaaaatatagaacctcctaatgttttagtagggaaaaggccccaaaataatggcttaaatttgagaaggagttgttcaaaagcagatattaacaatgctttcatctgagctagagctttaatggggagctgcataagatgctggcctatgcgttagaggacaaaacctcaagacattctcatgcagaaaccaaacttggaacaaaggaacctttaccttagcctgtggctgaacaataacacatggattttcaaaagtaaatctaggctgggcgcggtggctcatgcctgtaataccagcactttgggtggtccaggcgggtggatcatgatgtcaagaaattgagaccatcctggccaacatggtgaaaccccatctctactaaaaacacaaaaattagctgagcgtggtggtgtgcatctgtagtcccagctactcatgaggctgaggcaggagaatcacgtgaacctgggagcagaggttgcagtgagtggagatcgtgccactgcactccagcctggccacagagtgaaaaaaaaaaaatgcattatcttataattctccattttgtcataagtataaacaaaaatggaaaacatccataagtacaactttagtttgcttattaggaagaataaatcaaaatgctcaagcaggattttttttctaaagttgagcttgggtgtgttctatatcaataagcctgtgcaggatataaataatcacattgaagaagtcctatccaaatttccttttaaaattcacaggtatataagttgattgattggtgtcagagcaaacacaaccctttgtgtgtcagagattacagccacatggtaggcaatatgaagcatatatacttaggaacagttaagtgaataaaaaagagatacatagaataagaggtctgagaagaccttttggttcagttcctatatgagcagagacctggagaaagggagtgagccttggaattgtctataggaaggtgggttaggcacggtaataaagaccttaaggtgaaaaagcatttggaatgaggcctcagcaagtggagtagagtgagtttagagataaaggaaacatagcagagataggggagcagagaggtagtaaggtgggggtgagaagaagaaagcatggtgagccattgttggcatttggactcaggtctaaatgagatgacaatgactaaaaaaacactactagaaattaaatgggtcataagtcaggttattttaaaaatcagtaatagttccaagtctttgctattgtgaatagtgccacaatgaacagatgtgtgcatgtgtcttcatagtagaatgatttataatcctttggatatatacccagtaacaggattgctgggtcaaatggtatttctagttccagatccttgaggaatcaccacactgtcttccacaatggttgaactaatttacattcccaccaacagtgtaaaagcattcctatttctccatattctctccagcatcttttgctgactttttaatgattgccattctaactgttgttaaatggtatctcattgtggttttgatttgcatttttctaatgacaagtgataagcattttttcgtatgtatgttggccaaatgtccatcagtgatagactggattaagaaaatgtggtacatatacaccatggaatactatgcagccataaaaaaagaatgagttcatgtcctttgcagggacatggatgaagctggaaaccatcattctcagcaaactaacacaagaacagaaaaccaaacaccgcatgttctgactcataagtggtagctgaacaatgagaacatatggacattaggaggggaacgtcacacaccatggcctgtcagagggtggggggctaggggagggatagaattaggagaaatacctaatgtaggtgacgggtctatgggtacagcaaaccactatcgcaggtgtataactatgtaacaaacctgcacatgtaccccagaacttaaagaataataaaaaatataaaacaggaaaaatcagacaaaatgaaaaatcagtgatagaatactaacaaacttagagtgtcattttattcaagaaagttacagtcaataacgaaaacgtatcgcacagtagaaatgctgctaaatccatgaagaaaaattgatggaaatatatttttagagccattaattcaccactgtcaagtttatgacatatttaacagcaaaagattgagagtacaaataactgtaggtttaatagtgattttctgtatctcaacactaaagcatagtagatacttctataaaatatgagcattatcaataaatctccctatgaagttggatgtgcaagaagagcaatagtttaaaaatttcagttacattaactaaattcaagtctgaactctcaacaaggcattcagaaaatcgtatgtctgtcattattgggaatgctctcccctgagcctatggaatggccagagctcagtagatccacatggtgtctttcatagggcaaaagcattttcattttcagttcattgaggcaaccaagtgatacattcactatacaattttaaggtatcttgtgaagtcaagtgtattaactgtcctgatattaaacacgtggcatacagaaaaagttgaagagagtgtaatcaggggaatatttatagaaacgtggggaggattaaaggaagaaactatggtgaagaatgcagggattcacatgagttaataacctttactacatctaaacctaagcagtcaaggggagagggctattaatttgataaaatccctcatgttgggagagcgccactggacacaactgtgaactgagcccctaggtatctaaagaatgctgttagtttcaaatcattgcctggtgaagttgagagaagtgataccttagtctctccatagaatcctccagtgttttgccagtgccgctccttagtttagtctaaccagaagtccaaggttaagagattccaggtgatgtagtcatcacatacaaagaagaggtgaagaagtttggtgggttagtgaagtaggagtggaaaacggtataatcggcattccaggtatctagttctgttttgtttctgtgcgaaatgaggacttgagaatctgcatgccgagaactctgatgttggctagggcccagtcttgttggatgcatcaggaagccagtcacctttgaggccataccacttctatttgatgacagagagtagacgtggtttctggctaatttggggactaaggactccttcctattcttctggagacaaccagagccagaaaagaaagacacgctgagagtcacttcggatatctgctcttcgtcgtaaacttgttaaaggcttaggaaaatagtaaaaaaaatttcctgccacatacacaaattataaacgggcaatatatttgaatgcagtgaaaatgtcattaaatacacacaaactttcaaaattcatgttatttaataacagtagaaactaataatatacttataaattaagtttgattaaggtttgttaaaccaagagtataaaactacatttgtgaaggaaaaagcattccatatgaaaacccatgagaaatggctcaggctgtactgagagtttgaatttttgtctttgattttgatcttcattaaaaagataaattgaatcaagctttcaaataaaaatgttacaaaaatgctttaaggaaagcaggaactaaagataaagaaatagaagaaacactagataaaatatacagctagttccttataatatgaaatagattaatatcttatgaatgtgatccagacaaggagggagaaaaacaaatgtatgcagtttaaaaatggaagggaaatattaagtatgagatatagaaaccaaaaacgggttttacacagaaatacatatatgtttattataaaaaatgaagttgaggccgagcgtggtggctcacacctgtaatcccagcactttgggaggctggggcgggcagatcacctgaggtcaggagttcgagaccatcctggccaacatggcaaaaccccgtctctactaaaaaaaaaaaaattagacgggtgtggtggctggcgcctgtaattccagctactggggaggctgaggcatgagaatcacttgaacccatgaggcggaggttgcactgagaggtgatcataccactgcactctagtctgggggatcgagcaagacttgtctccaaaaaaaaaaatttttttttgaataccagtgataagtttgtccacacaccaagaaattgataattgctaatagaaaatcatatgaacagcctcctaattctataaacctatgaaaagaaaccctggtttaaaaaaatcactcaaaatttagccctctgatttttaaaggaatattagaagtgtcttttcaaaatgatactttttggtaatttctggatcattaagtcaaggtcattttgtcttctctcttttccttagggtctcctccattttagcctgtccctctgccataaatcactagttctagcatattctgtagttctaaactagctcctcagtttaaccctgttcctcagtttctttcctttccctgtcctggcgtttaacctgttatcctcacttgaatgccactcagcttatatctgtagagctcagacactacgtctgtgttccaatttgcattctttgtggtggctgttttagcatgaagttatccctgctgtcaataatgtattttggaaagccacttattgagaagaaagtacttctaagtgcagtgataactttattgcggtatttgctgagagcaaagctcatttgtaatagttggttgtgattttaaaaagcgaacaaaatacaaaatcctgagaaatgggagactatgctactaagtggttattcttgtctctacatcagctctaggtaaaaatgtatccacagcttctttttatttacaagtttttgaaggtaaagcaaatcccagctaggatgaaacatctcttatacagccattctattatttctttgccctgtcccacttttgtttgtaagtagtgcctttcattaggcattttaaattcagttctacacttaactctattctctcaaagatatttaatgggtaatttaaactttccttggatataactaagttctaatcagtgagtattctctattagatatttgcacttttaataattttgtgtctagtttaatgattaattttttgtctggtaaaggaacttagaaattacaaatttgatagagatttaactgtggtgctttaaactaccccccgctccccaagatgtattatgatctgtcttcctttctccaagcttgtgtcctcgtcttccctcttatgatttccttgcttacattttatgaattccgatcccttttataaagattcatacaaaaggtatagtgttgaaatataccctaggaacattaccaagacttcgctgacttaatataatttaatattaactgacacagttgtagatctaataattatgttcattgtaccagctcatcaattgtctatcacaaggtggtaagtttttaccaagtaacttcaaatctacaatgtgggatactacaaagcaaatagtcattgctatacattaaatcacaaatccaaggtgagtatttaaaaagcctagggtggaaattcagatgacagctatgttcaaatattcacttaaccccatcattgaaaatagtcactgaattagattgaatggttgtcagatgtcactgatctgaaaaatgatatactgttcacatgctggcatataatgttagataaagaggattctaaaatgttctttaaaactagtattttatgtgtcctttaagtattcagaaacttaaatagccatataatacatattttggagcatgtcagaatatatttgactataaactacttctatttattactcataaaatctagtatttaagtacaaattccaaatttaatttgttagacaagtatttcttacacaaaattgtcagtccacacaataggcctgtaaaatatttgcactttatatgtattaattctcaagtttgcagaagaggtagatcttgttaactctgtaacttatcaactatagggtctttgccaaatgattccgtgactttgactcactttatcatctgcgaaatgcattaatagtaaatgttcacttctttcaaaatacttgttatggaagatacaaatatacaaacataatctcgtattcattaaactcacattcagttgcaaggtaatataactactcttaaattgcagcatgttctcatttaaaataattttctgggtgagttgtttattcttcccatcccccttagtatacctcttgctttaagggaaattagtattgacacatttcttgtatattcaacttcaaattgagatagccagttacctattatgttcacatatggaggtctgctgggataataattatataactataaatagtactgtttaaaaatatttcttataatgtcactcaagtatcttttaagatttttattgtagctattgcttttttttttttttttttacttgaaattagtatacgtgacttgagcttaaaaagttggggctatatgggttgatttttgtcgttaaagttacatcctatattgccagataaaagatacgtaattacaaaaattcaaattaaataatatactgaaagtatatatatctttcatactaaattgtgaaagtattgaggacagtgtccatttactcaggcaatgccctctaatatatattctatataaggaattttgttgagtttagttaaaagagctactttcccaaaaagtttagtttgcattttattaatacgttcaaccagattacctgtatcaaaacttctattttgataaatttgttttaatgtctttcatgccattaaatgttcatattttcttaggattatgagacacttgtattaactgcctcaattctttattgtcaaagaggcagtatataaacaaatgaaaacatgactccattaaaaataattctcctgcaatgtatcagagtgatcataaacatatctgaaatatagaggaaatttaacatttcacttgtccataagcaatttgttgaaagtctattttttaaatttattcttaacattctatgcgtggcatatagtgagtggtcaaaaatagttaaagaatgactaaatatgtaaaacttaatcattgaaggtagagatagtatctttgtagtgagtacccagaattaaatcttgtaatatagttgaggtcaaaatgtgcttcaaaaattatctaatgtaaatttctatatctgaatcaaaaataattcttgaaatacggagataaggaagggaataaaaagctgtcattggaaatccaggtccacagtggcaatatggcccaccgtttaggttgtatatatcgacgtatttatgatttaataagaaaaagattcaatacatgcatctctcaatggaagaaaataggtatgatttatgcccataagtcttgaaattttaaacagtgtaaatcttaaatgtggtgtaaaagcacatgctgcagggcaatgaaactactttgcctttcctgtattttttatctttttaaaatgcattatatttagaaggattgtatgaatacttgagaagtttctcttgaatatggagaagtctttagcttggctacatgatggcagacatcttataaaagacatttaacatgtttaaaaagcaaattctgtttatctagaatgttggaaggaacttctcggtttatatatattttatgagaacgaaatgaaatgaaaagaaatgaaagaaccaaatagatggtggaagtacatgcttgaggtttcagtgtcaggaaggatatttacataataattttcaatgcatgggatttcccttttagttattgtttaagattctgtttaaggaaatcaactcaaacttttaaggatatttcagggttcctttcagaatctttttgtgaaattattttataatagtttgtaccatttcatatctagttaaaatcaccaagactgagtgaaaaggtagcttacccttatccccctcccttagctaattttaaaaatgcttgtattttacactgcatatgagggaacaaaagtgactccttcttaggacaaatatcaaactctgaaatgatctgggagaaccaattcctttgaaacaaatgtgagaaacgacctgctttagtctaatttcaattggctgaatgacgcaggacgtgttttcattagagcctgtagctctgaaatgtccttgtcactggttgtctaaaaaggcaagaagaggcagacaccatatattataaagatgatggttcccctgtgaatgagatataactttctgcaacttccaagttaaaaccgcaaatgcttaaatgatacacaaaactctaaacatccatctctctctgcatctaacaaaaataaaattgtatgaaaaaattcattaaagctttgtcagaactttgtcacctgtctttttctctctctcatacacaaaccacacatcacacacacacacacacacacacacacacacacacacacacacacacacgtaaatatcttacaggaatgtaactcttagttttattcatcattttcccttctctctctccttctgctctgccctaagaacttccattttcattatttgacttggttattgaaattattttcaagttacatgcccctcattctgacgtcttatttactattttctgtttgatgaaccctagtctgctattcttctttctgtaaagcaaatcaaaaataacactaacttgttcctgtcaataatctttcagaaaaccatcatatttcaggtttactttcatcttaagtttttcttaagtattcttaaatcttgaatatatcaatataataagtataaatccttttactgtaaaccatcatgggatatctaatcttagcttgaataaaatattgacgatggtagaaattacatccatgttcctgaaggaaagtgggataaaagaaaacagcgaggttttttgcctgtctcgaacaagcaaatgacgagaattgttcctcatagcccagtcatttaggaggtagagtacctggaagtaaatgctccctgaaatgattatatattaatcttagaattactaaatatatattgttatacaaaattatgtattgtaagtactagtctggcgatagaagagggacccccttaagttcttgtcctatgcctttaaaatagacagcaggagactactccatactaaagaataatttaatgtattaggttttctatgtgcaattcttacagactgcttattgtaacttgaggtgtttctaaagagttcacattttaatattctactggagtcacaataagtttccattatgtcaaagcaaaccatggaggttttctatcctccaaaattacatttgaataaagcaacttccgaagataacagtgtaaaactctgagacagcatcccatgttactttatgagtaaaatcttaggcctgttgacaggaactacaaaagccaattgtgctgcgtagtttaacttatttctgcaaaaactcaaggcatgttattacattttcacacagaatatcaattttcacacctattttggtatcagatgttttcattgtgcaaaacaggaaagcagaactttgggtaaccacagtgaccctactatttaatttccaaccatagagtgcttgtcacaacactgatacacacagtaggctcgtacattaacatacatgtcatattaatgttttctgttttgcttagtagacagatgtaatcattcacttcacacagattttaaaaggttttaatatttttaccattcagttatttagcaattagactgataattcttgaaagacataattctggaatgtgtattagaaaaaaaaacataaaagagaagttactgtatggcagggtgatgattatttaagaggaaatagtactgaattcagaaaaatgttatgacttacagctaatagtaagaaatacagcattataagagcaacaagcttatgagaattcatggccaaaacagaccagaccgtcaatgtgaggcattgaagagtaatataaatgccatgaacaataccctttcaggcatgacaaatacctccctcctctagagtcttcatggttatcaattagcatttcttacactccttggtagtttgaagaagacatgtacaagagacaaaacacaaccaaaataaataataatccttgtctgtatcatggtgtgaaatgtttattaacttggagagagagcctcttaaagctttttgtggagaattcactagatgtaattaatgaaatatcttctatccagacatagttttaaatcagaccttgtggaagcttcatttatctttgatactctgtttccctcttggtaaaatgcacataaatgtaaaatgttcatgaactcttggtaaaatttatatagctcatacatactctaatgatgtaggcatagtgaaatctgtattcagagagaactgtatagccataagatttttaaaagatggaaataaaagaagtatgcatcttaagaaattgtaaaaatagaaacaaaaataaaaattgtattcaacgtagaaaattgaataagaataatccattcaaaagtgagctcttgaaaagattaacaaaataggtaaacctatcccagtcataacaaagaaaacttagaataaaaactagacgagataaatgagaaaagacgcatgacagcagatacagaagaaatgaagtggaaactaaaagcaattttataacaattttgcaaaattctggaaaacttgattttctcgtacaatacaaatcactaaaattgagataagaataagtggaaaattagactgattacttcagaaaacatttagtaggttattaaaggtgtactgttgaagagtgtagtaggattctttacaaatgaatttaacgtaacccttaaagaataatttatatactttaagctattccaaagcatatgaaaagaaaaaaactccacaattccttttgtgatgtcaggttaacctttgtacttaacagtcaaaaagcaaagatcataaatctgtaagacagttttacttttgaatgaaatacaaaattttgttgaattataagaaatataatcacattttgcaagtggtaagcattctacaaatgttatctcttatttaccaagagctcttaaaattcaagaaggaaaagaaaactaccatatagaaattaatgagcaaaacatattaacagacaattcacacatggaattgtaataggtcagtgatacaaaaatatattcaaatgcacaaggaatcatggaaataaaagttaacaaagtgatgtatttgatcatacaaacaaaactaaaagaatcaaaaacaaaacaaaaatttcctggtgagagaagagcctattcttatacattctggttaaaatatgtaattctaaattgtttctaggaaggcaggtggaaacacctactaaaattacatatatatgtgtatatatgtgtgtgtatgtatatatgtatatagatgtatacatatgtatatatgtgtatagatgtatacatatgtatatatgtgtatagatgtatagatatatatgtgtatatgtgtagatacacatatacttgtatagatatgtctatatctccctgaaatgatgcgtatatatatatgtatagatgtatctactagagcagagtgtgtgtgtgtgtgtgtgtgtatacacacactctgatccagtatatacatcctgtgaattgttataataacagtagaagcatcagtatctgaaaatgtatgcataagatattggccaggtgtggtgactgctggtgggaatgttaatcaattctgccattgtggaaagcagtgtggtgattcctcaaagaagttaaaacagaaataccattcaacccagcaacctcattatttggtatatacccaaaggaatataaattgttctacgataaagacacatgcacatatatgtttattgcagcactattcacagtagcaaagatggggaatcaacataaatgtccatcaacagtagactgattaagaaaatatgctacatatacaccatggaatacaacccagacaaaaataagattgtagcaacatggatgcagctggagccgttatccttagcaaactagtgcatgaacagaaaaccaaatatcacatgttctcacttataagtgggagttaggctgggcgcagtggcttatacctgtaacctagtactttgggaggccgaggcgagcgggatcacctgaggtcgggagttcgagaccagcctgaccaacatggagaaaccccgtctctactaaaaatacaaaattagccaggcgtggtggcgcatgcctgtaatcccagctacttgggaggctgaggcaggagaatcgcttgaaactcgggaggcggaggttgtggtgagccgagatcgtgccactgcactccagtctgggcaacaagagcgaaactccacctcaaaaaaaaaaaaaaaaaggggagttaataacaagaacacatggatataaagtggggaacaacagacactggagcctactcaagagtaaaaggtgggaggagggagaggatcagaaaaactacctatcaggcaccatacttattacctgggcgatgaaataatgtgtacattaaacccccatgacacgcaatttacctatgtaacaaacctgcacatgtactcctgaacctaatataaaagttaaaaaagagtagctgtctgccactgaatacaattctgtccctgaatataatatctccaattcccaatcagttaattaccccctagtgatctgaatgctttctggcatgctttctccacctgatacttttcttcattccaatctattttttctttacagatttaatcaatactgagtacatgaatatatcttatgtcttttgcttatcttttcacaatgttacttcctttttcttaccccttgggcttccgtgagacacagttgcctacctaattgtttttcctgtggatatagataaattttattggaaaaaaaccatgaacatttatttaggtattatctgtggctgctgctgtgtgtgtgtgtgtgtggggggggggtgcgatgtgtgttccaatgacttattttttattgtggtaaaatacaaatgatgtaaaatttaccatataactattttttattttttaattagcaaaaaaaattgtatataccatgtagcatatgattttttaaaatatctagatgttgtggaatgcttcaagctaataaacatatacattaacttatatgtttatcatttggggttgaggacacttaaaatctattctcttagcaattttcaaaatacaatattgttattaaccaaagtcagcatgttgtacagtagatctcttgaatttattcctattaaatgtaatttagtatcatttgaccaacatctgcctaaccctcctcctccaagctctatcccctgctaaccaacattttactctcaattctatgagctcaacattttaaaatttcatatacaagtgacatgatgtaatgtttgtctttctgtgcctggcttatgtcatttgacgtaacgtactctagattcattaatttcattgcaaatgagaggattctctgctttttaagtccgagtagtattccagtgtgtgtgtgtgtaggtctgtatacctgcattttctttattctttcatctactgatggacacttaagttgatttcctatcttcgctattttgagtagcactacaatatacattgaagtgcagttatttctttgacatattgatttgtttcctttggaatatatacccagcagtagaattcctgaattatatggtagttttatttgtaattttttgagaaacctccatactgtttttcatgactacaataatttacatttccaccaacactgtgcaaagattcctttttctccacatctttgccacaacttaccttttgtctttttgataatagccattctgtgtgatgtaatatttcattgtagttttaatttgcatttctctgatgattagtgatgttcaacattatttcatttatgtgctggccgttggtttgtcttcttttgagaaatgtctattcaggttcattgccctagatagggtttgaggtatcattttttctatttttttagtgtataattcagtggctttaagtatatttctgttgttgggtagtcatcaccgctatccatctctagaatgatttcatcatcccaagttgaattcatactgattaaacgattactctccattttcacctcccctagcctttaataacttccattttttctctatgaatttggctattttaggtacctcatataagtagaatcatacaatatttgtcattttatgtcttgcttatttcacttagcatatgtttccaaggttcatttatgttgtagtttgtatcagaatttcattcctttttaaggctgaaaatattccgttgtatgtacataccacattttgtttatccatttatctgtagatggacatttgggtgttctcacattttggctattgtgaataatgttactatgataattggtctaccaatatcttaatctctgtttttaattattttggttataaacatagaggtagaattgctagagcctaatggtagatacttttttattatgtgaccttctgttgtgaactttttgacactgggggggtagtaccttactttcctttatcaggtctgagcccagtacctgaatatagtggaaattggaccttatgagaccttttatgaggacaaggaaatggaggaactatcttcctgcttacacagtgacaagtcttatgacagtggataaggggttactggaatctaagttcctattacttgatctaagtctccccagagtcaggtccatggcaacccaaaacgtatctaccagcagtgcttcccgcagtatgagtgagtatgtttcctaaaaatagcatattctctgcttaactgcttgagtctttagtgctatatcatctgattgtcactatcactagaattaagtttcatgaaagcagaaggtttttacttttacatgctcttattacttcattgcctggcagatagccaaaaggtacttgttgagttagtgaatcaatgaatcaatagataaattcatagtggcttttccttatggaggaatttctctcctctactgccatatgaggaatccccagatgatgatgcagatgatgatgctttcttattcttgaatgatcaatctccccttcgatgtagtaacatcttataaaactaaaatacgatatcatgaccaagatgtcaacattcataaaaccaccaatagtattcagattttcccagctttactcatatttatgtgtatgtgtgcatgcatatgtgtgtatttagttctatgcaacattattacgtgtgtaggtttgtaaatccaccatcagagtcaatatgcagaacagttccaccattacaagggtccctcatattgcccttttataagaacattcagctaccccacatcttactcccattcctgacctctgccaactgctattctgttctctatttctgtaactttgtcttttcaagactctcatagatacggattcatacagtatgctaccctttcagaatgactttttccccacttagcataatgcccatgaaattcatccaatttgctgcatgtatcaatagtttgttcttttcattgatgagtgttattccatggtgtggctgtactatggtttgtttatctacccctgagggcatctgggttcccagtttggggctattacaaataaacgtagtatgaacacttaggtgcaggtttttgtgtacacatgtgttttcatttccttgagataaatgctcaagagcccaattaccagattgtataataagtacatgttcagttttgtgagaaactgccagactgttttccaaagtggctatatcatttgagtttccactagcaggggttgagtcatccagtttctccacaccctcaccagcattttatggcactattttttaattttaaccattatgataaatgtgcagtgatacattattgtggttacaatttgcattcctctattggctaaaaacattgaacatcttttcatatgcttgcttttcagatgcttgtgtttaactttactccaccttaaacatttgaggagtgtgaaggacaggagacacagagatttgccttgattaaggcaaataaaaccctgccagattttcatttccaaacacagtcctagacagagataagagagctggcagtttgctccattgtttattagagacctaacattcattctaaaacagaggcgttttactaaaatgcagtcagccttaattataatggcactccttggagctaggtggaagtactggtgaatttttctgagttgtaattccatactagaaagcatatcttaattttaaacatactttatgacattttatttggagatactccagttgacctctttaatctgcagtaatctattcatgtgctgaaagtaaatatatttggggtgcttgtttgttatggaaagtgattttacacatgcattttgtttaatttttagattattttcaaaaagcttcaatgctaagtctctgaaaatagctaaatgcaattaccttcacgtttttattattattattattgcaactaggcatttggtctcttaccttcaaatgttttacccctttctttaacaggttgatttagtgaatattggaagtactgacatcgtagatggaaatcataaactgactcttggtttgatttggaatataatcctccactggcaggtaagaatcctgatgaatggtttccttttgggtaacattaatcttgttttttaatttttacccttgacgtgtgaaacaaatgtgtatttctaacaataacaaaccctgctccatagtgctgctttttaaattgacactaccatgtcgtctgaaatgttaaggatcatcacggtataaaataggttctggtacatttacaggaatatttttcaaaattttatttcattgagtaagtataaggtaaaaatacaaagtcccaatcataggtgagtaatttttttcacaaatgtatgttctataacttgtctataagttaatttagtatgttttattttaatcactaccaaaggaatgaggctttctcagtcttgggtattcttaacataaattattgccaataaaagattagtagaatatgggtatctctatcaataaatgtgtgtaatacatacaaactccataatgtgatttggaaattatttttaagtcacctgagcatagggtcttccgactgtctatttgacctctgcaaaatgggttgaaggatttgtggaaaagatacagacacacacccgtgtgtgtgtgtgtgtagtatatatgcgtatatatataatgtgtctatatatacacacatatatacaatatgcatgtgtgtatatacacacactcatatccacacattatatatgtatatatatacacactcatatccacacattatatatgtatatataagaccaacatgaacttatatccactaatattatccactcattgtatacatatacataatagtataatcataatatgtatacataatcatacatgaacttatatccactaatattttccactcattgtatatatatacgtaatagtaactcgttatacacatatgtataaatatgtatgtgtatatatatataccaacatgaacttgaatttaaacttccacggttaccatcttagtggcatttggtatattgccacccctgttctgggccatggtcccttcactatcaaaagagtaaaaataaaaataaatgtgtatgtatttcttatcacgattaagtgggagaatatctgcaaggcactcagtgtagtataccacttttatttgaggtgtatcatatgacttgtattgattgcttaaagttttccactcatttaaaaaatttggaggctgagaaatgactgctgtttttactggtcgggattacttttttataaatcagcgtttttgaaatgtaattgttagaccatcaatgtactcattctaagtgtaaaattcaatttgcatcaatctggtttagttctggttcttggtagcctctcaaactattttgagggatgaataactcccccccaccacgttcattaaaatttgcaggatatttacagagttatatagccatcatagcgatctaattttggcacttttccaccaccttaaaaagaagtttcttctccatttacagtcatttttcactcccaccccagccctaggcaattgtcaatctatttctgtccatatgtatttgcctttttggatattttatatcaatataatacatgttcttttgtgtctggcttcttgcaatgagggtaatagttcagatccagccctattgtagcagatatcatggcttcattcggtaaacttgaatttttttattttttatttttatttttttttatttttattttgagacagagtcttgctctgtcgcccaggctggagtgcagtggcgcgatctcggctcactgcaagctccgcctcccggattcacgccattctcctgcctcagcctcccgagtagctgggactacaggcgcccccccaccacgcccggctaatttttttttgtatttttagtagagacggggtttcaccgtgttagccaggatggtctcgatctcctgacctcgtgatcctcctgcctcggcctcccaaagtgctgggattgcaggcatgagccactgcgcccggcttgaattttaacttgaattgtagattgctcttgctcagagtcaaatagtgagtagacacaaagagtacctattaaattcagcagccatgttgctctcctaattggcccccatatatttttattccaaattctctgaacaggcttaatgctacttcacaacagtaagcggggagaggggaagagaaagagcgggaattaatatgtgctggcaacaaagaatagctcataggagccttaagtgagcccaagttggccgattttcagcccgttccatatagtgatggtgtcaaatagaaccagcaagcaacataccgcatctctccccaaactgcttttcatatgttgctcagtacttctcaaaatatcttgaggaaggaacacttttcccctaatccattgtatgtaagatagaataaaaccaaagcgttacaaaaataagatgcccaacacccatgcttcctcctttattattaaatacattagacataaatggtactctgtaaaatcgctacataagtttcttgatgcactctgaattgttgactttatcttatggcatagtaacaaataattcctagagtgaatccagtttgcagatcccgctttgcgtaagacagatgtaagttttgacaaagccagcagaagaactcaagcatgcacagagctccaaaaggcactctgaactgtatttattgtttatactacttcttatatgatcttaccatttttaaaaatatcctgaagccctttccaactccatctgaactagtccaagataagctttcaagactattatgtctgataatttcttcacttgcttgcaagttgttcatttattattatttttttattttttatttttgagacagagtctcgctctgtcacccaggctggagtgcagtggcgcgatctctgctcactgcaagctccgcctcctgggttcatgccattctcttgcctcagcctcccaagtagctgggactacaggcgcccgccaccacgcccggctaattttttgtattttgttcagtagagatggggtttcaccgtgttagccaggatggtctcgatctcctgaccttgtgatccgcccgtctcggcctcccaaagtgtttggattacaggcgtgagccaccgcacccagcccatttttcattattagcatgtggaggcgcttttgcaatgaggaatatcagaaggaatgctttttaaatctttctttgtctgagacctctcttatagcctgttgtttttcatttatgcccttgaatcaccatatccttgagactgcaagactgtagactcttcccagcctctgcttacttatctcatctctcttatatcacactgccctgttctaaaactattaagcacactttgaaaaattatcttgctcagtgttcatcataatccagtgaatctaaaaatgtgtttttcttttttttttttttttttacaccaacattacatattttcttcctattaaatggtagaagcccttgaatttcagcaaagattaaaggacattttggtcaacttaatgtacattctagatctatcagataacgagcggcatttacagatagaaccatgttggcccctttttctaatgcaacatactatgttattaatagtgccatggaggacttctcattgaacttgtgaaaactcaggaatgcaaactctgttttcctattactgtttttctactgtccatctcaaataaaattgctagcctaaaacagtaacgcatattttgtaacataggcaggtttgaacaaaattgcaaagcatataacatgtgtttggcatctttttcttccttcttaagtgcaattctttttttttcggagtgctaaacttggctctggcaaccagctggttgtaataacaaatcttgctaacagtggtgagctatcagaagtcaggtccatacttttactggacaattcaagggatgtacttaatggcaacgctaattcactttagaatgttcatattattgatacaatttgcaattacaggagaatgatgacgttcgcactgctgaaagccatccctgtaaattcctgcctaccaagtcacttctgtgcaagacagttcttgctctgctcttctgcagagcttcacagaaactatccttaccatataagattattcctaccctcttcatttctattcctctgctgcaacttcttttaatcacagtctgggttctggggagtagacttcggagttgagtttggcaggcagcatgtttattaagccatgccctggaaaaaaaaaaaaaaaaaaaaacacctgtagaagggcagaggtgacaggagtggaaagaggaagaactagagctgtgacgtagaccctatgacacgcttattcaaaccccatagacaacttgcagctaggatgacccctcagagttgtctcaaatggggttaaaatggctgagtgtttatactctgccccttcatcagtcaatagtagtgggttgccctagagagggtgtgacattggctggcaggactctgcaactcaggtggtacctgagagaactaacaactagaagctgcctgaccacagctggagcaacaagcccttccttgaaggtcaatcttggtggtgcacctccatgtccatcatgccttcttggcccagttaactcctagtcatttttaaaaatcactgctcaaagacatttcaacttttttccttttaaaaattgatttatagttgtatgcgcgcacacacacaaatacatctgtttaaattgagcctcctttagagacagtgagacctgaggacgggacagttttctgtttacaggctcacctttggggaccagctcaatgattttttgataactgccttttatgtaggaaaaggagacatgattatcatacattgccctttattatttttttttgtctgagcaacatttgcacctaagtagaagcaataacagcgaggctgaggctgataagctgaattagtgacataatgatgctataaaggagttttggattgaatactttgttgtcctttaacgttatgcacatagagggcagactggccaagcatttcacaaatgaatcacattcatcattggaggattgcttgattattgcaaatccattaccaccattaagccactatctgctgattccaaccgtaatttagcacaggacacaaaatacacctcctgcagtcactgtacataaaggttgagcaatttataattttagaatatgagacaaattacgtaattatttgacctgtattcactgagtaactgactaaataagtaggtcaagaaggaattaggaaaacttggataatccactcctaaataataggcttagttatcaagggattgtgacagatacatgcaaagatttcatatctccgaatcgttactgtgtttacaaagcatcatctcaaatcttttaaaagtatgttaaaatgagatttagtagtatatcctaaaatttgcatttactttttaataaaaagatgactaacattggagatgttaaaatatgcatttaccccaaaggcatttgttaacttctatatggatgaaaaaataaaattgtcatatttagaatgcacaataaatattcatcatctgatcaaatgttgatagtatatgaaccttaaccttcccagaaggaaagtgcttagtggtacagactgatcacttttacatagatgtcttcttccagcatctcataaggggcttatatttaaaaagcagtctttaataaataataattctttaataaaagatgtagacagttttttctatgaagcgtcactgcattcatgaaacttagaaaaaatgcttagaatggatttctgcatcagatgactcagaagaattaaacttgataatctgttgaataacatctgcacatgcacgaagcctatgagacaatcaaatacatggaaaccaagtaatgaaaatagaaccaaggctacatatgtacacctcttagggataaatatttccttcctttgttgttttttttctttattttaggtaggcaaacatttctgtcttcttttcagttcagccaataaatatagcttgcgttaaatgatggtatgaaatcaggggttttatctgaccatattttgtactttgatcttacactaaccttgcatgtaagatacacagaaatgaggcctagaagaggttaagcaacttgtccaattaccacaattaatagcaaaggcaaaatttgaacatatactttaaaaaacaattatctatagtattcctcctatccaaaaagcgcttttatatcttaagtccttggttaacaataagtctaatgttttatacactgtcttctctagcttgttcattgaaagctagaaggtgagcaattctataaacagtaaatgttgggtctaatatggcagaatccaggagtaatagtgaacacattcagtaaatggtatggcatagataccaatgaatcagaatagactcctagcctttgagaatagacttaacttctggtagaatctattatgtctcattactaattggccctaaaatttctatttatcactgaagatcaaggacattcatatttaagtttgcatggttcttgctcaaggaatgcattttcttatgaaaatttatttccacatgtaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggtaagaagattactgagacattaaataacttgtaaaagtggtgatttagactctgatgacatatttttccccagtatggttccagatcatgtcctactttacaacatgttatgtacattgaccacattgatctaacgttccattggaatgaactaattaagaatattttccagtgttctatgggatacatataattcagttgttgaaacattaacattagcggagcgtgaaagtggttatagtggagggggagagtatcaatatgtttgacactgggaatcccagtaaatccaggttgtattctaactttgccgagaatggtgttggtctttttatacagataatgtgtttgtataagcctaaactatacaggtaaaaatgatactagatctcatgtgagtagttgtagttaaattaattaccatcatcagatacgtagtgtggagaaagaaacatctgtcttatcagatacacactttgatatcaaacaccataaagccctgtatactttgttctagttcagggtcataagatgctcagagcatttttagtaaccaagacaaagagcagaacacaattaattatatgacacaatgttttgaataccaacagaaacaattgcactggaacagcaaatcaattgctataaagcaagagagagatcttttgtggattttaataaaaagaattcactgtaatacagtgaaccaaagtccttaactatattccattcaacattatatttcttaagatgaaaaagattttttttgcttttcttgtgtaaagttcagtaaatgaattaataacagttcaagaaaaagcaaagcagtgtaggaaatacatatgtatatgtacacatacacttagagatacaatatatactatatgccatatatactacaccatttatactctatatatgtatatatatgtgtgtgtgtgtgtgtatatatatatatatatatatatatatgcttgtgtgtgtgtatttgagagagagggactacagtcactttattttggtcttcctgttacccgtttcatttacccaacccagggctaaatgcattgcctaattaactgtttaaaatgtcactggactgcatcttgcctaattttcagtgcaagttatgttttctcactttgatttttttttttttttgaccactctaccattttcctatgccaatcctgcttctagaaaagctaagaatattaattttctctaaggtaaagctcagtccaagagcaaacacatttcaaataagcatctttgtcaggtgtcttgctccagctggatttaattaaccccatcccgactgggtttccaggtgaattactcagcaacctgatttagaacagaggcagacatgcattcaaatgtcacgttaagcagcgttaacacattgtttctcgtatgacagaagaaaatgtttccacagcctcaatacagttagatgagaagggatagagacattctgtctgtgttttaagtcaatgctcatttatgcagccacatgcttaacactaagggcccgaaaatattgattttgctgttcatgtacacatttgcagatgaataaaaatatcaaggatcaggttatgtggtccttgttggctctctaacgtttttcccttcaagtggaagacttcaatcctgcaagcatgttcccactctatatttgttaatattctatttaatgatttctgaatacatttgtaggtaatacagtaaacatacccaaattgccctgttttatctgtccctgacccactctttctctgtcaaaatatcctcatttatatactctctcctgtcatattggatgaatcatcagtaactctctttatgtattacatggttacttttcaagaggttcttcacagttgtttaatgttctttcatgaatcatctcccccttctttttgtatttggcagatgttcatattctttatctaaagaaaaaaatggttgaactctctgttccatagcgattgtcgttggcacaattaggaatgtcatgaggtgccctcatttcaataattgagtggttcaactatacagaacaaagacatgtagttaatatagagcataaggattgactaagtgtcatggcagttaaaagttgtgtgataaaacgcaaagtccactacaatacccttcaaaggaagccagatttctactttttgtgttaaaacccaatgataattgcttagaaatatgtacaaaagatgcagataaaattacaataactataaagttacaattgtcttcctaaatccttattttagtgtattaccacagcaaattagaagcaaatgaacactagaatcaggagcaaagggaaaacagaaacacaatgtgtcttcatgaccccaatcttaacttaccttatttcaattcttagatgcagtcactgtcagctacttgtactttggttcctgctggttataataatatgtgtgataatgtttctacttgttgacaaactaatttctaacagtataggtatttactccatagtatgaaaaccagccatattatgtttcatccccaggtatttcctaattttattacttataatcattttatagttgtaatttttgcttttattacattaaatggtatgagtatacctcattttaaatttttaccaagtttagaaaggaacttttgaccaatatgaaaaacgagaaaatcatcacacattcttactctcgcctcttctccacctcccatttcggattacattctgtttgcatcagtagtatttgtaacatttatatcagttctgtaaagataggtgtttttggcttgagtctgtaaattgaaaatacatcactcttcttatataaatgtaattaacattacagcaaaataatagaaacgaatgtttttaaacaattattattttgtagacaccgttctaggtaaaatattcaatcaagttccatgacgtagatgctgtcattttacccatctcacaaatagataaattgagtcatagagaggttacgtaatttacctaaaactgtttggctaacatgtggtagagctaggatttaaatttacactatcctaatcatggtgttgatttaattaaaaatctggtgatccttggttgcaagtcaataaattatggtccaggttaacattaaatgctgtgtgggtttccttcatagttggttagttttacaatttttatgcatttgaaagtcatagatatttaaaatgttaattaattttaatagtataaaagaattcaattcatttttaatgctagacgtgacctcaaaggccttttggttcaatgctttttgaatgagaatgccaaagctcaaataaattatatgacttagataagatatccacacactcagttggttagttagtggccaaggaaatggggaaggtaagacaagggaatacagcacgaatgcataagcaatgctcttttttctcatcatactcaatttaaccttgtatactatgccatagatgagaaaactagtttctcatatgttcccacctatgtcctttttttactcccattgcctacagaaaaaaatgaagataaggcagagtgcgcatagtgaacttaaaagtcccctaaatattctacaatttttaaatttttttatatatttttcataacaaaggcattatccaatttgtaaataagctagtttccataagcttgttagctgttaggggtattggaaaatatggagggattcgatttcctaataattgtaaaaattctggtgtattaactagagtagaagcaattaagaagaaaccaataaacctatacctttatttatgtatttttttgagacggagtctcgctctgttgcacaggctagagcgcagtgggccaaccttggctcactgcaacctccacttcccaggttcaagcgattctactgcctcagcctcctgagtagctgggactataggcacgagccaccatgccctgctaatttttgtatttttagtagtgtcggggttttaccatgttgtccaggctggtctcgaaatcctggcctcaggtgattgacccgtctcggcctcccaaagtgctgggagtataggcgggagccactgcgcctggccaattttgaattacagttttagaaaaataacagctaaactacctttgtaactttttttttgtttttttcgttattttgtttttttgtttttgcatagcatgagctcttaaacaggagtccattaatagattcaaatattctaaaactgtatgtagactctgttcacagatatggagagtttttttgtaggagtagaagtttcatagctctcaacagattctcaaaggtgtctgtgattcagaataggtgaagaaccacttgactaatgacttccagtgctgttgggataaattataatacgttaacagccaacaccttatgcaaactcagccagtttctttcttttaaacctatctcccaccacttgatacttagaatcttccaatggagccaggcctgtgaggtcttgattatctgagcatgttttgcttttttccttccctaagaactttaattctctaacgctcacacaacttagaattctattatcaatacattttttttaatgcaagtcgaaacgtctatttaatctgtctttcagcctcagaaaactttcttgaccgcttcagattttacaaaacattttcttattgtctgtgttttttcacatttagagtttaattaattcatatggcttcttcatttttcttgctcattaaatttaaaatccttataagacaagaactgcctcttacactcctttgcattttctctattatcaagtaacatggtatgtaagtttcatgtgctcatccattctctcgtgtagttgataaatatttgttgagcctttattttgtgtcaggctaggtttccagcagtgaacaaaataggcaataaaagattgtacattctagtggaagagaaagatacacagagaaatttaattaaattatataatacgttaaatagtaagtgttaatgagaatagtataaagcagataaggagaaagaaaataagtatatgtgagtttgatttgaggcatgcagttttctttcatttatctatttaggagactggttcttcctcagtcacccaggctggagtgcagtggtacaatcatggctcactatagccacccaggctcaagtgattctccaacctcagcctcctgagtagctgggaccacaggggcatgccagcacacttggctattttttttttttttttttaataagttgtagagaccaggtctcactatgtggttcaggttggtctctaactcctggcctcaagcaaatccttcagcctcagcctcccaaagtgcttggtttacaggtgtgagccaaggtgcctggccagcatgcaattttagatagggcttgggcagggaagaacttatcagtgatgtgattttcgagtaaagacccaatggaagtaaaggagtgagccatgtttatgtcttcgaaaagcgaattccaaatccaagtgcaggaaactatggatcctgtttatggaatatgaggaaagagacaagaaataaaatcagagagttaatagggacctggaccctgttggacttcgtagatcacatgaaatacgtaatttgtacttcccctaaagcagagatttgagaagacggatatgatgaaacatgttaacagatcactctggcaactctgctatgcactaattaacgcaggcaagagtgagagaagagttatgaggctattgtgataattcatgcaagataaaatggattttggactagagtgatggcagtgaggatagtcagaagcagtcaaattctgaatacattttgaattaaatgttgtgtgagagtaaaatagtcattaaggatgactccaagggtttttatctgagcaactgcaattttaaacacattgttcattattgaggaagggagaacagcaagaaaagtaggtaggtttgggggagtatgatgaggataaacatcagaagctcagttcaggacacttgaagcttgtgattactaaatggagataatgagtgtttagaagaatctataatttgaagtttagggaagaggtctgggttagacatataaaactgggcattaccagtaaatggctggtattgaaatccacgagactggatgagatagataaatttttgttgcttggataagctagcgtagattatttgtcatcttcaggattttcttttttccccacatctttattgctgtataattgacaaataaacgttgtatgtatttaaggtatacatcctcagcattcttttttgatacagggtctcactctgttgcccaggctagagtacagtggcacgattatggttcactgaaccctcaacctccctgggctcaggtgatcctcccacctcagccttctgagtagttggaactgtaggcatgtgacaccacacccagctagtttttctttctttctttctttctttctttttttttttttttttttttttttttggtagaaacaaggtttcaccaaattgtctaggctggtcttgaacttctgggctcaaaggatctgcccacctccgtctcccaaattgttgagattacaggcatgagccaccacacccaatgagatcttccattaaaattattacttgtttaaatagaaatattttaaagggtaaatgaattacactcaagacttaaggactatgggcattggttgtcaatgaaaattaagcatggaagtaaatctcatggaacattctagattgatttatatttgtctttgtgtatgtgtgtatgtgtatgtgttttaggccagacctatttgactggaatagtgtggtttgccagcagtcagccacacaacgactggaacatgcattcaacatcgccagatatcaattaggcatagagaaactactcgatcctgaaggttggtaaatttctggactaccactgcttttagtatggtagagtttaatgttttcatctgagacttgtcatttctacacaaaatacaaaactacatatcttaagttttccaatactgtagatatatttaaaatgttcagccttcttgcactatattatgaattgtcttatttaattctagttctcaaaataccagtatctaaaattgcagtgaagacttttaggaaaaaagcctttaaaatgtgtatgccctatggatggagcatactgcatttggagtgcattgactccaaataattataaaaagttaatgttttgcttatgctaccaagagatttgatagagtaatcagctataattaattagctactcttgccaatttcattcatatactctataaaaggcaacatggtttactatttaaatcaggaaatctattcctgccactacttctgttgtaatttttcactctggggagatcctctgttggatggttactcattttctgcttctttagttgataggcagaagtgtatttatatttttattacattacacttcaataactttgactcttatctctggtgctacatagtcataccttccagacgtagagattacagagataataacactgtgacctctactcttcttctagcctatgaagtacactttttgccatgccaattttgaaatggtagcctctgttctcaattctcaaggctttactacactctaaaatcaggagttggaaaagtgaaatcggtgggattgaagatgatatttgggtagaagctgttctacaatagaagctgataattaaatgcttttgggaatattaaatcgatttcatcaattccaaaacaggagatctttcaatatggatggtaggtcccatcaagaaaactcaaaaatgacccagaagacagccttttgccagtgaatttattatcaaccagaatctagtactcagttttgcagacgcagaagcctgattgcctcagatcatctagcagatccacattggggtgggaggagttaactttaagtttaaaaagtgatatataaataaaaatggaaattcagtaatcttaaatgagatataacaagcagcagaatattcacatacaattgacaaatatattgctcttgataagcacatgtacttgggaaagcaaattacaacaaaaatgttagtttgtgaagttgggatcagattaagttgacttgaaatgtttcttctcctttggataatgcatggctgaacactgaatactgtaacccctttttattgcttctatacacgatagtatccctcctacccctgtttttagctctaagggagaaactattaatcctacgtccttagtttgcagtataggggaggattactttactattgactcgtagtacacatttgtatgttttctcttagttcagtgaggtagaaagggcagacataatgaaaatacggacttcaacctctgaggataaagagctatactgtatgaatttgaaagataaggctgttaatatgtttgttttttattgaatcacatatggtcagttcccattattggggtgtatgctctagttattcttgtgtgtgtcctatcctttcataaaacagtaagagaagatttaaaaatagatatttttcttattaagtgacaaaatggcttttgacctctagtgctcctttgaacttacagaataggagtgcctaaatgggcatccacatcataatcagaaaataggtaaatatatacacctatgtatatatccacaaaaaatttaaatgaataaaaacaattttaaaaagtaggttgacgagcctgtaatcagaaaaaggcaggtacatgaatagtgtattttatagctaaaagagcctggtatacctaactccatatgctctcctaagtgggaagtatatgtagaaaggtacattgtatatcctataagatcaccattttactgtctcaaacttcaacaatttaaaatcaacaaaatgtaatatgaaatacaggctgattaatgaagatccagccactgcttatggtctcgttttcccaataaaatctcatatctgtaaagcctttctatatatagactcttccaattgaaagagcatcttatcgcttaaacaggtttcctgtttatttgcgtagaggtgtttgtagtattctctgatggtagtttgtatttctgtgggatcagtggtgatatcccctttatcattttttattgtgtctatttgattcttctctatttttctttattagtctatctagcagtctattttgttaatctcttcaaaaaaaaacacctcctggatttgttgatgtttttttttttttttttttttttttttaaatgtttccgtctccttcagttctgctctgatcttagttatttcttgtcttctgctagcttttgatttgcttgctctggcttctctagttctttcagttgtgatgttagggtgttgattttagatctttcccgctttctcctgtgggcatttagtgctgtaaatttccctctcaacactgctttagctgtgtcccagagattctggcacattgtatctttgttctcattggtttcaaagaacttctttatttctgtcagaattctgttatttacccagtagttattcagaagcagattgttagtttccatgtagttgtatggttttgagtgagtttcttaatcctgagttctaatttgtttgcactgtggtctgagaggttggttgttatgattttcattcttttgcatttgctgaggagtgttttacttctaattatgtgatcaattttagaataagtatgatgtggtgctgagaagaatgtatattctgttgatttggggtggagagttctgtagatgtctgtgaggtccacttggtccagagctgagttcaagtactgaacatccttgttaattttctgtctcgttgatctaatgttggcagtggggtgttaaagtctcccactattattgtttgggagtctgtctctatgtaggtctctaagaacttgctttatgaatctgggtgctcctgtattgggtgcatatatatttaggatagttaggacttcttattgcattgatccctttaccattatgtaatgcccttctttgtctttttttgttttttttaaatctttgttagtttaaagtctattttatcagagaatagaattgcaacccctgcttttattttttttgctttccatttgcttggtaaatattcctctatccttttattttgagcctatgtgtgtctttgcacgtgagattgctctcctgactacagcacaccatttggtcttgactcttcatccaatttgccagtctgtgtcttttaattggggcatttagcccatttacatttaaggttaatattgttatgtgtaaatttgatcctgtcattatgatgctagctggttattttgcttgttagttgatgcagtttcttcatggtgtcgatggtgtttacaatttggtatgcttctgcagtggctggtactggtttgtccttgccatatttagtgcttcctgaaggagctcttgtaagacaggcctggtggtgacaaaatctctcagcatttgctcgtctttaaagcattctatttctccttcgcttatgaagcttagtttgactggctatgaaattctgagttaaaaattattttaagaatgttgaatattggcccctactctcttctggcttgtagggtttctgcagaaagatctgctgttagtctgatgggcttccctttgtgggtaagccgacctttctctttgactgtcctgaacattttttccttcatttcaaccttggtgaatctgacaattatgtgtcttggggttgctctttttgaggagtatttttgtggatgttctctgtatttcctaaatttgaatggtgggctgtcttgctagtttgggaaagttcgccgggataatatcctgaagaatgttttcccaggtatactaatcaaacttaggttttgtcttttcacatagtcccatatttcgtggaggctttgttcattccttttcattcttttttctctaatcttgtcttcacactttatttcattaagttgatcttcaatctctgatatcttttcttctgctggatcgattgagctattgatacttgtgtatgcttcatgaagttgttgtgctgtgtttttcagttccatcaggtcatttattgttttgcctaaactggttattgtagttagcaactcctctaaccttttttcaaggttcttagcttccttccattgggttagaacatgctcctttagcttggaggagtttattacccaccttctgaagcctacttatgtcaattcgtcatactcattctccatccagttttgttctcttgtttggtgaggagttgtgatcctttggaggagaagaggtgttctgggttttggaattttcaccctttttgtgctggtttttcctcatctttgtggatttatctacctttgatctttgacattggtgaccttcagatggggtttctgagtggatgtcctttttgttgatgctattcctttctgttttagttttccttcaaacaggcccctctgctgcaggtttgctggagtttactggaggtccactctagaccctatttgcctgggtatcaccagcagagactgcagaacagcaaagattgctgcctgttccatcctctggaagcttcgtcccagaggggcacccaccagttgccagccagagctctcctgtatgatgtgtctgtcgacccctgctgggaggcatctcctaggcaggaggcacgggggtcagggccccacttgagaaggcaatctgtcccttagcagagctccagtgctgtgctgggagatctgctgctctcttcagagccggcaggcaagaacgtttagtctgctgatgctgcacccacagctgccccttccctcacgtgctctgtctcagggagatgggagttttatctgtaagccgctgactggggctgctgcctttctttcagagatgccctgcccagagaggaagaatctagagaggcagtctggctacagtggctttgctgagctacagtgggctctgcccagtttgaacttcccagcgactttgtttacactgtgagggaaaaccgcctactcaagcctcagtaatggcggacgcccctccctccaccaagctggagcctcaggtccacttcagactgctgtgctggcagcgagaattacaagccagtggatctcagcttgctgggctccgtgggcgttggatctgctgaacttgaccacttggctccctggtttcagccccctttccaggggagtgaacggttctgtctcgctggcgttccaggcaccactgggtattagactcccacacaataatagtgggagacttgaacacaccccactgtcaatattagacagatcaacgagacagaaaattaaaaaggatattcagtacttgagctcagctctggaccaagcagacctaatagacatctacagaactctccaccccaaatcaacagaatatacattcttctcagcaccacattgcacttattctaaaattgacgacataattggaagtaaaatactcctcagcaaatgcaaaagaatgaaaatcataacagcctctcagatcacagtgcaatctaattagaatgcgggattaagaaactcaaaagtgcacaactacatggaagctgaacaaacctgctcctgggtgactactgggtaaataatgaaattaaggcagaaataaataagttctttgaaaccaatgagaacaaacacacaatgtagcagaatctgtgggacacagctaaagaagtgtttagaagagggaaatttatagcactaaatgcccacaggagaaagtgggaaagatctataatcgacatcctaacatcacaattaaatgaactagagcagcaagagcaaacaaattcaaaagctatcagaagacaaataactaagagcagaactgaaggagatagagacacgaaaaacccttaaaaaaaaaaaactcaattcaggagctgtttttttgaaaagattaacaaaatagatggctagccagactaaaaaagaagaaaagagagaagaatcaaatagacacagtaaaaaatgataaaggggatatcaccactgatcccacagaaatacaaactaccatcagagaatactataaacatctccacgcaaataaactagaaaatctagaagaaatggaaaaattcctgtacatatacactcttccaagattaaaccaggaagaagtcaaatccctgaatagaacaataacaagttctgaaattgaggcagtaattaatagcctacaaaccaaaaaaagcccaggaccagacagattcacagccgaattctaccagaggtacaaagaggagctagtaccattccttctgaaactattccaaacaatagaaaaataaggactcctccctaactcattttatgaggccaacatcatcctgataccaaaacctggcagagacacaataaaaaaaatttcaggtcaatatccctgatgaacatcaatgtgaaaggctcaataaaatactggcaaaccgaatccagcagcacatcaaaaaggttatccaccatgatcaagttggcttcatccctgggatgcaagattagtttaacatacagaaaccaacaaacgtaatccatcacataaacagaaccaatgacaaaaaccacatgattatctcaatagatgcagaaaaggcctttgataaaattcactacccttcatgctaaaaattttcaataaactaggtattgatggaatgtgtctcaaaataagagctatttatgacatacccacagccaatatcatactgaatgggcaaaagctggaagcactccctttaaaaactggcacaagacaaaaattccctctctcatcactcctattcaacatagtattggaagttctggccagcacaatcaggcaggagaaagaaagggtattcaaattctctgtttgcagatgacatgattgtatatttagaaaaccccatcatctcagccgaaaatctccttaagctgataggcagtgtcaacaaagtctcaggatacaaaatcgatgtggaaaaataacaagcattcctatacaccgataataaacagccaaatcatgagtgaactcccatttacaattgctacaaggagaatagaattcctagcaatccaacttataagggatgtgaaggacctcttcaaggagaactacaaaccactgctcaaggaagtaagagaggacgcaaacaaatgaaaaaacattccatgcttatggataggaagaatcaatatcatgaaaatggccatactgcccgaagtaatttatagattcaatgttacctcattaagctacaattcactttcttcacagaattagaaaaaaactactttaaatttcatgtggaactaaaaaagagcctgcattgccaaaaccatcctaagcaaaaataacaaagctggaggcatcatgctaccttacttgaaactacactacaaggctacagtaaccaaaacagcatgatactggtaccagaacagatacatagacgaatggaacagaacagaggcctcagaaataacaccacacatctacaaccatctgatctttgacaaacctgccaaaaacaagcaatggggaaagcattccctatttaataaatgatgatgggaaaactggctagccatatgcagaagactgaaactggaccccttccttaccccttatacaaaaattaactcaagatggattaaagacttaaatgtaatacctaaaaccataaaaaccctagaagaaaacctaggcaatacctttcaggacataggcatgggcaaagacttcatgactgaaacaccaaaagcaatggcaagaaaagccaaaattgacaaatgagatcttactaaatagctcctgcacagcaaaagaaaactatcatcagagtgaacaggcagcctataggatgggagaaaatttttgcaatctatctatctgacaaagggctaatatccagaatctacaagaaacaaatttacaggaaaataaccccatcaaaaagtaggcaaagggtatgaacagacccttctcaaagaagacatttatgtggccaacaagtatgtgaaaaaaaagttcatcatcactggtcattagagaaatgaaaatcaaaaccacaatgagataccatctcatgctagttagaatggtgatcatcaaaaagtcaggaaacaacagatgctggagagaatatggagaaataggaatgattttacactgttgggagtgtaaattagttcaaacattgtggaagacagtgtggtgattgctcaaggatctagagccagaaataccatttgaccaagcaatcccatcactgggtatatacccaaaggattataaattattctgtgcttatttcagcactattcacaatagcaaagacttgaaaccaacccaaatgcccatcaatgatagactggataaagaaaatttggcacatatacaccatggaatactatgcagcaacaaaaaaggatgagtttcatgtcctttgcagggatgtggatgaagctggaaaacatcattctcagcaaactaacataggaacagaaaatcaaactcggcatgttctcactcataaatcggagttgaacaaccagaagacatggatgcagtggagcatcacacactggggccttttggggtgtgtggggctaggggagtgatagcattaggggaaatacctaacatagatgacggattggtacagcaaaccaccatggcatgtgtatacctatgtaacaaacctgcacgttctgcacatgtatcccaaaacttaaagtataataataaaaagtttcttaaagtttacttatggctgcaaataagatgaggattcagcataagtcatatatttttaaaatatgtcaattcttgccattgtgttagggaaaccaccaagtacacatttatacatttttgctcagcatttttcaggagataatctcaatgatgattcaaagaaaaaaataataactcataagaatttttatttactgactgcttagtcacaaaagacagaacaccatctcttgaagtctcagacttagaacactctcttcgatagatttaccagcaaaattcgtgattcatgcctgtatagtaattgcttttgtgatgttcatatttttatttaaccagatattggttctgtagcttatgcatgatgttggctactctccaaagaaatttcattttaaattagttatgccccttaggagaataatgaaacatttggggagaattttattattgggggattgaagctatatttggtttaagaaatacctgccaaataatgctttgacaattttaaacataagctttgttgatagaattgctttataaaattaggaagtcattgaaaccttgtaggatttcatatatagaatttgatatgctttggccttaactggtgttttgaggcctgaggtttagttttaagtggaattgccttttaaaatgagtagcagtaggcattagcataagcgatttcaggagctgtttctagtgtgtttagatgctaacatatgcaaaaataagtacatctagggtaaacttaataaattatgtatgtttatgctcatagataataggtatatctctttaaaaatatccttttgtgaatcagacaattctcttcccgttatgatttctctgtaagacagtacattctacatgcgttggtcgtgggtttcatatacattgtttctctgagtttcaaacagattggtttgtttgccagtccaaaaaaaaaaaaaaaatcctccctatattaagagagtgctttgtcagctttcccctgtgaataacaaagtgaggatgttctctttaaaggaataaaacaaaaaatcagggataaaagattgcgcctgttctagatgtcttttgaatattagtgtagaaagccatttccatttaggatatgaaatatgatatggaaatgttcttacttatttaccagggtaactttagaacaaaaatgaataatgacagtcaaatttgaccaaaaaaggaaggacactaggactcgagagaaatttttgtatcctcaaaatgacatttacaaacccgttagggtttggttttaatcccctttattttgacttcctgagaatggtgacacggattctattttctgcttggctaatccctgcatcactcttgagttgtttttatagccttcttttccaagaattagctctgcctgttggaaagttttactcctggagtgaatgctttcagacttggctttgtatgcatgcaggattttaacctacaaaaataatcatggaaagatacatagaatttgctataaaagagaagaatatttttaaggcctcttatgttgggtttgatatcaattggctgaacaagggctgttttaacttttttccgcctctgctgtaatcatcacattttgataccataatggcaagaaatgtttataagtttacacaggttaaaattgagagggttaattctcaggaggattagagttaatttaaataaataaatatttttgtgaacataaacactaattttatatcatttagattgatttttgtctagaactcattatagagtaccttgttttcagaaaatctaatgcgattgcaatattataggtgttccttctctatatacggtatttcaactagaaatccttactgtaaatatttcagacaatttagagtcaaactctgcagttgaaaatatatttaagaaaatatttaagaaaatatttcactggcacttacatgaatgaaaaatggccattgcctttttgatgacaaagtaatatataccaaataggtatgatacagatgattatattaacattcagatattattgtagcaatttcctcttccctgatgggaaatcttgaaattgctcttcatgacaaaaattaagacgtaaatgttatttcccagtggcctaaaagttagaagaggcatgagagtattccagtgtgttctcttgatgttatgtgttgtacatctttctcagttcagataccataaaaaaactgagtattttctgggcagttggaaccagtcactaataaatgaaagcaatttttgttctccttatccatttcagttgtttggatgacaaataattgcatgtaactgtcccaaattcacctacttagacaacagagacttgaaaaacattaaatatgatatttgtgtgtgcgggagcctggcttgaatttaccctttataacaaattttggtattttctactaatctttcacattcttctatgatttgtcaccattttaactttatggaaaatggtcaatttataatttctatctcccctaggggctgatttgttaaagtatgctttagttaagtaagagtttcttactcagttggggaatttaaataatgaagtataatcatgcgattgaagatgtgcattatggattaggttctatgccaaatttgttcagaaacatttaaatataattcttacctagataactgagaatctcttttcaattagcttaccaggattattttcacaactttttttttttaattacaggtgaaataacaatatccttggcctatacagtgacattaagtgatttttgaatgattgacaagacattaataaattaataatgagaaatgcagccatgaggttctaatgctaaataatatgtaatagacactttgtggatggttttcctagtcatatcatcacaatgagttcatgagactaaagaaatatattaaaaacatctattggtatttgttaattttatttcagctatgaaggaatacatgagatattaggtttgattcagaaaagtgttctatagttgatatctgtgtttcttgtcacagaattttgccttggcaaaaacattttgaccattctaatgatggtaaatgagaataaaatggcataagtagtttaaaattttctatgtggttttaagtcagtgataatatttgaatgtaatgtatattttgctgatagttggaaaacttacttcactgtcttcaaaatggagttaactgtgttttatacataattataagtgatatcacagggctgggtgtgatggctgacacctgtaatcccagcacattgggaggccaaggcaggagaattgctttaggccaggagttcaaggctgcggtgagctatgattgtgccactactctcaagcctaggcaaaagaactgaggccctgtccccccatcccacaaaaacaaacaaaaaaagacatcacagaacctgcaaatgaatatccaaaaaccttaaagctgggcactggaaaaatagatattaggttggtacatatgttttccaattaaataatttctatatataaaatgcatgtgacattttacagctggaacatgaaatataagatgaaaatatactattttacaacaatatttgggtaaaataatgatgaactaaagtctttgttgatgtcatttaaatcttataagagggaaatttaattgtcatacaataggatttattccttgcagagggaaacctgaagatttatagttgtcttgtcattttattttaaagcaataagctatcctcttagatttattctctttttagaacttttatttttattgatgcataacgttttacatatatgtacatacatgtgatattttgttaaacgcactgaatgtgtaatggtcaagtcagtgtatttggggtattcattactttgagtatttatcatttttatgttctgtgaacattttgagttctctcatctactttgaaatgtacatcatattgttgctaactctagtcacccctttctgctgttgaacattagaatatataccttccaactatatatttgtacccattaaataacccctttttatattcccttcctacccttcctagcctctggtatcttattatactctctatttccatgagaacaactttttttacacctatatatgagtaagaaaatgtaaaatctatttatctttgcctcgattgtctcacttaataacctgcagtttcattcatgttggtgcagaaaatgtaattcttttttatggatgaagagtattccactgtatatatgtaccacattttctttatccatttgttcactaatggacacttaagttgctattataaatagtgcctcaataagcatgcaagtacaggtatgccatgcatatacttttcctgatagttagaaaagtatatgattgctttccctttacatatatacttattagtggcattgctgacacatactctatttctatgtttagttttttgagaaatcttctccatactgttttcaatagtggctatactgacttatattctgaactacaacaatgtattaagagttcccttttcgttgcacctcgtcaacatctgttgttttcttgtctttttaataatagccattctaactggggcaagatgatggctcatcatgacttgatttgcatttccctaatgattagtgatgttgagcattttttcatatacccgttggtcatttgtcttcttttgagaaatacttattattgtcctttgtccatttttaatgtgattatttttttactgttaaattgtttgggatcctcgtatttcctagatattagtctcttgtctgaatagtttacaaatcttttctcccattcagcaggttgtctcttcactctgttgaatccttcctttgttttacagaagctctttcattttctacagtcccaattatctatttatgtttttgttgcctgcgcttttgaggtcataaccataaaatctttgcctagaccaaggtcctgtctgttttccctatgtttgcttcatgtagtttcagttttaggtcttacctttaaatccttaatccatcttgagctgaattttctaatatggtgagagacagggatccagtttcatacttctgcatctgacaatccaattctcagcaccatttgaagaaggtgtccttccccctaatgcatgttcttggtgcttttgtcaaaaacaagttgtatgtaaatacatggatttaattctgagttctctaatctattccattgttctatatgtctgtttttattctaacaccttgctgttttgtcaagtagtgtgattcataagtctttgttctttttgctcaggattgctttggctattcaggctctctgctggtctttgatcgtacaaattttatgatcactttttattccatttctgtattctgatagggactgcattattcaatgtagaatgctttgagtagaaagatcatgttaataacattaattcttctgaccgataaacatgggatgactttccatttgttggtgtactcttcaatttgttttgtcagtgttctgtattttatacggacctttccctcctgggctaaacttactcctaggtattatttccagccgttgtaaataggtttgccttcttgatttctttctcagccagttcattattggtatatagaaatgctactgaattgtgtatgttgatttttgtatcctgcaactttactaaatttatttatcagatctgagagctttctggtgagggtttagctttttctagctataagttattaacaaagagcagtacttggacaacgatttcttctattaggacgccttgtatttctttctcttgattgctctggctaggacctccagtactatgttgaatgagtggtgaaagtgggcatccttgtcttgttcttttttttgtttttggttttttgtttttgagatggagtcttgctctgttgcccaggctggagtacagtggcccaatcttggctcattgcaagctcagcctccagggttcatgccgttctcttgcctcagcctcccgagcagctgggaccacaggcatctgccaccatgcccggctaattttttgtatttttagtagagatggggtttcaccgtgttagccaggatgatctcgatctcctgatctattgatccacccacctctgcctcccaaagtgctgggattacaggcgtgagccaccacgcctgaccattccagttttatagggagaaatttttcagcttttccccattcagtttgatactacttgtagatttgtcatatatggtctttattttgttaattttttttgtatgcctagtttgttggagtttttatctcgaagggatgttaaattttatgaaatgttcttttgtgtctattgaaaggatcatgttttctgtttttcattctgtttgatgtaatatgtcatatttattgatttgtgtatgatgtatccttgtatcattgggataaattccacttgataatattacattttttatgttctattggattgctagcattttgtagagaatttctacatcagtgttcatcagggatgttgtcctgtattttttgttgcataattgtctgggtttggcatcagggtaatgctggcttcatagaatgagatagggggaattccttcctcttcaatttttcttggaacacttacaggagaattggtaaagtttggtagaattcagcagtaaagacatctggtcctggactgtcttcgttgggaaattttttaagattactgattcaagatcattactaattatagatctgttcagattttctatttcttcttgatccacggttggttgtatgtgtccgggaatttatacattcctctagatttttagtttattatttaatagttgttcagtatagtctctgaactttttatttctatggtatcagttgtaatgtctccgtcttcatttatgattttgagtcttttttttttcttggttagtctagcaagtgctttattttcatctttttaaaaatcaaacttctcatttcattgatactttgtattttttgctctctattttcttgagttttgctcaatttttaggattttcatccttctactaattctgggtttggtttgtttttttttctttgactagctccttgaagtactttgttagattgtttgaaatatttcaacatttttgatgtgagcatttttgctatatacatcccccttagcactgcttttgccatatcccgtaggtgttattatattttgatattcatttgtttcaataattttttgaaaacatttcctcaattttcttccttgacccaatggtcattcaggagtatgttgttcaatttccatgtttttgtacaggttccaaagtttctctttttgttatttccttgtgttttaagaagatattagatatgattttgattttttataaatttgttaagacatattctgtcataacatatggtctgtcctggagaatgttctgtgtgcttatgagaaaaaaatgtgtatgactgttgaaggaattgtcctataagtgtctgttaggactatttggtctaaggagcagtttcaagccaatgtttctttgttaattttttgtctaagtgatctaatgctgagagtggggtgttgaagtcctcagatattactgtatttgcatctagctctccctttagatctaatacttgctttatatatctgggagctctcgtgttgggtgtatgtatgtttagaatttttatatactcttgctaaacttatccctttatcattatataatgaccttattgtttgtttttactgtttttgactgaaagtctgttttatgtaagcatagctgctgcttctcccctttggcttcggtttgcataaaatatacttttccatccctttacttcaaatctatatgtgtctttacaggtgaaatgagtttattttaggcagaatatttttgggttatatattttttaatccattcagccagtttatgtcttttatgtggaatgtttaatcaatttacattcaacattattactgatatgtgagggcttatttctttcattttattgatttatggttgttttgaatattttttcttcatttttttccctcattatcattatagtgtgatggtattctttagtggtaacatttgagtaacttttcttgattttttttgtgtgtttgcactactagttgtttttatatttttatgtgttttcatgatggtagttgtcattctttcacttccaggtataggactcccttaaacctttcttgtaaggccagtatcatggtgataaatttccacagctttcactcgtctaggaactattttatttctccttgatttatgaaggctaccttggctgggtagagtatccttggctggtggttgttttctttcagcaagtttaatataacatctcattcttctctggcctgtaaggtttcttctgagaaattcactgttaatctgatggaggtttctttataagtgacaaggtgcttttctcttgctgtttttagaattctctttttgtctttggcttttgagagtttggctataatgtgtcatggacaagacatttttgaattgtatccctttttgagatctttcagcatcctgtatctggatgtctaaatctcttgctagacttgggaagatttcatctattattttgttaaatagggtttctaaacctttagtttctcctttaccttctaggacataaaaaatgcaagcatttcatggctttatggtgttgtatatgtcacataggctttgctcatttttttaaaattttttgttattttttgtttgagtaggttattttaaaagacctgttttcatgttctgagattcttctgttttatctagtctcctcttgagtctttgcctttgattctgaatgtatatagtagtatacttcctgtatgatttctttggatgtaaacagtatgaatggtgtctgtaacttcctcagtagcttagggtgcagttgttagcagaagctgtggtgaagttttgccggtgactgggacaccaagtggtccagtcttcaggccccagtggtggcatcagttggttgagcgtgcctgtcctcaggcctcagagctgtgtacattggcattgatgttagtgtgtccaggcaggctaaccctttggcttataggtggcttgcttggttgtcaggaaaagcataggtgggctgggtgggtacacaggttcccagcccaggggcagcaagcatggtgcgggtaatggcaatagtgggaggggggcaaccctctggaatgcaagcaatccatgatggtgttggtggtggatgcaacagattgggcaagccagttcctaggcctgcagatggtgcatgtaggttgacgccagctttggtggtagtggaagcttgagtgggcccaaattcaggccccaggaagactagtcagatgccaatggtggtaaactggggtgggagagccccaggtctctatacaaatttttatgtactgggggatttggaagagcagagctgggaagacctgtcctcaggactcctggtggtgcatgcaaccactggttattgtagtcgaggggcaaggtgctccccaggtcccttgtgcaatgctcaggtggaaggcagtgttggctacactgtggccctgctactggagagggtaaggttgctttccttgggagcagccataagcagttgcctgggtagcctgtgcgtcgcttgtgtctcaactccacagcagttcacagtgacagcatttgcaggcagtggaattagtcttcagtgtgcatgaagttgagtggccacccctctgttgggcaggggagggtttgctgccagtggttcctgccttggccccagcagttgcagccatgggtgggaaatatcactgagactccaggaatgtggagatagggaagatttttagtcctaggtcaggacatagactggtgggggctgggctctcaaaaccaggccatgttgcagctgcttaggactctagagtttgtggaacccagcatgggcttcttccgtgaagcaatgcctttgcacagtatctagacagctgtgtgttggtttgggggcccacacgggttgaagggctctcaattggctaggattgtaggaatcttgtacaagaatgtgtacctttgtgcatctctaattctctccccatgttagggagcctctccagactcctagccaatctcagctggatagagtgcctcatttccttctttttccttttagtggttttcattgcttctctgttgaatttcagtgttttctcttagttaatgtattcaaagtatgattatctacttggtactttggttcctctccatggaagaggtgagtaacagatccatcaattcagccattttgaagccccagattttttgtcttatggcaatcgtgtggagttagtggatcatatgatatccagttgaaaagtgagaaaactgttacaactattaaattattaggaattttatatattattacaatttaataaggtggttgaaaccagtgtttttacttttaggaaatatcctgtaatatcattcttgtgagatgttaatattgctgaataaacttttgcttcaaatcaaagcacatttttcccctgcaaagatttttctaatttatcatcagtgatataaactcaaatttgcaagttccttttggtagaagagtgcaaatgtttaagtagggcagtcatgttctagataatttccatactttatcttatgtcttgtacacaacaattccaggtaagtttatccttcttttataaatggaaaaactgaggcttagagagctttattaaaatcaagatcacacagccaatagataactgagctataatcaaatccagggtttatctcttcttaaagtccgtgttatttctcacaagactgtccaataaaatcggttggggaagctttatggcaacactgggattgaaactagtattttatttcactgaggacgggctgtgacatcagcaatttttagaagctcagtaagtgagagtatcctgcagctaagatagaaacaactacaatggaacaattgtttctgtgagatatgcccttttataggataagatccagaatctgttgtcccagcatttgtttagacttctagcattttcttccttaaaaaatgactaagcctgctgttcacatcttcaattactggagtactgcttattgctaacagttctgttaatgagaaattgttcatccacagacaaagtaaaaatagactagctgtcacataagactggccatcaaaacattctctttaggattaagaaacttgccttatctcctgtctgcacagttgtctctcttcattccttcttctatttattgcttcacggacatgtttgtgatagaatggtactctgactcaaacagtttccagcaagggttgcccaggtgagaggagctgtttgcagaggtgatccctgactctttgttctttaatttatttcttcttttgcctgcctctctcatcttgttactaattgacatcactgtgttctgctatctgaggtttgttgatgccttttgcagccaataaaaatgtctttcattggcagagctgataaagaactagaagaatttttaataataactaagggctaataagggaaaacaattaaaatgatggtaaaataatagttttcaaattagaagtctgatcccataaatccacttgaaataagcaaatggcttaattttatgatctctgatattaatgccataaataggttgaatttatttaccatttatccagggttagttttgctaaacagtttgtattttagccagatatgcaacttttactgacaggacataatgaactttggagcctgcactgttagtgtagttgtaaggagataaaattggcaattatactcacagatggaatagaatttaatctatgacatttacttagctgtacagaaggatacaaggcaggagatacactgtcatagaatctttgtatcattggatggcccagaagcaaccaacatacagatttccacatgcctctcacccaaatgtgctccatatagctgctaggacaacggccaaaatcagtgtggtttacttgacatgaagaaattgcagcattaatttcccaccaatatttaataccattgttgtcacataggacaaaagactatatattgcctctctgccccactccccagttaatttaatagtagtcctacctagcaaacaagagtgacaagaaattctactattatcttaactcttaatcctaagaaaataagtttctatgttcattttcctaggcagcatcagattaacctagggttgatttaactttttctacacagagccaactagttttgggttaaaatctgatttttgcctttattagttttaggccactggaaaattattgaggctcagtattgctcacgtgtaaagtaaaaatatttacctcccactgctacttcaaggagtaagtaaaacctgtatgtatttggcccgtaatatgagcccagaaacagtagctaaagttatgtcaaataactggaatgttgtaaaaattaaatggtccctttatactcctgtagggaaaactgatctttccagttattttgcctgcctctagaataaatgctgactctccccaaattaaatacaggagtcctcccttattcattacagtttctgctacccatggtcaaccgtggtccttaaattgatgagtacagtacaattagatgatggtggggagggtgggcagggagaggtgagagtccacattcacgtaacttttattactgcatattgctataattgttctattagttattaatctttttctgtgcctaatttataagttaaattttatcataggtatgtatatgtatgggaaaaacagtatatatagggcctatttgtggtttcagacatctgctgtaggtcttggaacatatcccccgtggaaaagggggatctactgtcatttcccatttgaaatcttgctggtcttcctgtgaccttcccactcattctggttttctggtctgaggaatactgctggctcacagctggtgtactgggtggtaatctttgatatccttgagctccagagtctaatctagttttcataaaagatttatactatatcttaaattcctcagagtggttctctctctctttctctctctctctctctctctctctcacacacacacacacacacacacacacacacacacttgacagagagattgattcacagttgtcatggatacatggtagatttctagcaagtctcctgaaggctggttcatgatagtaccttataattgtcatagtatttgtaagacattagttagcacacttgcaaaagtataactaggttttctcttgtagtcattacgtcatatgacatcgtaaaagtggttgaattggttcccagactctcagaaaaactcaacttctgaagctgggagtaatacatacatagtaatattgatgtaatctggtgtgatatttattaaacattaagtgctgggcacattgcttgatattgtataatttcgttttatttctgcaaaaactctaggaggtagagactattattttggtcatttgcaactgaagagtttatgtaaattgcccacatcactcagctagtgagttggagttaagattccctacttgtaactactacagaatataatcttatggcagaatattcctctcttcttccatgaatattttctttgcattaactaaaaggttactcattttattacagggctaattgggtttgtttttaattggatgcacatccatcagttgattccaaatgttttgaaaataaatggaaaagttttataaactagagccagaataagagggatactgaattctttttactatgatgtttccttgagagaatcattaaataattaaagtagaaggatgtttacaaatcttgcaagtatgacattctatccaagccacactaaagttatcaaagggagacactcaccagttatgaaaatattcccctctactctttctcagttaactctaaaattagatggcaaaggcatcaaaacatctcactatctcaaatatttcctcagtgaggtcgtgatgtgaacatctcttatctagattgaaatcccaccttgagtcatatgtggattaaaaaaaaaagctattatctgagaaagtctaaataaaaagatacattttacctaggctttaatatctaagtttttctgtatagaatcagttgggcaagtgagtctcttggaaaagtgatttgaaaactgtttttattaataattggaatacacacacacacacacacacacacacacacacacactcttattcctcctcaagaggcaagagtacatggtgaagcccttaataaattcacctcactgtagttaaacagcagactatgatattgttgtagttgttaatcaaagggactctgaaaagagacagccagaagtggggaaaaaactagtatagaaaaataacgattgggcatttgagtatttggaaaaaacctggtgaagtaactaggttttaaaagactgaagagaaagacaaatttcacccattgcaaaatataacaacgatataaaaatgagacataagctcctggataaaaataaataatgtatttttttctctctattatatctcgaattttgctttcaccaacaaactgcatgtgaaatacgaaaaaagttaaaaaatatggaatattaagggactataagatgagaaatttttaaattgttataacctaagtaaaactgctaaagctagttgtagcgagatctgtcttacataaattttccattaaatgataatatctttgcattcatcataaacagaaatgtacattttaagcaaaatcattataatagaaatgataatactccttacctagccttcttcacgttaatcttaacatagactagtgaagaacatagcaaaggtagtgcttgaaggaatgttcttattgaaagaaatctttcctcagattgatcaagaggcattgaataatcataataattcaaactttaatcttgcagatggaatgaaaatgtttaaaattagaattattgtcagagcttaaatattgttacttacacaagccaaatacattaatattatgagcactattgttttagctaatgtgtcttttactctgcagagtacatatagactagtctaaaaggttttttttttttaatgcttttatagagcacgagcatttgtgcaggtggctgagtagactaagattttttccaatgggttgatttgaccacatcattaataaagtagaaattctggagcccctactttttattcttagtctgacattgtaaattctttcagatgctacataagcattttaaagttatgtgccccaggcttactttgttcagtagaaatgcatgttaattcatcaaatgtctattgataactttacataaggaatagtgctatatactccaagtgtgtcaggaagtaaaagatatacagtctgccaaggtattgaaaattgcatataggccaacaaacaatatataggtaactgttatataagacagaatgtgaactaattcagagaatattttttaaagtacagagcatgtttttcattctaataaatgtacaaatatttatgtcaaatgaaaatgtggctgcatcataattcttatatgggattttaaatataccaaaatccacggatccatacagtagttcttactctgcttccctaattttattagttggacataaatgcataaatcgataagatgattttggagcgggaacctaactttttctatagttccttggaagttaattgatttcttaagtgataaagtccaccactattttgagtaaggtttagttaatgatttctgtttaacatgtgtgatttctaataaaaagttctggatttattttctcttgttgaaagttgttcattagaactgacacctgagctaacataagcaaaagtcattgtaagtccacacgtttgcacagatgggtgtccccccaccatccttaggtttgagcaatggatttttacaagtgaaactcagtgcaattaatcacctccaacatgagaaaatgctctttaaactattttaagtcaacatttacaagagaaattggcctataatacacctcgggttcttaacctttttgagagctatagaaacgctgcttctctataaaggtaacatatattgccaataaaatacataagggaggacatctacttataaaactcagaaaacgatttaataggaacagttgttttattagccttctgctctttaatggctgagatcatcctggggctatttaaaaatgatttaatttgtcctctaaacacacagatgagttccaggtgtgtatttcccccccccacccccgctccatgaatcaaccatgtctgcactgacattaatagcttggatcgggaaatctctgtaataataaatctatcttttaagttggtcatttaagcagctttaagtatgaaaaaagtgaagtattagaactatttcaatccatgatgccttatagattatactttaagaatacgactgtgcctcactatctgagaactggttctaggaactccagatactaaaatctgtggatgcttaagttccttatataaatgatgtcatatttgcatataacctatgcacatcctcctgtttacattaaattatctctagattacttataatacctaatacaatataaatagtacgtaaatagttgttacattttattctttgtgtttaatttctaggttcagggttacacatgcatttttgttatatagataaattatgtgttacaggggctctgagtacagattactttgtcacccaggtaataagcatagtacccaacagggagatttctatcctgttaatttttattgtatttcctgaatatttttttatttgggaaacaatttattttttttggaaatttttgtgggtacatactaggggtgtgtgtgtatatatatggtatatatgtgtatatatatgtgtgtatatatataccatatatgtgtatatatatgtgtgtatatatataccatatatgtgtacatatatgtgtgtatatatggtgtatatataccatatatgtgtatatacgtatatacacatatgtgtatatacgtatacacgtatatacacatatgtgtatatgtatacatatatggtatatatgtgtgtatatgccatatatctatatatatggtatatatatatacatatatgtatatacatatggtgtgtgtgtatatatacaccatatatgtatatgtgtgtgtatatatacaccatatatgtatatgtgtgtgtatatatataaacacaccatatatgtatatatacgtgtgtgtgtatatatacacacaccatataggtatatatatgtgtgtgtgtatgtgtgtgtgtatataatttttgtgggtacatggggtgtttgtgtatatatgatatatatgtgtatatgtatatatatacgtgtgtgtgtatatatatatggtacgtgagatgttttgatagaggcatacaatatggaataagcacgtcatgagaatagcatgtcacctcaagcatttatcctttgagttataaactaattacactcttgaagttattttcaaatgcacaattattgactatattcaccctattgtatcaaatcagaggttatttgaatttgcagatacagaacccgcagatacggagggcccactgtatatcactaaatcattcatacctctccacctgtacaaccaccaccatagttcaagttattctcatctttttctgtgactgcaggaagaacttgacaatgactggccctattttctttctggatttaacttaattctcttttacacacaatcatctagcatgatatttacatagtttaaggccttagcacttgctgttccaactccctgggatgttgttcttccactctgcatttcacagctgaaccccagaaagattatgtcctttgttgatttaacccttctcagaatagcatgtgtctctgttactgcatacatattgaaactattcttagttttttgttttgttttgtgcttatgttatcacatactatacacaccaagtctgtaggctgtttttttgatattctagtgatttttaatgataatatttaatacatatatgagaaaagaacctttttaatgttaagggagagcatgatctgtgaaattatctgtctttaatttatctttggaaatgaacatttttcaaagttttcattagattgtattcaaaattggtttttattctaaaaaattaccatgttactatttcatatttaaatgcaactaggattagacaagcaacaataataatttttttcttacctgggagcctacatgaatactgagtgtattaagatatcaactgagatatcttgctatcttagtttgaggagaataccatatatttggggaaatagagagaaagtggagtgaacatgtaatttatgtctcttaaaggtgactcaaatgttctttatctgtatcttaaaatctttagtgagcattcttccttatgtttaggctagttttctctctgagataggtaaagtaagctactttgccttagtatgcggatgtatgtgtgtgcacgtactcatgtgcccatcttgtcaatacatggagagatggaataagacgaatgtagtatgtctggggtagaaatttggttgcaggagagaggctgacacattcacaagcagcagcaagggaagagggattactggagtagaggcaagggagaatttatttacttaattacataatacttatttagaatctacagtgttcccggtatattgagttatatatgagaatgcaagaaaatgacatcactagtttaaagatacaatgtcttctgtttttcaaatgtttcgttgattttgttttattcaatactgtttagtacaatattaacagagtaaacaacagtatgagtccttctcatgtttcactttgattgtatcattgatatttaatccaacgtaaaattcctaaccttcaaaaaataattctcacttaatgttccagtggagtttgttcccaccatagtactgctggcctatcacaatgctgtaggtagttgtagacttgttcagtcctgttattggtggtgacttcctcatgtgctgggacctttattattcacagctgaattcccagagcataagagtgccttttttttttttttttttctttttttgagacagaggctcgctccgtcgcccaggctggagtgcagtggcgcgatctcggctcactgcaagctccgcctcccgggttcacgctattctcctgcctcagcctcccgagtagctgggactacaggcgcctgccaccatgcccggctaatttttttattttttatttttttttattttttttttatttttagtagagacggggtttcactgtgttagccaggatggtctcgatctcctgacctcgtgatctgcccgcctcggcctctgaaagtgcgagtgcctgttttttaatgtacaacaaatgtttcttgaagacacggcttttacattagcatattacatgaaagtgtgagggtcattaatatgtgtgaagaccagttaggattttaaagttctgatcagatacgttatcaagctgatagattaaattaactgattaatccaaggaattaacattaacaagcaatgaaatggtcagtatccaagtattgaagttgtatttgggttttacctaatattttccttgatcttactggctactttgttgtctaagctgaagaaaggccttcctgattacctttatttaaataaaataacagtggtgaaggtaatttcaaaaaatattaactatgctaaaacatatacctgtggtttgatatacaagaagctgcagaaggttctcagaaatatgtaaaacaatttattcccaaggtaattgataattgtatgcattcttacagaataagctgttataaaatttcaaactttatctaaaactcaatagcacgtctcataaaatgaactaaatagttctgtcgggcataagaatgtcggcttctagtatagaattccatgtatggtacaaaagttgtagagagattgtgtaattgctacattcatcgtataattttagaaaaatcctcttggtaatttatatggtaaaaattgactgttacaattagaaacataaggcatattttgtctcaatggattttattgagtatgctaaagcaatacacactacatatcgggtaagtgtgtgtactatgaggggagaagtatatggatacacagatcatgatttctatgtaaaatttatatcaggcttgtatgggagaagatacatgacaagttaaaatataaaatgaccacataattaaagtataatttaaattgggattattataatttaaatattttcccaagaatatcttgaatagtaatctttaaaatttttctttttttgatttttttattatacttttagggtacatgtgcataacgtgcaggtttgttacatatgtatacatgtgccatgttggtgtgctgcacccattagctcgtcatttaacattaggtatatctcctaatgctatccctcccccatacccccaccccaccccaccccaccccaccacaggccgtatgcagccataaaaaaggatgagttcatgtcctttgtagggacatggatgaagctggaaaccatcattctcagcaaactatcgcaaggataaaaaaccaaacaccgcatgttctcactcataggtgggaattgaacaatgagaacacatggacacaggaagggggaacatctgtaaaatctaaaaataatttagtttcaaaagataactttaaaaatgtctaaatgctagtggtaaaaattaaatatgtagatgatttattaaacattttaaaaacctcatgaaaaagggaatgtgcgacaaaagactaatttgcagctatcaaaaaataggaacagaaaaaatgtgctagcatattaatataaatattaggtgtcattgtgtgtccgagcaacattgttatcagttcccatctagtaatgactctctgtgtgtgtgcagtaaaatcaataataaaggggatgaataggacgactttcatttgaaactaaatctcttggaattgtgtgagctactgtgccacctatcagtggaatgatgaaataattcatacatgaacaattagcttaaataatcagcttaatttagtcaaatttattacaggcaccagtttacaaaaataattggtgcccaagatatttaatacttgggaataccagaattagagtatatcggagacaaagtgaaatctggatactcaatatgatacgacttttttgtttaaacctgcatatttaaactctcctttggtagttggatgctggctccccaaggatactcatgtcgaaatccctagaacctgtgagtatagtacatgatacatgacacaggggaattaaggttgttaattagctgatcttaaaatagggagggagattaacctggattacctgagtgcacactatgtagtcaccggaatgcttaaaaatgaaagaggcacaagagtaggcctgagtgatataatttgagaaagactatacctactgttgttcgctttgaagaatggaggaagaccaggggttaaggaatattggaggtctataaaagctagaaaagggaaagaaacatgatctcttctagaatttccagaaaggaacaaagccctgctgttgcttgagtttagtctaataagactcatgtcagatgtctaacctactcagctgtaagataaaacatttgtcttgttttaagccattaagattttgggaatatgttacaacagtaattgaatactactgcactctctgtagttttttttctgttcagtttcttagctctggtctgttgtacttggctgttcagctttggggcctgacaaactgccctcaatggtagaagtccagcagtgctcatttctatagggttcgggacttgaatcacaaaaggcacgaagggaaaaactttttccctcaccctagacgaaagtccatattttttttttttttttttgcgaggatctgacattttaaaagatgtttagcagtagaaatccctactgttttcagggaatattatcctctacgcttcttacctggcacagtcatgggacaattacatcaacacacaatactttgtcctatatattctgtattatttttaattaacagcatcaactgacaaatctatgttgaaccatatgaagcccaggtctcacctacagtctcttttccagtaatattcagacatatatcagttttttagaattcttgctgggattgcttcttgtatggttaaatgaatgtgctcatgtgcatgggtatataattatgtgcatgcacacatggacgtgcgcacactgctggacatccaaaattgagcagcgatgtgcacagggcataagaatgtatacttgatacttaaaaggatttctaaaatttttacacagtaactgttgccatccttaagatagctctttccttaagtatgcaaaaacagttgggctgtttcaaatgcttatggaagcatctgaaatttccttgcagaagaatgtctttgttttaaatttacatgtctaaataccaattggaaaggtaaagatttgctcaatagaaaggagtaatctgttaaaagtttaaaaaataccgatttcttttggaaaactgcgaagtcctgaattcagaggtcttattcttgtttattctaatcaccccatctgaaggaagcataactttccccaatgactgaaataataacagtaagaatgagaatacatggaaaatgatattaaattcttaccataaacaatcttaaaatttttgctttgaggttaagttttctgagaaattccatacttgcttaaaatatgtttttacaaagtaataactgccattattatttacaacacattaagtactatcctagttatttcaattgcatcctcccattaatttcctagcttggtaggattccccccccaaccagaaaccaaacttaaaaactaggaacttccagtccagtctgtatccctagatgtaagattctgacctggataaattgataatgctgcgaaacaaagtgacctagaaatccagctaatcttatcagtgctcgtttttaattgagaaaatctaattactcagataattgtggagcgtgttgcatactcttaattactgtaaaaacaaaaaaaaaagacaaatttatgctgctatataggcctcacgccctataaaactggatatacttttttatgacccatttagcttcattcattttatcagtgcatagaatgcagtatgttttccttatttcatactattttgttttactttttgtaaccataaaacatcagctttcatgcacaagcatatttttggttggatgagtttgtttaattaattaagcatttgagaacatcagtggtttagttttgaggtgtcacaaatagaaaaacttagggaaaatttctcattgtattggaaacaatttattctgcattaataagttgatataatttggctctgtgtcccctacccaagtctcatctcaaattgtaatccccacgtgtagagggagggtcctggtgggaggtgattggatcagggaggcggttgtccccatgctcttcttgtgatagtgtgtgaatgctcatgtgatctgatggtttaaaagtatttgacagccttccccccgaccccactgccctgtgaagaaggtacttgcttccccttcaccttccaccatgattgtaagtttcctgggggcctccccacccatgtagaactgtgagtctattaatcctcttttacttataaattacccaaccacaggtactctttataacagtgtgaaaacagactaaaacagaaaattggtgcccagatagtggggcattgctataaatatagcaattatagaagtgactttggaactgggtaactggcagaggttggaacaatttggggggggggtcagaagaagacagaaagatgagggagagtttggaatttcccagagacttgttgaatggctttgaccacaatgttgatagtgatacggacaatgaagtccaggctgagatagtctcagatggagatgaggaacttgttgggaactggagtaaaagtgactcttgctatgctttagcaaagagattggtggcattttgccccttccctagacatctgtggaactttgaacttgagagatgatttagggtatctggcagaaatctgtaagcagcaaggcattcaagatgtgacttgactttttctgaaaacatacggttatatgcgttcacagagagattatctgaaatgggaacttttctttaaaaggaaagcagagcataaaagtttggaaaatttgcagcctgtccatgcggcagaaaagaaaaacccattttctagggagtaagtcaagcctgctgcagaaatttgcataagtaaagagaagcagaatgttagtagccaagacaatggggaaaacgtcttcagggtatgtcagagacctttgtgccagccccttccatcacaggcccagaggcctagaagggaaaaatggtttggtgggccaggcccaaggccccactgctctgtgcagccttgggacctggcttcctgtgtcctagctgcttcagctccagccttggctaaaaggggccaaggtacatcttgcaccattgcttcagagggtgcaagccccaagccttggcagcttccatgtggtgttctgcctacggctgtgcagaaggcaagaaatgaggtttgggaacctctgcctagatgtctagaggatgtatggaaacacctggatgttcaggtagaagtctgctgcaggggcggagtcctcatggagaacctctactagggcaatgcaggggggaaatgtggggttggagcccttccccccaccacagagtcctcactggggcactgcctagtggagccatgagaagaggcccaccatctagaccccagaatggtagatccactgacaacttgcaccatgcacttagaaaagctgcaggcactgtgaaagccatgggggctgtgctctgcagagccacaggcgtggagctgtccaaggtcatgggagcccaccccttgcatcagcctgccctggatatgagacatggagtcaaggcagatttgggagctttaagatttaacgattgcctggctgcatttcaaacttgcgtgggacctgtgtctactttgctttgaccagtttcccccatttagaatggaaacatttacccaatacttatacctgcattgtaccttggaagtaactagcttgcttttggttttacaggcttgtaggcagagagaacttgccttgtctcagatgaaactttggacttggaattttgacttaatgccgaaatgagttaagactttgcgagactgttgggaaggcatgactgtgttttgaaatgtgatgacatgaggcttgggaggggccgggagcagaatgatatggtttggctatgtgtacccacccaaattttgtctcaaattgtaatccccacgtgtcaagggagggaactggtgggatattggatcatttgggggatgggggatgggtggttcccctatgctgcactcatgatagttctcacaagttctgatggtttaagtgtctggctgttccctgccccctcctgccacctagtgaagagagtgcttgcttcccctttgcctttcaccatgattttaactttcctgaggcttccccagccatgcggaactgtgaatcaattaaacctctttctttctaaattacccagtctcaggtattccttatggcagtgtgaaaatggactaatacataagtatactaagtgatagaactacctagaaagaataaatccagattaacttaagatgctcttggaatcagtgtttcagtgtaattgactgtggacttaaacagctttaatggagaagttgcatcttacgaattgtttctttccctccggtcttagtcccattacttgaaagaaggggtacttggtaaatgttgattacgttattaaaaatattttaacttatttttagtaaaattgaataactctcttatattacaatcgtggaacccttgccctttagcaggccatttctcctaaggaatttcagacatccctaatcttaacatctttatataatgtacatactgttgtgcgagtgtatctttctaggggcccatttatcttaaaccgactttcctatgttcctatcatttaatgtgtttttccattggtaatgatatatttcttctgttccaggatgggccagatatcagatatcacacattgcaagtgtaaactaaagcccagagcagaaattcaaatggaattaaagtataaataaaaatataggtcagacagaatatggataggttgtaggaatagatcagatgccagatgtagattttaaaaaacatgttcagaaaatatagtattgaaaactaagaaagagcactccagaggagctttaaaaaaggagagcgagagaaagaaaaataatagaaaataaaactggaggacattgttaagtgaaatcaaccaggcacagagacacaaatattgcaagttctcactcatatgtgggagctaaagtaaattgaactcatggagatagagagtgggatgatggttaccagatgctgagaagggtaagtggggaggacaggataaggagggagtggtaaataggtaaaaaaaaaaaaaaaaataaaaagtatatagttagatagaaggaatcagatctagtgtttggtagcaccctagagtgattatagttaccaataatttatatttcaaaataatagttaaattggaatttagctaacataaatgataaatgcttgaggtgatggatgccctaatttccctgatttatcattacatgttgtattcatgtatcaaaatatcccatgcaccccaaatgtacaactattatgtagtcataataactaaaataattaacgaaaatgaacctcatctaataattggacatttctctcgctagctataaataccaggctttcagtcagctctacttttagtttatgaatgaataccatagaaacacctgtaatgtcctccagtcaaaggtgttgatcacccaaagctgagcttgttaaatttacagggaaagggtaagcaccaccttcagggaatagtcatagcctctcagaagaggagcatgacggaaggatacttaagagttttacacgctgagctggatggttctaagtatgctctcgacagattggtcagaattagcttaccagatgagttgctgtgacagtctgtggtgttatcttggaacacatgagtttgcccgagtttctgtaaatctacttgagcttaaacaatttgatatgtttattttccccaaacgattttatgttagccatcacgggtaattatgcttggcataagggactcttgcttgatataggggggagtctgttgtatccgagttcttagatcatcctatattacatcctatattaactctttaggatacagggattgattagggagtgatatattagttcacttacatagggagaaatgatcaactcagaatatttttgtccctttaaaacgtctacctctatgtaagagtaaagagcataggctcttgagctgcactgtctttgaatcctagctctgctacctaccagatgtgtgaccttaaaaactttacacaagcaattagttcgtcagtttcctcatttgtgcaatgtggttaataataaatgggttaatgtatgttaaatacttcatatagtacagagtaaagactagttattgtaactcatgctattgctgatttttaaatgatgtttattttaattcaattgctgttcccccttgtaaacgtagaaagaaaaggttaggaaagggagatgtagaattctactaacaatgacttatattagtagttgggccaataggccctccaaaggagattcatcttgtgggatgtaagtgcatatagtagaatatgtcatgaattaataacggcattcaaaaatgaagcaaagacctgtttaaatgacctcagggagaaatcagaaacttttacagcagtatctgctttaggaaatagctagtgatttaccatttcaaattatgaatggccaaccaatgccctcatcagttaggcattgacagcccattcttctagttctatcttcttctgtaccggtttcaggtgtttccttctattactccttgaattggctatggcatagtcagagtatcaaaatcactggcttagttaggacctcctagtgctctatataaatatattggtatttttatctttttgacttggaatggtttcatttaacatgtaagatacttagatgttgagcccatccttgagaagaataatgtataaacctcaaagataaaacaaaatcctctcattcttgatcagtgcttttagtttgagcatgtcacttggattactgtgtctctggctctagcattaaaatagtcaacctctgaaatagcaaaagtggtacagaaactcgtatattttggagagtcatcacagggaatactatttagttatatttaaccaattgttgttatgcatctttcaggggtgagacactgaaaatattgcaaagacataatcacagcccttgatataatagtagtttgaaaaaagccgtattggggcacagaaggagtagtggcagagtgtgtgtgtgtgtgtgtgtgtattaacaaaatgggattagggaatttgtcaatgatgagatgacatttatgttttcacttgctgaaaactttagaaatctacttagtttgctaggtttgtagtggcttctgttttcatctgtagtagttacaccttaagtgtgacaaactttcatttacttaatcagtttcagtctttctaaggctggcatgatcactaaatgagaatagactcatcttaattttcacatggcttcaaaattatagaaatattaatccttccaaaaaatgtttagatgtagtccaaaagatttgtctgtggtctctgaaaagtgtttcactggagataaagctaatccagtttaaagtaactttgtaatcaaaattaatattgcatgcgctaatcataggctctccatgccttcacttctagtcagatccaggctcattgggagtcaagtgccagagaggtcctgcctcaggacctttgtacttgctgatcctttaatatggaaatgtgttttctccagagagtcatcacaggattcaactgcttatttcattcaactctatttttaaatgttcctgtagttgaaaggctttccctctctaaatcctctcttaagtagagccaacctctccatgccttttgttccctctctttaccttgctctatttttctttataggacttgccatgacctgattttgtgtagcatatttatttgtccttatttttatttctagtcctagaatttaagcttcataagttaaggactttgtacattttattcactgctatatctcctggtcctaaaacagtaggaacttaaatgtttaatgaaaaacataaatgaatgattaaattactaatagaatctgtattccctctccaaatgtacatttggtattgtactaatgtatataattttatgcaactcataaagtaatcgacatatttatattgctttcaaaattagcgccctcaaatacatttaggttagaaaaactaaaattaatacatcaattgatcatcaagcatagaaaaggaactccaagaacacgtaaacattttacatctaaggtcttactatacttttggtattaatgtatattgtattaaatcattgtaaatgtagttttctattccgaatagcaatactagaggaatttactttaaattctacattctctgctggatgatcccccaaaactgctgcccagataattacagttccctctcttagcttgtcttccagtctctaatttcctcctactttaaatcattgttcacatgccaccacaattagtgtttgaagatgacaggtctaagcatgtcattctcttgttaatacaaccccatgttctttctaaacaaaatccggctttctatgcctgccttttattgcttcccaccatgtgttctgtacccattcttaaactaaccttcagttacaccaaccttgggaatacatgttcctgaaccacaaaagggtttcctccatgtttttatcttacagaagtcacttaccttagtacttcatgcatagtctgtactaagtaagggtttattggtgatgactatgtgttcaatcttttaaaaactttgccactgtcctagaacttaaagatgactattccatgaagctggtttatatttcaaagataaaatgtcatatttattataagcctcctgtttttttttttttctggtttttcctggatagtaatgtttactcaatttactaataaaactagaatatatcacttggctataagctgtagtaccacagaatttgaggtgacacagaaaaattattcatctgctcttatatctttccaagggcatgattagtcttgatggcctggtgcaactgaattctattaattcttatttaaatcatcagaaacaaagtgtgatctcgtgtcactgaattagctaaacaaccttgctgctttaacacataagtgccaaaatagaaaggagcttaaaacaatagtttatatgtagcccaggtataagtccaatgtaggtgttccttattggtgactgatatggtttggctgtgtccccacccaaattgcatcttgaattcccacgtgttctgggagtggcccagtgggaggtaattgaatcatgggggcaggtctttcccgtgctgttttcttgatagtggtaagtctcgtgagatctgatggcttcataagggggagactccttgcacaagttaccttctcgtctgccaccatgtgagacatgcctttcgcattctgccatgattgtgaggccaccccagccacgtggaaccgtaaatgaattaaacgtctttcttttgtaaatcgtccagtctcggcaggtatttatcagcagtgtgaaaatggactaattacagtgactaatatttttctatatttttctgcctttgttgtggctctaccttcttcacagatgatgatgttttttgtttttttgttttttcatatagccattgaagagggggaagcaaatacagaaaagccacagtgacttcttagaagccttgtggtagaggtgatgcatatgtgctcccttcactttccacatgaaggggatgtgtgctcatgaaacatgtatatagccatgcctgtctacaaggataatgcagtggctggctgagtggctgcttctaagtgaaaaatctatactttaaaagctggagaaaggacatggttgtttgacagcctgtctctgccatagttaggaactatcagcttcataaataaaactatctggtggtcttctcaatggggagcttaattacctcaagtcaataagaggaaaatatccattagattcaattctatgttaagaaaatcgtggtcccagtgggattataatttctaaaatgaaggaatgtcagtaaatttaatggaaccttaagtataccatagaaaaaaatgatacattctgacattgaattttgttgatttaaataaatttattgtggtaaccatgctggttcccttcatgacatatgaatggggaattaaataatatacacaatgctttgctgaaaagtgttcaatttgtgttagatcagatacacttgtcttggtgacaaaattggcacaaagctttatgaaacccacgagtgggcaaagattgtatcagaaatatctaacggtataaagcaattttgtttttcattgttacgatattgacacatctccaagaaacacatccagggatgaatagctctattccccaaattctaaagacagcatctgacggaaatctaatttcagtcttgttattaaataagttttcttagtgtctgccatagtagacagtgtttgcaagatagcatattcattttttaacatatttttcttttgtgtgttataaataaaattaataaactgtcatattctactggtatccactgacgtttcttagttttactttaatctcaccattatgtaaattgactttgacagaatatttttagttgaaacattgctggaaattgaataaagttatgtgtgtgtgtaactcctgtgaaacactcaatgttatatctatatctcttatcaatagttaagcctttatgaaaataattgattctttagcatggtgtattgcacctttctcccaaacagagatttacagacacatagtagggtgtgtatatatatagatgagcatcaggtataacacataaatgcttatatatctaattggtgttgaggtctgaattaatgtatttttgaaagcatcggttcttgtgacagtagaatcaaatacttgcataatgttttatagactagttataatccttacaaaaatcctattgacaaaatagcattagcttaatattccagatgagaaaatgggctccaagtaattagatgctttgttcctgatcaaacactaagtggaaaaaaacccacctcattacaaaattttcttgttgaaagacttcagactgcctctaaaatagaggagagaagaaatagtctgacactctaaattggatataaacgtcagaattgggactataagtctagaaaaagtaagtatgtttaatggcacatatagaacttacagtcttaacaaatgaagctttttggtcaattttggagtatgatcttctataacacggaaaatcattttggggttttttttcctgaataattcataaatggagatggactaaagaaaatataaaggaaatagcataggaaaattttgtaaaaacttatttggatattttatgatttttctacatctgttttctaaattttacaccagggttccctttaaatggctacttttttggaaaagaaatctgagtatatacccatatgcaaatgagcctcaaaaaatactaggtgcctttagcttctgttaatatgaaattactaattcatgatgagaatattttattttaatgttagcggtgttgcttttggttggaagccaggtaaatgtaatcctattactatgcctataatgcggagtagttttgtttaatggtatgtattaatgcggcattggacagcttgaattgaatcagagaaatggtgttggcaagcattaaagactttaagagaatgcaaattttatatgcctctttttattgtaaattgacaatatataattgtataaatatatggcatacaaagtgatggtagaatttatgaatacaatgtggagtaattaaatcaagctagttaacatatctatcacctcaaagacttttgtggagagaacatttgaagtgtactctcttagcagcttcgaaatgagcaatactctattaactatattcatgctgtgcaatgcatttcaaattttcatcagaaaaatcagctttgaaagagtgtatgcaaaaattttataagcttctcagatgatatgatcttatatgtagaaaattctagagatttccacacaaaaaacctgctagaactaataaattaagcacaattgcagtaaataaaatcaatatacagaaataagttatattttatgcactaacagtgatgcagtccaaaaaggagattaaggaaacaattttatttaaaatagtaacaaaaagagtaaaatacttaggaattaaccaagaaggtggaagacttatacactgacaactacaaaacaatcctgaaagaaattaaacatttatttttataaataaatgaaaaggaaccccaggtttatgaaatggaacactcaatattgttgttgaggtatccgagttactcaaaacaaactacacattcagtgccatctctaagaaaatcccaattagtttttctgcagaaatagacaactctatcaaaaattcccatgtaatctcatggatccaggaatagttgaaacgatcttgaaaaaagaatgaagttgaagggtcatacgtcctgatttcaaaacttactacaaagctaccataatcaaaacactgtggtattggcttaaaaaaagggaatgtagaacaatagaatataatagccctgaagtaaactctactatatattgtcaaacaattttccataaggttgccaaggttttttaatgattttttaatgaagccacaaatgttgctaagaaactgaatatatacatttaaaataaatgaagttggactcttataaaatacacaaaaattaagtcaaaatggatcaggaagtaaacgtggccaaaagtacagaacttttagaagaaagcgtagacatttggaagaaaacataaacattagattgggcaattaaatatcttggatatgacactaaaagctcaggctacaacagaaaaattaggtaaattgaaatgcatcaacattaaaaacttctgtgcatgaatgaacaccatcagagtgaaaaggcaacttacggaatgggagaagatgtttgcgaatcatatattcaatagggaattaatatccagactgtgccaagaactcctatatgttagtccattcttgcattgctctaaagaaatatctgaaactgggtaaattataaagaaaagaggtttaattggctcacatttctgtaggctgtacaggaagcatgatgctggcatctgctcggcttctggggaggcctcaggaaacataaagcagaaagggaagggtgacctggcaggtcatatggtcagaacaggagcaagaggggtggagggagatgtcatacacttttaaacgaccagatttcataagaactctctatcacgagaatagtaccaagcggacagtactaaaccattcatcagaaatttgccccagtgatccaatcacctcccaccagacaccaactccaacattggggattacaattcaacatgagatttgagtggggacacagttaaattatatcatcgtagaattcaacaacagaaaaacagcaattaaaaaaatgaataaatgagttgatcagaaatttctctaaagtttggccagtaagaccatgagtagataatcgatatcgctgatcattagggaaatgcagataaatcccaaatgagatagcacttcacacccattaggatgatgattattttaaaacaccaaaaaaaaaaaaaaaaacccagaaaataaatatggttgaggatgtggaaaaatttgaacacttgtgaactgctggagggaatgtaaaaccttgcagtcactgtggaaacaaatatgttggtttctcaaaatatagaacgtagaattaccatgtgatccagcaattccacttctgggaatatactcaaaagaattgaaaaaaggaccttcaaaatatatttgtacacccatgtttatagcagcattattcatagtagcaaaagatggagcaactcaaatgtccatctgaagatgaatggataaacaaaatgtggtaaatgtatacagtagaatattattcagccttaagaaagttctgacacacattatagcatggatgaatcttgatgatgatatgctaaggggaaaaagccagatacaaaaggataacatatgattctatttgtatgagctatctagagcagtaaaatgcatagataaagtagaatggtggcctctagaagctgggggagagaaggtatggggagttatttaatggatatgaagttttttgggggaagataatttttggaggtggatggtggggatggtgacacaacaaggtaaatatacttaatgctgataaattgtatgcttataaatgattagaattatatgttttatgttatatatattttaccatgataaaaacctataagctttcttgtaaagttttagaaaatgtttggattcataagtgttggatgattgagttttatagtgtaaatttaatgtagttgtgctcaattgtcaattgtatgcctattgtctgtgagtatatattttccagattgttctctaaacataatttttaaccatttagttggaaaaaaaaaaaacctcaacttaaacccaaatggaattatgtagtccattcagtgcatactgtgaaatatattagtaacattttattcattttaaagattttcgttatcagtttaggaagaatgataattttataaatccatagcatactgttgttgtgtgcgggtaatactcattatttaggctgtttttaatttggggtcttttttaacagataatcaacaaacgttttttatttgcacacagtactcttagtatttcgttttgcttcagtaatagtaaatgaggctggggtttggagagcacgattgcttttggaaaagtcaatagagacatgtttttatcgctactgctttttttctatgttaattggaatttgacgtaaaattgattctgaaagatatcaaggtagacacttgaaatatagattggacaataaggttggtagaccattactgtgctttgaactagagtcattaatgtgattgtgaaaatttttactttgtatgttattcatcacttttctcccttagtggtgtttagagcatgatgagttgttactgtactgacaagtattagtctagtagtaatttctcataggctgacaagtgccaaaattcatcctcacatatgaatacactaaagcagacaaacactgttttcatctctgacactatctacagtttatcgtgatacattattttggcctacagggtcacaggcaaattatatttaatcactgctttaaactaaaacataactataaatatttttgcactctttaaatcagcataacaatccaatagacttcaagatcctgagataatatttaataacattaaaatgatttaaaagtataacgattgtattaaataattctgaataaacaatacttttgaatgaagaagattaattagcatgatcattatagaaatggtcctattaatacaaagatgtcaagagtcatttctggttcaagtcaattaagctacgttttaattgaaaaaagctgttcattgtgtacagcggtagcactcctgacatatcatataaatgaccccattaatgcaggagaaataaggtcaactgagacatttttactgaaaccaattatgttacattttaattgaaaaataaaagctgcttttattcaaaggaagcaccactgacactccatcatattccatagcctcctaatattgcagtaacttcctaagcagtctctcagttcttcgcattatacaaagttatctttttactacattaattaggtcatgtgttccctatttaacaccttctgaagactctacattgtacttagaaaaatgtctggagtctgaaagcagccagcaagaccctgtgtgatctgtcccctgcttgcttcttgatctcacttcacactggttcccttacttcaccaggctccggtcaagcaagaacatacttcttctccctctttatatagctgacaacttcctgccattcagtctgagccgaaaggtctcatcttcagaagaatcctttgcagtctaccatatgtaaaagagctctcctgatgagccctcccagccattcctgtatcctattcacacttcttgctttaaaatcatcatcattatctgaaattaccttgtttgattatctagcttatttcttctctgcttcccctactagaatgtttggtgtcaaggactttgtccgttggcttcagtactgtatagccagtagctaggagaatgccgaagagatggtaggtgaaaaatgtttgtggaatggataaataaatgaatagcaatagtacagaagtatgccatcttatttgttaataggtgaccatcggttgatagagtttcatttctcctgattgcttaactcagtaacactctcctgcaggagagctagtcaggactcagggtttttttgttttttttgattttttttttctttttttttctttttttgagacagagtcttgctctgtcacctagactggagtgcagtggtacgatctggcctcactgcaacctctgcctcctaggttcaaatgattcctcctgtctcagcctcccgagtagctgggattacaggcgcgtgcaactatgcctggctaattttttgtgtttttagtagagactgggtttcactgtgttagccagaatggtctcgatctccttaccttgtgatctgcccatctcggcctcccaaagtgctgggataacaagcatgagccaccatgcccagcccgaggactcaggtttaagtatgtgaacagatagttcagaagacgttataaactgttaatggaaagtctggaaggaacccagagatatgttttgtttgatctacaccttactacagatttgggtttctgttagcagatctagcagctctggggcaacattctgcaatggcaccatcctggtagtactgaggagtgctactctcctccctcaaagcgggcacattactgttcagtctggagctgcactcgccatacacacagtttatgtaactccactgacagactctgccactccagtcatttatggcatctgactttgattccacatggaaatctactgggtggacctgtcacatttaaagataatcatcatcatcattgtgtatgtgtgtgtataagttacattggccatttttctggggactgagtctgtctactccaaaagctgtgaaaatagtaatgattaaaagtcctcagactctatgattgtggaaattctttgtattctagaagcacacaattctaagacttctgagtgtctctcttcagtctcctgtgaagagcatcaccgatttatcactaaatgagcagattatatactggggatttagtgtagaatgtgccatacagtagctgtgcttcttgaagaaatccctggataggccaggtgggtttatggtaagagataaaattaaatagacgctgcaaaaaaaggagacaacattattaaagtcacaggaacaaatgacacttgtaaacatcttggacatgagttgataacatttaagtgtagtccaaagagttcaaataaaaaggcattgcaatcacttgagagagagagagaaataatgcccggagagtacatttgggctatattttagagaaaggccttgataggtagaaatagggaagaatagcattccaggtgaaatagcaaggcaaaagcaccaatgaagaagaaataagaggaaggcatattcaaggtatagaaaatcatgtcattatgtgaggtacaaaaagctatcgagtgtgcatttatatatgaggtatcatgctaggaacccaggatagctagatcaaaaggtatgcattaaagacattttgactaatttccaaatgatcataatgatgcctatatgcaacatcaatatatgaagtattcagtttcccattccttgcaagtaaacctgaatatgtttaacattatatcactctgttcttccctcctgcaaccataattcataagttattttcaccaattcattcaccaagcatttattgaacactatgtatcatgtctctgattggcactggggaaacaaatgtctctaatctcaagggacatacagtagaatgggagagagatacagttcctttaaattctggacctttccatttctcttctattttcaatagagcttgcagtcatggaaaatttattctctgtggcaacaaagtagggcagatatttgccctggaaggtgaagagagatagagaaggctttctgcctaacatttatcatgaggtactaacaaatatgacaattgaataatgctgttaaatactatgtggcatactgattccatttcacatacttatgtctcctctttttaatagaaggtagtgtaaaaagaagtcctgtgttacagtaatgtttcttttattatctaattgatccttgggtacgttacctaataattgggtatgtacatctccacatacatagcagtggaatagtaatagttggggggatttttgtgacatttaagaagaataattacaagagtcaaaagtataatataaacacaaaataggaactttccatttttcaatgcagatttattcagcatctttgcttctgattccatgtatttttctgcttcagaattctttttttatcctctatcttattttacagttaataatttcctgagggactactttctgagtggaaaattgttagaatcctgaagaaatgtatcacatgggcctgcctgggtcttcccccgccccccccccccccccaagaaaaacctgcatctgccttaaacataagatccagtagtcagtatgaaattcatcaagctaaagcttatctcgtctgtagttgtagctctctgaaactttaaaaaaggagttttaaactttgcatatctgaatttctgaggtagcattatatatgaaaccaaaaatatataaaataataagaaaattgctaaagaatcactttgtgaaatgatgaatccatttagcttagttcttctgtttggatatgatagccttattgccatagagaaattgaggtaaggcattaagagaacaagcaaacaattttgcagtaactaactcatctctcccatgttgccaggtgtgccgcatattgctgagcagtgaaaggattaagctaggaaagaaagtggggaaagtgctacctggaaatcagaatgaacattgaatatagaaatgcatctaagggggaatgagaaagagaagagtaaattaggtttttcttgagtcctgtctttgttacttccacattttgtctacaggattaagcattcagtgcctgataagtttagtattgtgccagaggaccccagagaaaaattagaaatgatcctttccttctagcaactttcagtgtaacttgagagtcaggactgaccaaaatagttcaataggtctgaagtaaaattatttgtgaagtagtaaatttcactttatagtgtatgaatgctgtagaaatatatgagagaaatcaacaagggctgtgatggaaaataggaaacatccagaagtagaagttgagctgaaacttaaagatagttagaattggataagataaaatgagtattcccagttgcaaaacaatgtgagagcatgtttcgaaatagagaagagggatgggcataggaaaaacatacagatgaagtaaaagagggcattttatcttttttatttttttcattttacatgtctgttttgtttgtggacgcctatttggtctcattgttctggctttgggagacaggcaggggatgctgcggagcacatggcccctatttgtggtcgttttgctccaggtgaaaataatagccaccctttattgaacacatcctgtgtttcaggcactgtgctaagctcttacactttgttatctcgtaatcttgagaatacctgtgtgagggcaaattgcagtaagagtaaatggggggtttgattccgaagtctgagattcttgcctttatgaccactgacagttaaggggcttgttacataattacaggaactcaagagtcttggtcgttgaataacaatggatcaagtgctgtgctgtgacccattattttatcaagtggatggaataaaacatgactactgtgttcatttggatgagtaggagaatgctgaactttgaaaggttatggaaggcaagcctgtagagaggtaccaaaatggcatgtagcaacacgcagggaggagaaagacctggatttaaatgcagtctctgccatctagagctgcgtgagcttgagaagtctgcatcatcttccctctctggcccctaaagctaaagaattaaaatgtatcaccactgctctctaagagttcagtttaagtgacagcaatagtcaagagtgtcagtttgagttttcccccaaagcaaagcctgacagaaagccatgattggctgattatcaaagaaactagtaagaaaactcaggaacatgtgggacctggaaaagtgagacaaggaagaaggaaaagctaataaagataacattgttgaactgatgaccataataggtaactgtacctcaaccttgcctgggacattatagaaccttatagaactgtcctcagaaatgtccctttgaaggacaatttattttcctccctcctcttcctcctcctcctcctgttgctagagctaggaagtgaaagggtgttaaccctctaacagcagaaacaggaactgcagcaaaaatgagagatgggttgatgggatacagtgcaaaatacaaagaggcatctactgttcaaaataaacctataaaggaatctgtattagtctgttctcatgctgctaataaaggcgtaccaaagactaggtaatttataaaggaaaggtttaattgactcatagttctacatggctggggaggcctcacaatcatggtggagggcaaatgagcagcaaagtcacatcttccatggagacaggcaagaagagaaagcatgttccgggaaactttcttgtataaaaccatcagatctcgtgagacgtattcactatcacgagaacagcatgggaaagacctgccgccatgattcagttacctcctaccaggtccctcccatgacatggtgggaattacgggagctacaattcaagatttgggggaagaaacaaccaaaccatatcagaatcgaaagaaaaattataaagtcaaagtagaggaaattctggagagccttgaaagttgggctaaaactagatagaatgtgtatgtctcaacattttctattatatccctgaatcatataacttgttaagaatggggttacacaaaatttcagttaggttggagagggaaattcaagagaactgttgggtgtatataacaagactatagttaatagcaatgtattgtatgcttgaaaatttcaaaaagaatagactttaaatgttctcacaagcatgtgaggtaatggatatatcaattggcttgattgagccatttttaaatgtatatgcctatcaagatatattgtatactataaatatataaaatttgtcatgttaagtaaattcgaaattagaaaaaaaatggagctaatctctttaagagttaaaccctgaattgtagggaatttcttgctgacgaagactaatttggtcttgaagagaatttcatgtcaccatgaacttatggcctgacttcaaaccagtgatgagctgtggagggatatagggcactttgctttccatcagatcctctcttaagctgttttgcatcacttaattctaactgtaaagttgggaaaatgtagatggggcaagtgacagcatatggtttgatatatacttgattgtatccataagaacatcctcttacctttttaataagtagcttggagtgcttcctgccaaggctttcaccagttatccagaagattaaaggctgaagtagtgattgtccttggaatgtccctctatctatgtgtagatctgtggttttattcatttgtttcccaaattgatccacaaggagattaatcttgtatttttttcctgatgacttttataaactagatgcgtaagacatataatattgacatcatatcaagttgcccatagggttatttaaatatttgaagagatgtgtttgttctcttacactctctgaatgcttttggtttttagcgattttattgtcatcaaaaaccatattcgactacacatttttctgacctactagacattcacatttagctttgggtactttgtcattgtagaagcaagtataaagtaatgaaatttatgattcaatcagaaaacaagtattgaagctgctgaaatatgacgttctcagctttatttcttctacgaaaagtccaggttaatgtttataaaatatttttaaacttttttgtctgttcaggactgaatttcttgttgagccggaatggtgagataattctttcttctgtggaacaaatgcattttaatgatagttacttatatgaaaatgttactaagatttaatttatgcgcttaatgctgcttaaaataaatgtattcaataacaaaacaaagccaatagccatagcacattaattattgaatagactttctgtagttactgcaactgaatgacaggtagtaagaccttaatatttgcaatcacaattgtattcttctttgccctagattaagcttgctgattacagtgcaatgaagaaaaattaattagtttgctccagtggagcagttaatatagcacaagcgaaacccataccctgcttcctcctgtaaccaacttgttttcacttactctgccttttgatacacaaccattttcttgatcacttcccaattgaggaaaagtttaattaagtagctaatactatttagaaaatatagtgctaaggaaaaaacatgttattaaattcaaaccattgatatttttattgctatttaacttatattttatacctggcaagcaaataattgaatattgtttgaaaatatttgtaattaagaactcaagaatatgaaaacatcattgagttataaaacatgtattactcctcaaagagcaaatattcctgtgttgggctgctcttagttggagtaaacacattacctgcccacagggaacttttcatctattagaattcagaatacatttcagggattcttaccaaaaagatttagaatacagctatatgaatttatagaaatattttaacttcagaaggattgtgtgctcacttccgtatcttcctttaagattttagtcatgttccgttttttgtgttttttttccttgtctgaagacaatatttttagaggagagaatttctttgaaattgatactgtaagtaaatttactgtatttacttagaactactcattcacccatacaaaaaaaaagttgagctttcattattgagctctcctcattatgttataaaggaaaaagacattgtccttatcatgggagacaagcagatacatgggcaattcttcagcaatgtgatgagtagggaaagacatacatgatgtgggaaatagtgttttacagtcaggtcatgcattgaaccaaaactcaggccgtaaggaaaggctttgaaggggcagtggtaacttacctgacatgtaaaggagccagatgaaaaggatgttgcaggcagagaagctgtaatgtacagagaactgaaggtaaaataaaatatcagcttatggcttggcaaacactatggggaaagaggcacagaagtcacaatgatagtgggagccatctgcacaatgatttaatggctagggtgttatgtacagttatgtgtcttgtatattgcatcatttctataacagtataaatgctattgagtataaattagatatttattgacctcatattttacagatttgccgtgaaaatttctgtatgtttaaatctgcgataagtttgttattgactcattcatctaaattaatagcttgttcttcagaaaagaagttttgagactggttgtgatggtctcatcaggttgaagagatcatacttttactgtggcacctattttttttttttaatggtttatttctatttgagtaaaacagtggctaaggttctatggtatcgggataagatggtgataagtgatctatatgacagagttggcagaggaattaataaccatattgacttgggagagtgagctctgtatatagaatacacattttagtcaggagggcagagtggtaaaagtctgagatcttgagatgcactgcttgggtttgaatcctagctgtattacttaaaagctgtgtggccctcagaaagttagtcatactgtgtttcagtttcctcatctgtaaaatggcgataattgtatccatctgataagattgttttgaaaatatttaagtttaacatgtatgtatgtagttacatacatgtaaaagtatttaaaaaggtgcttggtagatattaagtgaccagcaactctaaatattgttttattataattagtaagctaccacaggttctgtgctgctgaataattgatcaataccttacataacatcagcaaaggggtaattttcaattttgcagatggcacaaatctgggtggggggtcaaaatgaagatgagaatttttcatgataggctaaatcacggggtcaaaacccacaaaatagaattgagcagggtttggtaccttcttaattgcttgcttgctttattttcaatggcttgttatgtaacaccaaccatgtggtcaacttgctaggttatataaaggtgaataaggctcggttccttccctcaagaacatattaacatgtagacgcaagtacagaaagggagaactaacattgtattataaatattctaaaaatgctaaattaacagaaatatgatacaaagtatagtataatgtagtatttagaggagataatggtttcacactcctttgctctgacaaagcatcaagagtctttagttatttgtgtcagattttaagaaagccaattaaatgttatagaacacccacagctgagggaagaatttgtactgaagcttggttggagtatactccctgtgtggcttactatgagtggcagtgcagagggtttgtggtggtcaaataggaaatctttatgagtatgaaaaacaaatttctaaggtagactcaatgcaaagtcgaaccacatctggaagaactataaattccataaatgttcattaagcacctcctatgggcaaagtgttctgttaggcctgaatgaatttattgaagacataagaaaaggctcatgtcttggaatatattgtcttttgaggaataccagcataattatgattgtataatagtttaattttatttttgatgtgtactatttaaaattcagagtgctataaaaatagtaaatcagggaatctgtatctggaggaataagaaatgaagtctttttgaaggaagtgatatttagatggaagtctgggtactagcttgttgtggagaaggaagagggtaaaggcatgagggaggaaaatacaggtggggatggaaaggtgttctaagcagggagaagtcagtgcttgtgtattagtccgttttcatgctgctgataaagagatacctgagattgggtaatttatacagcaaaaagggtttaatagacttgcaattctatgtggatggggaagcctcacaatcatggtggaaggcaaggaggagtaagtcacattttacaggaatgacagagggcaaagaaagcttgtgcagggaaactccacttacaaagccatcagatctcgtgagactttcactaccacaagaacagcatgggaaagacctgtccccatgattcaattacctcccacagggatcctctgacaacatgtgggaattcaagatgagatttgggtggggactcagccaaaccatatcattccacccccggcccctcccaaatctcatatcctcacatttgaaaaccaatcttgccttcccaacagtgcaccaaagtctttactcattccctcattaactcaaaactccacagtccaaagtgtcatcctagataaggcaatttccttctgcctgtgagcctataaaatcaaaagcagattagttacttcctagatacagtggggttacaggcattgggtaaatatagcccttccaaataggagaaattgtccaaaacaaaggggcttcagggcacatgcaagtctgaaatccagcagggctgtcaaatcttaaagctccaaaatgatctcctttgactgcgtatctcacatccaggtcatgctgatgcaagagaggggttcacgtggtcttgggccactctgcccctgcggcttttcagggtacagcctccctcctggatgctttcatgagctggcattgattgtggctttcctcggtgtgtgttgcaagctgccagtggatctaccattctggggtctggaggacagtggccctcttttcatggctctaatagacagtgctctagtagggtctctgtgtgagggctctaaccccacatttttcttttgcactgccctagcagaggttctccatgagggccctgcccctacagcaaacttctacctgggcatccaggtttttccatacatcctctgaaatctaggcagaggttcccaaaccgcagttcttgacttctgtgcacctgcgggctcaacacgacgtggaagctgccaaggcttgggcttccgccctctgaagtaacagcccaagctgtacctcggccccttttagtcacagctggagtggctgggacacagggcaccaagtctctaggctgcacaccacagagggaccctgggcctagcccacaaaaccattttttcctcctaaactccagacatgtgatgggaggggctgccacaaaggtctctgacgtgccctggagacatttttctcattgtcttggtgattaacattcagttccttgttacttatacaaatttctgcagtgggcgtgaatttcttctcagaaagtgtgattttcttttttatcacattgtcaggctgtaatttttccaaacttttatgctctgtttcccttttaaaactgaatgccttaacaggacccaagtcacctcacgaatgctttgctgcttagaagtttctcccaccagataacgctaaatcacccctctcaagctcaaagttccctataactctagggcaggagcaaaatgctcccagtctctttgctaaaatataatgagtcacttttgttcgggctcccaacaagttgctcatctctatctgagaccatctcagcttggatttcattctctacatcattatcagcatcttggtcaaagctattcaagtctctaggaagtcccaaactttcccacattttcctgtcttctgagctctcaaactgttgcaacctctgcctgttacccagttccaaagttgcttccacattttcacgtgtcttttcagcagcaccccactctactggtaccaattcactgtattaatttgtttttatactgctgataaagtcatgccagagaatggataatttatacaggaaaaagagtttaatggacttagagttccacgtagctagggaagcttcacaatcatgctggaaggcaaggaagagcaagtcacgtcttacatggatggcagcagacagagagcttgtgtggggaaactcccccttacaaagccatcagattttgtgaaacttattcactatcatgagaacagcacgggaaatacctgaccccatgatccagttacctcccactgggtccttcctacaacatgtgggaattcatgatgatatttgggtgagggcacagccaaaccatatcagtaggtataagtaaaataggtgaagggtggagatcaatcagaggaaagcacaccaaataggaggacaagttctcaatccactgcaaggatttgatttgtagtttggctttcaggcctttaactgtcttcagcttggaagtggggtttcactgggtacccacccctatctgcctaggagtttggctctgcttcctgtcactgtcatatgcacttctctgtggtttccaaaacctgacacagggaagaaatacaatacaggtatctgatttatagcaatctgttataaattattgaatgaatatcatattttaaattcatacctgatagatattttgcacatttcttgatttacttctaaaataagtggatttctcttctttccaaatgtaaatcaaatttcgcctaacttcatatgaaacacgggaagtttttctcccttttgtcagaatttttaaatgtatttatattttaatctgaagaaactagctttctcaaggatggatagagtttgaaaatgatagacatgattcagttttctaactctaatgctatgctagttttcatagagtttatgattaacataaatgtagcaatatacatgattttccgttagggaaaaatctctgtttattcttaatgttgtaaatcacaagtcaataaacacttatgagtgtcttctatatatgtagaaatgtactaggtttcatgggtaaaagtgacaaataaggcaaggcgtctgttttttcatccaatggaaatggctcacaatcacatttcaaaaaagatcagtgaactgtatataactacctatgtcttaatatgaacaaattgtgattcattggttcatataacagctgcaattcctaatacctaacatcaaatcttttttgctatgtgtggtgttagccacataaattctcactattgattcaataatgagttttttggcttttaattgtgtgtcatttttttgttgtttacagacatgataattttacgtagttctgccttggtgtctacctcaattatcagagtcttaaagagattatagcaactgggaaccctaaaagccttcagcaaatcttggctttagccaggatcctcaaataatgtccaaacgtgttaagaacttgaaatattgaacatttccacttcatttccattcattctttccatttccttaggaaaattctaataagaaatgtaattcttaggagcagagagcaggggaagaaaacaggataatttataaactgtttaataaccttgtgagcaattgaatgttgaccatataaattctggataatatcattattgtactcaggttggctgttaaaaagtcataaaggaaagaattttaggcatctatttctagataactattaaaatggtgatcttatcattgcataccatttagctggggagacagaattgtatttaatgaaatgactcatttgttgtattggattcctgccaaattatttcatggtttgtcaaatgataatttcacaagtgtcagtgacaagatgttggacattagttttctcttttcctatctgctgagtcacagttctcaagggatggatattatagtgattcaatcacaccttagattttggcttacatttactaatcagtctagtaaatttggtaggggggaaatcgtgccatagcatataaaataatgagttccatttcctccccacattggcttctattttttgggttctgtatgtacctaggacctaatggggcacttgccacgtaggtccccaatgggagaaaaggttctgttaattactccatcacattaaacagtccagttagtacccatagaggtgaggaagaatgtgcttatgttttatgcttcaggcaaagtagctaatcagagagctgtgaacaattgtaaggaagtgacttgctgcctggttctctgcaatgactgatgacacagtctttttacatcacagaatgtgtaaaatttgttcacatgtataagctcttgttactttgagagggcaattctgggataatttggttgccatattatacttagtcaatccctatgtattgataatctgttttaatttgcatgttgatatacttactgacttacctaataccatcatttatggtttgagatatcattcttaatttccctttaataatacatgtaatgcatgggtttacctagccctaagactcatttcaaaatatattttctgaagttctgtagatgtaattattaaaatcacaaactttcaaactggactcataccccagctggctatggtacttaatgaaaattaaactttttgctcctcagttttcttatctgtataacaggattaaatgccccaccctcgcagttttccttttttctttttcttttcttttcttttcttttttttttttttgagacggagtcttgttctgtcacccagtctggagagtgcagtggcatgatcttggctcactgctaccgctgcctcccgggttcaagcaattctcctgcctcagcctccccgagtagctgggactacaggcatccgcaaccacacctggctaattcgtgtatttttagtagaaacggggttttgccatgttggccaggctggtctcgtacttctgtcctcaggtgatctgcctgcctcagcctcccaaagtgctgggattacaggtgtaagccaccacacctggcctacactttttctttaaggataaaagggaaatacgtgtattaccattgtgcttgtcatatagtaagtaccaaataaagagtagcttctaccattattaaaagctatcctggcttttttactattattaaaagttattcaaagcctacatatagaaggcatagctatatgcctttgtgtcacatgaatagtcaacttttctaattttttctgtggctgtgctttgctctcaaagtgtggcctgcatcagagtcatcagggaaggtggtggttaaaacggattcctccccggcatgttggctcacacctgtagtcccagcactttgggaggccaaggcaggcagatcccttcagcccaggagttccagacaagactgagaaacacagcaaaaaatacttaaaaaaaaaattagcgaggtgtggtagtgcaaacctgtagtcctaactattcgggacgctgaggcgggaggatcaggattgcttaaacacaggagtttgatgctacagtgagtgcatgatcatgccactgcactcgagcctggacaacagagtgagatcttgtttcaaatacagtaagtaagtaaataaataaacccagcaaaacacagatccctaggtctcactctcacgcttgattgagtatgtctaaggatgtgggcaagattctgcagccacaactgtctcccaggtgaggctgatggtactcgttctccaactaaagtttgagtagctttgccctggagtagctgtcccaaacaggttaatcctcagaattgcctgggaagatttaaaatatatttcccaaacataactgaatcaaaatttgaggagacattgtaaaaaatccatttgaaaattgttgcgcaaattagaggttctcaaacttgagtgcacatcagaattttctggaggccttgttaaaacagattgttgagatacggaatcaacctaagtgtccattaacagataaatgaatttaaaaatatggcatataaacacaatggaatattattcagccataaaaagaatgaaatcctgtaattggtggtaacatggatgagcctggatactgttaagtgaaataagtcgggcacgaagagataaatatcacaagttttcatatgttagagctaaaaagtttgatttcatagaagcaggcagtagaatagtggttagcagaagccggggagggtaagagggaggagagggaggaaagggacaagctagttaacagatacaaaatgataagctaaataggacggatatgtactagtgttctaaagcactgtaaggtaacttcagttaacagtaatttattgtgcatgtttaaatagctagaagagaggattttgaaacttcccaacacaaagaaatgacaaatatttgaggtaatggatatgataattagcctgatttgattattacatgttatattcatataggaaaatatcactctgtacctcctaaatatgcataattatgtgtcgattaaacattaaaaagaaaacacagatttctgggtctcactccctgagatactaaccaagtaagtctgggagagtcctgaaattcggtatttctaaaaaggtcccaggtgacgctgatgctggtctggatccacactttgagaaccatagcctgccctagaccactgcttcttaactcattttaaaattaaggatctgtgtgagattctgctggatggtgtagattttcttgaaaaataaaaaacgtgaacatagtttccatatactttccagtgttcatggatcccttgaagtatgtctatgattcttgtatgaaagcttgactccagatagaacgtctttgagtaacatatcccaggttaggaatggaattctctggggctatttgcaaatctgtctaaacatgggaatatgccagtaacattttactccattacccagagaacaggaccaagtcatgttattacctgtagaatgataagagactttcaattctaagaattatggcttatttttacaacttgttggaatatgatttgcagatttggtgaaaatggtagttacttccacaaagatgtttaacaatttaaaagttctagaagtttgtgtttcctactggctttattctttatttttactcttcaaatctagctgttcgctgtctttttcctgaaacatttttattaaggaaaatacagaattttgcagcttatcagtttaaacagaaaacatccctgaaaagtcttcgactatatgactacattacttatacaaatcgtgatcatagtgaaactgaattactttgtaaataaccatgattcattactataagcagggttttgaaattatgactacctcgagaaaacttttattaagaataaaaaagcaactatctcagctggaccaataatagaaacaccagtatattcactcgctttttatttctcaaagcacatttgtggcttgtagccaagaattcattgcattgaaggagtgtttgacaagcagtattgaagctgtaaacactttgaactcattacagtgtctcaccataggaacttaactgtcactgaagacaccctgtctgtgaaaccatcattcctacaattatttttacctttgcctgaaaatatgcttttgtgctttaaggtatttcaaaagacaagagaaagatggaagctaaggaggctatagggatttcctgagttctgtgagtgctgtgttgatacagaacaagatcagaaacttggatatatatgtttcaacttaaaatgctgattgatcatcatgacaatagttttatagagcatttgtatgggggtgaatgtttgaagttataaaaagcattgtaatgttactcattcatgggctgaacaaacatttcctctttctctttctctggctttcttgccaattacttttttcttgccaattacttttttcttgccaaaaacaactgagatcacccccttaagtccattttgaaacaaacttagcaaggagtggttgttagtctgcaataacaatctacatctcaaactcacatccttacagttgttgtgtaggtatcatagctgcgtgaaacagtgaagtgtaagattgtgtctacagtggtctggaaaatttgactcataatcacatgtagaatacagtcctttaagaactctcccaccccgcatcactgccctgaagataatgagccaatgatcctgatggtaatctcttctaaaatcatacgtatttgagaaaaattgtatcttttcggagactggtaatagtccagatgaaaagtgtttatatcctgaacctagagtattgacaaagcagatgaagaggattgattgggatggagaagattcattgatgggacttaaggaatgactagatatgacaggatagggaggtgaagtatgctaggatgatctgtatgataatgtcttacacaagtgaacagaagtccagtttaaataacgaggtttggagggagggagtaaagaagatggatttcatttttcttaggtctaatttaatgtgcttttggtaaaatgtctactaggccaccatgtatatgaatctgaaccttaaaaaggaggtttgagcagataggtgcacagtttttaatcattagcatatttaacagttgaaaccatgagagaatatgccttatgagaagaagacaccaagatcacacaatgctaggaagaccaaaaaggttgtggcagagaggtgggagggttgatcatgagaggaataattaagtactaaattccactgaaaacattaagtaagatgtgggttaaaatagtttattagatttggcaaattggaagttttgataatattcaaaagagcaactttggaggaatggcaaaaaaaaaaaaaattgtaagaatggttatccttcctagaagatggttgcagaaatgattcagaaatagcttgtaagtagagggtaactgaaaagccctgagtgtgcttactagctggtgagagagggtttaaagatgaatatgtgttccttaaatccattttgtgtgtttatgaggacagggtaaatagtctagctaaatcaccacaccctgccctgtgcctagcatagtttctatatatttattaggcaccaaatattttaggtatatatttttttatgtaaaatatatagggaactgtgtgaggccctggaagaaacacaatgtctattttcattgaaaaagagctacattggagagactaaccacccatcactcaatactattttatttagttgtataagtaatgggtgctatggcagtttatgacagacagacctgcccttatcttgggggaaccacagaatgctttacagaggaagccatttttaatgttctactgagagcaaaatagaacttcctcccattcctcacccactgaacacattccacagagttaaaaactctgctttccttccacggtcacttttcttggcattcagaaattattggaaactgtaactatgggttcagtgccaacaacattctaacactcatggttagaatcctaaccagaaagagtacaaataagggtcctttcttttttgattttggctcagatatcgatgttactaataatgataataaaataatagtttaaatttaccctgtctttatgattttcagaatacttcccccttctagtttatttgggatgagatgctagggaatatgagtaggaaaatgataaagtgagacaaagaaggaaggaaagtcaatgaagactacatttcaagagtttaaactgtggtggacaactggcgctcaatttgactggggacttgaagaaaattatgtggaacacacacctcagacttatcctttgaagagatgagaatgctaaggtatttatacaccaactcctgctggtcatctgttggcagatcccgggaggggctgtgcattcactccctagcatttttgatctattgcatgcactccggaagaacagactccagtaggcaaagagatgcaggagctggcaggtggaagttggaacaatgtccactgaaatgcgaaggactcagaggaagagacagggtatcatcagcaccagcctaatggggtttgaatctccattttgccatttactagcagtgtgatctctggcaacttacttatcctctcttggccttcgtttcttcatctgtaaaatggggatcataatagtatctacatcgtaggattgcagtgaggattaaataaattattcatgtaacaattttacagaagagaacatgaaaatttcgaaaagattacttacttgtcaaatatcacacatatgggaagcaggccaaagccttgattcttggccccagcctttttccttatacctactgcccaatgtctgtgttgccttgtatcttcataatttacttcccattttctcattgcttaggtctcattcctgattcttttgtcccatttactctcctctaaacccttgtgattgtccagatgagctttagcttgggtgtctgtgtatcccttctgaatatttcatgcttcggccttgcccagcagcttaaacttacactattaactcccggtcttctctacctcgcatttttcctcttacctatgaggcatcttgacctataatattttcacttccaccagctgagtctatctgtggcacatgattacttgtctgattccttgttctcatggaatccttaggcttctctgatgtattttatcctattggcattcacatcccagtgggcacgaagaatatttaataaaaacattggctttattttagaacggaataaacacatcattctttcctcctaaaaataaaagacatattagttggattgtgtcattactgtagagtgatacaagccagaagatgcagtgacaatatcagaatggtgtgttatctgttaccaaagggaatgggtggtagctgtgtaaccaggtcatcatagtggcatgaccatagccaagtgtacggcaccatagtcaagggcactgaacaggtcattagttgggattgagtcaagagttggaccatttgacatggaacacacattctaaaaatatattaagttggtgcaaaagtaatcacggtttttgccattactttcaatggcaagaaaatgcaattactgttgcaccaatctaatagtaacataaacatcaagcggcttcaacttttgcctaacaagtttatttaaaaggttctaggctagtcatgtttaaaatggaacagctttattgagatataatttatatgccatacaatcatctgtttaaagtatacaactcaatgtttttagtatattcacaggactatgcaaccaaatattgtgttggtattataccaattagagatatgacaaaagctttggaccctctcatgcacatttgtacaaacacaaaagaatttgcatatgataccagaaaattcatggacttctctgaagtccatttatatgcccagaagtactactcgttcagccaaactctatcttaaggcagctattaattctgtttgtacaatccagcagacagataaggttgttgatcgtcttatggactcatggatatcaccttaacgacaacaatatatgtgccaagtctggctcctaaagttttaggattttgtgtttaaaaagggggagaaaagctttagtatgtttcgaatcctaactgacagtgagtgacaaaggtttgaaaaaatatattgcagatgtgtgaacatctggaggctaattgtacatgtttaggtactccataatctcatgaaaacttttgacctagaaatgtcagcgctgttgccctctcaaagagtcatgattctttatcacatcgctttattgtaaaatggaagtacatttagtggcaatatccgtgtgattagctatgtccagtcatcagatttttcttgcgttattatgattattacagattctattacactatgacattgagcataaatcaccagcctccttctcggcacatacaagagtcacttattttctaaaggttaccaaatatactaacttgtttaaacaaacgtacacacacaccttcctatatctgggtaggtacagactcagataaatcttcatacaacagcatgctataatgaaaagaacttaagttttagagtcataaataacttgatttgaatccatgagtatatatttacttactgtataatctagggcatgttatgtaaacacttgagaattcaatgccaaccttgggataacaaattttacccagcaagtctatgagaaagatcatagaaataacgcatgggaagtacttaaaacagtgtcctacacatggatacagatcaagaggtagtaaatacactcacaaaatggtctaattaagaaagtcttccatgagtttatgccctccaaaagatgagattcgaggccaattttgtgtcataaactttatgcttttataatattcatttctattttatgattatataatgcttaaataataatatagtaaatattcatgtaaaattcttacaccgaaagataaatattgttaatatgttggtggtcattaacttctccttctctctgttctttctcctctcttatttatgtgacaatatatgatccttttttctgaggtttaatagtgattcccatgttttcctcttccatagataccataaatctgttgatacacatgttctctttaccatgaaatagatcccttctctgtaccatggcccctataaatcaggatacactacattatgcatctataagaataattctgatatctcagcgactcaaaagaatagaattttcttcccgccaaacttcatgtcactatagattggtaggcgtctcaactcattgtactcagctgaaggacctgggctgagagaagggtcatctcaatataaactttaagaacgcaagagaacatgtgaaagcacacgataacccgtaaagcttctgcttggaaatggcgcacatcacttctgttcacatttaatttgatgaagtaagtcacatggccatatcaaagtacaagtaggcagagtaaaagatactatcaggagcctggaataaaagaatggaactttggtgaatagacttaatggcaaccacatcccttaaaacaagggttctcaaacttgaacatgcatcagaataacctagaggtttgttaaaacagggagtgttgggatccaccccctgagtttctcatcctgtaggtctagagtacagccagagcggttgcacttctcacaaattcccagttgctgttgattctgatgtctgagaaccacactatgagaactgctgccctaaagtataaaagctcttctcttaagattccacaatggaaaacacttcaacagtggtactttcgactgtccatggtcacatttcaaccacatacttctcaagtttccaaatttatctcaatctccaaccactggtctgttaataatttcccaaaattgctgtattatttcttttcctctggtggaatttaattaaaatatctttcctacaaaccttttccaaatcattctaactagaagtattgcctataccttttccatagtagtatacacctttccaaagtgatcacatgctttgtattatggtaatcttacacttgtgtttttctcagtttcatgaactgttttcaagcgcactcatagaaatttacccaaaatgaatactaaaacacttaattttttattcctgattttgccacattagggtaaaagacttggccacatgttctaaatttaaatcactactcttgtctcagaagccatgtgaacagtagggaggacagcataggttctggagctggactgcctgggtcaaaactaaccttgccactttttagctgtgtaaacttgtgcaaatttcttaagatccctgagccttttcctcatctagaaaatgaaagtgagaattgtattcataccataggactgttacaagaattaaatgaattagttgatttgaaacatttagtgcaggacttggcaagttttgagccattataaccattataattgcaaaacatcctgaagttattctctatgcctgaagttacattttcttaatatccattttctccttaatcccttaaaagctgtcttctgcctcatttattctatcaaaactgtattctcaacagtcactaattatattctaattgaatttcagagtgaatttcacacctctccttttgaaagattcatttctatgaatttgggacagcttcctagtatgatattccatctataagtatatccatatcatctatatcgtataccttatctgctctgctaactctttccttgtgttattatggatgttctccaattctgttctgcagacgggtgacaagtgaacatgtagaagaagttttcagtctcctagttttacctccattcaattaactttaaaatctacattactagttctgctgtgtcaccggcagtccaagaaaagaaacctgatcagtttgtgaaaatagctaatatttaatatgagcttattatgtgccagctactttacctggagtttcttatttaagccttacaattgctttattaagggctaggaacttcacatgtacattaaaatgtagaagcaaactgttgaggagagaaaggaatttacccatattatacagataactaataggaagtagagattggatttgaatgaatccaggactgatgtcgaagcccagtgtcttaatgttattttgggatgtctgcatagatttttttttctttataagggagtgatgattttaaaagcaacaagacccaccttaggtaaagtccatcatccaaaaccaaactcagttttattcctgtgcctacgcaaccacattattggatgcctagaaaatgttcaaacttctaaccaagtcactggtaaccctctgtgattttggcttaatcaggtttattcatcagttttgcccatatttcacttgagctctagtctcattaccttaattacagcttcctgtatgtctataggcttttgcttctatagacccaatttatatggtatcaactctatatgaagccgtttttgaatctcctagtaatgctttaattttcctaaaattcctgttatatcaaatcagatttcttttttatttttttgtcagttataagtttattttttgtgagggcaaaaataaatttgttggataatgagtttgtgagtagtagatcaatttgttcacatattttgcaaaagttagagcttattactcattcatgtactattgatgtaacgcattagaagacagttaacattagttcctaattgcacctgaccaaaaggagctgtgggcctggcctatacaccttattgcgtgttcagcatcaactgatttagtgaagcagcaaaaagaaaaatggtgtgtgcagtattatctttctgccacagatacatgtttttaatttccaagtttccaatgcatcattcagttttatctaatgggaatgcagctgagagaagtttgtatcaacccaaaactacatgctaatatagtttagttttcaagacttgtggagtctttttttttaatggaataagatcatcagaaatcctggagcaagacagactggctgtggtctaccagcattgtagtaaaaacattggggaagttttataagacctaattattagaaaataccataaaatagtcattttcatagaaaaagctttcctttctttcctcacactaaatcacattactttgtgttcaaggtaaaatggagtttgaaatctggatgtaaataagaaaagatattattttattccaagtgaaacatgtattcacacttcacgtcttgaagcaccaggtggccatttgggctgagttttcaagaaaaaaaaaattatatagattttatgtccccccccttttgttgttgctgttggtggtggtggtggtgatttttattttttggtaaagataataacatatgaaacaattttcctgttaattaaaacttactctatttatgagcatgatattttaaagaaattttttatatataatgaatatttggatatatatgtggttaatggttattttaacaaacattttggtttgctgaaatttttaagtttttttttcttttattattatactttaagctttagggtacatgtgcacattgtgcaggttagttacatacgtatacatgtgccatgctggtgcgctgcacccactaactcgtcatctagcattagataaatctcccagtgctatccctaccccctccccccaccccaccacagtccccagagtgtggtgttccccttcctgtgtccatgtgttctcattgttcaattcccacctatgagtgagaatatgtggtgtttggttttttgttcttgcgatagtttactgagaatgatgatttccaatttcatccatgtccctacaaaggacatgaactcatcattttttatggccgcatagcattccatggtgtatatgtgccacattttcttaatccactctatcattgttggacatttgggttggttccaagtctttgctatcgtgaataatgccgcaataaacatacgtgtgcatgtgtctttatagcagcatgatttatagtcctatgggtatatacccagtaacgggatggctgggtcaaatgcgatttctagttctagatccctgaggaatggccacactgacttccacaatggttgaactagtttacagtcccaccaacagtgaaaaagtgttcctatttctccacatcctctccagcacctgttgtttcctgactttttaatgatcgccattctaactggtgtgagatggtatctcattgtggttttgatttgcatttctctgatgcccagtgatgatgagcattttttcatgtgtcttttggctgcataaatgtcttcttttgagaattgtctgttcatgtccttcgcccactttttgatggggttgtttgttttttcttgtaaatttgtttgagttcattgtagattctggatattagccctttgtcagatgagtaggttgcaaaaattttctcccattttgtaggttgcctgttcactctgatggtagtttcttttgttgtgcagaagctctttagtttaacgagatcccatttgtcagttctggcttttgttgccattgcttttggtgttttagacatgaagtccttgcccatgcctatgtcctgaatggtaatgcctaggttttcttccagggtttttatggttttaggtctaacgtttaagtttttaatccatgttgaattgatttttgtataaggtgtgaggaagggatccagtttcagctttctacatatggctagccagttttcctagcaccatttattaaatagggaatcctttccccattgcttgtttttctcaggtttgtcaaagatcagatagtggtagatatgcggcgttatttctgagggctctgttctgttccattgatctatatctctgttttggtaccagtaccatgctgttttggttactgcagccttgtagtatagtttgaagtcaggtagtgtgatgcctccagctttgttcttttggcttaggagtgacttggtgatgcgggctcttttttggttccatatcaactttaaagtagttttttccaattctgtgaagaaaggcattggtagcttgatggggatgacattgaatctgtaaattaccttgggcagtatggccattttcacgatattgattcttcctacccatgagcatggaatgttcttccatttgtttgtatcctcttttatttcattgagcagtggtttgtagttctcctcgaagaggtccttcacatcccttgtaagttggattcctaggtattttattctctttgaagcaattgtgaatgggagttcactcatgatttggctctctgcttgtctgttgttggtgtataagaatgcttgtgatttttgtacattgattttgtatcctgagactttgctgaagttccctatcagcttaaggagattttaggctgagacagtggggttttctagatatacaatcatgtcatctgcaaacagggtcaatttgactttctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccgtcaatacctaatttactgagagtttttagcatgaagggttgttgaattttgtcaaaggccttttctgcatctatggagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattgaggatttttgcatcagtgttcatcaaggatattggtctaaaattctcttttttggttgtgtctctgccaggctttcgtatcaggatgatgctggcctcataaaatgagttagggaggattccctctttttctattgattggaatagtttcagaaggaatggtaccagttcctccttgtacctctggtcgaattcggctgtgaatccatctggtcctggactctttttggttggtaagctattgattattgccacaatttcagatcctgttattggtctattcagagattcaacttcttcctggtttagtcttgggagagtgtatgtgtgcaggaatttatccatttcttctagattttctagtttatttgcgtagaggtgtttgtagtattctctgatggtagtttgtatttctgtgggatcagtggtgatatcccctttatcattttttattgcatctatttgattcttctctctttttttctttattagtcttgctagcagtctatctattttgttgatcctttcaaaaaaccagctcctggattcattaattttttgaagggttttttgtgtctctatttccttcagttctgctctgattttagttatttcttgtcttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcattatgcaccccgtagtcattcaggaggaggttgttcagtttccatgtagttgagcggttttgagtgagattcttaattctgagttctagtttgattgcactgtggtctgagagatagtttgttataatttctgttcttctacatttgctgaggagagctttacttccaagtatgtggtcagttgtggaataggtgtggtgtggtgctgaaaagaatgtatattctgttgatttggggtggagagttctgtagatgtctattaggtccacttggtgcagagctgagttcaattcctgggtatccttgttggctttctgtctcgttgatctgtctaatgttgacagtggggtgttaaagtctcccattattaatgtgtgggagtctaagtctctttgtaggtcactcaggacttgctttatgaatctgggtgctcctttgttgggtgcatatatatttaggatagttagctcttcctgttgaattgattcctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagctcactgatgggtcttgactctttatccaagttgccagtctgtgtcttttagttggagcatttagcccatttacatttaaggttaatattgttatgtgtgaatttgatcctgtcattatgatgttagctggtgattttgctcgttagttgatgcagtttcttcctagtctcaatggtctttacattttggcatgattttgcagcggctggtaccggttgttcctttccatgtttagcgcttccttcaggagctcttttagggcaggcctggtggtgacaaaatctctcagcatttgcttgtctgtagagtattttatttctcctttacttatgaagcttagtttgcctggatgtgaaattctgggttgaaaattcttttctttaagaatgttgaatattggcccccactctcttctggcttgtagggtgtctgccgagagatccgctgttagtgtgatgggcttccctttgagggtaacccgacctttctctctggctgcccttaacactttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaaattggttccattctccccatcactttcaggtacaccaatcagacgtagatttggtcttttcacatagtcccatatttcttggaggctttgctcatttctttttattctttttcctctaaacttcccttctcggttcatttcattaatttcatcttccatcactgataccctttcttccagttgatcgcatcggctcctgaggcttctgcattcttcacgtacttctctagccttggttttcagctccatcagctcctttaagcacttctctgtaatggttattctacttatacattcttctaaatgtttttcaaagttttcaacttctttgcctttggtttgaatgtcctcccgtagctcagagtaatttgatcgtctgaagccttcttctctcagctcgtcaaagtcatcctctctccagctttgttccgttgctagtgaggaactgtgttcctttggaggaggagaggtgctctgctttttagagtttccagtttttctgctctgtttcttccccatctttgtggttttatctacttttggactttgatgatggtgacgtccagatgggttttttgtgtggatgtcctttctgtttgttagttttccttctaacagacaggaccctcagctgcaggtctgttggagtaccctgccgtgtgaggtgtcagtatgccccttttggggagtgcctcccagttagggtgctcgggggtcaggggtcaggcacccacttgaggaggcagtctgccccttctcagatctccagctgcgtactgggagaaccactgctctcttcaaagctgtcagacagggatatttaaatctgcagaggttactgctgtctttttgtttgtctgtgccctgccctcagaggtggagcctacagaggcaggcaggcctccttgagttgtggtgggctccacccagttcaagcttcccagctgctttgtttacctaatcaagcctaggcaatggcgggtgcccctcccccagccttgctgccaccttgcagtttgatctcagactgctgtgctagcaatcagcgagattccgttggggtaggaccctccgagccagatgcaggatataatctcctggtgtgccgttttttaagcccgtcggaaacacgcagtattcgggtgggtgtgacccgattttccaggtgctgtccgtcacccctttctttgactaggaaagggaactccctgaccccttgcacttcccgagtgaggcaatgcctcaccctgcttcgggtcgcgcacggtgcacgcacccactgagctgcgcccactgtctggcactccctagtgagatgaacctggtacctcagatggaaatgcagaaatcacccgtcttctgcgtcgctcactctgggagctgtagaccggagctgttcctattcggccatcttggctcctcctctcaaatcagatttctgatccaatatttcaagttttaattttcccactggtaggctctattcctactctttttctgctcatggctgaaaattttctgtatctcccatctctttcatatttgaatctattgaatacatagcctccacactcttaataaaatactaatttcatcatgtaacttcattattcaaaatatttagtggctcccactacctatattaaagattccaaactcagtagttactaatatttttcataggctttctagtcctgtcctttcttttagtcttatctcttactactttaagcttattcctagggcaaacatcttactatttccaaaatgtgattcaacgtcattcctattgcctaggaagacactcttctgtcctatggctctctaagtctacttcctgttgaagtactctttttcataaacattcaaattgtttttgtgtcctactttggtgttacctgacatattttaaaactcatggattggatcacatatctatgcatttacttatggcaccattacattttatttattttaagagacaagatattactcttttgcccaggctggagtgcactagcacagtcgtagcttaccacaggcctccaactcctgagtcaagtgatccttctagctcagcctcctgagtaactagaattgcaggtgtacaacacaatgcagaggtacatttaaacaattttttattgttattttgtagagacagggtcttgcttcattgccccggttggtctcaaactcctggcctcaagcgatcctcctgcctcagcctccgaaaatgctgagattaggaatgtgaaccattgtgcctggcccacgttacattttaacagtggggatctgaacactgcagtttcccaaagccaaaaacatgactaactcagctataaatatttaaccaactcttaagtatacctcctggaccatggtcatatagagcagaggctgtgctactatatatgctttagttttgctagtacatttagaaaattgtttattacatagtcagtactatggtgaatggttaagatatgttgaatgccctgctgagacaacgtttttactttgataggaaagtcaaaagaataacacacatatttaattattaaagaaccagaacatgtagttttctgaatttcttagtataaaaagctccttaagagacataagtatacaaatatacacttcttcatctatgatactctattaaatttggcatatttctttttaacaaaaacttacaagggtagaaatctgctgagatgatatatgaaatgtggaaatgttaaagatagattgggggggtggttaagataagacattgaagcatataatactcctcttggagaatcattcagcttgccaagctaccatgaatcagtgtttgaaaagaggcagaagatacatacatagaaaaatcagccaaaatattcattaacatgaaatgtttccaaagctgaagtgctacattaatggttgactttgtgcctcaagactaaatattgggcaatgttagctttccctataataaaacttgccccaaaatatatgttgagtatcccttatccaaaatgcttgggaccagaagtgttttggattttggatattttcagtttggaatatctttattatacatacgagttgagcatccataatctgaaaatctgaaatccgaaatgattcaataaggatttcccttaaaaatgatcgtgtagttactcaaaaaattacagattttgtagcatttcagatttcaaattttcctattagggatgttcaacctgtattgaacttacttgcttacacgtgttgcccgtttgctgtactgtaagctctgtgaaaaaagtatctgctgacttctttgttcataattgcgccctagcaccttttgtggtagttggaaaatggtagacactgagtaaatatttactaaatgagtggataggtaaaagtatttcagtttggcatggcaagatggaaagactaacagtgtttaagtggctatggccaacgtcaggccttcttcagtttaagaactgtggaaagaagaaaattaaacaattaaggaaagataagaataaatccaacaggaagttctcactgaagccaagagattcaaaaaaatacaggaagaagaagaggaagaaaatactattttctatgcattatattcccaaagatatctgccttactgattaatatcaattaataccataactatcacattttctcataggccaaggtgaaatgtctgataagacaagctttgttgctaacacaatttaactcactttagaatattaacatgacatttatgtggtctactcctctctaagctcaaataaagcagctgcgtataaaaagcagccatggattaaatgacttcagcctgctttgtggaaactactgctgttaaacctgctcttgataaactacaaagagtgcctggactccatttatgaaaagacatttgaatatagacctcacatggtgatcatttaaaaatattatattttgcctgtattacaacattgggttgtatttttgtttaaatctctacttcatttacttatgcgtgtaatactgacttgcttcacaaaatgttactctggagtgtctggcaagcttcctaacaagaaatttgaaagcagttttacatgaaaatcacatttttgaattttatatttctagacaagttttagtacaagcagtgtaagagcataagagtagtctatgtcatatgctatttgtcagtctccaatgaagagtaaacatttatcagcttcagtaacaatccctgcctaactgaggagtgtcattttctgaaaatattgattgatagaggccttgcctaaaaaatataaaatgcatgtaatttacacacagctgagaaatacaagctcattttttcctgacaagcagtaatgccctttataaactatggagattaaattacaaaaaaagttaaattaaaaacaaaagtatgatcagagtgatcagagttttgtgtggtacattttctagtaatcatgttttacagcagtctaatttggtaaataaaagtgaattggaatatattttaaaggctaatatgtatatgtgtgtatgtgtatgtatatacatgtatatgtgtgtatatatacatcatagaaacctttatatttaagagaaaatcatcaacaaatacttttaacacatttgttgttatgacgcagtaacatgtatcctaaattaggaaagtcatgtttccggatattttcctaaggaaatattggttctaaaaattcagcataggaacgtcaagtattttattattcactgaagggaccaataatatcaatgcaagcagaggcctgatatagaaaaattaattaaggtgattatagaggtgtaagcaggactctagtaaatgaatttagaaggtggtctagtcagttgcttgaacattaatcagaatttagagttctgctctgttataaactcaatggtctcgtgaaaccatttttatacaagtctcaatgaattcatctctatatagttcttgttccacctactttagtattttttgaggagcaaatgagataatgtgtgcgaacataagacacaatgtgtaatctaagccaatctgggcagattaccttctctagtgcagattagagatatctatgcattcactaactgaatttttgtaccagttggaagtgtttctgaagcagatcttttttttgctagtctattataattattaaagatgatatcatgcctaaaatttgtcacattaaagaagcatcagtatctttgtaacattcacacattgattttacttcaacctagaggaaccatgactgcctttaaccatttgaaaaggtctttatgaatctaccatctccaagatgaatacccacagcctttattattgggctcacttttggtgtcctttatcgtcatggtagtcatagctcctacatctagtaaacgttaggcctagaatttgaattgccttgattctcaaataatatctgaatccatcatcttatatatttataatttctttgaatatgtgataattaattcagggtaattagcacatccaatgtctgtgtgtagaaacattgtgttggaccccataaatatgtataattatcatgtcagtcataaataataaaaaaaacttcccacaaataatttataaacccatgcagtccttataactgctctttccaatattaatttcagacttaaaggtgatctgttaaattttatcttactggtttcgatattattatagctaagacatccatagctgaattttattacaaagagtaaaagctaccctttccaggagagtaaaatattttattataatagctgtatttttatgccttaagatccaagatcattggcaaggtatatttggtggaagcagtccaaatgagagtcacatgaccatcaagtagatataactttaaactgacacaaggccatttgccatcactttttggatagggtgtgctgccacatgtgtgtttttaaaatactatattttagtacagattcaaaattttgtctgtgaatttattatgggagacattgataagctacattgtgaatatgaccttatctatcgaactaataatatgatcaaaagagaaaatgacatttgttcatgggttgatttgctaaccccgcagtgtcataaatagtttatagtagtgtcattgcctccatagaaagttaagattgcgtagattcttcagctgtaataaatttgtaacatatatattggataaaagtatatgagaatgttcaaaacattatttagattaagagatatacctattagaaattgcatatattccaggggaattttttaaatttttgtgggtacatagtttgtatgtgtatatatgtatagaaagagagagacagtacatgagatactttgataaaggcatgcagtaaataataatcacatggagaatggggtatccatccactcaagcatttatcctttgtgttataaacaatccaatgatactgagttattataaaatgtacagttaaattattgagtatagtcaccttgctgtgctcgcaaatactatgttttattctttctaaggaatttttgtacccattaaccaaccccagcttacctccaccccctagtaccctactcagcctttgagttgagatctctctctctctttagctctaataatatttgctttatttatctgggtgctccagtgttgggtgcctaaatatttgcaattgttgtatccttttgctgaattgacccctttctcattatataatgaccttttttgactctttgtttttgtcttgaaatctgttctgtctgaaaaaagtacagccactcctgctgttttttggtttccattggcatggaatatcttttttcatccattttcagcccatgtgtatctttataggcggtcattaaagatgtcaagtattttgtagaatcatagcatgtatataaacacatgcatgcatatacatatatatacctatggactacaatattatagataaaatttcataagtgactatgatccatgatatgagaggcagagaatgctcagcagtgggatccctctctcaagccatactgtcaaatctagtatattgaaatttctggaacacccttatatattagagtctttaccagaaatgctggtacgtttattttaactgttattgcagaaatggctaagaaaacaatgtctagattctaaagcaaggattaggattgtatactttcttctgttgtgttacacagatacaaccaaacaatgactatttattaagtactatctgtggctaaggtgttgtacttgaggctgtgttatttacgcactaagctgttaaagtttatttgatgtttactagagctttctgatgccaagaacacaactctggttttggtagctctcttttttccattgtttaaaaatgctaaagatcatgcaaataattaacatatgataaacattttttaatctcagtaacattgtaaatttataatatgatgagaaaaagagctgaaagattactgatgtaatttataacaggttagtatttttagttcatcattataaacccagaagagaagagctaataaagttattcagttgtgcttatgtaaatcttttggatcttgagacttatttaatgactggatgaagattttaagtgccatgggatatgtgagctacatggttcaactgtacaattggatcactgttcattttatgggctgtgatatacttcacattgggttgatttattgtttcagagtaaaattagctttaacatgttttcttcctaactgaattgtaaatcaattatgttaacagctcctcttggtaagggcctagacaaaatacatatggtcaataaccattttgtgtgaaataagcatataaaaagcagactttagtagactactctagatttgcatagttcctcataaatcaactttatgaaaatgataagaactgaacagaaatttatttgaagaatttgagccataacagccttataaattaggttcacttcacctattttattcacctcgtttagtttcagcaaaaaagtctgatttaatttagagtttattattacttttgattttaaatgcacaattcttaattgtatatttatacattccagttggaccaattttttgaaaggatttcctcaagaagtagaattgcaccatttaaatgtattatatttgacttgtcaactgtcgaatctaattgtcatcatttgaaatacaacaatatgtgctaattattttagttttagtttttattcttttactggatgtacttaaggcaaccttgtccaactcacagcccatgggctacatgtggcccaggacagctttgaatgcagcctaactgtaattcacccactttcttaaaacattatgagatttttttgcaggtttttttttttagttgattagctattgttagtgttagtgtattttaggtgtggcctaagataattattcttcaaatggagcctaaggaagccaaaagattacatacccctgatttaaggggtacaagatgttacgatatacatagacataatgaaatgattactgaattcaaccaaattatcctatccattatcttccataataactgttttggtatggtaagaatacctaaagtctcttttcttagctaatgttcagtgtacaatacaatgccattaactgtagtcatcatactaagcagttatcgagatttatttatccaatataacttcaagtttgtgtcctttgacctacttctcctcatttcttccaaacatttaaagagtaatttataccatttgttcttaaaatcttctaaataatagaagaggaaatacctccaaagccatttatgacttcagcatcaccctaaatacgaaagtcaaacagacaccgcaagagaagaaaatatatatatgccaatatctaggaggaatatagatgtgaaagtcctcaataaagtattagcaagacaaataacacattggattataaaccgtgaccaggtgggtttagccctaggacacaaggttggtttaacatacacaaatcaatcaatgcgacatactacattaacagaaagatgaaaaaccacatgattatctcaatacatgcagaaaaagcatttgataaagctaaacatccttttattattataactcttcgcaaaatatgtatggaaggaaatttcctcaacatcaaggctatttatgaaaagcctatagctaatatgatcaacggtggttgtggggtggttgtactgaaagctttccccttaagatttgctaaaaagcaaggatgcccactcttaccacttccatttgtcatagtaccaaaaatactagcaggagcagtgagacaaaattaataaaaggctttcacatctgaaaggaagaagtaatattatttctgtttgcaaatggtatgatcgtatatgtagaaacccctaaggactccacaagaaaaatgttagaactaataaatgagttcagtaagtagtggaatacaaaatcaacataaaattagttgcatttttatgcaaaagatatccaaaaaattttaaaaaattctatttatgataacatagaataaaatatttaagacccaatttaaagaagaaagtgaaaaatacgtacaaccaaaactataaaacattgaggaacaaattaaaaggtaaatatatgggaaaatatcccatgtttgtagactggaagaagtaatattgttaaaatttccatactacccaaatggatatatagctgtcccttggtatccacgggacatgggttccaggatgccagtggataccaaaatccaaagatgcttaaatcccttatacaaaatggcatagtatttgcatatacctatgcacacccccctatatactttaaaacatctatcgattatttgttattacacctaatacaatgtaaatgctatagaaatagttgttaccatatattatttttacttgtattaatattttttgttgttgtattgagttttttgttctatttttgattatttctggtctacagttgcatccgtggaaatagaaggttgactgtacaaatttaatgtaatccctgtgaaaatctaaatggcattttttttcacagaaataaaagagcattataaaacttacatgaaatcccaaatagccagaacaatcttgaggaaaaaaaagttggaaatactgctctttggatttgaaattatatcataaatctacagtattaaaaagagtattgtaatgccataaaaacagacacataaactgatggaacagaatagagatctcacaaataaacctaagcctatataatcaactaattttggacaggaccaccaagaagatatgtggggaaaggacagtctcttcaataaatggtgttgtaaattgtacccttgtcttatactgtacacaaaaattaagtgaaaatggactaaagacttaaatataagacctaaaatcataagactcctagaagaaaacagagaggaaaaagctctctgacagtcgcctttgcaaggattttttgaatatcacatcaaaatttcaggcaagaaaacaaaaataaactagtggaactacattaatctaaaaagcttctggaaagcaaaagaaaaacacagcctacagattatgagtagatatttgcaaaacatatatctgataagggtttaatatccaaaatatataaggaacttgcacaattccatagtgacaaactaaataacccaattaaaaaattgggaaagaacttgaacattttttttttcaaagaagatgtgcaaacggccaacagggaaattaaaacgtgctcaatatcactattagggaaatgcaaatcaaaatcataataaggtattacttcatacctgttaggatgagtattatctaaaagatgagataacaagtgccagtaaaggcaaggaggaaagggaaccctgacatactgctggtgtcggtgtaaattagagcagacattatggaaaattgtctgggagtgtttcctcaaaaagttaaaaatagaactaccatatgacccaacaatcccactcctgggtatagacccacagaaaatgaaatcagaaccttgtggagatagccttactctcatgttcattgcgttatgattcataatagccaagatatgaaaataacctgagtgtccactgacagataaagaaattgtgacacacacacacacacacacaaatattcagcctcacaaaagatagtgccatttgtaacaacataggtgagcctgaaggaaattacactaagtgaaataagcaagacacagaaaaaaatatgctacgttatctaacatctgaaatctgaagaaaatgtataagttgaatacatagacagtagaatggtgattaccaggagtagtgagggtgaggaaataagtcaatgtgtacatggaaacttgcagttatgtgggataaataaatttagagtttcgatatacagctaacccttttttaaaaaaatataaaagcagataataatggggtaaaatgtagtgttttgatctatgcatacattatgagaaagatttgatctagctagttaaaatgtctatcgcctcagctacttaaccctttctaatatttatctaaaatatgtcagatccagagatgtatgaccagattttaacatcatttttaatgtagaattgacagttgtaacaatgattttctcagtttgcttattcaacacccatggaccaagataataaatttaggacctatttaagtagtttctaaaaaggcgttaaaaaaatccccatgggggcaaacaatgtgaatcgaataacatttccaaatgaatgtaatttgctcatttggatgtgagctaagtaaaaaaacgattgtaaaagaaaatgtaagtaatagaaattatctaagaagagcaatgagatgtgttccatctgtgaccaattttggtcaattttttcacaggcatttaatgggtgcaaaatgagccagtcttggtattagaccgttaaaatgcattgtcttctaggagttcatattgtttcccctcccattctgaaaaaaattagaaaaggtaacaacaataaagaattgtggtagacaaaaactcttttgtaaggtatgatttgactcgtataataggtgttacgagtgttgagtggctctgtcagatagaaacagtcaaagaaatgctagtaatgttgtcttgtttgctttacttgtaagtatcttgtgtattttatttacttaatatatttaatttactttaatattaaaacgtgtgtgtgtgtatatatatatatatatatgaatgaatgaattctaatgggtcaggtcatatagtatgtgtgtgcacgtgtgcacatgcaagctgggataacaacgtattatatgatagagtctatctggtgataaacgttcagaggttggaaaagggcattgtgtaccaagctcttgaggtattctgggaaataactgcacaccaagcatttggatattgactgactgataacagtaaatgtacatttattcagctaaataaatgaaaaaaaaagtatcaggcattccaagcagtgaaaataacttaaataagaacacaaaagtaagtctacatttaatatgctcaaagcatcatgtgcatctgtacaatatccaaaatatttccaccagaattaaattttgttattccattattttactataatatttggaggcaaatgcatattaacataatcagtttaaactttgcaatactaaggtttctcttttatttagtacaatgacccaaagttatagaattatttgcctctgatttcttggcaacatatgtatactttactgaaaatttcatctacttcattcttcatcaccctacactcacacagagaaacaaattgataatgagaaattgaaaaggaatatgaaagctcagtgctgatttttatttggttcatgtaaacctctagaagcttagctctattaagattatctgaacctttgtaatactttctatttgaagctatttgcttccaaccagtctatcttatattaattattattttcaattcatcagattatgtggatgcaatggctgataagttgagatatactttgaggaacactgctatgataatcatgatagaggatgcatgggtgattcatagtatttccaactatgtccagttatgtttagtgtttgtgaatcacctatttgcctaccttctctagttgagtaactatatatgtaggtaattgaatcagactattttgctaccaagaatatagcctcttccccgatataaagaggcaccaattacagattatttacctaatggagcattttaaatatggaaggttattaactatttacacttgagtcaacattggaataaaaagttttagctgacaaaattatttgctaagtgtgtacttccatccacatttgccatatattttaaagagcaataaggaaagtcttttaaagtgatgaaattcagggctttcatttaattgatgtttttatgtgacatatttatattaataataaaatgcaaaacagtgaacaggtaatatttaatctttgttcttccttttcttaaagtcaggaagccagaactagtcagtcctatcagtaaaagcaaaagtaatatatccaatgacatttgcttaaatacattaccaagtcctgagaaaggttcttactaatctgggaataaatgtccttatcttgatatgtgtattagtccgttctcacattgctataaacaactacctgtgactgggtaatttataaagaaaagaggcttaattgacttgcagttccacaggctgtatgggaagcatggctggggaggtctcaggaaatcactgtggaaggtgaaggggaagtaggcacggcttacatggccagagaaggaggaagagagagcaggcagagatgctacacgctttcacacaaccagatatcatgagaactcactatcattggaacagtaagagggaaatctgcccctatgattcagtcacctcccaccaggcgcctcattcaatattggggatcacaatacaacatgagatttgggcagggacacagtgccaaactatatcgttctgccccaacccctcccaaatctcatattgttctcacatttcaaaatacaatcatgctttcccaacagttccccaaagtcttaactcattccagtattagttcaaaagtccacagtccaaagtctcatctgagactaaggcaagtcccttcaacctatgatcctgtaaaatcaaaatgagttacttccaagatacaatgagggtacaggcattagctcaaaagagttaaatcgatcagaagaaaggggttacaggccctgtgcaagtccaaaacccagcagggtagtcattaaatcttaaagctccaaaataatttcctttgactccacatctcatccaagccacagtgatgcaagggacaggctcccaaggccttgggcatctccatccctgtggctcagcagggtgtacagcacccttagttgttttcatgggctggcattgagtgactggggcttttccaggtgtatggtgcaaactgtcactggagagaccattctaggctctggaggacagtggccctcttctcaaagctcaagtaggcagtgccccagtggggactctgtgtgagagctctaaccccacattacccttctgcactgccctagtagaggttctctatgcaggctcccccgctgcagcagacttctacctggacatgcaggtgtttccacacattctctgaaatctaggtggatgctctcaagcctcaactctcacactctgcacacttgcaggattaacaccacatggaagccaccaatgcttatggcttgcaccctctgaagcaacaccccaagacacatctggggcctttttagtaacagctggagctggagtgtctgggacatagggagcagtgtcttgaggttgtgcagagcagtgaggccctaggcctggcctccgaaatcatttttccttcctagacctccagacctgtgataggaggggctgctgcaaagggttctgaaatgcctttgggcattttcccctttgtcttggttattaacattcagttcctttttacttatgcaaatttccgcagacagcttgaatttcccccaccaccccgagaaaataggcttttgttttctaccacatggtcaggctgcaaattttctaaacttttatgctctgcttcccttttaaatataagttccagtttcagataatctctttgctcatacatatgaccgtatactgttagaagaagccaggtcacatcttaaatgttttgctggttagaaatttcttctaccatataccctaaatcatcagtctcaagttaaaagttccacacatacctagagcaggggcacaatgctgccaatctctttttgttaaagcattgcgagagtgacctttattgcagttcccaataagttcctcatcttcatctgagaccacctcagcctggatctcattgtccatatcaatatcagcattttggtccaagcagttcaagtctctaggaagttacaaactttccctcatcttcctgtcttctgagcgctccacactgttccaacgtgtgcttcttactctgttccaaagttagttccacgttctcatgtatcttcgtagcagtgccctacctctcggtaccaattttctgtattagtcctttctcgcattgctataaactacctgagattgagtaatttgtaaagataagaggtttacttaactcaaagttcttcaggctgtacaggaagtatggctggggatacctcaggaaatttccaccttcttgtggaaggcgaaggggaagcaggcacatcttataccttacatggccagagaaggaggagaaagcagggggcagtactacacacttttaaacaaccagatctcatgagaactcattatcatgagaacagcaactgggaaattcaccctcatgatcctatcatctcccaccaggcccctcctccaacactggggaacacaactcaacatgagatttgggcaaggaaacaaatccaaatcatatcaatatgctagaatgactcaaacaataaatacgacaagaatattcctcctctgtattgacgctgttcagtatttttctggagaacctagccaatattatatgacgagagaaagttacatgaaatatatattggaaagcacaagataaattatttgaaaataatatgattttctcattatgtaaaatgatctcaaaattaggaaatgtacagtggtaataaaatgatactcagcatagttactttttgtttttcagtttccacaaacaagtgagatcatgcaatatttttctttctgtgtcttgcttatttcacttagcctaatgttcttcggctccatctgtcctgtggcaaataagaagatctcctttttttgtgtttctgttttgagatgaagtctcactctgccactcaagctggagtgcagtggctcactgcaacctccacctccccggttcaagtgattatcctacctcagcctcccaagtagctgggatttacaggcgcccaccaccacacccagctaatttttgcatttttagtagagatggggtttcaccatgttggccagggtctcaaactcctgacctcaggtgatctgcgtatctgcctgccatggcctccctaagtccctaagtgctaggattataggcataagccaccacacctggtcaagatctccttttttttttttttttttttttttttgatggaatctctgtcaccaggctgatgtgcagtggcacaatctcggctcactgcaacctccacttcctggctttaagagattctcctgcctcagcctcctgaatagctgggattacaggcgcacaccaccaagccaaactaatttttgaatttttagtagtgattggcttttaccatgttggccaggatggtctcaatctcttgaccttgtgatcctcctgccttggcctcccaaagtgctgggattacaggcatgagccaccacgcctggcccaagatctcctttttaaaggccaagtaatattccattgtgtataactatatagagagaataaaacagtggttaccaggttgggggtggaaggaggaaatggggagatgtaggtcaaagtctataaagtagcaaatatgtgggataaacaagttgaaagatctaatataaaacatgaggattatagttaatagtgtgttgtattcagaatttttactaaatgagtagattatagcttctcgtggtcagagggtgggggaacgattatgtgagatgatggatatgttaatttctttcattatggtttcattatggtaaccatttacatgtgtatcttatagcatcatgtgtataccttaaaacacacaataaaattatttttaaaaaagagaagttccaaaatctatgtagttttcttagaagtaaaccgcacaagaaagtataagcttttttttataggaagtttaaagttgtatataagtacataaataaagacatgaggaaaggaagtcacatatgatgaaaatgctagttctccctaagttagtttgtacattgaaagtaacttcagtcacactcgcatgttcactggagcactatgcgtaatagcaaaatcgtggaatcaagttgtgtccatgagtagataaagataatgtggtgtgtatatataatggaatactaacgagccacaaaggaataaaattatgtcttttgcagcaacatggatgaaactggaggctatcatcctaagtgaaataagtcagaaacagaaaatcaaatactgtattttcctataagtggtaactaatcaatgggtacacatggacatacagaattgaatactcaacattggagactccaaaagatgggagagtgggaagggggtgagagatgaaaaattacctattaggtacattgtagactatttgtgtgatgggtacactaaaagccgagacttgatcactacacaacatatccatgtaacaaaattgcacttgtaccccttaaatctaaagttcctgaagttacttcaatcaagatctagatggtccctgacttaagatggtttgactaatgatttttcaactttatgatggtgtgaaagcagtgtgcgttcagtagaaaccgtactttgagtacccatttaatcatgccatttttcactgtcactactgtgctcaatgcattacacgatatattcagtactttagtttttatagaacaggctttgtgttagatggttttgccaaagtataggctaatgtaagtgttcttgcatgtttaaggaaggctaggctaagctataatatttgacaggttcagtgtattaaatgcaattttgactcactatattttctatggacaatgggtttattggaatgtaaccctgtcataagtcgaggagcatctgtataattacacactcacatgcccacaaacatgtatgtatgcgactctctgtgtatctatatttgtattattttagaggatataacagaaccctagcaataaatagaatttatctcagatggtaaaatgaagataattgtattttaaaagttacagaagtatatattaacaaataggtgacaagaaataatctagagaggagcaatagtaggaagtagttactatttctactattcctactatatagtagctgaaaggaaagggggaacggagttcagtgaaagctgcaccaatggagggaatgtagttgttggtagaactcagatactacattatgcagctctggagcagggaaataatagagaaatttccccagctttctctttccctcttctttcaatctccagctggtacttcccaccagcttaatgcaactggaatctagccagctaatgatcacaggagatacagtgtgaaagggtcagccacttagagaataagcagagaagaaagggtgtttatgttcagggtgagcacactgaacataaatcacatgaatggtaagagggattcagttttctagataattctaaaatttgtttaaatgtaaatgcgtgagtacagttaagaaattattttcaaacaggtgatttgctttagtagattttataacatacttaacatagtatgacatgatagagaaataatttaatggtgtggaatagatattttgacaacattcccttttatttaggtaaatttagtacacaattagggtgacatttcatgtctctagagatagaataggttagctaataaagccttcaactgtggaaacccaaggcacaacaaatactaagataactttcagataatgattgaatgtgaataaacatttaaatactttattacaatgtagaagaatattacaataatattaaggtgatataaaacctagaggctgtaaaataccgacaaatttaccaacacaaaattaaaatattttccattgtgaaagaccattaaacagtaataaaacctatgatggactgcagaatgacactagtaataaaaaatcaataacctcagtatgataacactcctacaatgaatatacaaagtataatattttaaaagtggctacatattatggtcaggacattcacttgggaaaattagaaatagcccatcaaaataaaattaagcttaactaataaataaatgcatagtacaaatatcttcttattatgagggttcatgtaaataggccctgtgtttcttttggaggaaacacaacttgtaatattttaatcagacaatttagtattatctttcaaaatatgtaattttacatatatttgatcctgaggtttcacatttaagaattagatatatagtaatactcatacatatctacgacaaatgtgtaaggatgttcattgcagcgttgtacacagtagctccagtatttttcatgctatggactgttaggcagatatatctctaccattggactataggcaccataaaatcagggtctaggtttgtttgtgtttgtttttatttttgctcactatttcagctgcagtgtccagcataatcctcgacttatggcaagtgtccaataaatagttacagaataaataaatggataaatgaatacatgcattactgaaattaattttgaagttcacattgtatatatacatgtgtatatacattttaaacttgaaatttgctgaaaacatactttatgccaggcattgctctaaatgccttacttgcacttaccttcttggaaaagtctttgcctcattttaccaatgagggtatgaagaaatgaagaaattaagtttcttatccaaattcataataccagtgagtggtaaagctaaattttgaatctttactaattgagcacatcttaagaaagtacatgcatagacagtgtatatgtttaatctcattagacaggcagatgagtatgataaatggatagctaaaagaatggctgaatggatagatgcatggatgtatggatgacatagcatctggtgacaagtattacttctagctaatgggactgtggtgctgtagagatatggggtactttcactattaactttaaatgcgtctgtactgttttagttttccactacaataagcatgtatggcttttgtaataaaatgtttaaaagtgagagattaaatccagacttatgaaattaaaatatcaaagacaactaacggttgaactcttggggccaaaaccgtcaatgggatgtgttttctctgagggaaagctttcctaatcaaggggcacgttcccattgagataagagtggaaatgacccatctggtcaatccaagatcagagcccatatggggactggagctatgataaggagtcaggctccataggatatagtaattgagatagttataccaagcccctgggtttctggtcatcaggaaagacaggcccctgctagtagagctctacctgagggagaggtatttgagagaggccgacatttcagagtcaagaagaactggaagctataccaagaaaatgggttatgtggtatttagcatatcagttttaaccctcatccagccactgagaaaaggaaagaagaaattttaaaattgcaaatggacaaaaggaacattcagtaattaaaatagcagtaagattctacgcaaagcctttccttttctctatttagtctttgaagttgctaatatctagtcaaagggagttgctttccaaatatgtaatgtttgcatgcatattatagttatatattagtgatcatattgtttataaatgtgtgtataccatcctaggtttttgtttctttattgaatccctttctcatatatctgagcttaaaaagcattttttacaattatcattatttggtagaatcctacccaccgctgactcatagttttagtgagatgacaaggaattcacacacttgaatctttcaaacccccaggtatgcagacgcttagcacaaaatttttggaagctatgcttccaaagttctaaggagtctgcttttcctatcctcagtctgagagcacttgagtacatttttttttctgtagatatcagtcaatattatttttgaaaatacgtttttgtaaagcacggtgctattttgtagtgtgtatgccaaagtttagaacaatgaataaaacattagttttcctgtgtcttgagtattttcaatctgaatttaaaatgtactaactttgtcatcatcactcataggcttcttgattaacctgctaatgctctctaatttggaaattaatgcttctttccctatcacttaaaaataatctgatacagtttctagagcatgagatgttcttcaaatcaagtcttatttttggaaatgtgatcaataagaaaaacttcttgcaatacaataggaagctgaggtgcattatgcttaactttatccaaggtcacaaaatgaaagaactgggagccaaaccaaggactctacttttttttttccactttaatcagactgtcacttattggttgtatgaccttgggctgtattcttaactcacaagagagtggtgaatttaaatgaaaaaaaaacataataaaagttcttgtatataattgatacttgataaaaactaattctataccaaactgaatctcttttgcagaattttgtagggagaaaaatacaggctgctcctgttccttgctatgtgctttctgccccttcaagcagtgctcaattttcaacatgtgtcttactctacattcagggggtgtagaccatgaaaatgaacctttattcccaaaaggttctctctccattcatttactgatttaacaaatactgagtacctactacttctcagtcattggtaaaacaatctaaaggaagttcctgcctttgtggtttttatattcttatataaaaaataaacataataatgacagtttgtgacaagcaatgtaaaggaaatcaatgtaaaataaagggaaaggggttgggcttctttaaatgggataggaaatgcatctctgaagaggtgccatatgagttaagacctaatgggtgagaatgaatcaaaaatgcaaaaagagaaattattttaggtaaaagagcaccaaatatgaagatcaagaggtgtaaaatggccttcggtatttgagatgcaaaaacaaaacaagaccaatgtgtgaaagagaaagagggatgacattagagtgcttttagctaagtgtgaaggattgggtcatgctgtactttacaggcatggaaggcagtgtcttttaacacatacatcaaattctattcactattcaaaaaatatactttagtatatacattttaatgaaaatcaatctcagctatgttttacgcattcttaacatcatttattacattctcttttataaagttatcccttatcatcatcatatttgtgttacatggttttggatgcttactctctttttcacttgtacctttctccatcaatgcttcacatttgattatcttcacttctgtaaatttctaaattgcatttttttcacattggaaattacttgacatccatggatattattgtatttgtagttgggaggtcctaattacaatggtggaagccagaaactccaaactcaaatgaaatttcataagtactgtcaaaaggaaaatgtatctttgtaatttgaaaatgggttaaagtttgctacttcttgattgggtgtgtttcatcagcatgcctccagtagtgcttagaaaatacacaaatgcgtgatgttcgtccactggtttcagttttcagttagagtactactgaaaactttggattagttcaggaaaacttaattcgccatcagttattttgtcagttgttgaagtttgtgtgtgatggtgttttgctcaacactgaaccccttattctgatgttgcgtatgacatatgataccaccatgacaccatcccacataaatgttttgtgctgagagagtcacatcagtgttgtatgccatctggtttgtccaatggtccactcgtttcttccttaggaattaggaaatggagccattctaattataaaacgtgattaattgcttggtgaattggtatcatgtctgacacatggtaggcattccacaaatacttaatgaaggcatgaatgcaagcaaacctatgaattacaattatgtgccaattggaaggaaatcaggaaaaataatagatcgtatatattgagcatttactttgcattcattttctctgttaacatcatccctaattatttgcaagatactaatatgactcattttatagataaaaactgggacagggaaattagtgaattttaccacagtcccttacctattagtgatagggtcaggatttgatcaaggtatttttgcctcaacaggctaagctcttttatatgtagtgggtccatttttaccatatttttttcaaaaaaaaaaaaacctgatcattttgtacaatatctgcgttaagctagtcatcattgagtaatttgccccaggactgcccttataccatcaggcatattttgaaatcccaaaatataccagaaagaataataaccaattaaatttatgtcacatgaaataaacatctttattctggcctcactgtgtatcaagtataacttctaacactgtaaacaattaaggttcacaaatagactattttatgttagcgaggaagataaggggtggagttacttctgaaactgactatactttttctagcagcagaggaaagaaaaagtcaatttggttaggtcaaaagcaaagcacgaaaaccgcaggtgacaatcacttaagcagagttaaatgtcactgagtcaaaatactttcatctcaaatgtaaaccctaatagttcttcccacaacaggcatgtcgagagaattgtaagaaagtacagatgtttttctatctgtagtctcccatgctgactgagtagcttccatttgttatgtcaagttagtgtctgttctcctgggtttagaagttacataccaaatatttgttctaaggatttaaatagtcaaggatgtatttttcaaataaaatatatttaacatatgtaaacttaggacaattgtgacggaagagacaattttgaaaatttcctgcatttggaaattgaaaatttaaagatagaacttttcctgttgattagggcacacggcagaaatttgatttttgaaaaacttttcaactgaaacacgtcttatttaaaactcctaaagtcacagttggttgcgaattttcatttaactgacttttccccaccagcttctgtgcatttgctctgaggcactctcaggatgtttggtattaacactgcagagcttccattctgatttaatttccaaaaactatcccagcgaagagggcttttatggaaggcaattcaatgaagcagggatacagtggcaagtggtaaactgagaattttgaaattatttattcgtaacttcctttcccattacagtcattctttcatgagaacatatctctgggatcatttatttaccattgtattattaaagtctaaaatatagcctggcacaaagtaactcaataaacgtttgtggagtatatttttctgtgtctcatattttcaatatagatttttttttaccccctccgagacggagtcttgctctgtttcccaggctggagtacagtggcgtgatctcggctcaccgtcatctctgcctcccgggttcaagcaattctcctgcctcagcctcccgagtaggtgggattacaggcatgcaccaccatacccggctgatttttgtatttttaatagagacggggtttcaccatcttggccaggctggtctctgaactcctgacctcaggtgatccgcccacctcagcctcccaaagtgctcggattacaggcatgagccaccatgcccagccatagtttttacaatcactatcattacttccagctaccattatttactggattggctgcatgataagttccatttgtattggtaggtttaggatttattgattaacagaacgctcaaatagttttcagtgtatcagtcttctaaaagcatctgattttccttttttccctgttatgctctaggcaagcattatgcattttgagccactgtttttttcttttttaattttttgtttgtttgttttttgagatggagtctcactctctcacccagggtggagtgcagtggcccgatctcagcttgctgcaacctcctcctccctggttcaagcgattctctaacctcagcctcccgaatagctgggatcacctgggattagaggcgtgtatcaccatgcccagctaatttttacattttttttttattattatactttaagttttagggtacatgtgcacaacgtgcaggtttgttacatatgtatacatgtgccatgttggtgtgctgcacccattaactcgtcatttcgcattaggtatatctcctaatgctatccctcccccctccccactccccccaccccacaacaggccccggtgtgtgatgttccccttcctgtgtccaagtgttctcttttttcagttcccacctctgagtgagaacatgcagtgtttggttttttgtccttgtgatagtttgctgagaatgatggtttccagcttcatccatgtccctacaaaggacatgaactcatccttttttatgactgcatagtattccatggtgcatatatgccacattttcttaatccagtctatcattgttggacatttgggttggttccaagtctttgctattgtgaatagtgctgcagtaaacatacgtgtgcatgtgtctttatagcagcatgatttatagtcctttgggtatatacccagtaatgggatggctggctcaaatggtatttctagttctagatccctgagacatttattcagccaaaaaacacatgaaaaaatgctcatcatcactggccatcagagaaatgcaaatcaaaaccacaatgagataccatctcacaccagttagaatggcgatcattaaaaagtcaggaaacaacaggtgccggagaggatgtggagaaatttttatatttttagttgagacggcttttcaccgtgttggccaggctggtgtcaaattcctaacctcaggcgatgcacctgcctcgtcctcccgaagtgctgggattacaggcatgagctaaagcgcccagcctgagccactgttttctacttgtaacaagatgatggtgatagttttctgctagttacaccataagcatgttgaaaagcgtaatggaaagtgcaaaagataaaattgttttgtgtttctcctggataaatataggccattactttttatcgttattaattttatgatgaaattcaatcatcttcatcaacgcaaattatttccattatgacattttaccgtcctttaatgagaagcattgttactaaatggtaaaagcaactgcttgtatcagtgaatgaagtgctaaaaatggattaattaaggagtacttaatttagctaaggcagaacatatcttgcagaatgttaaaaaatttaacatgggaggagttgtgcaaattttaattaaaatgttgtatatctattgtatatagtgacttgtaagtagagaatacatgtatgtacaatgcagtcagtgctgaatgccaaatacaaaatattaaaaataacaatatcatgctttaatgaattagtccattgccatgatatggtctacaacttagaaactccagcatttagatatcagatgatattataacataaatctcttcgtatgcaagcctcaaaaaataatccactttacttccagcactttgtccttttagaatatcacatcaatgaattaggttattgtttacaaccataggttttggttgtgccaacatataggcctttctgttttcatattttgagcattctggctatggctagtttatgaccagaagtgccttctttccagtttctctattccttttcttctcagtgaatttatttatttttgtttcctaatacaaaccctgtggggaggttgatgctcatcatggtttctaaatgacatcctctcacagtttttgttgtttaataaaactcttaaaagactgaccaactaaagctttgtgagtgcacatttatacctgctatctttgaaatcttgcttgttttcaattacacatgctatgcattataattctgtatttccattcctgcctgtcccttggcagaaacttggcctgaaatttagacagtagagcctcttctttagatttcccagcggtgtttgaaggttacacccagcgactggctaatcggacttccctgaggttgactgcccaagattagttttgttgaaggcactgctttcatcttacttactcacattgactttcttggggtgagggcatgttgaaagcaaactttgtgcgatacttggtcttcaaatacactgagatagtatctgagagaatgaggttaaggtaccatggcagtgtagtgcaatgactggtttctaatctgattttgactagcctttgaatttgccttcagaccgccatgaggttcaacttctttattcgaaaaatgatcaaatttcgctaaatgatttatttgttccatagtatcctcaaatatgaaacactcatcagaaacggtgttattgttcataaagtaaaatctctagcagtattgtgagttctcactattttcattctgagacggcttcaaagattggataagcaattattaaaatctggtgtccgtgagcattttatgtagtagagtcttggtgtaaaattacgttcatgtaattgttaagttcttactttggggattcagccactgctctcatttcataaaatcttaatgtcgtgtaataagaagtataaattacatcccatcattttcatactcctcaaatactttatagtactcattatcataccattgcctttagtcactgtcttacataattctcatcaatttctatgactttaactgtcctctgtattgagtttcttaacaaatacttaggtgatcacagagtgccaggaattggccttagtgcagtcatcataaatgaggattaccccgaagtccataacatttattttgatttcccataaaaagtaatgtttataattatggggtggctcatctgctatatactcataatctaacatagtctaagtatattctatagcacatgacaatcacttagcacatatggaataagtgataaatgctttttccttctaagtaaattcttctggcttcctgttaatagtatacaaatggtctcctacaactaggtttgtttttgtgttaatgatagaaacagcaaaaatatgacaaaaatgacaaaaaaatgcaacatagtaatggtattaaggttcaacaaactttacagttttactaaacattggatttgggcttcataacatcttaaataagagggaatgctcctggtcaaccacagtctctgaaaggagcgtattcttaggttttgcggggggagtcagaagtccagcaatctaagaacatttcagattgggaataggatgatgatagctttagaagcgtggtaactcaggtgagaccattgttaattagtttgagaattatcttcattgaagtgaatccactctggcaaagtttcagaagggagtgtttgctgctggttggctgggggaagcatgataagaatcatggaggaactaattgttaaatgaataaatagggtagattgaaacttttgttggtgtctacttgttaccatggctgcagaacaatcagtgtcctctttcgtcctcttcctcctttgttttattgtcagtttattaatctttatatcctaaggctgtagcacataactttgtatataggcatttccaaagactgtggagtaaatgatttgaaaattgaatgaagtcatttttgatccatcttagaatttttgtcattcattgacttgttttcatttcccccgtacacagttgtaccttagatcttgaacactttatatctggattatggtcctagcctcctatttctctcaagttttcctccagcaatccattctgtacttaaagaatttactttaataaaattttgatggtgtcaccctctcattgaaaagtatttactctctagtctattgaatgaaggccaggttttctagtttgctgttgatgatccctcagttttctatgtacaatctaccagtttcatcttagttttcactactctactctctctaagacacacaaagccactgttgccaagacatcgctaatgtgtccctacctctgcatgtttattctacatattcccactgccccgaatactcttccccattccctcatttccagctattgaaatcctatgcataattaattcagtttcctatttaaagagaattgccttatcctccaatattatatgattttaaaaatctgaacatgttaaacaactggttgtgccaattagaggaacacattttaaattctgttcagcaatgcaattactttgtacttctattatttactttcttattccaaattagaagcagaattcatgaattttctatctttcaaatttcctggataatccattaaaatactttgaatataatagatttcttgaaaatgtatgttgatgaaattcaaaatattttagaagacctaaattcctttcttcaaaaattacttatttctacctactggcagttttgaattccacataatctcagaagtgggatagtaatagtttggggcaaaatggcaatagtttggttaaataagtgcatatttattgtaatgactgatatttatgaacagctgcatttagtccacatgttttatgtaaatgaaatttattacaatgtttgaaattttttggggggcaataaaaataatgcttggccaatttttcaccattttttactttttataatggcatatatttgagaccaaacatacatgcatgtgtctatgtataacacagcagtgaataggcacaggctcaaccctttttgttttctcacatcatggttttatttaatatactaaaaatgaaagagctctaagttatgctaatcacaggtacagctgactagttactagtgagaaggaagaacattttctagaatttcaagatacggtgaagtatagtatctactatataagaaacaattggtcaaatattttgaaaaacaattatcaaatgaattggagatttctaggcttcagaattccaaagctaagtttgtaagattattaaggaaggcagtgttcatgcacaaaatattatttagttcttctttaaaaagtacttgcaaaaattactttgaccatctgttgattaataattaaagtgtaataagttgagccatatgtgttgtataactttgtacctttcagccttgtgcattgaaatgtctaatatcatttgaataaatgaataaaacaataaaacgggagatgatgtaacagtctgcttataagtaatgtttttggcccttattcaaaatgtagcagactagcagtttcagcatcacttgggagactattgcaaatgcagagctccaggctctaccccgatctattgaatcagattctgtagttttaaaagatccccaggtgattcatatgtacattaagaattgagaagcactgtattgttctacggatagaagtagaccaaggaacattaattttttcgtctcttgtaactctttttaaaaatactttaaaaatagctgttctgattaatcatggttctgatacttgcaaaagaattgatgaagtcacttgttcaacctgcttttgtgctaacggacttgagactttactcttggctttttcacttataatcagaacacctgatcagaatatacatactgaatacagatatcttaatagtagttaagctaagataaattgtatggcaaggaaaatacattgccacattaccttgacctcctgccaggatttatgtttatcttttatctttgatttttatattcattaatgattaaaaaactaaaattgcatacatttatcatgtacaacacgatgttttgaaatatgtatacgttctggaatggctacattgaactaattaatacatgttttacttcatatgcttagcatgtttcatggtgagtatacttaatatctactctcgcagcaatttttaggaatacaatacattgttataaactaggttgtacaatagatctcctgaacttatttttcctatctaactgaaattttgtgtcctttgaccaacatcttcccaacccctgccccacagcccctggtaaacaccattctactctctacttctatgaattcaactttttagattccatgtgttagtgagatcatgtggtacttatctttctgtgcctggcttatttcacttaatatcctccagatttacacatgctgtctcaatgacaaaatttccttctttttaaaggatgaaaaaggatgacaatgaaatgctagcatttcatagtcagaacttatgtgttaacatttctagtactaatgacatacttcacataaaggattactttacatcttggttcactggaatgagtgcagtaagtaaattttaatgccaagtagcaaatgaatcttttgaaggagctgccactttatatgtgttattacaaagtattattgactttaaatgctgcgtttcattcactttctggatgtggcaaaggatatgaagtcagatcaacttaatgtgcgggacttttacatttgtctctaatgtctgagaaggaaagtgatattctactttatcccatgcaccacaatgtaaacaaatatttttaacatacacggaatagtaaaaatcattatatggtatttttctgtttaatttatattgtggatacatgactcatttcagcagagacttatttagctctctgcatactttaatatcagcaacattcagttaaaaggtatcaggtttctttactgagaaccaaagcggtaaaccattttgtgtatttgtttaattaccagtgcaccatttgaattgacatgttaatataactttccattggagggaaaatgtaatcttttatttttgtttcttatctaatgaaagctactctgttagatgggctagtttggcaatttgacttaggaaaaagtaatatggaatgaagtttttatatgaacaaggaaaataaattaactttactgctcatctcattggtctgccaaattggaaagacattttaggcctcattctcatgttctaattagtctctggaggacattcatggacaattcactgttcattaatctatcgtcttcctttaactttgatttgttcattatccttttagagtctcaaatatagaaaccaaaaattgatgtgtagtgttaatgtgcttacagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacaggtaaagtgtgtaaaggacagctactattcaagatgttttctgttttatatgcatttttaggtattacgtgcacatatatatataacttatatgtatatacacgtgtatatatacaaagcctaatgtatgtatatgtacaaaaagagacagactaaaccttttcaattttgcttcattgactacaatattcatttcaaaacatattttaaaaatactattcatatgtaccatatcataggaatatagaacataatatattaaatttccattgtgtaacacacaatgaaatgaaaggcaaacttacgtacatattaaactctaaaatcttcatcaactagaacaaagagctagagaaagattaaaggcaaatacagtttttaatcattaaaaaatactttatgacaatatgatgtacaaagtcagattttgattattcaggataacaattttgaaaatagaaaagtgttttaaactatttcaaataaacaataaagaaaaacatgatgaaattcttcgttacataattgtatagaatttagtggggttcttccatgacattggcttgttctttctctcaacagtgggtggtttggatgttttcctatgctttctcaggcacaaacaacagtgaagaaacctttagcaacatttctgctgaatgtgtggagagctcttaggccaaactctctcactttgctgagctagctctgtattagcttatgaaatttttagtcctttccagggtatggacctgatgaattctgtttttatttactttggatttagagaaaattgcttatggatgcctgtttttgccggattgaagagtaccatcccatataaatgttggagttgtgttactttggaatcctcatggctaaatagcatgctcatatcttcccagatcatttactctccaacatgatattaagtgccttcattctgggagtataccaatttcgaatatcatttatatatgtttagtattaaacattgaatctcaccatttccatttaatgttctgttttctaccatgttggaaagtagtcctttcgggttacttatggtttttccccctcctctctatccactcccccaaacccttctctgcagatcacggtcagtctagcacagggatatgagagaacttcttcccctaagcctcgattcaagagctatgcctacacacaggctgcttatgtcaccacctctgaccctacacggagcccatttccttcacaggtctgtcaacatttactctctgttgtacaaaccagagaactgcttccaagataatctaacactgcttttacttgcttgaatttttcagtgccttttatctcctcgtgaagagctggtttgtttttccaagttttattgattccctcatgtgattctgctttgttattgagtcttctctaggtttactatacgttgattcttcataaatatgaattcccgtaatggtttctactttcattatgtaataacctctaaggttctctttgacaaaggctgctaatggttataaaaaacatgaggctcatgaaaagttttatatatgtaacttcgaaaagtgtaggtacatctgtgaaaattgctaattacactatttggggagatttttctggatctacgtaaaggaaatacatacattctaagtgaattattttatctattcattctaaaatatatattctatgtaagaaaaatataactgcaagcttcttcatatgctctcctttaattttgctaatttaaacttgtgtatagcaggctctgtagtatttataagaaaaagtcacactgaaaccaggtcatattctcggcaatgtttagtactttctatatgaggaagactcagtggagttttccaccctttcaatattgtatggaacccaatatacaagaaatagccttataaatgttacagcgtgggaatgaaatgtgctaggattgctagatttgcaagaattactttttaacaaaaatgatttattttgctcaatggagccaattcgaaacgtgctagaggatgtgatttttatcaaaactacactatgaatgggagtttaaaaatgatagacctgatcctatcggctaaaaaatgtgtacatttttggagactcaattttttgttaagatagtggtgtgcatttaattagtaatttatttggcagttaatcgatgcattagctgaaaattctaagctttgaaatagttatgacctccatccttggctagtttacttgcaaagctctcttctcactctctctcattctggacctcttgactctccatcgactctctagactcaatttatcaccattccctccgttgaaatcaccaagacttaaggaataagtgccacctcctaagattaaggagcatacaccaagcaaagatataggggtttttttccccctctcattatcactttattgagctgccttttctaggttttctccaatgcctattctggtagcacattttcacctcatcaccaccttcattaaggcatcgctcaggtatgactccttaatgaagtaattacaaatggacttacatcttgctaggctctgctcattctacctttgtgtaaatattaccaaatacataatatgtcataaatcacagataattcaacaaattcacttacttgttttatttaaaataagccattcaaataaatgtaatgtttatcatttaaaaaagacacagcacaaatcacaagagatgggggatggggaatgatatattctgtcactaaaggaagcatatcagaagatgatgttacatgtagttaggtttgataagtgtatgccttaattattcacactaagaacatttatttcaaaagtgtcaaaaggactgagctttcactgcccctacaggctgtacctgctctacttcaaaggaactcaagacaggctggatctgattccatcagaaagctttattaaagtgtttacttgctggtctacagagaaaaataacgttctctataagaggagagagccatgtgggtgactgtcccctatggaaaacacgtgcatgccctcactccccagacacatcactctgctttaacttcatttatttattcaacaaataagtattcttaatcacagagacaaatggcttttattcagctctcctaactttctaccactgatgaaacatttttctcagcctctacactcagcgggttcttcctctctgactattctgtgtctttcattacctggctctttctgttcttccaacttctttagcttatgaaactcatgggaaatatcttggcattcttatctctgtacttgttcttttatcaacataatttaataataatttaataacctggcttcaatctgtattcaatctgtatgcaaatgatcattgtatctctgtcttcaccacttccaatcttacttgagttatagccacatttccaattaattttcaactctttgtatgtatctataccttgatatccactaatatctcaaacctagtatgtctccaagtgaagtttattatgaagtttcttgtccattttttaatgttattcagagccctaataatacaatttttttcgcttaattttgtccatataacaaggctactctcctaaactgcctcgaaaagatttatgatatattaatattttatatttttatgctcattacacacgtatttcatgttccttcaaccaaattacatcactcgttctcccacacaggtgccccaaaattttccatattagcttttatgcttcccttagctcagagtgcttttgtctctgttttaaattggccaacttaatttgtatttctaggcctaattagtaagtggcagaacctgaattcaaatttgcatttattcaactccatgcccatgctcattatagtagggtgacgctgcactttctcgacggtgattcttatatattgcgttacgcacacatagagcagtattcatacatttgattatttagcgcttgtgtttgaatcacctattatgtgccaggtactgttattgaagcaagtgacacataaacatgcaaaacaatctgtgtctgaaagtattctaattttattatcctcctgctgtcttccctcatgccatacgtttttaactcatttaataaatggtaaggccgggcgtggtggctcatgcctgtactcccagtactttgggaggccaaggtgggtggatcacctgaggtcagagttcgagaccaaccgaaccaacatggtaaaaccccatctctactaaaaatacaaaattagctgggtgtggtggcgcacacctgtaatcccagctactcgggaggctgaggcaggagaatcacttgaacccgggaggtggaggttgcagtgagttgaaatcatgccattgcactacagcatgggcaacaagagtgaaactctgtctcaaaaatacataaataaaaaaaataaatggtatgatatgagccttttaattttatctgtgagcttttctgtttcatgatcctctagcatagcatatctggtagcagaattggaggccaatatttcatcaaagtcatttccctcctgatgcagtagatgtgacttatgaaataattagagaaatcaaggattaccgtgaggtttcttacttaagcaactggccaaatagagttgccacaaaccaagatgggtgagactgtagaaggaacaggtttgggagtgaacgttaggatttcagttttaaacatattaatcttgaggtgcctatgaggctatgaatgcatgtaaagaaggggttctaagatcagagttgaggataataatttagaagtcaacacatagatgttatttaaatccatcggccaggataagattgccaaggaaaaatgtgtagacagatgagatctctagatgtatatatgatgaggcatcagcaaaggggctgaaaaaggtggctagaaaggggagagaaaaaggagaagatagatgtggcattctggaatccagaagaaagtgttttcagagaaaggaagatacctaactacattaaatattgctgatgagttcaaataacatgatgattgaaaattattcagtgaatttaggaaaacagtagggtacgatgtctgggaaatcctaatatatagcagttactacagtggaattactaacactcctattcactcttaaaactttcccattttgaccgataaagttacatgctctctctagtttatatcccctttaataagaacaatttcagtggtgtgtgcatgtgtgtgtatttggaggtgttgctgattagagtaggttcaaacgacagtaaaagtgaaggctaccctcattgtaacacttaaaaaaacaaactacaccgcgagctgggtgtagtggctcatgcctgtaatcccgcctcttttggaggatgacgcggggagatcacttgaggctaggagtttgagaccagcctggccaacatggcaaaatgctgtttctactgaaaacacaaaaattaagcgagtgtggtggcacacacctgtaatcccagctacttgggaagctgaggcatgaggattgcttgaagccaggaggtggaggttgcagtgagctgagatcggccactgcactccagcctgggtgacagggcaagactcggtctcaaaacactaccctgaatagttgatggccacagggacaaaaacatacttcttttaaattaacccatcctgataactaatcatgtgtctatatgtattagttcgatttttgatgcaacaactacaaacctagtgcccctaatcaacacatattcattattttacagttctttagttcagatgtttaaaacaggtctcattcagctaacattaacatatcagcagggctgccttccttttggaggctgtagaggagaatccatttccatgccttttctagcttctagaggctgaccacattcactggctcattgccccctttcaacttcaaagctaacaagggcaaattgagtctttctcatatgacatcactcttacctatactcttctgcccccctacatctacttttaagagccttcattattacttacttgctatgtgaccttcagagaatttcttgaactctgggcctcagtttcctcatgtgtattattgaaactgtttctaactcatatagttattaggagtgttaaatgagattaattttataaagaacattgcatggtataagcacattgtaagttctcaaaacccggcaaccaatatgattactactttagatacatcaggggttagataagattttgtggtctgatctgagaaaatttttatgtttttattagcacttttatgagaagagatagcctggattctgatttataaacaaactcacaacctgtatagagttcggcaagttaatataccgagtaaaagattctaaggaaaaggatatccttttttgttctgaggttgctgaggaacaatcttggaaccatgcagagcagaacatagtaatgccttttataaagcagaaaaagcacttctgggtgattttacatccagcaatcctgtgttgggaggggatgaggcagaggagatttttcactctatctctgcctttgccccctcctggcacaacttgtccctcagactgtccacatattgtagaaagtaattggcaaacagaggatgggaagccagccagggagaccactccttagattaaaagtatcactaatttgcttcgaggaagcctttatacatcctgatgtgactgaacaaattacccagaaacagaattgttaggttttagctcaactctataaattggtacactgaagacttctgagtagaattttaaaactggaaggaaccttgaagtgaatatatgtgatgatgttattttcaacagttacactcttatcgtttaacttcttttgaaatttactttattgtgtgtaagaacacttaacatgggattcaccctcttaactgatttttaagtgtaaaatacagcattgttcagtataggtacaagttgtacaacagatcttgagaattttctcatctttcatagctgaaccttcgttaattagcagcttcccacttcctcctctccacagcctctagcaactactatttcactctctgatttgatcagcttgagtattttacatacctcttataagtagaatcatggagtgtttgtccttatgtgactgtcttatttcacttcccataatgtccttagggttcatccatgttgttaatgtggcaggatctctttctttttgaatattaatagtaatctcttgtatgtatataccacattttctttatcccctcatccatcagtggacactgaggatgtttccacatcttggctcttgtgaatggtgttgcaatgaacatggcattgcaggtatcccttcaagatcctgatttcaattcttttggataaatatccaaaagtgagattgctagatcaagtgggagttctgtttttaatttttgaggagcaactatattattttccataatagccatgccattttttacttcaccaacggtgtacaatagttccaattattccacatccttactaatccattttttaatagtaggcatccaacaggtataaatgtgatagctcattctgcttttcatttacatttccctgataattcataatgttgaacatattttcatacacctgttgaccatttgggtgtcgtctttggagaaatgtctgttcaagcctttagcccatttttaattgcgtttttagtttttttttttttgccaatgagttgtaggaattctttatatattttagaagataaccagttgttaatataatataaggtcttcaggtctgatcacaaaatcttacctaagccctgatgtatttaaaatagtaatcatgatattggttgctgtctttttgataacttagaatgtagctataccatgaagtattctttatataattcattttatttaaccctcctaatagctctgagttagaaataattctcataatatatatatatggtttgtattttcccattccatagattgccttttcacagtgttgatttgttcccttttctaaacagaagatttttagttttatgtagtcttaattctattttttttgcttttattgcttgtgcttttggaaataattgcgaggatgaatgtcacaagatttttccaatgttttcttctaggagttttatggattgaggttttacatttacatattttatccgtttggagttgatatttgcatatggcataagataagcaccaatttcattattttgcacgtggatatccagtttttccaacaccatttgttgaagagattatcctttcctccttgtgtatgcttggctctatcgtggaacatcagttaaccctatatgtgtagatttatatctgggctctattctgttctattggtctatatgtctgtcttcatgacaatacaatttatttttaattactgtagtttagtaatatattttgaaatcaggaagtgtgatacctccaattttgtacttctttctcaaggttgatttagccatttgggattctttgtggttccatatgaatttcagagtttttctctgtttctgtgaaaaatgccattggaattttgataaagattatattagttctgtagatttctttgaatgtaatgacaattttaagtccttcgatccatgaatgtaggatgtctttccatttgattttgtcatctttaatttctttcatcaatgttttatagttttcagtacatactctttgacctctttagtttattactgttttctttttggtgctcttgtgaatggaatttgtctcctagaaactcaactaatttttgtatgatgattttgtatcctacaactttactgatttttaaattggttctagtgtttttaatggattctagggttttctattcataagattatgtcatctgcaaataggaataacattcttcatttctgatttatatacctttacttttttttttttgcctaattattctagcaaggacttccagtattgccatcggtagaagtggcaagaatgggcatacttaccttgttcctcctgttcctgatttcatagaaaatcctttcagttcgcagttgttgtgatatgacctgcgatctttttatatatggcttttacattgaagcaatttccttctattcctagtttgttgagagtttaatggttttttttaaatagtgaaattgtgttgaattttgccaaacaagttttcagcatctaatgaaatgaacatgtgacttcttatttattctgttaacgtggtgtatcatactaattgattttcatgttgaaccatccttgtatcccaaggataaatctcacttggtcatggtatatgatccttttaatgtgttgttaaaatttgccagaattttgttgagaattttgcctctatatctgtcaaggatattgagttgcagttttcttgggatgtctttttctggctttggtaatgctgaccttataaagtgaatttggaagtgctccctccacttcagttttttcaaagagttcgtgaagcattggcattaattttctttaaaaaatgtttgatagaaatcacttatgaagtcacctcgtcttttgcttttctttgttgagagtttaaaaattacttactcaatcccttacttgtattgatctattcagacttttccatttttacacagttcagatttggtaggttttatgtttctaggaatttaaccatgtttttagattacagtttcttggtgtaaaattgttcatagtggtctctttatgaagattaaaggagcgttattgtgttatagtccaaaaacctagaggtttttaaaaaaatgatttagtgtaagtaacttaaaaacaaaaagttatttaaggtaaagccctcattaagtatgaaaattttataaggatagtataaccaaaatacatcatttattccactaggtgtgtctgcatttaggaaatatgttaaatgcctagcatgtaatttacatttattatttctgatcttcaaaaaaatcttacaaagatgtaactccacaaatggagttacctatcaaaataggttaggaaattgatgcttaaaaaaagctttgaatagtgtgggaatgttatttttcttcttgacatataagtgataattctaaataagaataggaaattttctgtcatccatgtcccaaatacatttcctgttttgtcctctgaattattctattcatgtttattttgatgtaaataagaattttaatggtgttaaacttttcgaagaacattaaggaatattccatagctaagatattaagatgaaaacaggagtataataggaatctagtctgtgggacctgcatatgctattttctctctattactcagttttctcatctctaaaataaagatactttcaactttccatggggtggctaaaataattaatgcatagtgtatgtgagaaaagcctccactatcacatagagtgttagaggggaaagactccattcaccttcttacacaacaggcattcaataagtagttaagggtaaagaaatatttacaacaacgtggatcaacactcttccattttgcattatatttataaatgataatgtaatcttaaaaatataagtcaaaaaatgtagaatgaaagtccatttttacatttggtaaagatatttggagtttctggaagagatgatatataattttaccaaccattctagaaaatgacttttttgtctcttgataccagagataggtccagaggtattgctgtggatgttacaaaaatagagtcaatttttgcgaaccaaggatatttgaatgctctcatttaagtcatgtttattacattttatgggatttgtcggttcctagaatttgaatgaattattggatggaatttagctaatctgtgttccggtgtttaagcaggtcagggcggcttatttgtaatcattaatagtttgtttggatctccacatgtaggctagatgcagtatgccttctttaggaagggcctcttaaggaatatctttttcaaacatttattttaatacttttttatttttatgttttattatttttcttttacaaatcaagtctttatggaagtaagaattcgtgttacaactgattgaccttagttgtgtgactcagttatctcttggcatacctgtgtaatgcttagctcacctgtgtaatacaggtgtgcttaccttgttcaccagtaactattgccatatagcaaatcaactcaaaacttgggagcttataaaaacaacattcgtttttcttattatctcttttgattctgggtctcagatgggttcagggcttctcatataggtgtaataaaatagtagatgaagctgaagtcattttgaaggcttcttcactaacatgcctggtggctactgctggaacttcagccagggcagttggctggaacatgtatatgtggccttatttaatctgcagtcactcactaaatgctggctggattccaagagtaagtgacccaaagagtaccaagcagaaactctattgccttttgtgacttagtcttggaagtcacatagtataacttcttccatagtcaggggtccatcctagtcaaggggcagaaacataaacccaactcttgatggagaagtatcagtgttacatccgaagaataacatgtaagatgaaacatattgtatccatcttaaaaaaatacaatctgtcagaacttacaagattcttctgaagaatccaggttagttgggaaatgtggctagcatggtgcctaacaggtgttcaataaagtgcactctacttactgatgactgtacttgttttaggtaagcttgtacagatcttcaaatatccaggctcctgattaagaagtttgagaatgtccttgcacataagtgtcacagagtaggagccgaaatggccacttaattgctttctagcacaaatgaaatttcaaatccatttggaaataatttgtatgtgtaatttaataccaagaatattaagtagacactgaaacctctacacctttcattttacaggtgaagacactcaagctgagatatgctaagtcatgtacctaagattacagagcagaaatatttggtctaggatcctgatatcctgaattttgttaaacatgatgtcttcttaaggattataattattttaagctaattcatcacactgtcacattttctgtagggcgatctctagtttctacattcattaagtaatttgattttcttttttgcattaattttattacaatctattttgttttcagaaaatattttaatatttttaatcttttctctttaaattattaaccttatattttaatgaaactatattcaaagtgttgtaacatcataattaagatacatgacaaccatgattgaaaatgaaaacttagatacatttctttcttttcttttcttttctttttttttttttttttttttttgagatggagtttttgctctgttgccccggctgaagtgcactggcacgatcttggctcaatgcaacctctgcctcctgggttcaagcaactctcctgcctcagcctcctgagtagctggtattacaggtgcctgccaccacacccagctaatttttgtatttttcagtagagacgaggtttccccattttggccaggctggtctcgaactcttgacctcaggtgatccagccgccttggccatccaaagttctgtgattacagatgtgagccattgtgcccggccatacagatatattccttaaaatgtataattagtggatacccatgcctaattttaatccctgctatagaattctggcagcacatatccttgcatattgtggtctttatctacaaataatatcagtgaaaaaatgtaataatgcttggttaatcaacataaacttgttaccaaacttgtagattaacacagagcctcctattatgtcatacatgtgttaaatccatgtgggtctcaaatctactagcaaacttttttgttttcactaagagtttacccccttaagcatgtcaatgtaaagaaaaatattaattcttttgaagagataccttatttagtaataattagagtgactttaaaatcaacacataattaacggtcacatattttgttcattataaagtttaatagaaatacagtcattttttaaattatgagaatgctatcaattaaatctttggggaaataaactatctttggaaggattaatgatgagttgatggtatcgttatgaaactcctcatttctagatcatctgcataccaattcagctacataaagtcatgttcctcttttatgtgtagcaaatccagattttcaagcttagcattttaaatacttacttctattaggtaacttatttaaagtgtaatgatgccaatgatgagaggtatgtataacaatgggattacttcacaataaaacttacttatagtgaatatttatgaaaatgtttattaggtgtctctgggaactctggtcaatttaaaatcttagtacattttatcttcattataacatgtcccaaggaaatttttggctgaaagattagcattataaaaatagaactttaattagaaatttctatattgtgtgtcagattgctaaatccagtggcaattatctgcttcctaagatatgtagtcctctttctgaaacattcaaatttactttataatacctgaaaaagtcatttcaagaagaaatttagatcattaatggaatgagaaataagattagcccgtggattcttctacttctactttataatttaaatttcaggtgagctaggtgattaaagtcattttaactatttggtacctcaaatagttcaggaacaagtatgccggaagcactgtagtattaccattaatttaataattgcttattggccacttgatcctagaagccaggaataaatgtgaaataaagtttttataagctcttaaaaatcttaacatttctattgcttcatagagcatgattatagttaattatttatggagtcaataaaggaatttagtatggcaattcttgcatcatgtattggttatgatgcttttaagaaagactctaaggaaagttagaagtcaaatataaagttgggaaaattattagtaacatttataacatacgaaggattgatagccctcatatataaataatgctgataaatcaataagtaaaactagaatgccccaataggaaaattcataaagaacatgagccagaaaatgacaaaagcgaaaaagcccatatatcattaagtatgtaaaaagacataccatctacttaataaaaaaatataatataaacaatcaaattatttttaactaccagataggcagattgaaacagtgataatactgataattttgcagaacataaagaaacaggaaacatcaaaagttgtaagagggcttatgacagaataaattgatgctgtccttctggtgcataattttttaatcacaaaatttaaatttaggagtaataatctggtaaatgaaatgatgtaagacatagttaaaacaggttttcaaagagggaaagtttaataaacacttgaatagtgatcaccataggattaataaaacttagggtaaatatttttaatgcaatatcatgaaatctttaaaattcatgctatagttatatacttaataccatgctgtaaagatagcactgatacatggttagattataagcaaagttttcaaatagagtatatatctgtgtgttacgtgtgcatatatatgtgtgtgtgtgggtatatacatacagcaatacacatatctaccaataatactaaacacttacatagggagtatgttctattcgaagttatacatatgggttgtctctaacagcactttatctctgtgcctatttccctagtctcatcctcataactagaactctaaatccattatgtatacacactgtgtgtgtgtgtgtgtgtgtgtgtgtgtgtgtgtgtatgtatgtgtgtgtgtgtgtgttttgtatgtgctataacatttcacttttgcttctatggtgcaatttttttcattggaaatttaacaacttactatttttaccgtcttaatttttaaacaaataagtcattattactcagtggcccttgaaatattgaggcaatatgtctcaaaaacttcttgttaggtgaatggttacattcactccttctttctttctttttttttttattatacttttagggtacatgtgcacaatgtgcaggttagttacatatgtatacatgtgccatgttggtgtgctgcacccattaactcatcatttaacattaggtatatctcctaatgctatcccttccccctccccccaccccactacgggacccagtgtgtgatgttccccttcctgtgtccatgtgttctcattgttcgattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtggcacattttcttaatccagtctatcattgttggacatttgggttgattccaagtctttgctattgtgagtagtgccacaataagcatacgtgtacatgtatctttatagcagcatgatttataatcctttgggtatatacccagtaatgtgatggctgggtcaagtggtatttctagttctagatccctgaggaatcgccactccttctttcaatagaaaattattgagtaattagtatgtcctagaaactaccataaagctctttaccatgataacccaattgtggtttggagatttactaatgtatcacaatatgcaggttaaagactgctgttagaatgtgttactagtcacttaatgtttattaagtgccatctaaaccagtcattctagatctggttattaaatttcactatgttataataactttttcattccaatgtgcactgtgaatcagcaagggaacgctattcattgtggtcatttggaaacccagcctgatgaaacagctactatctaggatactcccagtcactccgcaaagggaaagaaaattctgaaaggtcttgtgctggcaattaattgcttgaactggaagtgacatatctgcttcagttcacaactcacgagcacaactagttacatggtctcacccaacttagaactaagaaatatattcgtattacatgtctcaaaggtagaaagctggaaataaatatgaatggtgttaataactgctacactgctaaatttatgttgtcagaaacatctaaggacaaaatgaactatgaaataaaaacatggccatgctctcaaaatttgttttttttgatatgaactcttcaagcataaaaaattaaattccaaaattgaaatcataaactaagttaacttgctaaaattcatggggtcaaatatgtgatatttgaatactcgctaatagaaatgtctcaaaatgcaataaaaggctttgggggatagtgagccctctgtcagagtagtgtttaagtatagactacctaatgagactggttgtaaaaggcagtcggtcacgggacacatggcttattaatatgttcacttactatgtactggaaccatatagctgtctaagatgagctttcttctcctttgcaagccttaaatccataattctaatcgatgggtcttgtggaatagtggtaactattatggaatgagagacagtgaaccaagcatggggaacatatatggccatattattgcccttaaggaatttacaaactgagtaagtagagaagatgttgagagtagttctaaatcctgaaataatttcactttacactcggaagaaaatccaaaacaccatcgtgatttgttccctataggtatcctaccttctttcctacccttaaccccatttctcagctccagatacactggcctactagcttggcatcaaatacgccaagcatactttgagttcagtgactttacacatgtatctccctcttcctggaagggtttttcccccagttattcatatggcgcacttcctttaccttagactgcaaagagatcttttctgactaccctatttgatatgccactaccattgttctgtcttctttcaaagctttaatttttttcctcattgtagttatcactactgacattacgatatttgcaggtcgtttttccctaatgagtaaaaactccaagaggaaaaggactagaatatatactaggtacataaagcatattgatcaaatgaatgaaagcatcacgtttcttttatatgccccagtttgcgattgtattgtatattctaagagttgagtgaacagcaatacttaagggagcagctgcccgtgaatctaatatattgttcagggttttgaagcaggtcctgcaatataaaccctgctgcagcacagttttacgtcatcttccttctcttactatgaattattaatcccatcaacctcatcgtaatagaagagttacgtataaaagaatgagtaatacaaggtgggatatgctaccttgtatttcaaacacatgtttgatttttccaaactaatttcagtgattggagagatcgtacaaatatggatatataaggcttattactagcgtgatgaatgggatccaagaatcggcagtttatgcatcctacaatggtccatcgactcgtactcaggaagatttccatagagtaagttcatcttgaacagagctttttacgaggcttagataagaaaagaatgaaaatactttaggtgggacatgatttcaataaatggtattactaaagccatggaaataaccctatgcttaagagatggacgaaacagatattttggaatctttgctgctctaagattctttatcgcctaatagcaaaaagattagataaagaggaaaactatcacttactggtcaaaggtagaaaatgtatggagaagaaatcagtgaaaagtgatgtaaaatatgtaactaggaaataaataaggctagagaaggtaccagaagtagatgagcagctgtggactgttacccccactcccgtctcaaatataaggggcgtagcctgagggttttctgttcaaaacaactttgactgtgtgtgtgtgtgtatgtgtttctgtgtgtgtgtgctggggagaaaggttggggtgggtggaaggagagttgatggggggagagagacagcaaacaatgttgaggctcaaaatgaaatttctatttttaagtacattttgaaaatattggcttatataaagttttcactaatttttgaagtaatattaaatatatgagtcttttaacaaatattgggcattcataatttgagatgtaatacctaattttgaatgaaataattgtttttctcaataaattaaagcataagaattattggagatttttcaccattccatgagaggaaattttagtagtgtacaaaagtagattaagatttatagacagcctttggcttggagaaacttactctactcagtgcctgaggaccagttgtgaagacagtcttatttgtgttggacaaaaacgtcaggcctttgaaaaaaacaatattcaaagtcagtattttgattgtatttgaagttcttagtgatgtttctaaacgttacgttaaatattagaaaaatattttcatggtcatatgtgtcatggtcataatcaatatgatagcttagttttttaagagtacaaaaatttaggccaggcacggtggctcatgcctgtaatcccagcactctgggaggccgaagcaggcggatcatgagttcaggagttcgagaccagcctgaccaacatggtgaagccccgtctcaagtaaaaatacaaaaatcagccaggtgtggtggcacatgcctgtattcccagctactcagaggctgaggcaggagaatcgcttgaaccccagaggcggaggttgcagtgagccgagatcgcgccactgcactccagcctgggtgacagagtaagactccgtctcaaaaaaaaaaaaaaaaaaaaaaaaaaaaaagtacaaatattagagcgaaacgaacatcaacaatttagtgaacgtttcttgtgtcagtttcagtctcagtatactgtgaaaagggaatgaaaaaaacatgtttaaagtgagtaaaattgattgacgtggtctttttcagcatgttttaagtgtttttcgctttgccaattaaaacttctattttattatttacctaaatctaccccccagtaaacaaaatagtatttccattttcataaaaggcagttccttttctttttcatcacccccatctttagagatctttgactttctattttttctcactgcctgacattaagattccttctgttaaatgtttttgaattacatttagttcataagaaatgtttcccctagactttaagaactttcggacataaaatttttcgccaattttgttcattcacttaacaaggacaaaaaaccagaaagagttgggtgacaatttccattcagtaaatgttctttactaaatctgaattgcatattgtggaatcagtaaatgtcaagaacaagccagtctatcttttcacaaaaaaaaaaaccaaaacctcgttgttactattttctattgtttttctagtttctattttatttacttttgttctgatctttattctttccttctattaacttcccctgtggaataactccaattataccatatcatgaagcaaaacatataactgtagaaatacaaaaggctcaactataacactggactaagcattggctgatctcccctagcatacctagcaatattaatcactcagataattaggcactgtcctatatttttgtaagatttataactttaaatttttcattacatatttttttccagtgactttgagacttatcttactttttagtgtgttaggtttatcagtggtgattttattgttatacatgacctcataatagttgttttttctttcagtacatttgttttatgtttaaatttttatatttacatgattaacttatgcaaattatatgtttaaaaatctgttttattgccaaagttgtaaggagggagtcaaagttcctagtcatttatttattagaattattcacaggagtgacaacgtgcgtaagtttatgttgaccagtcaaattttctcttcacaaaggacagaatgtgaaaagcacagattcttttttggtcatggggcagggaaagataatataactctgactgtgagagaatgagggaggagtagagaagggatcacatgttagtgtttattcttgtttcgtagaatgtactcatattggcctggacagttgccctttgattttaggagattaaaatatactaagcatgtaggcacccacccatacacacatacacaacacaacacacacacacacacacacacggacacgcaaacacagttgctaatcagtctgacttttatctgtaattctggttctgctacttactaaatgtgtgacttaaggtatattactgcacattgtgctcacttttgtctatttggatattttagttgacatttcaccttacataaaaaatgtgttgaaaattgttagcaagaaacaccatagggcatcatcatctgctttgtgatacataaaacatttgttaaaactgttcttttcttctgtaaggacactcaacagatttatcaaataaccattttaagtgtacaatacagtattattagagacaacgttgtgtagcagatctttagaatttattcatcttgcatgatgaaaattttatgcccattaattagcatttccccattttctcctcctttcagcctctaaaagccaccactctaatctctgattctctgagtttggcaattttagatacctggtgtgagtagaatcatgaagtatttgtatttctgtgtctagcttttttcatttacaatataccttcaaggttcatccaacttgtcacatattgcaagttttccttctttttaaagactgaataaaattccattgtatgtatttaccacatcttctttatccattcagctatcgggcatttacgttgttcccacatcgtgactatttttaatcgtgctataatgagcactggagtgctaatagctctttgagatcctgatattttgctctttttttgataaaatggcttcataatagttatttcctcatatcattattctaaaaattgagctgctaagtataaatctgatcacaaagtaaacatgtaaatattattttttaatcacacatgaaggatttttatagtaactttgtgtaaaggtgggtattttcttgtaagttattggaatctattaattttaagggagcattccaaattttaagaggtagaaagaaacaaaattccagtgcctatgtagtttatttcattttaatttaaattatgagatgattgaatagtgttcacattagaagtataggaagatagtttagaggtcaacttctttggtcttgtatttctttttgttaatgaaattaatgtgtgttcagtggaaatatgcacatgtgaatatactgttagtttctttaaataaattatatctccaaatgatataataccatgaagccactacaaagttaagatataaaagagtttaattgcatggcatatttttacaatacattaaataactgaaaatgtagctaagacaacattgtgactggttttgaaaaaataaattatttgtgtggttatacatctatatatgtacttagaacaaaggttatattcagaatattttacactagactcttttcaattaattttataggagtttcatttctctgaattttcatttgtcagtgaaattacatattttaaaacatgcaaaaataaataaaacatgtaatttaaaaatgtaaaactcttttacatatatttttaaatgtcaataaatgaaaaactcttacatatatttttcaatttcaataaatgaaaatcaggaaaatagtgacatggtcttcaaaaatcacaatttaatagagaaaactgaagataggaaataatattctaattacggacaatgattaacactggcagaactggtaaatagtacactataaaataaaatactacattaagatatataatcagaggacatcatacctcaatacatatgtgtttgttttgttttttaaagacacgggctaacattactaattactgaaggatggagaatgttaactgagcttgtaatgataagccggtgcagataaataaaatggtataacaatcatcacagtttataaaaccctaagagtttgttaaatgtgcataatagcgtccacaatcccgctaacacaatctccaaacatttttgtgtacacatagtgtaaaggatccagaatttcaatcatattctcaaaagaattcattgccccaaaatggcaatgaaattctgagaaaaatagggtatggtgagactctgaggacttggaaagccaggcaaaatactacttatttctatggtacagacagataagtcctttatgttatattatccatgttgaaaatctggtagattgggaagcaggaaagaggtttcatgtttcagctgcaaactttgtgttcgtggaaagacaagagcaagtgctacataagttgagccattcccagaacaggtagtgaaagggctctattgcttcaactgaagaatgtgttatgctcttatgtataagagggattcttcacaccttataaaatgttcatatcccttttacgtgctttgtattatttatgccccagtgagcttacttgtgagataaaagatgaaatttttaactctgtcaactaaaaacaaccttatatatcttgaatgagttgaccaaagtagtatggttagaaactgataggtatgtcactcaacccaagttttccaatttctgggctctgaatcattttattagcctaagctccttcctgagtgttgatcttagataatgaaccagttactcttagataatgtctgtgatgatgaataatgtcacaaaaattactaactgatattggacaatcattatataacaaacattgctgtaaacacttttcatacattaattcaatgtttataacaaccctattgagaagattctgttaatatatccattttacacttgagaaaattgataagctggttaagaaatctgtgcacagttatgcacatgaaaagcagctgtgccaggatttgaacacacacacaatctcattccagaattgattctattaacctgtatgctaaaatgacacaacatagagctttatgaagctatcattagaggaaaggttgggttttcataaacacacttatgcacacacttcatgatttactaaaagtggatgaatatataagcaatataatgacaaattataaatcaggcaaccagaaaataagaaggtaaaatacaggcaggtttaaaataaaggttactttataaaatgaaaggtgaagtttgggaactggtaatgaggaagaataattgctgtgaaatctatcaacagatgacttcattaatcttttttccttgaaagagattcagatgatattaccatctctttcaggagtggaagagagagaattggagagaaatgttttaaagattctgatttatagcaagcctgtgaaaaaatggtgcattaaattcccatttggcatcctagttgtagtaagataatacatcctttctaaaaattccatttgatgaataagcaaaccaattcaaaatgactccattttattgataatagcatcagtgtcattaatgagaatgctttttgactaacagcaattaactagatttggtgaactgagcaattgaacattgaatttgaaatcagaacattcggcactgaagatgatataagtacatattagaatgattgttgattatttaaggatttattaagttgatgaagaacattaaagtctattatatcctgtattatttaggatgcttggtttcaaatgtactcaagatacaaagagaatttgttggctaagtaaagagttcaaggtttgctcaagggtttaatacagagttttattatggatttaaggagaagtctttgcttctctgttaatctaagcctaccctccataacttttcgaactcatacagaccggcttccctcagcagatcttggaaactcttttcccttgtttacagctaaatgtaaagaatatatctttacccaaataggaaacaaaaggtctgagtttctctctgcttggaaactcttagatcatatgcctggcctgaacacctccctgaagcaaagtacatagcagtatcccacttggcttgcacaaaaaccgagcgcatatctagaactgagagtaataacaatgctttccaaatcaccaggctactgtgccatcagagagtagaagaaaggatattgactgtataattgcagtgcttactacagtcctcctctttgaatatccaacattgctatacacccttcatagcatatattcactttcaaagatgctcagactcctcaaaaagagcaagtataaaacattatccagtgattgcattcagctccaaggttgggatatctgggtgattagcagtccctttcaattagtctttatgatccatccagtggactatgactaagtgaaaaaatttgatgtccagtactgctaagtaaaaagttagaagggcacatcctgattaaaactaaactaaatttataaaagaaaccaaattgaaacagatattatatcctgcactttcagagccttcctggtgatttttccttctgttcattataaattttgctaaatacttgtcttcatcatgatatctgaagttgacatattttggggttttgtgttactttattattctacttattgtgttgtttaaaagtcctggtgcttgccctaggtttgagtgataacaaggtgtttttagttagacctggggtttctttggcaatcagatttgtttactatttataggctttcagtatttgttcttatcaattccatgacccagtaacccaaattctatgatttggttttaggcttcaaatgttaacctcttttgacatctttaagaggcctctgtgctttgcacaatcccctgactgagaaaatttgcagcacagggttggggtagagggcatagccaatctttgagtatatctttgaagtatagattacatagaagctgcttcttcatgataggagggatcgtctactttgtcacaaaagtgctttagggaagcactatagttgattttttttagtacttaagtcttacattctgcctctcctgtctctgttcatacaaacattcgatttggagtaaaaatacaaattggcttttccactcatatcaggctccaaattatcagcctctcaaggcgttcacgttataagccacaggcagagagggcttcttcagacaaagctatattttcttttttttctgtacttcaaaaacaagtaaccattagcatgaggttttttctttcttggtttaaagaggccagtaggtggcaacatttttgtttctatcaaatctcctaatagtgttggtactcgtaaggcacatgacttaggataaaatagaccattgtttaatcaactgttttttaatcatgtaccaagtatcattttgagttggggtgggggaggtttatcatccttgtcttctcataattcagcctgttccacattataggatctattaactttcaacaacccacttcctgataccaaagtccatataaactagaatgatgtttggtacaataatggaaaactcttctcaagaaaacttgaaatatgcagacacacacacgcacatgcacacacatacacatacacacacatacagaaaacatccacattggagcagtaacatgtgacatcttttcttccattaaagatttcttgtaattaaaccttgggaattattggcttatgtaacagaaaattccaaaggaatggcaggattctggtaagcctttaatccaaatattcacattgtcatcacactgcagctccgtatctcagtggctcttttggctcttcactcttccgttatctatgccaggtagttatttctttccctatacagttttgttatgatagatggctgccagaactgtaacatttttttctttgcttatgtcaaaggaaaaataagtactttttttctcagtcaagcagaactctggacaccttctggttggaacatgttaagtcatgtttccacagttaatatactgtgttaaagcataaaatgttgtagttggatttttgttctatgtccctggcaaaaaggatttatttaaagcaatcaggacttatgcatgggattggggaggtgattaattgctcccaagccacaagattccttcataaggatggaatatagtttggaaattattttatggtagtatttgaaagagttcagtgttttcccatgatttaataatataaatccttaatagaataaaatatatcatgaattgcaagtgtatttgaaagtgtgtgtgtgtctaattttattggatccagaaaatatgctctattttttcttggaaaatgctgtgttttatatccactgcattttttttatgttctgtacatttcagttggatttctttcaaagggactgccctctatcaatcaaagtcatctttagcataggttaggctattactgatgaatcaaatatttctagagcaatactttaggacctgtcccacaactaatatattcaaaatttagcaaaagtttattgagtacctgttagaagcaaaggactatgctaggtgttctcatatacatgaagataaatatatgtcataaaacaatgacaaattggctttcagaatgtgcttatttccaatatcatcatatttttcttttctgtcatttttcattttatcatataaagaccttgaggggtgttttttcagagaaacaataaaccaatgatggatgagcccacttgagttagttacatactatacagcttatataaagcataagcatataaaaagtatatgcatctactttcatagtttggattgttatttaaatttggtggtattacattttcttctcacagatgactggtcttaaatgtgtactatagaatttacagaaacaaaccatagggtttaataagctgaataaaatgaagctctttatctggttagattactttgtaaaggacaagaataggggagcctcccaggtcaacctgatgtatgattttccatttttctaaataagttttattgacttttacattttaatggaaaatgagtaattagcagaggtgcagattatatttggcagaaaatgattataatatttttatcagagagtaaaatatatgcagaaatagccaagtaatctgatttgttaataataatagtatcctgattatggttttatcttttgttttaaaataacatttatatagggtcaattttgaagataaatgggaacctggtgaactctgtctctttttctcagagtgtgtgtgtgtatgtacataaatttaaaaatcgaagttatagttaattggaataagaagtttgttgaaaacagtttgatgtctggtaattgagaaatgtttatgaatctgacataatttactaaataatggagagagatacattattcagaacattatataagtacctaggccaaatttctgaaagatccaaggtgagagatatatgtataattatcttggtggtaatttactcatgagtagtattgacattgagatattaacaatttgtaccgacccacttgtagctgagtatatattcttaaattgtgttccaacataaactgtcatctatattggtggatctttgcgatgctttgggttaggtcatcaaaacctaagcaaaccctggggaatgtactttatatgtatattattctcccactcacacacacacacacatcctcactgtttagaagtacacatttgtcaacattacaatgcttttggcattcacagaatctgttcaaattagtacagtgttcactactgccatagcaggaaaaaaactgtacttttgaatcatttatttttaaatcatttgaagtagaaaattctgacaggttgcactgatgaatctttactaaaaataaaggtctttgtttacaaataattacatcttctcaaccagtggtttcatgttgcttactttcttaaaattccaaatagaacaaggtttgcaaaaatcgtcacatatacatgttatcactgttgactgttttatgataatttaggtagcattcattgtacacttacaatatggcaggagcatgtggcagttacttgaatggcaatatttatgaggtttaccaccaatcaagcttcccactatacagattaagattaagacttactgaagggtccttgtgctagtaagaggcagagtaaaatagacctaggcatcttgaattcctaaacctatgatttctaagttatgtcttctggcctttgtgttaaaatttatttctaatcaacagtgatacttttaaaatatacataatagtgtcatatgtgaaggtcaaacactagtaatttaatctgtcaagtacttactgatcatctaatttgtgttaattactgggtgttacttgacttgtcctcaggttctttatgcactagagaggagacagacactcttacagctgctttaagacacagtagagataggaagtataataacttttcatataaatcctctgggaccataaattatagcttcataaatcttggcttagcaggtagcagaaggtataactgaatgatgagccttgatagtcaagtatgatttttataaggagatcatcccatagaaatattacttcactttgtggagctaaatgagaaagaagcacgaatcgtcagttcattttgtgactgttcgtttcgtgtgtagggcatatggttaggggaggaggagtaggagaggcggctggaaaatgaggttgaaggacacattgtggaggattttgcatatcatgctcaaggagatacattttattcagtaggcaagagaagggcattggcaggttttgaataacaagtcatgtgtttcaaccctgggacttatgaagctgaatggagaggcactttgcctttaggaaggattgccaaaaaaaaccaaaaagggccatgctgagttgaaagtgtcaaggttgcctccagaataagctaactgtatttggaaatcagggtttattatcaacagatcagttaagaccagtgatagaatcgcattgcaggggctagggtggagagagataacagagtaatcccaaaaagtacatgaaatttcacagagaaaaaaagtacaatcaaatttgaagaggttcaaggacagaatatttgattgattgttttgttgatcgatctatctatctgtagggaactagaggtgggagacatagttaggtacgatttaagagtttccttaggaaagtaccatcacataacagatatttaaaaagactttaaagaaggtagttatgttaaacagtgctgcaaatgaattgaggaggatgcaggtaggggaagggcaactggatctactgttttagaagtatacttgtgtgctgtgagagggatttttaagtataagtgtggaaaacaagaaataatacatagaattacggctgattatgggaaactggaaggaggaaagtttaatcaattctgaggttcagtgatgaaagtaaggaggagatgggatagttcatagaagaatgatgttaatatttcagattgggagagaattaagagttctgataaactcctaattttgatgatacactctgtggtaggaatctacagtacaccgtaaattcctgtgtataacatacaatgtgctatataaaatatgtggtatcaacctataaatgttgatttttcaggacaaaaatgtccagaaaaatgtaatgaacattcagcatacagcttcgataagaagttttaatcccattagtatttaactaacatactcccatttttagtaagtgattattattagtattgattcctacttaattctcttcaatgccgtagtctctgtattttcctcccttcattaaaaaaaaaaaatctttcaagttcaagttttatcagagagcaagatggcatagggaagagagcagagaccatgacatcactggaacagtttaacatgatttgattttataaaacatgataaaataagtatcaggcggcattttgttttaaaacacttgctgctggaattccactattcatatgataacctgctgatcagtaggactctgtctcctgatgccaagtttttagcaccttctacagcaatgtgtgaataatgcagagatgcgaaggaaccttttaagccaacttgagaaacaagccctgtcaaaaacatgatttctcatgactgaataatgcaacagactattccatttagaaaaacatcagtaaatagtctgagttttgatagtgattacattcttacacttgaggtaaaaaaaatattcttgtctcagtccacaaagttgataggcatagggacatatgagtgtatacactgagggtgtttaacaatgaaatgtgattcaaaaatataacaagatttgataagcaaatgggccagcaatttgaaatgcttcaaattatacttaggctctgagatgaaatgtatgtcatttaagtgtacttttttttttttcccgagatggagtctccctctgtcgccaggctggcatgcagtggcacaatctcggctcactgcaacctccgcctcctgggctcaagcgattcttctgccttagcctcactagtagctgggattacaggcacctgccaccatgcccgactaatttttgtatttttttttttttaaatagtgacaaggttttgctatgttggccaggctggtcttgaactcctgaccttaggtgatccgcccgcctcggcctcccaaagtgctgggattacaggcatgagccacagtgcccagccttaagggtatttttaagtagctcatcaagatgcaattagatttaccattatctgacttgagtagaaaactggaaaaaaaaaaaaaaaaaacacaaaagcagagaatggtgagaacttttaagcgaaggtgtagccgacccagtgtcaaatagacaaaatgtagaaaagacaaatattatacatgtgatcttttctgtcacataatgttgacccctaggatttccatcttatgctttcagtaacagtaaactacaatatttagtgcagtattagatgattatcatgtcctaatacatttcctccataaaactagaagaatggcacttaaggtccaatgaaatatgatggttaaatataatatttgtactcccttgttggtgttgcttaatgcatttcttaatcctccaatttatcgtgtcacacagcactaagctcaacaatttattcataaagtggctgcaaatataatttggaacaaacttttttttgttcaatataatttatttatttattgcttgtataatcacacaaaagtgtgagttccatgaggacagagacagttgtctcttctgtttactacaaacgtcttccgggccagtaataaccagaagttgttacctgttaaataaactgaaagtcaaatgtagggtgatttctacgcatgaggagttctagagctcattgatgtcatccaaggtttaaattcttagtgtaatgtattctaggctcatccatgttgtagcaaatggcaagatttcattctttttttaaggactgaataatattcaattgcatatatgccataatgtctttaatcatttatccatggatacttaaacgttgtttccatatcttggctactgtgaacaatgcttcaatgagcatagaagcccggatatctttacaaggttgtgttattttttcctttgtgtatatgcccagaaggagggattcttgggtcatatggtggttttgaattccttgcctcacaaaaccttgctttgtctttgcttgctgtttttttttttttggagacagattattgctctgttgcccaggttagagttcattgacccaatttcagctcactgcacccctgcctcccaggttcaacgattctacttcctcagcctcccaagtagatgggactacaggcacccaccaccacgcctggctaatttttgttattttagtagagacagggtttcaccatgttggccatgctggtctcgaactcctgaccattcccatcaatgatagactggataaagaaaatgtggcacatatacatggaatactatgcgaccataaaatagaatgagttcttgtcctttgcagggacatggatggagctggaaaccatcattctaagcaaactaacccaggaacagaaaaccaaataccgcatgttctcactcataagtgggagttgaacaatgagaacacatggacacagggaggggaacatcacacaccatcgcctgtctgggagtggagggcaagggtagggagagcattaggataaatacctaatgcatgcagggcttaaaacctggatgacgggttgatgggtgcagcaaaccactatagcacatgtatatttatgtaacaaacctgcacgttctgcacatgtatcccagaacttgaagtataataataaaaaaagacacctaggaatcattctcaacaactgtactgtccttgtcatatttatagtgcccacgtccaatacactctaagatcatatatgtcagaagtctgtcatctccccctctttccctacttctgttttgttgaagtcctcagtatatatctcatcaattcattttttcaacagttcttgagttcttatggcagcagtcaggttctgactattacatactgtcattcactggatatctaactggtcttgctgccctcatcttccatagatcattctccacactgcatccagaatgatctttcataaatataaatgtagtaccaatgttcatggtttgactgtcaattcccccaaaagattaccgggaaaacacgttgatgaaacaacgctgagtgtattagacatggcgccataagggaagacactaacttgacaaggtcttagtagtgtgtaaaaattcctacttctcagttcatatttcgcttcccttttcaatgcttccatttcttcttggacgtgttcttatgagagcacatatattttttgcttacttgtaggtttcctccactggactatgatttccttgagggcagctcttttattctttatatccattgtgatctaagtgagtgattaatacatagttgatacatgaatccacaatatgtgctcattttagtattaattgaatacataagacattgcttcttaagtgtgccttaattggcacaataacaaaatttgttgaggatttactgaagaccaggttcttccatgctgtatgtatattattaacatgtttaacttagcttaccaacattaggagtttatattcttgttattcccattttcagacgagaacactaaggttcagtggtacagaaaagaatttgagtctagatattttgattccacagcccatattcttaattctcggtacactacacttctctagcatgtttgataatatattggtaacactcaattgccaaatgtattctgcatatatcacaaccagtatcctgatatatgttggttgggttatgaaatgacacataatttgttcaacaaacatttattaagtttttacagtatgctagccacaatgtgagattccttatatgtactacctaaattaagtaacttaagtaaatgtaggaggatttgagacatgcatttactttcccctctttgatttctaaggcaccacacattccaggttttcttcctgtttttctagcatctgctttgattttaatttgctggttcttccccatcaacacaaattcctgatatgacagtaaccaggggttggttcttagaccacattcattttctcgatgatcttatctagcctcctggcatcaaatactgtctgtaagttgatgcctcccaatgtttacccccagctcagagctttctgccaaactccaaacttagatacacaactttttatacattcctagtcaattcaaatttaccctatgtaaaactaaatttactaacacccacatctgcttcgtcaatagtttttcctgtgtcagtaaggtttcactatagccttccagttgccccaaatgaacatctttgagtcaaacttagtcttgttctttctcacacctgatgttgttgattagaaaactatgccaggtttggccggatgcggtggctcacgcctgtaatcccagcactttgagaggccgaggcgggcggatcacgaggtcaggagatcgagaccatcctggctaacacggtgaaaccccgtctctactaaaaatacaaaaaatttgccggccgtggtggcaggtgcctgtagtcccagctactcgggaggctgaggcaggagaatggcgtgaacccgggaggcggagcttgtagtgagcggatatcgcgctactgcactccagcctgggtgacagagcgagactccatctcaaaaaaaaaaaaaaaaaaaaacctatgccaggtccaccttaaccaggtatatatccagaatctgatcacttctgactacttacatggccaccaccatcacctctggtctaaattagtgaaatagccttttaaacaagcctgcctgctttggccttgccttacctgtaatccattttgtctgccagatggtcttgttaaaacgtaaggcaaatcacatcactcttctgctgaaaaccttcccatgccttgccagacattcagtaaaatgcagtcctgctgttttataagcccatgcacaatcacctcctcctttctctatgtttcttctctggcttccttttccaccgttgttaccgtctctcattccaccgcagtcatagatgcctctacctggaacacatttcctccacatactcacatgacttactctctcatatctttaaatctttttctcaatgatattttccctagtactttcaattccccttccttgcttccttttctccataacacttacatccttctattttacttatttctcttgattagcatgccttcagtgacatgattcactgaatgagaacttagatttctgtctgttttgtatatggctatatcatcattgcctaaaatagtgcctggtcctttgtagttgcttaataaatatttgttaaagcaacactatttgtactaagtgacagagccagaattccatatgattttcaagctcttctctataaaataaatgaagttatgatgtattgaatgtataaaggctcttttgttagttgctcttctacctggcaagtctgtaattaaaataattttgtaaaaaattatctatttgaagtttttttattatttgttcaattgccagtagataggctagacaaagataagtttaccaattgattatggatatcttacattcttattaaaaagcaaaataataatggatataacacattattattttcatgattaaggatatatcacctctaatgagtagatactaaaagagccttaattttctgattcccttatttctcctcaaggcaaggatagatatccctgtgctgatggcatcgaatgcattggcaagcctaaaatcaaacaagctttctagtagactccactcaagattatcatcaatcttcctttgcaaatttggttttcagtttttgtcttcacattgaaaaatagtcaatatattggcaacaaatgtaatgcattactcaatggcaggtgatatcgctaaagatggtcaattacatgctaaaaacaaaggactttgaggtctgttggatgccaaaacctacagtcaattcagtcaatatttttgacagtacagagggaaaaatcactcaaggaaaattgccacagtatacattaaatatctttgtttatcccattttagttattttgtgtgatatctctaaatgctgttctgtatatgctgctgacaaggagcaaatttatttgtttagaaattctgcagcctttccatcctttgccttaactttcttgttgaggtactaatgagctgtgaaaggccaaatgaaagagaaataacacctccagataatctgtactctgataaactactcccagaataattgggagtttatggttgttgtagggcagtggaagaaataagcaatgttggccaactatacggaacaacccgtgttaataaatttgtaaaagaagtttacaaggcaatcacaatcctttcaaacaaatgtcatgcatgtactttcaggcctaggcacaatgttattatctgaaaagcttgataggtaggattgtattttgtcccactatttctaaatcaggaaattctaagcatacttgtgacgatttctcttttaccttaaatggcttccctattccagatttacagtttctgcatgagttttctactcaatttgcataattttaatttacctttatgttaaggtttttgaagagctgccgtactttcatatttggagtttaacatattttaatttatggacgtggcaataatttgatgacctttttagtgtaatataaagcctatatataaaaacttccaaatagaatatgtactgagtttgtaggaaatttataagtattatgcaaatcaagaatatggtagctgattccactagaggctattttgaaaatataaagaaactttgtttttaaacatagtattgattatctcactatgtgacaaaaaggtatttctgtttattctgtttctttccatttctgctttccaaagtagaacaaataagttgaaatgtaccaatgggtgtgttttaagttttgacaggtttcgggtatgattatataccaacaaaatcccagtaatatttgctgcatatttcattgtatctatattttatgtactgatttaaaatttaaaatgtgagtaaattttaaggcattgtgctaatgaaacttatggtagttcattttttatttttatatagacaagctatctgtttagaatgcaaaaattatatgccatatacaatcatattataaacatataaaattggtcacagaaatttctaagggtgaaaaagactggatgaatcaaagaaatctatccacaattctgtgagtgtatgagagacttagaatgatcacattcacataaaatataacacattattatattttgatttttaaattaaattttataaatctagctatctctgggaaatgtttcttccccttgagttattacaaaaaagtctggcaacaagttaatattcaggatttcgtgagacagatactgaattcagttcccatctctgctttttattagctcttcgaccttgggcaagtttctaacctttatgaatcaggtctcctcatagtaaaatgtagacaataatcatcccttatgttgtgaggttaaattagatgatttagtggagtgcttacaccatccctcacaaatggtaaacacttaattcactatacttcagttctggtggtaaattctaaaagaatttagatgatgaagacagcattataatttaaagcacagtctacacagtggatagcacccacttaggagatacacacgatgaactggggttctagaaggacatattataatgtctcttcacaggcttatttaagaattaagaaagaaataaactttaccaatttttaatatacaggttttcagataatttgatgtaatatatggtacttgatatcttctgtggaaaatcagagatccttaataggatgcataatgtcaggcctctctcttatttattagcgtttttggtgctcttgatgtgctgctatgtctatgaacactaaagtgtgtttatagattatgttatcttaagtagtagaatacttaaaatctttgtcagcaaaatcagagtaacctaggaaatctattttactacacagaaatgttctggacatctcatggcaaagtagttgaaaagattgagttatgtactttatttttgaaaaggtcaagtgttacataaatgctgaacattttcaggttggcaagtggctgtgagtactatgttatttctcaaattatttccaaaagcagaaaaaaaccttcaatctttgaaggagaagcttctgtattaacaatattaagaaagagactagattttataagacattcatgctatggagagagcattttaaaaatggatatttggtggtagtcccattataaataggtcagttataaaatattctatacctacagaaaataaatggaaagaaatgtcaaatctgtttaaaaatattataagtgaaaactttcagtgaggttttgtctctgtttatgactttaggacgtttactttctatgttcacctcacttagggttctgtttcgcttttctgctcatgcttccatttcctcagttggtaatatacacatatctgtacatatcctttaatcctcttctagtatcttcaccaaatcagaagtgattgctcttatcacttagcccaccctgattttgagttttttttttacttgaaaatatgagaagtaatgttagtataacaagagatggaaacttatcaaaaggtttcatacttttatttttctgaaatgcaaaagacttactgcgttcttctcagttctatgaaccctaagatcaaaagctttagttgtctatgggacacagagatacagaccctgaagcatgattactcctattaggagccaatgataaaattgaagaactttccactgctttcagccaacaggatagaggacttttattactttccttgaggcagagggtggaatttgcaggtgttaatgaaatctaccagagtcttcccaagaattaataccattctttgaaatggcaggctctgaagacctttccttgaataggaaaggaataggaagagattccaagaatctctttccttgaatagggaagccaacactgcattgaagaaggcagtaagtgaaataaacaagtggagtttgtgtcatttcttgtccctgctctgtcatggaaagatgccttggtctaattctcttaggaaaaaaaatgtcctcatatcagtataaggtaaaatggaatattgttacatgtcatatgctaagagacacattattgtattcaacaaacatatagtatgttatactgtatgtcaggtgctgaacaaaataaactgtctactgtcgtgaggcttccgagatgctacatcacctctcataaaagaacttccccatttccacaatcacacccttataattgtcttcctaattagctcactagttatttatattatttccctaattttaataatgaaactatcccacagaagcactatagatgcccaagaagtagagacaggaagctacccattagttcccccatagggatttctctcccttatgaaggatataccacatctttgtttaaggaataaggaaaagagacaaaggtatgtaacataaataaagagaaagcacacagaatttagtgatatatgtgaaaggtaacgggataaaccaagcaactggtgtatgttaaggaggtgaatatagctaatgtccttggagaaaatttacctagttagaaaagatgtgtcaatttagtagaatatttttacaacctaaaatctaattgaaccaaactcctctttattgttgttagttctctattctgggttgcactaaataaaaacaatgaggcagtgaaagtgattttataaaagttgaatggcaaagggtgatgctgaatgtcaatacaatcgctgtatgttgtctgtgagccttacaattaccctctaaattagtatcatatctattttcaggtgtgtaccaagagtgtgaaattaaaaaactttgccaagttcaagtacacactacctataaattccagaacctgaatttgacctcatgtttattttactccaaagtgaggccgacttaaagtttcccgaatgcggccactggttttatgcagcatgatttctttgagacattgttatatacagcaatggaggtagggcagggggagggcagtgagatttcagagatggctagcttggacatgcaatagagtgggaaagtgacccaatgagaatcaattggagggggagagattggagagaggaaagataatcaacagtgagaagttcagagaaattagtttaaatgtgggaagcaatttcatcatcaggagatagcaatctatggcctgagggtgaaaatagacttgctacctgatttttgtaaataaagttttattggaacacatccatgtttattcacttaatgtattgtctccagatgctttggggctacaatttgcagtgacagagctgagttgggggcatctggtctttagtggtctgcaaaattgaagatacctattatctagccctttacagaaaaaagcttaaggttaaggagtcttggatcaaataacaggaagaataagattttcactgaaattagtgtaagtgtagataagtttctatattttggggacatctcttgtgctaacttctaatttctttacatatagacttgtggaataaatgagtacatagctaagaatattataaatgatgagaaaaaaagcaaaattccaaaacgggctacatgggaatatttatgtttaggttctcctcatagctcacaattaatttgtatatgcaattacaaactctatggactacggtcattctagaggaatattatttaagtgcagtatatgtcaatttgaaataataagttttcacgagatatgtgtattttgttttgatttttttggtatgtaaaaaccacttgtctaaagcagtttacttctgaattattttgcattttaaaagtatccagtgaatcatttttttcctatttataaatgactgattaaaataaataagacttggtgtttttccatgagacgtatttgaaaattaataaaattgttaaacttaggattaaggaaaataacattaagaatttatttggtcttctgagacattttgtaactatcctattttaaattaaatttagtacttttacaaaatctcgtttcaattaccaactcatatgaattccaaccaaatactgacttttaaaattattgaaacatccaccaaacagtacagagttattatgttcatccttcttctctggacttcatgaatctctgtcagccaaggaatgtcggtttgtttactgggtatcccatttttcctcccacacctcataggtgtgacttggatttcctcatcctcatcttggaaataggtccccccttttagggtgtttgtaagaattatatgaaacagtaagaacaaagaaatcactaggctagacgtctttcatgtgccatctaataaatttctgagaaagtttttttattgatgcttatgaaaattttattataaacttgcttttaaaaagaaatcttttatattgggttattaaattgttctaggtacatttctctaaatcttctattattttctctctgaccttccattgatttaggagaatttgccataacagtgcttatttctttttcttccttcttgattttatgagaaaggttctattgtgtggattataatagccaagacagaaagtctcaggtgaagtacaggaaaaaataaaggaataaaatataaaataagttagaaagtaaatgtatacccaaagatataaatggtagaattagagaaattagaggaagaaaacacacacacacacacacacacacacacatataagttggtatactatatatgtatgtgaatatgtatatatgtataaacacatatgaaatatgaataggaatattgggaagacatatatttgaaactatgaatattttatgccatattactccattttcaaggtattgattggttaaaacatattttatataaaacctgaaattggaagcacaaatgaccttaaataagaaattaaaattaccccaaacaatttagtaaatatttattatctgtgtactgtgctgttaggcacggggtcagtgtccccgccttcctacaatgcaagggttagtgtaatatctaaaggtatgtgacttgaaaaacgatgaagcaaaatgactggaaccttcattgagagtatgttttagagagacagagtagagttttagagagacatctgattttatagtagaaagtttattttaaactcacatataagcttttacagatacatttttatagtaaaatctcagctgctagaaaattagagtatatcagtatatgagattgctgtaggtttcgtggcactaacaaaaacacaaggatggatgaactaaaaaatgagtttgtttctctttcagacttacttctcttaaatgttgtgtagatgggagtgatggaggccttgtaggaagtctctgctcattcagggatccatagtcctgttgcccagtttttcgatcatcccctgggacgctgtcttcgtagtcacggttgaggatagctcaccagcttcatgtgtgtatcacgaccttcaggagggaggacgaagaagagagcatatctatgcccatttacgtcttaatgacgaagttggatgcgttatatccaactggccaatacttggttacatgccacatctaactgcaagggaaagtgggaactgtagtgacatttctagatagccaaattgtcccctaaactttctaatactacataaagggtgaagaaagatacatattggaggatgagcaatctttgccagagccatttttttaatgtaggaattaagattaatgtttttcaaaaaaaggcaggggttgcaatcctagtgtctgataaaacagactttagaccaacaaagatcaaaagagacaaagaaggccattacataatggtaaagggatcaattcaacaagaagagctaactatcctaaatatatatgcacccaattcaggagcacccagattcataaagcaagtccttatagacctacaaagagacttagactcccacacgttaataatgggagactttaacaccccactgacaacattagacagatcagtgagacagaatgtcaacaaggatatccaagaattgaactcagctctgcaacaagcggacctcatagacatctacagaactctccacccctaatcaacagattatacattcttctcagcaccacatcacacttattccaaaattgaccacatagttggaagttaaagcacccctcagcaaatgtaaaagaacagaaattataacaaagtgtctctcagaccacagttcaatcaaactagaactctggattaagaaactcactcaaaaccactcaactacatggaaactgaacaacctgctgctgaatgactactgggtacataacgaaatgaaggcagaaataaagatgttctttgaaaccaatgagaacaaagacacaacataccagaatctgtgggacacatttaaagcagtgtgtagagggaaatttatagcactgaatgcccacaagagaaagcaggaaagatctaaaattgacaccctaacataacaattaaaagaactagagaagcaagagcaaacacattcaaaagctagcagaaggcaagaaataactaagatcagagcccaactgaaggaaatagagacacaaaaagccctttaaaaaatcaatgaatctaggagctggttatgatcaacaaaattgatagatcgctagcaagactaataagaaaagagagaagaatcaaatagatgcaataaaaaataataaaggggatatcaccaccgatcccacagaaattcaaactaccatcagagaaaactgtaaacacctctacgcaaataaactagaaaatctagaaggaatggataaattcgtggacacatacaccctcccaagactaaaccaggaagttgaatccctgaatagaccaataacaggctctgaaattgaggcaataattaatagcctaccaaccaaaaaaagtccaggaccagatggattcacagccgaattctaccagaggtacaaggaagagctggtaccattccttctgaaactattccaatgaatagaaaaagagggaatcctccctaactcattttatgaggcaagcatcatcctgataccaaagcctggcagagacaaaacaaaaaaaagagaattttagaccaatatccttgatgaacattgatgcaaaaatcctcaataaaatactggcaatccgaatccagcagcacatcaaaaagcttatccaccattatcaagtgggcttcatccctgggatgcagggctggttcaacacacacaaatcaataaatataatgcagcatataaacagaaccaaagatagaaaccacatgattatctccatagatgcagaaaaggcctttgacaaaattcaacaaccttcatgctaaaaactctcaataaattaggtattgatgggacgtatcttaaaataataagagctatgtatgacaaacccacagccactatcatattgaatgggcaaaaactggaagcattccctttgaaaactggcacaagacagggatgccctctctcaccactcctattcaacatagtgttggaagttccggccagggcaatcaggcagaagaaggaaataaagggtattcaattaggaaaagaggaagtcaaattgtccctgtttgcagatgacatgattgtatatctagaaaaccccattgtctcagcccaaaatctacttaagctgataagcaacttcagcaaagtctcaggatacaaatcaatgtgcaaaaatcacaagcattcttatacaccaataacagacagaggcaaatcatgagtgaactccattcacaattgcttcaaagagaataaaatacctaggaatccaacttgcaagggatgtgaaggacctcttcaaggagaactacaaaccactgctcaccaaaatacaagaggacacaaacaaatggaagaacattctatgctcatggataggaagaatcaatattgtgaaaatggccatactgcccaaggtaatttatagattcaatgccatccccatcaagctaccaatgactttctacacggaattggaaaaaactactttaaagttcatatggaaccaaaaaagagcccacattgccaggtcaatcctaagccaaaagaacaaagctggaggtatcacactacctgattttaaactatactacaaggctacagtaaccaaaacagcatggtactggtatcagaatagagatatagaccaatggaacagaacaaagccctcagaaataatgccacatatctactactatctgatctttgacaaacctgagaaaaacaagcaatggggaaaggattccctatttaataaatggtgctgggaaaactggctagccatatgtagaaagctgaaactggatcccttccttacacattatacaaaaatgaattcaagatggatcaaagacttaaatgttagacctaaaaccataaaaacctagaagaaaacctaggcaatacctttcaggacataggcatgggtaaggacttcatgtccaaaacaccaaaagcaatggcaacaagagtcaaaattgacaaatgggatctaattaaaccaaggagcttctgcaaagcaaaagaaactaccatcatagtgaacaggcaacctacagaatgggagaaaatttttacaatctaatcatctggcaaagggctaatatccagaatctacaaagaagtcaaacaaatttacaagaaaaaaacaaccctatcaaaaagtgggcaaaggatatgaacagacacttctcaaaaaaggcattgatgcagccaacagacacatgaaaaaaatgctcatcatcactggccatcagagaaatgcaaatcaaaaccacaatgagataccattgcacatagttagaatggtgaacaataaaaagtcaggaaacaacaggtgctggagaggatgtggagaaataagagcacttttacactgttgatgggattgtaaactagttcaaccattgtggaagagagtgtgcaattcctcaaggatctagaactagaaataccatttgacccagccatcccattttatcccattacagtaatatacccattactgggtatattcccaaaggattaaaaatcatgctgctataaagacagatgcacacgtatgtttattgcggcactattcacaatagcaaagacttggaaccaacccaaatgtccatcgatgatagactggattaagaaaatgtggcacatatacaccatgaaatactatgcagccataaaacaggatgagttcatgtcctttgtagggacatggatgaagctggagaccatcattctcagcaagctaacgcaaggacaaaaaaccaaataccacatgttctcactcatgggtgggaattgaacaatgagaacccttggacacaggaaggggaacatcacacactgggtcccgtagtggggtggggggaggggggagggatagtattaggagatatacctgatgttaaatgacgagttaatgggtgtagcacaccatcatggcacatgtatacatatgtaacaaacctgaacgttgtgcacatgtaccctagtatttaaagtataaaaaaaaagattaatgtttttggctctagaaccttttgtttaataggctatagaatgagatttttaaaaactaaaataccccatatgtgtacgtatgatacccatttttgtcttcttaactggagcatcggaggcacaatgtagcatttctgtgagtggttctgcaatagtgaagaatgttaaatttgctgacatttaacatcaaaggcaaatcatagggattaacagaaggcgcagagttcgaatggtggacttgacacatgccttcttttagaaagaatttgttagctttattttttgctcagcttcttctgacttctttttctgtttatgtttttaaaaaactgttaaaattatgttttaaatttttgtggctacgtagtaggtgtatgtatttatggggtacatgagatgttttgatacagacatgcagtgtgaaataaggacatcatggataatggaggatttaccgggtctgtactaccatctgggctgtgtcccattgctgtctttctggtattctggtatcttcctcagtgtgatatcagtgtctgtgacttgcgtgcattatttagacttgacatttgatttcctactcagcaacgtaatgaagacgaggtattttcctagtagcttccaaaccattgattgaatttgtggaaattaagaaaaaatacactttgacttatttttaagaagttacgtgagggccggacaccgtggctcacacctgtaatcccagcactttgggaggctgaggtgggcggatgacctgaggtcaggagtttgagaccagcctggccaacgtgttgaaaccctgtctctattaaaaatataaaaattagcccggtgtggtggcttgtgcctgtaatcccagctactcgggaggctgaggcaggagaatggcttgaacccagaagggagaggctgcagtgagccgagatcccaccattgcactccagcctgggcaggaagagcaatactcaatctcaaaaaaacagaaaaaaaaaaagttatattatatttttttaaaagtgctgttgcttagactcttaattcattttcttcatttaaagagattgatcatattgggataaagacgtgttttggaatccaaacaacctggttttaagtcccagaaccaccagttacctttgtgacctttggcaagtcatctaatttttctatttccatttcctcatcctactaatttctatcaccctgatctgttgtagtgaaaaatgatataatgcgtgttaagtgattagcaaattgactgacactaagtactcaataaataatggcagctgttgttattgctgttgtatatgcggtagtagttgtatttgttgttgattgttgccctaacagcaggccatgatttttcctaaatcctcattagggcttaactttgaactcaatttcaggccctatctatattaaaaattacctatttaatagtgtcattaggttgaatgtcatgtacagtgttgcatgatggattaatttctcataaatcacttcagtaatcatttttatgctttgaatagtaccttggtttacgtgttatatctgtgagaaaacacagcggaaatgtgtcaagaatatttccaggtactaatcctggttgttcagaaatgctcttctgttatttagtgaaagaaccgcttggttatccctctgtaatcctttatcttggaaataatcttttactgaggggtaaaaagattatagaatacaccaaaaaattcaccatccatgcattgacttagactccatgaaaaagaagtatgatacatttaaatgaactgagaatgataaaatttgcaaatgttcttgaagcatttatgcattcaagaccaataaaactgtttttgatccaggttaacagtcgtatcatactttaaggctgaatttagataaattgccaaaatccattttatcagtgatataaaactgctcagtgatagactgtgccctctcatagtgtcccagctattttttctaagagctttgtggtttgctgggctgctggtttcactacctacatgtagccacttgattacttatctcagtttgaattgcccaaatcatgcttccagaaacacacagagctcattcacctgtttccccataaaaatcatttatcatttcaatgaactttggcccccaaacacaggcattgcagagcatttcttgggatctagaatgtgcttagcattttatatgcactatctcatctaatctttccagcagccttacgtacgtatatttttatttttcttgttttatagatggggtaactgagatgcagagaggttaaatacccaagatcagacagatagtaaactggattttaaaatatatttatatattcagaagtatcaaggctattgctgtatacttcattagaaccatttctagtcagagaaattctacgagtagaaattatgactagaaattgtctccagaaatgagtgtctagagatttttctagacattgctggactaaaacagtcatttatcatccctgatttttttacctttctcctttctgctctttcaccttttttttttttttttttttttttaaaagagacggagtcttgctgttttgcccaggccggagtgcagtggcgctttctcggctcactgcaagctccgcctcccgggttcacgcctttctcctcctacctcagcctcccgagtaactgggactacaggcgccgccaccgcgcccggctaattttttgtatttttagtagagacggggtttaaccatgttagcgaagatggtctcgatctcctgacctcgtgatccgcctgcctcagcctcccaaagtgctgggattacaggtctgagccaccgcacccggcctcttccaccttttttaatgagcgatgtcttcaaggaacataggtgacaatatctaatacttcctaaatctaacaggcagtaattaagcctctgaagtctgtggataacgttgaataaatttgagtgtactcaattttgggggaaaaaaaaaaaacaaaaacagaatcgtttcatccattcactgtcatgcctctcatcgtaatcattatttgcccaatgtactgaagagaaacataaactactgtgataaagacaaaataggattgaagcataggaaaaataattagttccagttgatgatactggcatcttcattcatgaaacgattggggtctatctttcttataaatagatctataaagaacaaaaaccaactttcctagaaaatctcttcatttgatgccatgacatgtatgaagtgatctccaatcttaggtacaatgtaaaattctgtgatgataaaaacatattttggggtgctgaaacaaagcataagccactttttatatctttatttccaaattctcagattaaacatcgttttattttaaaatgtcttttattccaaggtctctatggaaaatatacaaatgtagaattcaggcaaatttcttttttcgtcggtttgcttagtctgaaattctagagccatttccaattttgttttacaaactgcagaaaaaagtttaatctcaccttagaacatatatacatatacatatcaaaataaacccatatgcacatctgaaacaaaaattgagacaataattgttagtattatataagtgacacagactactatttttctgtttaattttaaaatattcctagtcataacctactaacatgattttatgaaccatgaatggattctgacttacaatttgaaaaacaatagtctatctagacaaataattactcagatcttaaattcaaattttgattataattctgtatatatatagttgaattgatggatataaatataaaattttgcatagcttattcagatttgaatttatctttaagaaggctgtctttgaaatgtttttgttttatgcacatcctcagacaaaatatttaggttcagaatttgagtactagatgtcatgtccttgagtataagtatacaccttttaatattttcttccaaaattcaatcctgtgtaaatatcaataaatcataaagtgtttaatattttgattcaaattgcacagtgtaaagtattgtgttacttgagtattagtgctgtttacaatgcttcgtttggagaagattatttgaactcaagatagttaatgatttttaagaactcttaaatacgagctaggttaaggttcagatttcaaaaagagttaaataatgtttgctcttacacatttttgggggcgtattttcgacaataattttccatctcctgaaacctgaacagtgacttaagaaggtaatcttggggcaatttatgcttcaaaacacttcttatatatgcagaggaatttgataataattacagccgtaacatactttatttagttgttatacaaggtcactctgtgaagtgcattatgcactctttaattcttaccacaatcttattatggaagtattattgttcccattttacagaagcagaaactaaggcttatgcagggctaggtaactcccaaagtcacaagattccctttctttctatatcatcaatttcagcataagtggttggttcatataggaacataacaggagtaggaaaggatatgatagggtttcttggtcgtttgtattttcttgaaaaaattgccttcttgctgcatttgaagcagggtctggttcagataggaagcattatctcccagggctgccagcaaccttgtttactcagttatagacataacacacttacgccatattctttgaatcttactaaacttactgtgagctcaccagacttctgtgcttctagggcattgaaaatgctatatgcaaataggacagatacacatattataccacctgtctcctctgcgcatgtgcatccttcattgcacataggacttcacttctaaaacacaaattcaaaaataaaattatttacaatttcaggatagtatcagcagataatagaggcatgtgtttcttctgcgctcagggccctgtgcaactgctcaggttgcacaaacgtgaagctggttccacctgcgcacatctctcaggctgcctttatatcattttcccccttaatgctgactttgatagttattattaatagtatttagagacggaagagatacaccatggaagttgttctaacccctaagaccttcagaaattgccttactgttagacaagggttccatgcaaatagccctttcagtgcacttaccctctttgatatgatgaagttcggtgattttgacttaccaggatgacctttctctgccacttttatagaaactggaaaaagagtgcatcatttgatgaaaatgtcattgcaataactgccactatgccttgtcatctcgaaggacttaacagttggggaaatttaaaatattgaattttcaaaatttgagcatttatcagaagagcacaagtaagttggtgctggcagcttagtgggttaattcccagaactgagaaggacaggaaatgtagcacatacacaccaggggaaagccaccaaaggttgaattttctctgggtgagattatgaaatcccccaaacagcttctgttgttctacactgctttttgattcctttacaaaaccctgtttgttagggggccccgtgcttgcttgcaatatttgtggaatgcagaagattcttctacaaatatttctccaatatttgtttgttctgctcacctccgtaaatagtatgcctatgtccttgacctcagcaaagtccctcttgagcatgttctcaggatttttgaagcccggcgacctgcaaggagtacactcctcccaaagcaaaacctcctgcaaacttagtagtttactcaaatttttgcccttgataaatgcctttaggttaaagcagcagacatgtagtttatcccaagaagcctctcctgtcacttgagtgtatggttcctatagcatgcaaatctctgcaaacatatggccaggtttacagctcatgtaaactaccccgtctctattacttggcttcagatggggagaagttagagccacgcagagcgctccagcctctccagaggaagcctttctcaccagatttttctaatcgacctccttgcttgctcttacacacctttaagctagatattggattaagggttgtgagaccaattttgtgatcacttcttagcaattttttaacaggtaccctggatcttctctttagaattatggatgcttcgtacactttgctcttggctttagggtccagacggaaattccaagacaaccatttgcattctcacttaatatcctgctaattaaattgggtaaagcatacttcatattttagttcttctaagataatgtcttactatttaaatcgtggccttctggaaataaaggctaaatcacagaagtcattatgctgttagaaattttagatgggtgggtgaggtattttttttctttctaaattttgccttcctttcccctacctccttgttttcttactgatgcctttactggtctgtaaatatttggaaatatttcattacctagggcctctcaggaagagatatttcctttaatgccattgcagaggtatgtaaatataattctgataatgtatatgtaagttattataaataagaaatgaggaaagttcctacagatcaatatttatagcatttaaaaagcaacatgaggtgatatactaatttactccttccagtaatctagaagagctttaatacaatattaatttggtgtggattttgaccgctatttgaaaattgatgtatgcatgaggaagttaaaatgaaaactccctattgtctgtatctgctgttcctgtgtttgataatgccagtggacagtcctagcattttaaatatttcattcgattcatcatttaatgtactggaacaatctgcaaagacattaattgtgtaacacccaatttattttattgtgcagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggtaaactaaaacgttaatttacaaaacaaaacatatgacttgttataatggcaagtcatcctttttcctcaattactctcttacatccttgtattttggaaatttagttactatgatgtgcttgggattccaacagtcagattttgaagttttcttttggagagcaaccattgaaggcatttctacctgatcggccaacaggaatacgaaagcccaacttctttctcttgtgtcaaggcagtgctgaggcattacttacattcctgagttgatgtatggtattgggcttaacttctctcagtgggagacttttcctgagatgatacactcgtttggcttctttcccttccctgtcctttttcctccatcttcaactcccttgcggaacttcctgggagctcttccttaataaatcacttgcactgaagtccttatctcggggcctgcttctgaagaacttgacttaagataattttccttaattcatattaaaagtggttttgggattctgcaaatacaaattaaattccttttactgggaatataaatctaaatgggccacaagtttaaaactgcaaacaaataaaactcaaaaccacaccgatttacctagagttctaattacaattgttaacttccttctttgtcaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaagtaagtccttatttgtttttaattaagaagactaacaagttttggaagcttgtgattattttgatgtggtttgatggttaagttacgattctcagtttgttcccaaggcacacagctttctttcaagggagactggttggattttcatagaaataacattttggttttcacttttgtaactaaaagagcagatgttagatagatgcactgttatctacagaactatgttttaagatttgccaaaattctgtcatagttattattttctaggttttcctccaaacattaaaatgtcactataaaaggcacagaagcatgcacaggagattgtgtacataaaatcacctattagctatagttgacacgaaacttctcttctgaagaaaaagcccttgaaaatattaaagagttactcatctatatatggaaatcctcttgaaaaacattattcaaacgttttgggaaattcttattaaaatacagtatggctatgaattatcttaagaatatatattgacttaataaaaaagaggatttgagacatttctgaaaaatgacatatttcttataaaggtaacaagcagatctcatcattctggatatgtgttttgatttatattgttaggtgtgtatattcatgtaaagcctatcaagacaagatagatttatttttaaatgaaaagaaatgaagtgccaactgtggatttgaatacattaagtgaaaaaaattgtccaaatgccttaagtttatttaactattatttatgaagttcaaaagcgttaaaaaaaaaaaaggaccaaggaaactcattagatatgctagaaggattggtattccagtactaaattatagtgtgaaattatggaggggaaaaacacatttttaagctcaggccttttgaaagaataaataaggtacatgtaagatagaggtttcataactatatatgtattccaagccaggagatactaatctatgcatattgatattattcgcctgctgtgatcgtggtgatgattgtcactacccctagatgtgagaggtacaataatcatattataactgttgagtctgcccactccccagtgtttaccaggtccactaatttactccatctattatcgatattaagatataagctgccttctgtggtcatatgccaacattcttcaggttagaacttctatttgcagtgatctgtggaacttaaagcaacctcaaacaaaattagaaagttttgaaaatccaaccacctctttactgtccttgccataatagccaccagtgtcttctcctttgtgcactctaggtttccatcctctcctggaggctaaatgctctcatttttcttacactccccattttcaataaaactaacaatatggcattaattattcatactaatcagttaattaattgctgtgtgaaattgagttgcaagaaaatatgaattcctcctggaattaaaattgcaactttttctttgcttatctgaaacataaaaaaagtcttttatctgtgattctaacatttaaaaagatgttcattcaaaaattccccccttcaagggatgtctgccattaagtgaaggatgacagacacctagacttctgtgcgtgtaatttcctcatccccatcccactagagaatggaaatgctaaaatggcagtattaccacctagctgagattgacataaaaaattagtttgtccttagggaagattcaagagcttttgtacgtgttacagcttttagaataattattaagaaggcaaggagagccttctagctggtatagcttttgctaaaacatctcacagagtttttaaaatgagacacgtacatgtaaccacttctatcacatagacttttctggaaaattccttaaaaatgaatatacaaagcattatttgagcaacacaaattcagaaataatatgagagtttataaataacagtcttccttgccactttgactatgtatgtgttcgtgcataaaacctattaaattctaatgtgataagccattatgtaagctttgctgaacctgatttttgaaagattttgtgagaggaaacaaaaaacgtgattatgaaaagagggtattgtcattatttttaaaaaactaatctaggttttacttaatgcttcaaataaattataacctgttcagtttccattatcatggtcatgagaatggattatctccaatgattagcttcaacttggagcattacctattttttttctaaatatatgattacttcagagtagaagattactagtaaacaaaaatggattcatcgatacttcttttctctctctacctaagacagggtttggatagatccagtcggaagccattatttcctgcctaagccttggtttagcgattagagaaatgataattaacatttgtctagtcatattaagtatatccaaagctatgctataatttctaagttgatataacaaaagttaaaaacttcttgtaaatacagataagcttatcactaaaatctatgaacatttacacttagcaattattaatcctatctaccaacatacttactattaggttgctgcaaaagtaatcatgtttttttccattgtaagtaatgggaaaaactgtaattacttttgtaccaacctaatagcaacatcaaattatatttgatatatagtcattgtgagatatatatatatatatatatatatatatacgtataaaatacacatatatctctctatatgaacaaatattaatggaatacattatcaaaaacaattaatggcactggagactcaataatgatcatacaaggtctggccccagatctcatgaaacatattctgtagaggctggcagccaagaaaaaaaagaacacaagaaaaataccggataggaatatagtttttgaagagattaaaatgtaatgtgatagagaatggttgaggggaggctactttagactttgtgatccaggtaagactttgaaggttggtaccatttagtttgagatttgaatgacaagaaggtaccactatttgcagatcacaaggaagtgtggttcacggattaggaacagctaatgcaaaggcccaaaaatagggacagtttggcttgctggaggaaccaaaaggccagggggactgtagagttgcagggtggtaagttagatggctgaggtctgagatggggttgaaatataggtaggagactgattacatattgtagtgtcagtcagggctttgaataagggctttgaattctagactaagtgcaagacaaagccatcagattttatgtaggtgagagataggtcaagaaaacctatcaggaaggccactggaggaagagaggacagttattaggccagtgaagttggccagttaagacacagtagtgtcttagaccagctggtagttgtgataaaagtatactttactatcttagccatttagttattttaaaaaccacttctctgtttagttttagttcctatttttttttccttttgacagtaaaagtgctttttcctttggaaatagactgcttcaatttgtgcccacagttactattattcaagttgcatctaggaaataatatttatcccataaaccatcaacaattatgcaaaacaagaaatattaaaaatacaaagataatagcgtgccctgatttctgccttacataaaatcctctccagtttgcctaaggaataagggcttgctttctcaaacacttatttatgtgaactggggcaatatacttttcttttctgttctctactttatagttttgtaaaacagcaatagtgtcatgaggctgacatacctctgaaagatactagatgagatagggtataaaaagttagtttgtgaatgcaaaattattataaaatgtgaagaaagataactgtgataaataagatgatgagctgtcagttaactattttaccataccatgtcactttttatatgtaatttgatattttctatatgaagtattatataattttatatataattatatttcatatattttgtataataacttatatataattttttaacttttaaaaaaattttgcagggaatgaggtcttgttatgtttcccaggctagtctcaagctcctggcctcaagtgatcctctcccaccttggcctcccaaagtactagtattacagacctgagctaccaaacctgaccctcatagatgttttttactttttttctccagccttttctaattgcctcagtcatttttttttcccaaagagtatagctgtggttattttgtatggggataagggagcatgagcaggatgattagaaatacatttgcagttattttttcacaatggcaacatttaaaaatatgcttacaaaggaatgtcaggaaagataaccatacagatacttcctcctttctttctccttcataaccacactctcatttgattctttccttgctattgtattttccctccaattctgttgcttttatggacataaatttctgatgaggtaaaagctaatacaataaagaagtttattaacacatctccagtcacaaatgagtttggcacgtgccgatactggtcaattacaaaactttaccaatgtttatatgatttaaatgagaaaactaagtgccattcctttcataatgtagtgtttaaaacaagagaatattgatgtggttttgttagaaccccttaagaggagtaagccaatgattttttttttaatgctgtggaatacacttgggatggtaggaggtaaggaattcggaagaaaaacacacaacttccaactgtggaagtgcaagaagacaactggcacagggaaaacagaagattttcttctctatgaataaactaattaatttgattgaaaaatgcaacctgcagagagcaaaaaagatttactgacatttttataaggactcaaagttaagcacagcaagttccatcaacttttctgataattgtagttaggacatgcaggcagaaactaaaacttctgtgacggtaagggaaaaaaatgaaagcaagtcaggaggccaagtgaagttgtgttttttggtttatatcagcaggaggagagatatgaatagtatctgggtagatacacaagccataatatggaaaataattgtgaatcaccatcaatgctttgactggacagaaaaatacatctaacaaatatggctcatctctttttttttcccccaagtgtctatttgactctggaaataagatggcatatgtgagagtggatagagaaaaggaggtgctgaacaaatgagtgggttattttctcccaagtgcagtgaagtttgcgtatgtgaatatatgaatgaatagatgaacaactaaattaagttattcaggtaattccaatcttggaattgaattcgttgcagtaaatactttggaggtgcacaatctcaaactcctaattgtgattttatttcacaatttggtaagttcattgatttttctgttttacttcttccagtaatgttaagcaatagtaacttgcagatcaaggtggtgtaggaccagtagcatcagcgtcacctgagaacttgttaaaaatgcagactctcagctctcattctgatatatacagaatcagaattgtgcagtttagcaatatcccaggtgatccctgatcagtttaagtttgagaagcactgatctaactgaaattaagacagagtagaaatctcaacttctttgtaaacctctacttagatatcttctgttcctatttttctatcaagtgacgtgggccaaatattttaattactttctcaggagctctaaaaatggtgctgatatttcattcagtcctcatatgttgatatcataccccatgggtgattaagcagtagcaagattctggtgcaataatatataacagacaatatatgagtgttgatgagtattgataattaagctattggactaataagaagtaggaattatttatagatgataacgtgacattcggttaggttgcacatggattatggtcataataatttttctgtcaataattaaaaatgtgataatgcagctaaatgtggacatctcttgtactaataatacaatgcatgtgactcatagtttaaattacaggaaagctaaatttctggaattcacagaaatgagagagccgtatcttcaaaaacaatgctttctcacaaagataaataatgctgatatggtttggctcatcttgaattgtagttctcataatccccatgtgttgtgggagggacctggtggaaggtaattgaatcatgggagtgtaaccctcatgctgttctcatgatagtgagtgagttctcacaagatctgatggttttataaggggcctttccccttttgcttggcccttcttcctgctgccatgtgaagaaggacatgtttgcttccccttccatcatgattttttctgaggcctccccagccatgccgaactgtgagtcaattaaacttgttttctttataaattatccagtctctattatgtctttaattagcagcgtgagaacagactagtacagtacattggtaccgcagagagtggggtgctgctataaagatacccgaacacgtggaagtgactttggaactgggtaacagccaggggttggaacaattcaaattaaactaatagactatctcagagagcagatttaatagaagttgacattttaatcttagtacaaaaattcccaatcagaaatatcaaaactatgtcttgttcataattaagttatactacttatacattgaagaaatatttattgagtgtgtagtatgtgccaggcactgtgccagatgctatgtagtggcaaaatttttgaagttgagagtgagcttctatttccacataaatgaatagaatttcagagtgtcaacattacctattcttactagagataatttaaacagtcttccaaacgtgatatattcatatttgtccttggctcctgatgacatctgccaatttctttattttctttaaaagcatttaatcaggaagattgatttgagggttgccataatgtatttgccacaagaatctttttctttttctttttcttttttttttgagacagagtctccctgtctcccaggctggagtgcagtggcgctatctcggctcactgcaagctccgccccccgggttcacgccattctcctggttcagcctccccagtagttgggactacaggtgcccgccaccacgctcggctaactttttgtatttttagtagagacggggtttcaccatgttattcaggatggtctcgacctcctgacctcgtgatccacctgccttagcctcctcagcctcagtgctgggattacaggcatgagccaccacgcctggccaagaatcttttgcatccagccacgcagcttctttatgttattgttactaaactgaatttatgttttcaaaatgaaaataaatgtgtttgcatttgaactttaatgttgcctcggatagttgaaaaatattaataattaaactgttcagctatatggatggaggacaaaaatggatcaggatttgaaaacaatgacacattttcgattttctcatagaattcagtataaaaacaatactatttctcacattccattaagtaggaaaataaatgttagtgcatgtttaattttgtgaaaaactggaacattttccttcatttctagttgttggatggggaactttatattaggttctttctgaactatttactgtgaggttgtaatttaaagtttgacctccaagatcaggttgcagggtgcagtataataactatggcaattagtgggaatttttgaaaatgatacatgacatgctctccttggcttctttcctagcccaagatgtcagcatacttcgtgttgggaaagaaggtgctgtaaagaggagaatgaacacattagttttagggggataaaaactgtataattttgtcagaccttgcctcacttcattctccaatggaaactactatattagtgcctaagatttatacacaccgtgacaccatgcagtgtcaggctttgcagctgagtctagtaaggaataccagaatttggaggaaagcagatctagttactgaggcaagtaggtaaactaggccagtagggtttctacagcttcacagatgctgagggtacccattcagaaagttagcatgagaactagaggacaatagcgatggatgtacttgtggtaaaggtgatgagatagtgaaaacagtgacagctgaagtcttacacatttgagggggtaattggttctgtttggattctggctttaaagcttatatttcacaggccacttattgaactttgataaacgttataaatcttgggagttgaaaaatactaatatgcttcctatggaccattcattattgccatgcaacaacaacaaaaaactatgtgcatatgtttgtacatgcactactcaagcttttcttttaaatgaatgttgcttttctatattaaaacatgtttgccatttcttggattataatatatcatgatttctgattcctatatttaatgatacaccatacattttaaaaatatctagtcattttatatggtcaccatatatttgagggaaaatgagtctcgaagtttattgtggaggaggtggagaaaaatcgccaaacagaagcctccagtaattatccctgttgcaggaacatcaaattgaacaactgtccacactagaaaagcaccttcataagagtgaaaaattaggtgcatgatcgtagtacctggtttttgggttgtatcacagaaagaggcacagaagagggtagtaaaggcaatattctatcacctataccagctctccctcatccatggcagcagtcacatggcatgaagagagagtctatgtgcttgcagaagggagattgcagtgattataggactttgcattgaaaatcagtgctgccctgtcacagtggaaaccgacaaagaacagaactcagccaaatcccgcagagggagcatttagatgaaccctagacagggaagaatcatccatcccagtgtttggaacctgagttccggcaagccttgtcatcatggattagagtgctctgtggttctaaataaacttcaaaggtagtctaggccacaaggactgcagttcctttgcaagtcctggtgctgtgccgggctcagagtcagtggacttgggatacatacaacctagtgagacatccgctggggcagctaagggactgcttgtgcttcccttcccccaaccccaggcagcacagctcacagctccaggaaagactccttccttccgcttatgaagaagagaggagacaagaaagagaactttgtcttgctgcttggataccagctcagacatacaataggatagggcaccaggcagagtcttgaggtccccattccaggccctagctcacagataacatttctgaacacaccctgggccagaagagagcctgtcaccttgaagagaaggaccccgtcctggcagaattcatgacatgctgaccaaagggacctagggccctgaataatcagcagctgtagccaggcagtacttgctgtgggtattgggtgagactcagagctgtgatggtttcaggtgtgacccagtacattcccagctgtggtggctacagggagagaatccttctgcttcaggaaaggagaggtgagagtaaaggggactttggcttgcagcttgggttccagtttgaccacagtggggcagagcatcaagtgggctcctagggtccctgattccagagtttggctcctggattccattttcttactgccctgaagggagagactcaggactgacagcattcaccacaggctggccaaagtggccttggcccttgagtgaacattggacctcagacagtactctctttggttcagtagtcgtcgtggccatgaggagagacatctctgtttgtggaaaggggagagaagagagggaaggactttatcttttgggtggggtgccagcttagccacagtagaatagagcaccaggtagatttcttaggttcttgagttgatatagtttggacatgtgtgcctgctcaaatctcacgttgaattgtagtaatctgcagtgtttgaggtagggcctagtgggagctcattggatcatgggggcaaatttttcataattggttgctactgtccttgcaatagtgagtaaattcttgcaagatctggttgtttaaaagcgtggcaccctccctctcactcttgctcctgctgtggccatgtgatgtacctgttcctccttcaccttctgccataattgtaagtttcctgaggcctccccagcagctgagcagatgccagcatcatatttcctgtacagcctgtagaactgtgagccaattaagcgtcttttctttataaattactcagtctcaggtatttcttgatagcaatgcgagagtggcctagtacagaaaattgttaccaagaagtggggctttgctgtcaagatacttgaaaatgtagaagctgctttgaaattgggtaacagacagaagttggatgagtttggagggctcagaagaagacagatgagggaaaatttggaatgtcttagagactggttaaatgattgttaccaaagtgctgatactgatatgcacagtgaagtccaagctgtcgaggtctcagatggaaagaatgaacttattggcaactggagtaaatgacatgtttgttatcccttagcaaagaagttggctgtattatgtccatgctctagatatctgtgaaagtttgaacttgagagtgatgatctcgtgtgtctgacggaatgaatttctaagcagcaaaatgttcaagacgttgtgtggccacttctaacaacctactctctgatgcaggagcaaagaaataagatggaatatttattattttattttattgtactttaagttctgagatacatgtgcagaacgtgcaggttttttacatatttatacatgtatatttaaaaggaaagcagaccataaaggttttcaaaatttgcaacatggatatgtggtagaaaataaaagcccattttcaggagaactcaagaaggcttctgagcaaccacttgctagaaaaatttgtatacctacaaagaaggcaagtgctgatagccaagacaatggggaaaaaggcctggaaggcatttcagagatctaaaaggcagcccctcccattatagatccggaggcctaagaggacagaatggtttcctgggccaggcccagggtcccagctgccctgttcaacctcgtacactgtgcccccgccccaacccctcccccccgcacccagcgtcctggccactgtagctccagctgtggctcagagtggcccaagtacagcttgggccacagctccagcgggtacaagccataagcctgcaggtgcacagagtgcaagagttgaggcttgggaacatccatctagattttagaggttgtatggaaaagcctgggtttccaggcagaagcctgctccaggggcagaaccctcacagagaacttctcctggggcaatgcagagggaaaatgtgggctttgatcccccacacgtagtccccactggggcattgcctagtggacctgtaagaagagggccactgtcctccagactccagaatggtagatccactgacagcttgacccttgtatctggaaatgaaacacacactcagcaccagaccataagagcagctttggaagctgaaccctagaaagccacaaagttggagtctgcccaaggccttgggagcacaccactcccaccagtttaccctggatgtaggacatggagtcaaagcagataattttggagttttaagatttaatgactaccctgctgggtttcagacttgcatgagacctttcttttgaccaatttcacccttttggaataggagtgttgactcaatgcttataatcccattgtatcttggaagtaactaattggtttttgattttacgggctcataggtagaagaaacttaccttgtctcagatgagactccggacttttgagttaattctggaataagtaaagaccttgggggactgtttggaagacatgattgtatgtttaaatgtgagaaggacttgagatttgggaggggccaggatggaatagtatggtttggatgtatgttcttgcccagatctcacattgaattacaatcctcactgtcagaggtggggcctgggtgggagccgaatgaatcatggcgttgaatttctcatgaatggtttagcactatcctcttagtgctgttttcatgatagtgggtgaattcttgtcagatccagttggttaaaagtgtgtggtaccctcccactcacctcttccctggccgtgtgacatgactgctcctccttcgcaatttgccatgattgtaaatctcctgaggcctccgcagaagcagagcagatgccagcatcatgtctcagggacaacctgcagaaccatgagccatttaagcctcttttcttcataaattacccagtatcagatatttctttatagcattgtgagaatggcctaatacatgaccccaggccctggcttacatataggatcttgcaaacccaccagggaaaaattgctaccctgaagtgaaaaacacaagcttcattggatttgccacctgccgattgtagagtccttgggccctgagtgaatgtaggtgatagccagtcagtggtcagtgtgggccttgatcaagacccagtgttgtactggctttaggagtgacccaacacaatcctagtcgtggtagctacaggggtgcttgtgtcacctctcctttagctccaggcagctcatcacagagagagactctctttgttgaggggaaggaaagagaaaaagattatctaccaggtaatacaggggattttcctgaatcttcccaaagatcaccaaggcagtacgtttaacagtctgcaagagtcacagcattactgggcttgggtgcaccccagtgcatatatggctgcagtgaccaaaggaataaatcacaacacccaagaacctttaaatacctggaaagccctcctgagaagtatggatacaaacaagccgatactgcaaagactacaataaataccaaagtcttcaatgcccagacattgatgaacatccggaagcatcaagaccatccaagaaaacatgatctcaccaactgaactaaataaggcatcgctgaccaatcttggagagacagatatgtgacctttcagacagagaattccaaatggctgatttgaggatgctcaataaaatccaagatagtacagagaaggaattcagaatcctacacataaatttaacaaagggattgaaataaaaagaatcgaacaaaaattctggagttgaaagatttaactgacatactgaagaatgcgtcagagacgagtaacagaagaattgatcaagcaggagaaagaattagcttgaagacaagctatttgtaaatacagtcagaggagacaaaaaagtcctaaaaagtttattgaagagggtaataacacagaacttcccccacctagagagagagattaaaattcaagtacaagaagataatagaacaccaaggagatataatataaataagactacctcagggcatttaaaaatcaaacttccaaaggtcaaggataaagaaaagatcttaaaagcggtaatcatataaaaaaaaaaatcacatagaaatagctccagtatgtctggcagcacaattttcagtggaaaacttccaggccaggagagtggcatgatacatttaaagtgctgaaggaaaagacttttattctagaatagtatatctatgaaaatcctcttcatacttgaaggagaaatgaagactttctaagacaaagaaaagctgacagatttcattaacaccaaaccttttctacaagaaatggtaaagggcgttcttcaatcttaaagaaaaggatgttaatgagcaatgagtcatcatctgaagtaacaaaactcactggtgatagtaaggtttgttactattctgttacaaagagaatattataacactgtgattatgatgtctcaactacccatatcttgagtaaaaagactaaaagacgaacctatcaaaaataactgcaacaacttttcaagacatagacactataataagatataaatagaaacaacaaaaagagtggggggatgaagttaaagtgtagcattttttttttttttagttttctctttgcttatttgtttatgcaaccagtgttgtcatgaatttcaaataatggattataacttattctttacaaacctcatagttaccacaaatcaaataatgtactcaggtacataaaaattaataagaatgtataacatatgaccagagaaaattactttcattaatagtaagacaggaaggaaagagagaatgaagagaaggccacaaaacaaccagaaaggaaatagcaaaatgggaagtgtttaagtccttaacgtaccaatgataacatggaatgtaaattgactaaactatccaatctaaatacattgagtgacagaatggataaaagaatatacaagacacaataatctgttacttacaagaaacacacttgaccaataaagataaagatagactgaaaataaagggatggaacaagtattccatgccaatcgaaaccaaaaaagaacaggattagctattcttttatcagacaaaataggtttcaagacaaaaactataaaaagggacaacgccggtcattgtagaatgataaaggggtcaattcagcaagaggacataacaattgtaaataaatatgtacccaacattggaacacccagacgtataaatcaaatattattagagttagagagatagaccccaaaacagtaatagccggtgatttcaattccccattttcagcagtggccagatagatcatccagacataaaatcaacaaagaaacatcagacttattatgcagtgtagaccaatttgaactaatagatatttacagaacattttatccaacagctgcagagtacatattcttcttctcagcacatggataattttcaaggacaagccatatgttctgccacgaaacaagtcttagaaaattcaaaaatcaaaataacataaattagcttttctgatcacaactgaatatatcaagatatcagtaggaagaattttggaaactatagagacacatggaaattaaacaatatgctcttgaattatcagtgggtcaaagaagaagttaagaaggaaactatagaatttcttgaaacgaatgaaaaaggaaacgcaatgtaaccaaaacctatgggaagcagtgaaagcagtactatgaggaaagtttataggtataaatacctacatcaaaaaagcagaagaactttcaaataattgaatgatacaccttaaagagctagaaaagaaggagcaaaccaaacccaaaattagtatgagaaaataaatattacagtaaggaacagagctgaaatacattaaagtacaacaaaatgatacaaaagatcaacaaaacaaaaagaaggtttttttgaaagggttgacaaaaatgacaagtcttaagcttgactaagaaagaatgagatccagtcacttacaacaacatggatggaactggaggacgttatgttgattaaaataagcccggcacagaaaaacaaactttgcatgttctcacttacttgtgagagcttaaaaaaaaaaaaaaaaaaaaaaaaaaaaaaaaaaaaattaaaacaactgaactcatggagatagagactagaatgatggttaccagaggatgggaatgctagtgggtcgggggcagtggggatcattaatgggtacaaaaatatagttagattgaatgaatgtgatgtagtatttgatagcacgacaggatgattactgtcaaacataatttgttgtacgttttaaaataacaaaaagtataattggaatgtttgtcacataaagaaatgataagtgctcgaggtgatggataccctattaaccctaatgtcatattatgcctgtatgcctgtatgaatatgtctcttgtatcccataaatataaacacatactatatacccaaaaaaataaaaatttaaaaaatagggtattgtggtttctatcattaaagtaaacatcatgctaagaacaattgtctcaagagtaacaactgtaattttcgttttggtgaaaataataaaattattaatgacaatctctgtataaaattccaccaaatgaacttctgttttctatttttttaatatttataatcagtgccataaatgactttataatagatataaagttaatctctaaaaagttaattttagttcaggcaatattgcatgattgtgaagcaggccccggagccaaactacctgagttcccactttgtcaccttcccttgtttgcgttttgacccaagtaagcctttgtttccccacctgtaaattggggctaatatcagttgctgaatcaataggattaattacaataatacctctttttttctgacacacaattattattttgtatttaaaaattatatttaaaagccccaaattctacaagatcaaaattactctttagtaagtcttcttttttatttgtaatttctgggggtacataatagatattttagtacttgtggaagtcatttataaataagtaaacgcatgtttgtgcatcctgatcctttgtctccatgttacctctgtgcatctggttcatgttaaccctaacaagtcatgttgtctggatacagctttccaggtatttgccacttgtgaggacccaagggctaaagtaaaaattatggctgtgtcctggggcgggggggggggcggggaagaggcacaatcgttctcaaccctggatgttcattcgaattacctggttggatagttttttacagaaccaatacctgggctccattcccagatattctgattgaattgttggggaatggggctgggacgtcattttgaaaagttctctcagtgattctaatcaattagtacctttttatattaaggcattatttatataaattccactaattcacctatctgtgatagtttgaataaaagccggacttaaacattacctcaattaataactttctgttttttaacctatcttggatttcttttcttttttctctccctcttttattattattattatactttaatttctaggatgcatgtgcacaactcgcaggtttgatacataggtatacatgtgccatgttggtttgctgcacccatcagctcatttacattaggtatttctcctaatgctattccttccccagcccccaatacctttcttaatagagaatgaaacaaaagctgaaacaaagttgattttaaaaattacttatttaagcagatgacagcattctagaagcatctagttgcatataaagaattgttaagctaaaaccaaaactaatctatctataagaaccaccttgctagaatttttgagccatcgttttgttatttttatctatttttttaagacggagttttgttctttcacccaggctggagtgaagtggtgtgatctcagctcactgcaacctctgtccccccgggttcaagtgattctcctgcctcagcctcctgagtagccgggattaaaaagtgcttgccaccacgcccagctaatttttgtatttttagtagagatggggtttctattggccaggctggtcttgaactcctgacctcaggtgatccagccacctcggcctcccaaaatgctgggattacaggcctgagccactgtgcccagcctgagccatcattttgaataagtaaataaatcaattccaattttcatcagtacaattttagtttctaaatggcgtgcatttaaaagtaaaaacatgcattaaaaattaagtttctctaatttgtactggtatctttcccttaaatcatattatacaggttttatttctgacttaaatcatgtaattgtattttacatgtaagacatgtcaattgaacatcactggtagttcttttctaatctagactttcattataatacattacctccttttattaggtgtatttttttaaattgaggattgcatatatgccagtaactgtgaattctagggaattgggcctgagagcctgtcttcctaaagagctcacacctcttggtaatttgtaagttttaattgtagtcctctaggttttataaagtctatccatttatgcctttattagttagtgcctagcatatgattatgttttcataatatatgtttatacattttataatgtatttccataaagcacaaaaaatgctattaggaccatcaaatacaggctgaaattaatgaaaacatgtactattttgcatttataaatttgtatatggaaaatgaaaattttaaaaaatgctattaatgtttattgctagattgctaaacttaggatgtcattcctcatagacattggaggacaaaataaattggtatggataagtacttgcaaataaggattcacggatattggtaatctaattatctgtcggtttatagctgtgctgtccaatattgcagccgctagctatgtgtaggtaaattataattattataattaaatatagttaaaaattcagtttctgagccttactagccatacatatttcaagtgttcattattcccacctgactagtgtccattatatatgtatacctatagtgcacacatagaatatttacatcattttagtaagttctggacaacactggttaaagaataattgccttcctacattctttcttttttgttttttgaaacggcgtttcactctgtcactcaggctggagtctaatggtgcgaactcagctcactgcaacctccgcctcccgggttcaagcaattgtcctgcctcagcctcctgagtagctgggactacaggcatgtgccaccactcccggctaatttttgtatttttagtggagatggggtttcaccatgttggccaggatgctttcgaactcctgaccttgtgatccgccgcctcagcctcccaaagtgatgagattacaggcgtgagccatcgcacccagccgccttcctacattctaacagagtttctgtaaagcaaagctggcattcccattgaattcctttatgttcatacagatacgttttcatgtccgggggtgggatgacagctctcgagtaaaatcatttgaaaaatactacgtcttagaatgccatttactgcaaatgacaaaaaggccaactcaaagtgacttataccattgctccttaaaatgtgattaatggatccgaagcattgatatcccttgggcagttgttagaaatgcagaatctcaggccccaacccaggcctactgacttagaatgcatagtttgacactctccaggtgattcatatgtacattaaagtttgagaaacactgggcacaatcataaggatgtctgttatctaacaatatatcaaaaatgtcgttgacgctagagaccattaggtctgtaactctatgttgccaaagttccaagttcttacaacttatctgttttgctagcccctctctattctcagatgatctgaacgattggaagtttaccgtagcagttcctagtatcatgtcctgatatgcttttgcctatacctactgtcaggaccaactcctgccctatactactttattctaattccactccctcggctctctattgccagtcatatatgtatactccattcaccttttgcttttactttcccgtctaaatgacgacttgaaggatataaaatgaaacctggaaaaatgcaaacattttttcctatctgtgcatggtagatttttattttgtgactttgacaatttttccaaatttatttacatctttagaatgttagctggaaataagaaactcctgtctcattttcatcatgttttaaattgaactatatgaagccattttcatcaacaaagaaattgaaatatcagaaatttcatatgatctaatacaatattttgcccatgaaaaaaataaaatagtgcacagtcttgggtcacacagggtttgtgatttctatactggcttcacatgccactgtgccagctctttaacctaccactatcctcagaaataaaataacagtagctaggtgcggtggctcacgcctgtaatcccagaactttgggaggtcgaggcaggaggatagctggagaccaggagttcaagactagcctgggcaacatagggagaccacatctatacaaaaagagttaaaaatttgccagggaaggtggtgcacctgtagtctcagctactcaggaggctgaggcaggaggatcatttgggcctgggaggtcaaggcttcagtgagttatgattgtgtcactgtactcgagcctgggtaacagaatgagaccctgtctcaaaaaaaaaaaaaaaaatactagtattataaatctttaccttggcaaggttatgttaaaaaaagttgaataaatgttagccagtgtattttacaactaatattaatgacattttaacccagaggttaacctccccactccctgaagtcacccctttatttaaaccatctttgggaaaaaggacatttgtgtcatgaaggctgttaaactcaccttctgatatcagtgcctccttcaattttgcttcttcctctggttcagccttgcaatggaccactactcacttccttgctaatcacccagaaaactctggcctataattcacctgcactttactgatgctcttttcacaggcctcagtgaaggaaggaagcgtcctcttcattactagttatttcaatctttagagtttttcacatatcagtactgtaataaagcccttccttactttactgaagggcatacttgggcattctgagtctgataccctttgatacttccctgccagtgtcacataaatctatatcttctgagttttagcagtagtaactaatagatcgaacacataccttaagtagactagcagtggttttcaaataaataatattcttacctggaatgttgtcattcaaagtgtgatccatgacccagcaacattggtttcacctggaagctggttagaactgaattcttcgacccaaccccgtgaatttaaatcagaatcaccaggtgggctgtatccatatttaagtttgagaagctgtgatcaagaccccggggggcaccaaatccaaatgcctattgtagaagccagaaacataacataaggaagtgagatgagttgcgtataaaaaaggatagggagtgatgaggactacagcaaactggagagcttatactttgtatatgaagtataattggatgcgaagtataattggatgtgaagtataattgatactcaattttgtcctataggaaggaaggtttagggttgctgaatcctattaaatatgatcaagagtggtcagatttgatatttgtagctaatatctcaaattttaactactggcaaaaatttcaatttattttcaattagtatgagaccaaatccagcatatggactactatttgctaatatctagtcaaggcctgtagtaaggaaaagaaatattttctcaattaaaacatctcagaatcctttccaacaatgggatgaatgctttttgttttcgtgcttattagtatcacacctccacaatccttaggttcttctgttttcaaacttgttctgaggttaatttcatgcttcagacacatgaaatcctgctttttggagcctcaggtagaacccattctttggcagttggcagtcacacttctctctgtaagtggaggtgaagtcaggaagagaatgtaaaagtctcatgtcaaaataattcatagtaatctcctggggattggcagttgtcctcctattaatgttaatatcttggtctctgcagaatttgggtgagttgtgtttgtagaataaagttacctagagcagtaattttcaagtgtgagtatgcatcagtcacctggaagtcctgttaaaatacacatttctagacctcatcccagagtttctgattcagtaagtgtgagtcttgcacacacttctagcaagttttgaatttgcacttctagcaagtttctaggggatgggctgatgctgttggtccagggtccagtaaccacactttcagaaccactaatgaagagagaaaaagcagggctctatttggctgggagacattgatgtgactgtaccagtcattaaaatattgagccatcccgtttgcacacacccagccattctggtccctaccccaaaaatccccaaccagatgtttctgtatcccacttataaagagaaaacacctggctgggttcggggactcgcgcctataatcccagcacttttgggaggccaaggggagaggattgcttgagctaaggagttgaagaccagcctgggcaacataatgagaccttgtctctattaagagaaaaaaaaaaaaagaagataaaacacttatgtgtacatctcttcttattggtcaatctctgagtccaagtttgtaaaatgaaaccacgatagaacatgaaagattactgggtgttcaaatttcagatttggggcagagctcaagaaatctctgtggacccacagattaaggtaggctatgatactgtacaaccatcctgcaccttgtgcgatcaagctgcactggatttccggttcctctgtgatgtgacagggcctttcacaggtctttctttccgtctagaaagagtttataccttctttttcactacttctgacttcagtcttcacagttgtccagtactgcactaaaggcccccctttacagactcaattcaattgctctcatttcatagtatgatcacattataaccaactaatggcctgttgagctatatgtattatctgtggccctcacccgccatccatataaactccaagatagcaaggggctgtgttggtcttccttgcctctccatccgtagtatccaggtactcaataattgtatatttcgtaaattaatgaatgaatttttcaagtctcaactcttaggctgtgtgttctgcgaggacactgttcccaatgactgcaggtcaatttgtatcctctccttactccctcaggaatgtatataaatctaattataatggatttcttatattctaattatttttgtatttatgtctctaatagtctctaagctacttgaaattgaagataggtattttgtccattcctaacaaatatgagtttcctgcatagatatgaaactcagtaaagatttgttgaaggaaatgtctgtccaaaagcaaaaagtaaatgatgctttcaaatactagcaactttcagtttttgcttccacttaaatggatatctcatctctgttgtttctcataaaaataaaatgtctactttttgtgtttgataaatgaaagtttattctcataacttctgattgcaatgttcctcatggtaaatgtgtctctaaaatgttaaaagtcaataaatagtgcaatctaaattattgtaaacactctcaaaaggaatatgaaatgcatattggaagaaagctctgataacaaccccaatacttcggaccagctatggagccattatcttttatattttattttactggtttacttcccctgtttccctgtaattttatatgaagagtgtgagtggtatgtaacattacatacaggttccatgttggggtttaaatagcctggcattagtgtatgaggataaagatgctgatggaattttgtatccttttgttttaaatacacttatactaatttaagtattttgatagttactctgtttagcagattcatttcacttttctccttcttgctctgttcaaagaggatgaagtctagattttctgttacccaggttcctcttggcctttggttgctaaagtacttcagccaatgggaggcactggcaagagggtgaaagcagagattgtggtacttttctcttcctcttctgtttcttactgtggagtggctggaattgtgttcctcttaaactacagctactgttggacagctcttgttccatgtctctaattctcactgagctccggcaacagctctcttccttttttcttccagttccggggatgctaggtcagttgtctttgttgttaggtcctggctccttcactatcgtttattatttttcccccgacccttcacataaatgtgtaagtagtctactgagcgaaacatatttgagtgtgttctatctttcctgccaatagtatgcagcatccacacacacactcaacagacccaacttttatattttattgtttgaaatgctatcaatttctaaacattgctttttaaaccctactttaaattgacagataaaattgtatattcatcatgtacaacgtgatgcttctgagtaaatatatattgtggaacagttgaatctagctaattaacatatgcattaccttacatatttatcatttttatggtgggaatatttaacgtcctctctctctacatttttcaagagtatattttcattagctgtagtcaccatgctgtaaaatacatcacttgaatattttgactgtgactatatatcccttgaaaagtatctccatacctcccccttccccataaccacctcagcctctggtaaccactattcattccctacttctgtgggatcagctcttttagattccacatataagtgaaattaggcagtggttttctttctttactggcttatttcacttaacataatatcctccaggttcatccatgttgttgcaaatgacagtattttattcttttttatggctgaatagtattccattgtatatatgtataccacattttctttatccgttcatatgttggtggatatttggattgattccatatcttggccatgaatagtgctgcaataaaaatggtagtgcagatatttctttgacatactgatttcatttcctttgtatatataattcatagtgggattttgtatcatattgtagttttgttgttcatatttcaaggagccttcatactgttttccatgatgcctgtactgattgccattcccatttacagtgtgtaaaggttttcttttttttaattagtaatttttaacttttgcaggtacgtaatacatgcctttttcctaaatcgttatcaacatttatctttttttgttttggatagtagccatgctaacaaaagtgaggtgataatctcttcttttttcttttgacaaagatatcgttaattactattatattttaacttttaggtgcaagggtacatgtgcagttttgttacatgggtaaacttgtgtcatggaagtttattgtacagattatttcatcaccaggtataagcttagtactcattagttattttttcctaattctttccttctgccaccctccaaactccaataggccccatgtctgttgtttccctctatgtgcccatgtgttctcatcatttagctcccacttataagtgagaacgtggtgtatttggttttctgtttctgcgttattttgctaaggataatggcctccagcttcatctacgtttctgcaaagaacataatcttactctttttcatggccgcatagtattccatggtatgtgtttaccacattttctttatccagtttaccactgataagcatttaggttgattgtctttgtgattgtgaatagtgctgccacgaacatatgtgtgcatgtgtctttttggtagaatgatttatattcctttaagtgtatacacaataataggattgctgggtccaatggtagttctgttttgaggtctttgtggaatcaccacactgttttcaacaatagttgaaataatttacactcccacaaacagtgtataagtgttcccttttctttgcaagtaagctgatacctcattgtggttttaatttgcatttcccagatgattagtgctgttgagcattttttcatatctgtgttatccatttgtcccttttatgataaatgtctattttggtcttttgcctatttttaatcaggttatttgttttcttgctatggagttggttgaatttcttccatatttttatatgaacccccatcagatatatagtttgcaaatatttttctcattctattggatatctctttactctgttaatttttaattttaattttaatttttttgctgtgcagaaatttttagtttggtataagtcctcagtctatttttgcttttgttgcttgtgcttttacagtcatattcaaaagttattgcccaaataattgtgatgaagcttgtcctctatgttttctactaatagattgagagttttgagtcttaaatttaagtttttaatccatttcaaattggtttttgtatgtggcaagggataagggtctaatttcattcttctgcatgtagattcttacttttcctggtagcatttgctgaagagggtgtcctgtcctcacggtgtgttcttgacacccatgtccaaaatcagttgaatgcaaatgcattaatttattcctgggttctctattatgttccactgatcagtttttatgctaatacaatgctgtcttggttactatggcagaatttcttctagttgcgtactttgaccttagtgggaaataaaaaacatccttccaaagaaccatattattagtgtttccatattgatcgagtatcttctgttttttttattggttaacactatcatatatgggtatactaagagactcctggcaaatgcccatagttttctaatgtagtactacttgccccgcattgtattgggtgaactcagttgaccatttgtgcttaggttctgtatggtaacccctttctctgtctgtggattcagcagcatgaggagccaaacatgaacagcggtcatctcaacttctagtttaaagaaatcatttttgagtttcttataactcaaaatgttgaagaggtagttcaaaaaaaagttgaagaggtagttcacagataaggaacagaagtcacaaggtggagagagatggataaattaatattaggttaatacagatgagataattatatatagaagtatttatgggtgagtacacactcacacatccacttctttatgtcaacccagaggtcctgtaagctacaacaccctagaagcaaggagcatacctagcaacaggatcttgggtttcagtaacattctttaaagaaaaaaaaaaaaaaaaaaaaaaaaaggaaccagaacactgtggagaaacagctgattctaacactaggaaagggaatatagaaaatgagcctggaacatttggtagtgccagatagtaagaacatgctaaactccacggtctcgctctaaacaaaaaacactgatgggatgtgtcaaagaagccaactaagagacttcccaatgtccaaagctggaactatttgagcaaaaatccaaagcaaaaactagtattggatttagcccaaagtatcaaataactatacatgagtccatgctatgtaaataaataatttcataaataaatggaggaatagagacaaatctccaatgcagaaaaaactccaaaaacttatgtaacttctctgccctcacggagagggaatgtaactccccactccacaggggctgtgtatagtgactttcttattaaaaaacagtgtgaaaagagggggaaagagtaactttatagtggataaacatgacacctattactttagccaggtggtcacatttaacattgataagtcacgttgagggtatatatgctttataaaatgtgcttaaaatggcccattacttctgtggtctttcaaaaaccccagtttaattatgaggaaaaaaaatcagacaaatccccactgagaggcatactacaaaataccagcctggccagcacttttaaaaactgccagaaaaattctgagaaactgtcatagccaaaagcagattaaggaaacaggacaattgagtgtaatatggaatccttggagagatactgaaatacaaaaaatagtttaaggaaatcagaatataataatagtctccagctaatgcacaaatattggttcattaattgtaagagatgttccataataacataagatgttaataaaacgggagactgagtgcaagttatatgataactctttgtattataatctcattaatttttcgtgaatctaaaacagccaaaaaattaaatctgttaaaaaacactctcagctatgtgtgcactttgtgtgtttaaatgtgatgattaatggaaacttccagtaaagattttagagtaaaattatgtattcaaaataacatattcctaattcaaattataagatcaatgttcagaatatagttttgaaaaatgctttaaacatgatgtttataaagagtatttcctttaaaataaccatcagcacttctcatttgcatctcaaattttggttgaattaatgaatgaacaataatgtgttttcatcctcaacataaagttgtgtaattaataggcaaaacattatcccatgtccctgatgctggaaatgtaattgagaacgtttaagaacctggttgtagagcttaccgctgggctgtgaacctaggcctttggactttaaattcattacccagcccactattttctatatctttgtggggaaaaagcaccctttctctagtctatttgtgtgtatcaaatgacgtccaaacttaatgggttaaaacaatttataattgcgtcatgatctgaagaccgagaatataagcagggctcagccaggttgtttttatattactagttttatagctgggggtcaccccttgggctgtgctgagctggaagctcacttctaatacagtattttatcctgcagaatcactcctatatggtctctaatgattcggtagtgtagcctggcctcctttacagcatggaatctaggcttcaagagaggaagaaatacaaatgctgccagttcttttatagcctacacttggaattggtgtggtgtcagttatgccacattctgtggtcaaaaaaaaaaacacaagtccagatcatattcacagggatggaaaatagacctcatctcttgaagggaaaagtgacaaagaatttgtggccatctttaaccaccacacatactaaataatgagaatgtaaacgaacaactgccaaaatatactacttagtcaattatcagatgctttgcacttcagttagcatgttcacatttagttgactatgtgaaagtttttagaaatcaggatttgtgaactattataagtctgagaaataatagttccggggtgactgatagtgggctttacttacatccttctcaatgtccaatagatgcccccaaatgcgaacattccatatattataaattctattgttttacattgtgatgttcagtaataagttgctttcaaagaggtcataataggcttctttcaaattttcagtttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtaggtgtatcttatgttgcgtgctttctactagaaagcaaactctgtgtatagtacctatacacagtaacacagatgacatggttgatgggagagaattaaaacttaaagtcagccatattttaaaaattatttttacctaattgtttttgcaatctttgttgcaatggcttgaataagtcccctccaaaattcaggtgattgtattaggagatggaatatttaagggtgaataatccatcagggctcctcccttaagaataggatcaagtcccatataaaagaggcttcacacagtgttctcctatctcttgaccctccaccatgcaccaccatgtgaaaactctgtgaaaaggccctcaccagatgctaacatcttgatcttggatttcccaaactcgagaactgtgaaaaaataaaggtacattcttcctaaattacctcattctcagttatttttgttacagcagcacaaaatggattaagacatttgttgttgtttttttaaaaaatacagcatagctaggcttttcgtatttggaaaagaaatcaaacatatttgtggatgagaacaacgcagggtatgtgatttattaaaaatttgctttcctggaagacagacttcatagggattacttgtaatgcaaatttaaataataaggctacgattttttttaatgtaattttacattcaatttatagtaaattgaagctggccaagcttgatgataaatgagagtctgaagcattgcttttctatagaatatgacattttttaaatgttaatatttccatcttttttcttcagtttacttgtacatttccagttatgctccctcgctgccagaaagcatttttttttgtttctgttattgagacttctacaataatatttcttatccaaaattatgagggtgctttattttaataagtgccataaaatattacaattagctctgagttttattgttgaaataggctcctgctcaattcatgaggaaacacacacacacacaagatcctttgtaattgtcccaggattagggttgccacatttagcagacacaaataaaagaagcctacttaaatgtaaatttcagataaacaacaaataattttcttagtgtgtgtcccaaattgttcattgtttatctgaaattcacattttgctgagtgtcttttattttatctggcaactctacttatgatctgtggtttttggatttatggctttgaataggaatatctgctcctttacctcataccttcgaaatctgccttttgtcaaacttaattctctctttttataatattcagtcatatatagctttacagttcttccatgcaaatgaaagatacatttatttctaagttctagagttttttttaagtttaatgagcttcagttttgaatgacaaatggggccagcccttactattattgacccccaggagtcctctaagatctagcatttaagaagaactgtaactatggtaatccccgtctgctatgccatcaggaaaaaaacatcaactgtattgcaattatgtagaaattgtaactgtgattacttgtcatatagatactaattgagcacctgaagaagaagttaggtacagtgctagttctctaaccgtaccgcttttccgatgtggcacatttgcttctctcgttgacactatatctgccctctttcccttggcctacactggaagttacatgcagaaagtgtctatataaaccaggggtgtccaacccgttggcttccctgggcgacattggaagaattgtcttgggccacacataaaatatactaacactaatgatagctggtgaactaaaagaaataattgaaaaaatattttaagaaagtttacaaatttgtgttgggccacattgaaagccatcctgggtcatggattggacaaggttgatgtacagcaatggcttctctctaccggagggtatttctggtgcagaaccatttcagccagtttgaaggtggacaggaagtggaattagtgccaccagagctgcccttagccaatgaggagtaaaagttgatagagaaatcctgtagaatctttgtcccatagtgggacatttctaaggtatattctccacagtctttcagagattccccagtaagactgagctccaggtatccacagggtaacttcctgaacgtccccgtgctctcataatgccttacgagttcaccctccaaataaaccatttatttgttcacaaatcttttgttcaggatgtgtttttggaggaatctaacccaagacaaacttctcccactagaagccagaattcgagctccagttctaccactaactaaattgtcattttccaaacatcacttaatgtcccaggttctctgtatctttactttggaaataaaagagtgagtttgtttctagtgttccttccagtcacagtttaaatgtgtccaatacttttggaagttgaagtattttagaaaaggccaagattaggccacgtaacactgaacatcagaaggcaggacactgctgctggatgcctggagtgtaaagcgaaatccagggagaagagctccaaaagagcagtagaagaagaatgttagcatagctaagtacggataacctagggcagctatgaaggaagttcttagcttgggacgctgaacagactcttcattaaggtgagacaagctatccaggatcttaatattctgccaggtacctgaaatgttttgtagttttttctgaaagatataatgtgaatgaaatggaaaacgtttgacaaatattgtcataaaatttaaatatattattcattacttgaaagtatgccatttctaatgactatgaaattgccttgaagaaaaaatgtgaaacaaaagaaggcaacaggagtatatgcaagttgattatgtaacattttacctccaggcattatttatttatttaaagggcataaagaggccagaaggcattggttttctggctcagagagtaaggccaactcctacttttaactatttgagcactcttttttttgacagatttgacaatattttttgaaatatttgacagattttttttttataaaaattaagggaaagattcatattcaagtcctgaatattgataatgctcttttgtttcttggcaacaattttggcgagaagaaggtgacttaacatcaaacaatttagcaaagagttgactttatttaaacctgaaacatgtacattatattgtcttttaagactaaaaggagcatacatacagaattaaaggaacactgttttgttagtcttgccacacttcataaaacaaaagaaaataaatgttacttctttgggtaactgagttcaaactaaagccttatttatatagtcgttgaatcgctttgcagctttttttcccaagaattgtaaatcattgaaagtaaggaaatttctccttctgacaacaaaatgcatcagtaaccttagagtccccacaaaagcaactcccatctgctgcatcaccaaacttctaacctaatataatatttatttttagctttgtgtagatagacattaaatccttgtgccatcaccattttttcttaaagatgattgcagatgacaaaattaaagaaaagatacagattttattgctgggaattgatttaaattctgctcagatcagaggtcgcctgctctctctctctcaactggagggcaagattaaaatgtttgcaaatcttgcaagtacactgtgaatattacagatatgcttctgtatattctgtgacaggatcctttgctatcttcatttcaacagcattttattatgaggcaggctagaaattcagacactgtgaaatgtcaggaagataagtcacttttactgaacctggcaattaggtaaggtaaagcaattgatcctatatggtggttactattaaatctagccaaactctttactctgggtaaccaagaaaagttcaattggctgcaccatttgggagaaaccactcatccttcatagacattgctgtagggagagaatttagaggtttgctttagctttgaggcacccaagagtgagtctttctggggagtaaacaaatcgaacctctcattcccctgtgaaaaaatatatcacatataattctagctggtcttttttgtcttaaggggtagaatttattagtgatgttgacaaagaatgaaaggatttccctcgaaggagtggcatgatgctattgaggaggaaaagccttgagctttcattaatagtaaagaagtttgccattttggaggcatttttttcaaaaggaaaatatttaacagtgaaatcttttgtctcctggcacagtgagactgcgatgaagtttaaagctgagtttactagctaggttttccattcttttgagagatttagacttttgtgcatagatgcataaccttggtgacagcatcaacaaagactttacaaattacaagaatttgccgatgtgaatatatactctatattctgacttcagtgaaggttatatgtgaaatactgattaatacaaactaagtagcctcttagaaactcagtcacctatccttttcttgaaggttagttaaaggcagacatttgggttgccaagattgtgaaatatcctcatctggtgacctttaaaatgatctagatgttcatgttacagagaaggattaggtataattctgccaaaggatctgacatttcatttcattccattgcattctattccatatcactgaacaaaccctcattatagcacatgggtgctgtgaagaatgcagaaaccaatcatttacgatgtcttgtactatactgaatgctggaggatttaagcctgatcatggagggtgatcatgagtcttatataaaagactcaggcatttgcagtagtagttctatgagtaacaggaaaccattattcatgagaaattaaactagaaatagcagcaatttaggaaaacttatcttaatatttaagaagatattttttgaggataaataaaagagcagagaaacaggaggccggaaaacatgttaagaggatattgctgaaagtatatagagcctgaatgaaagcaatgacaacaaaaattgtaaacaggtacaaagcattctggatatcaaatcaaaaccaataggactagatttaggatatgaacaaaaagctcaaagtaatagattctgggactgggcaattgggacttgagattggtaattaagaaaataggcagtgaaaaagagaaatgcaatagttggaagaaggataagtgattcagttaagtttgacagtgccataggatcaagtggtgcttttagtggttagcaaactcactctcatatttagcaaggttaaaattacatgttgtttgtttctgctatgaagtttcattttatttcctgtcttttgccctcataagtgcttaatgaaagtttaatggttatgatggtaagggggataaacactataatctgaaaaaatactgtattataaccagagagccagatttcttttgtgttttcagagtgcttagtcaataattgatgctcagtaaatgtttttagaacacatgttctgattatattgactagttttattatccaaatcgtctccatcatggctaactttctgacaagggcatgaaagtttgataatttcaattaaaacgttgggcatacagcaaaaaaaaattcataaagctgtagaaaaatacatctgtaaagtggcttacctggtgatgttatctctggtgtcttcaatctctgactttccttttttccttctatctctgttgcattcccatatgcaaatatcttaatagtgctaaaccattgactatgaaattggtttgagtggtagtattattttgacataaatgattggaagtttatgtaaaaaagaacatcacacttttatagtctacgtagtagtatgtgcatgatattcagttacaatttttaaaatcgaattgagaagacatctaatatcccataagaattctattaacaagcatcatattccaagggtatatttgcacagtaatgctatagattattaaaataataataatataaaatccatgcccatattcttattttacaaatcaagtatttctagctatcagattattatttactttattagaaattactgagtattgattcagtaacattacttagaatgtcacagctttgtttgacagtatatcggtatagctacgaaaattatacctgatcaagactctgtcatcttagaggcactaacattagttattatacttcattactcttgtaatacttcctcatgagaagacactgacctctccaatggtgtttaaaggaaaaaaataagtaccctatttctaatttactgagttagtctcatgtaaaatgtctctctctctctgaaccagtactgtaacaatcaatttcagttctttcgtataggtaatacaaaattaataatgtagataaactaattataaaaaacattttaaaatgcattttagggaaaccttacaagaaagctaagacacacatgataacatgaattttaaggcaataattttccttatcaaatgtatgaccgtatcttataacaaaatgcatgtccgtaaatccaatcccgtgttaaaatataaggttgaatatgatactttttctgaagaatatggagaactatcctgtttaatatttctgttatgaacagaatttctagtggatttctaatactagtagatttctactggtacatctggtagtactctcttattcattggaagtaatgatactgtatcctttaacaattaaatttttatctaagtcatatctagtaagactaaaaaagcactaaactatttttacataatggtctacagttttggcacactgaggatatttaataatggaaatataatgtgattaccaagttattagaaataaatagtgatgctcaaaagggctatttccatgaatctcagtgtaagaatgcaaggataatgtgaatacgtcagaaatgaaagaaaataagcatttcctcaccacctaccaaatctaagcactgtacaagctgaagttaatgtattgtctcatttaactctagtaataagcatgtcttagaagaagttttaaaatagattgagggggtgcatgtgcaggtttgttacatggatatatcgtgtagtggtggagtctgggattttagtatatccataatctgaatagcgaacactatactcaataggtaatttttcacccctcacccccctaccagcctataatcttttgtagtttccagtttatattattccactctagatgtccgtgtgtaccctttgtttagtttcttcttataagcgagaacatgttgcatttaggtttctgtttccaagttacttcacttaggataatggcctatagttcctattcatgtaactgcaaaagacaggatttcatactttcttaggctgtgtagtgttctgtggtgtgtgtgtatatatgtgtgtatatatatgtatgtgtgtgtgtatatatatatatatatatatgcgtatatacacacatatatacatgtgcatatcacattttctttatccaatcatttactgatggacgcttaggttgattctttgctattgtaaatagtgctatgataaacatacaactgcaggtagctttttcatgtaacactttttgttgtttttgttgagtatatacccagtactaggattgcaggatccaatagttgtgttttaagttctttgagaaatctccatactgttttacataatgtttatattaacttacattcccaccaagagtgaataaacattttcttttctccacatccttgccaacacctgttgttgtttgacttttttaatgacaggtatccccttaaaaaaatgagatactgtcatttggaacaatgtggatggaactagagatcgttatgttaagtgaaataagccaggcacagaaagacaaacatctcttatgttctgacttatttgtgggatctaaaaattaaaacaattgaagtcatggaaatagagagtagaaggatggttatcagagactgggaagggtggtggaagggaggtggggatggttattgggtacaaaaattacagttagaaagaatgaaaagacataatatttgatcatatcatacagtaactatggtcaataataacttgtacattttacaataactgtgaaagcatataattaggttgcttgtaagacaaaggacaaatgcttaaggtgatagatactaaattctccatgatgtgattatttcactttgcatgcctgtatcaaaacatctcatgtaccccacaaatacacctactctgtacccacaaatttttaaatgacattgaaaaaaacaaataatagccatactgattggtgtgagatcatatctccttgtggttttaatttgcatttctctgatgattagtgatgttgagcattttctcatatgtttgttggccacttgtatatcttcttttaaaaaatgtctgctaatgtcctttgcctactttttaatggggttatctatttttcttcttgttgagttacttttagattctagatattagttttttgttagatgtatagttcggaattgttttccattctataagttgtctgttcattctgttgattgttttttgtttttttgtttgtttgtttttgctgttcagaagattttaaaattaagttccatttgtctacttttgtttttgagtacttagtcataaattctttgcccaagccagtgtcgagaagagtttttcctaggttttcttttaggatttttatattttcaggtcttacatttaagtctttaatacattttgagttaatttttgtatatggtgatttatgacccagtttcattcttctgcttatgactatccaatatttacagcacaatttactgaataggatgtcctttccccagtgtatatatacatttttttactttgttaaagatgtgttggtcatagatatgtggttttatatctgggttcttaatttggttaaatcaatctatatgtatctgtttttataccagtaccatactgttttggttactgtagccttttagtataatttgaagtcaggtaatgtgatgccttcaactttattcttcttgcttagcattgctttgactatttgggctcttttttgattctctatgtattttactatctttttctaattctgtgaaaaatgatgttggtaatttataaggactgtgttcaatctgtaaattgctttgagcagtgtggttattttaacaatattgatgctcccaatccatgagcagggaaagtttttccatttgtttgtgtcatctatgatttatttcatgggtgttttgtagttctccttgtagacacctttcacttttttgtttaaaggcattcctaggtattttttttttttgtagttgttgtaaatgagattgagttcttgatttggttctcagcttgatcattattggtgtatagaaatgctaccaattttgtacattgatttcatatcctgaaactttactgaagtcatttatcaaatatagggtccttttggaggagtcttaagggttttctagatgtaaaatcctatcatcagtgaagagaaatcatttgactttctttttcccaatttggatgccttttatttctttctcttgcctgattgctctagctaggacttccagtactatgttgaattggagcagtgaaaatgggtatccttgtcttgttgtagttcttgggggaggggggtgctctcaacatgttcctgtttagtatgatgttggctcttggtttgtcatatatgacttttgttattttgagatatgttctttcaatgcctagttgttgagggtctttatcttggggagaggctggattttatcaaatgccttttctgcatctattgagatgatcatatgttttttgtttttaattctttttatgtggtgaatcacatatattgctctgcatatattgcaccacacaaaacatatattgtgttatgtggtgaatcacagatattgctctgcatatatccctgcctacctggcataaagctcacgttattgtcatgtattatctttttgttatgcttttgggtttggtttgctagcattctgttgaggatttttgcatctatgttcatcagggatattggcctgtggtttcctttttgttgtgtccttacctgcctttggtatcatggtgatactggcttcgtagaattaattagggagaatttcctcttgtttgatattttgcaacagttacaataggattggtaccagttctttgcatgtctggtagaattcggctgtgaatacgtctggtcctgagctttattttattgggagatatttattactgattcagtttcactatttgttattggtctgtccaagatttttgcttcttgtggttcaattttgggagttgatatgtatccaggaatttattcatttcctccagattttctaatttgtgtacctagagatgcccatagtagtctgataatctttcgtatttctatggtatcagttgtaacgtcacatctatcatctctgactttgcttatttgattcttctgtttttttcttggttaatctagctagtggcctattaattttgtttatcttttcaaagaaaactctctaatttttttaattttttgtcttttattatctcagtttcatttagttctgctctgatcattgttatttcttatattctgctagctttggtttcggtttgttcttggttttctagttcattgaagtacaatattagtttgctaattttagatctttctatctttttggtgtaggcagttaatgctataaatttccatcttaggactgcttttgctgtatcccagaggtggaggtatgttgtatgtctctttttatttgtttcaaaaagttttaatttcttccttgatttcattgtccaaagatcattcaggagcaggttgtttaatttccatgtatttgtatagatttaaggagtcttcttggtactcatttctagtttttttccactgtggtgcaagaagatgcttgatatgattttgatttttttaaaaatgtgttaagaaccaccttgtggcctagcacattttcaatttttgataatgatccacgtgcagatgagaataatgtacattctgtggtggtagaatagaatgttctgtaagtgtctggcctggaaggatattaatacttgattttacagacaaatagatgtgttcaaagagtttaaggagttgttcaaggtaacttcagtattaattggtagattctgattttaactttgacctgtctgcctttgagaccatttctctccattttgagattccagtgaagcttgactccacctgagatcctagagactagagcagttgcagagaagtgacaaagagatttgaagatgttgtggcatttggattcccaggattgggaatgtctagatagaaggtacagagactgtgtgcatatgagtcttcaaacatagagtaagcagtagtggtagctacacattaaatactcagaatcaaaatgcttaatgaaataattcatcaccattactcctgtagttctttaaaatagaggaaaaagagactataagggaaacaggaatataggcttatgataagaatggcaataccgtctgagcaggaggataatcattggaactgaatttcacaactatattctgttagcagcacaatgcatagcatttcctctgtgctctgcctgaaactttccaccccaactctctcccaataatcttcttttctttttcaataattattttcagtaaaggcattttataattatttattcaatgttattggtttttaatctgattttaattctgtaactatatgcagaatgtatgggtgggtgcatgcatggattgtagaaagagtaggaaaggcaagagaattgagggctaccatttcgtgattagggactgtcctcactccatgacatatgtctgcccatgcaaatttttctgtgataaccatcagatgaggtagtttgaacctacttttattaatgtagtgtaaataaattggaagttcaggtattatttaaggatttaacacttactgtatatttctccagaccttaaaactttgctgtaacttcacttgttttcatgacttttcaaaaatcacattctcttcctgcacttatgatgtctattagaaaggatgatagtcagaatgtattagatgagggtaaaatagattagtattaggttaggtcattgcagtttagtttcaaaactttgatataaatatggctaaatatgaattctttcaactaattagatgctaatatttttggaatttatattgttttccaggcaaaatgcaaaacagttttaccttattcaatcttcttaaccacataaagaaataggcagttttattatcttagttttacaaattaggaagctgaggcttggtgtggttgatgactttctcaaagtcacgtgattggttattgatgcttccaggaattacacatagaaaatctgatttcagatgctacacttttgactacagttttactgtctcctcatagtcatgcacaagttttggtcaatctatttcatcctatgtccttttccatatgtaggagtacattaattgtctactttatttttaaaacagtttcttttcgtatttattgagtccccttcaggctattgagaagcatttagtgtgcttgtatagcctttcaaatctctccattgaaacagtctttcagaacccccatttggtagcttaggagttggcagaaacataaacattcatttctaacaaaaagataaaatcagtgtgttctgatataagaactaataaagatattcaatcacatttaagtaagtgaatatcaaaagcttttctagggtagcctgttgaggaagattatttaaaatattcagcaaatttataacaaagttatataccgtaaatagatcttcatggaaagctagacaatactgtgaccagccaggcttagcaaagtgaatatttcactgcaaataaaatcgaaagtcctttccagatcatatcattcaggccagcaagggatatagagcctagcccagtgtagaggtggtagaaggaatggggcatagaggaaaagagtgaaaaaaataaattacctaccaccccatcatttcccaagaaatcctaacactttctgatctgtacttgaagtttttatttgaaaaaaagtcaattcctgtccagatgtcttgaattaacatgatcattagtatctagggatttttttgttcatgagacagcttttttaagatacttctttcctggatgttagactcaactctattcctagaaccttctgaattcttaatgtcctttgcaaattttatgtttgctacaatttttttctcgttagtctttccttatgtgtgcatttattgagataaactacaaactactgaatatttgtaattaaacatctaaatatattaattttaaagtcatttttggagacaatagattgccttccaattcatgatgaacagcgttctgtgttgtttctaggggtgtgttttgtgtgtgtgtgtgtgtgtgtgtgtgcgtgtgcgtgtttgtgtgtgtgtgacctgcaagtaccggcaattagctgttgggtattcaatgaagtcggaggagtagttaaaaaaaaaaaaaactttacatataggtaacagctgttcttttcctgttctttccatagctgagtctatgctatggccaaaagaaatagacaagtaaaacaaaagcttctcccatcgaatttacaggatacccatccttgtttttgttttctattatactgcctttcgattaattattgctcttcacctttaaacatcaaatcaaaaatttccctagccttacataattccatgtctttatttcctaagtattattttacatgtgttctaagaaagggtaaaatagcatagatctagaataaacactgaagtggctctccagtggtttttctaagccacttttgaaaaccaacttgacatggacaagagccagaagaattcagtatcactgatggcatttaaaagaagtacaagaaaagtcaggtttaaataataaaattgggaacatgtactaagggagtaacaaattttgttaagccctttaactagagacttatttagaagaaatacaattattcacagaggtataacaaaaactgtttgtccaatctaggcattcttaatgttacatctcactgttggccttttctcttgtcataaagaaaaaaatacattatttgacatttgacaacaaacattggtaacatttgtatctaataatggtaatgaaatttaactaggaacatgatagatgtttgaaatctggtaagtgttacaaaagcattcctttaataaaataatgaaaataaatgcataataaagtacctagtatgtgtgtatatatgtgtatgtgtatgtacaatctggaagcttttaataaaggaaaacattttaacaatattatattacaatattttaatttgaaggtattattttctgacagacaaacatttttgtgtacttctctagggatgcatctatatttggaaactatttggctcatatttcaggcttaattagcaaatccaatataaatctccgttgtataaattcatctatgacaaattgaaatccataagaagtcagtatttaaaattgtaattaaatatagccttacaacactttagcatattattttttttaaatactcttgagaattcatttctttccaactggagaaacaggcaggcattctttaccccaatgatcaaggcctttattcatggattcctagtttggcagaacaattgaactttttaactccagctttttatgtctggcgtttctgctacttgtaagaatcagtgtaaaagtaaaccctgaacgttgcatagttcataatctgtattttgctgatattaaggagattagctaatacagttatattcactaatatttatttcgcatttgaagtctgagaaaataggagacgtgcttactgttttaccatagcttttgtcttacagctatttagtgtgctcaaaaaagtcagtttaaccttttttagtttaattcctaattagctgagaaagaagaaatacaattttaaaaagtcatagaggagaagagatactggaaataacattaaatcaaatgtaccttatgcaaatctactccagcactctggactcttcaacgttcttagtcactgtagagagcctttccccactcctttatttccttgtactcaccgtaagtccagagggttcttgtgttagattttaatgctatcatctcacaactctctttagtggtactttacgttagcacttctgccaagcataaaatataaacccttgatcaatatggcaagaatgccatttccaattataaaacaaatagatgaacgaaacaaaatcagaacaactaagtaatggagaatatagtacgtttgatcacatagactttaaaagactcaataagagttggattcattccatggatccaatgtttttcttacacttcttaagtaaaatatattaaaattgtgaaaaagcaatttacatgtaaaaatgaaaactggcattatttacttgtaattttgtaatatatgtaattatatatactcattgaaggacagaaaagaattgactaaattcagaaaaccaacttatgatacactggccaccaaattatcattttaattattatttgaaacattcccggctgacaccttcaaaatgttcccagtcctgtcttatataactcagaaaacacagactcaacatgactgtcaaggacaactctgaattttaatgtttccatttttggcctcatggcaaaaagagttttattaaccattataagctctggaatgtcaaaggcatgataggcagtatagattgcacacacaaaatagatgcatagtcattttattctaaattgcttcacttgaaaatgtagtatgaaaatctagagagacgaagtaaaaagaagtgattttatagtgttctaaaatgttgaggcttcgaaaataagaagcctaggataaaaatgctcatgcatttgagattgtgattcagccatcctaataagttcccttccacctgccatagagtttgaatacctaagagctagactgataggtgctaagcactgttgttttgcaagtagggacagcacgtttgccagaaagtaacgggaaatgtcccaaacttgtttctccactcttgtgttatgtaacaaaatgttctaagaaacaaagtagttgcctagaagtctcaaatagctattcagagaaatcccaataataaatagtgtaacagggtaaggtcttatgggatctggagcacccaggcaacataccttggttctagagcagcctcctttgtttacccctaatttattcctgtgtttacccctgttcatcattacaaaataattgtacatcatgtttttaaaaagattggaaatactgttttgtgacagcctcacttaatagggggaaatgattttttcagagccacatttgtaagttagaaaggcagtatttgaattattctggttttatcctagggttcagttgagaccaagtggttattttctgttgaggttagtgtaattgtgattacaccaaaaatcactaattcttcctattatattgtaatctttgtgcaatcaggaaggaacaaactcatctgtgcatgttttccccaaacccccacatggtaccatttatctgacaaatgtttattgatctttatttgcttgtaatacatagtgagaaggacagagggcatctctgttctagtggactgcctattatagtaagtagagacaaaaggactaagctgatacataagaaattattgagtagtgacaatactatgattaaaaaaatgacagaaatggtgaattactagggagcaacattggatagtttgctcatgaaaagctgctctaggtaggtgacacttacattgagtcctgaatgataaagaaatgatttaaacatctggaagaaaagcaatcctggtagagggaacagcttgacacatttttggaagagagacaaagcaagtcattctgaaacactgtgagggcgagaatggtatacaattagactggtgaggtagtcaggtgctagatcatataagaatttcaggtagagaagttaaattttctttcttagtatgatagaaatctattggtttttataaatcggactgacatctgatttgtagtttgagcggaagggaaaaaacgagtaaaggagctaaaaagtagtgtataggccaggcacagtggctcacgtttgtaatctcagcactttgggaggctgaggtgggtagattacctgaggtcaggagtttgagagcagcctggccaacgtggtgaaatcccgtctcaactgaaaatacaaaaaattagctgggcgtggtggtgtgcacctgtaatctcagctactcgggaggctgaggcaggagaatcccttgaacccggtaggtggagtttgcagtgagccgagatcatgccattggcattccaccctgggtgacacagtgagaatccgtctccaaaatagaaaaaaaaaataaaaaaagtagcacataggtaggagggtaatcaagagaaggtgtcaagaatgagggagtggccaattaggttagtaatcaacatgtcaagtaagacgctataacaaatggttattgaatttaggaacatgaaagttgatggtgtcctttacaaaagatatttcaatgggttagtgggcaaagtgaatagtaggataaatatgtaggcacagtaactataggatacatttgtttttttttttttcagtgaagaggaacacataataggacagtaggaggaccggtttgttggatcaagagtttgttttatttttatggtaatggagaagttcagtagagaagaagagcctgaaaatgccagaagtgctgatagttgtaggaaaaaagtccttgaaagggagaaagggggtgggatgagaaggagaacatcctgctgtacctttcttaacatttgtcttctctagatactttccagttaaattaacaatagaacatataaattttgctgagcgtcatagcagaaaattggcttggaatggttttaggttaataaaaaatgggagtacctgagatgtagcagaaataaatttcaccatttgagagcaaatcatttcaacacacatgtaagaatatcattttaatttcctttaaaacattttatctttcaggtgcttcaagaagatctagaacaagaacaagtcagggtcaattctctcactcacatggtggtggtagttgatgaatctagtggagatcacgcaactgctgctttggaagaacaacttaaggtcagattattttgcttagtaaactaaatatgtcctttaaaagaactataacttgaaaagtattttaaaaatttagaatgcaatttatatattaaaatacttagaatacaatatgtgtacaatatacacacactcataatcagctgaagtgctgtgatttaaagaattccataattctgatacaatagtaactaactgcggatgggtaaaatctaatactttaccagaaaatttcaattaatattaaataaggctgggaagcaggggttgaagggaggttactggttaaaaaaaatttaaatgcagacatttttctaaggcatggagtatttccatttaaaataacaattgaaagcacccatttcatcattagctgacccagtgtgaatagcttttcaatataattcatccaaggtgatgcttgtgtggttaaggcatcttgaaaaacagtccgtagaactcacagatggttgtatggtgggcctatactcttctgtatttgttttctacttgctttcattttcaccttattttctgcctttatttctttggcccaaagacatctactaaatatcggtaaatgtactgattatccctaatttgcttaaactctatctgcatttgtccatgattgcatacccctttaatggctactgccttccagcctcctcttttgtcttcaatcttctttcctcttttgatgttctcattttgcctctatatagctctgtagtgtcatgtgactttaagataatctagactagtatctaaaagggcagcattaaaaggaatcaagtggagagaaagcccttgctataacttttctttgattccatcccatcagttccttcagtcccaaaagaatccatgcttgagttctatactttatttaactattggctggaattgtcgtggaatgctctgcttccatttgactttgaaacagagatgattcttaggttctttgcaagtgatataatcttgtcttacctagtttactttttaaaagcaagaagaagaggacgagaagatggtacagaaggaggagtaaggagaaatcataaagtattaaaagattgataaagtataaaaacataaaaaaatttaacacaaataccctgggtatattataattctagggtagcttcagagactgtggactttaatatgtttaatactggactgagagggattctggtagacgtaattagaagaattacaggaaagagaaacaggtatttggatcccctaaaagaaaaacaatcatcaggactcagagaaggatcttagcaggctttttattagagcagagtctggctatccttaacttattcctcaaaacctattagtgttgagtgcccatctcacgccttctcttccttcgccctggcatccctcatcaccacaattccttcatccattgcactaaaattctgttgaaatgccatccagaggctcaaaaaggatagccagctgtctttggtaaagaggtacagatgggggaaagtaggaagggaagtccccatttagtccaataaggaagagagatgcatacttaacaccctgagttagaactctaaaaatacttccaataggatatatctgcatgtattgatttattctgtaaattctattatgatgatattttaggatttctctaactttaaaatacctttagagtcttctttggaaaaggtttgaagaaaaccaaagacaggtcagaatatatgcttagagtttctgaaagatgacatagcttatgaagtgtaatattctgaaaagtgtgctctccgataattagattctttctctcaaaggttcagcttgtccctcagcaatgttactgcagattagagtcttgtccttaactttagaggcttccaggatgtcagtgcgtagagagtctgtttcataggcagtgatgccagttaacttatttgattgagaaatatttttataaactaaattttataactaaaattggtcatttatatagtcttcagttttagaggtcattaccacatctctttctaagcattccacatcccatttgaatttttttcaacaagtactcgttatgttcttactatgtcccagggattgtgttgggtaaccaggtaagacagttaaaaaaaagaatttgtcactatctaccctggttgcgatgggtaatttgagagcctactgccttccttggaaccctggaacaatggtgactatatctcagtctccctctttgtagtagaatgctaattccttgtcatccatggtcactatgataggcaggtaggcatgggaactgcgctcttggtacatgcaatccagtataaaaatagacattaataaagtatttttaaaaatgagcaaatgttaaagaatggatgcaacttatttataaaggcaaaaaataagcttttgtgacaggaaattactctgacttagactgaactttgaacgcaacagatgattcctgaggaaagttttctttaagctaagatctaaatcatacattggaggaaaatggataaagtgtgcatgtaagtgtcatgggatccttgggtgtcactttgccagccagaaacctctgtggccggcagcacctctgtctgggttttgcttgtgcccgctgggctccttgcacccactcagcctggcaggctgtgcttggcttgcactactggcccggatccccatgcctgccaagggcaagccaggcacagagcagtaagaggtatgtgagcaagcgagcatgaggcctggccactgtgcacagacaggcatgccagctgcagcggaaggcagctacaggcaccagtactggtggcagctccatgtgaggctgtggctggaccagatgtaccacaagtagcttctgctgcaggcaccaatgtctggacaggggatcgcggtggcacctgaaagctcagagacaccaggaaccacagagccccaaggagcatgttacagcatgccacaaccctggcttgaggagccccaaggtctgggctctgcaaaaggccacagctcttctctgtttctcattgcccatagcatggtgagtggggggcatgtttcagccctgtttgtgttacagctctttttgtcctgccattcagcaagtcctgagttcttgtcccatgtccaggaagaatgaggtacatggacaactggagggtgagcaaggtgcagaggagcttcattgagcgagagaacagctctcaggataccacggtgggtagctcctttccacaggcaggtcgtcccagggagtgtgcagctgtgagtagagaggagacccatggtgggtggctcctttatgcaggcaggtcatcctgaagagtcaaggagacacaaagtaggtagctccttcctgcggctggtagtcccaatgtctaagtttgtctgagtctggggtttttatgggctcggaagggaggaggtacattctaattggtccatggacatccatggataggcccagaaaaagcaccataagttctcattctgggccacaaactccacccagaactggcagcccagcccccaggcttcaggccattcttggcttgaaggaggggtttctctgtggatctgctcctttctgcccaggagccagtctgcctcctgccaccatcaacatgccatccatgtagcctaggcagtttataccaaggggtacctgcaggcccacaccgaaccatcctcagtccccactcagcctctctcccatgctcatcagtgcccaaagtccagacgggcgcaaggcagcagggggctggcatgccagcactgtcccgagcacacacataaccagtcaggttgcgacaacacctggtcttggccgcaactttgcttctcccaggagccagtgcggggagcgaggagatgccagggagtgggagcaggcacttcttagtatgtggaggcaggggggcttcccaggcccccaagagcgcaggaatgcccaggtccggagctgtggctgggtggctgcagctgcacctggaagcatggggctcccaccctgccaactcagtagggagcagcgctcctgcttgttcctggcccttggtggctccacacagtgcacagccctggccacgcctcccttgctgcagctggcatctttgcagtggccgctccagacaggctgctgctgccatcataagtgagattggtggaggtgggtagagtttctaggatggataaatggtaaatcaagagagcgtggtttataaaaacttgcatgaaaaaagactataaaaagaccataaagaaagccttttgttcttgggagataactgtttctaataaagaaagaaggagaaacatggttaagcccatagcttatagaagatgctctaatgaaaatgtcttccaaagaaaaagcaaaaccattaaaaccctatttttaggtatgttattctgtacaagttaaaagttgagagccaactatagatgtattgaaggtctgtgtggtcatagaaccaggagaatttctgccatataaaaggcatttgaattattttgttaaaatactttaatattgaagttactgcctaatattttggagaattaaaagtatatgaaaagaatgaggctaggtacagtggctcacacctgtaatcccagcactttggaaggctggggagagaatattgcttgagcccagaagttcaaagattagcctgggcaacatagcaagactatcatatcgtattttgattttcctaataaaaataattataaagaatggataaagacagagtgtattaaggttctctagaaggacagaacccactggatggatggatggatggatagatagatgtatatatgtgtatataaaatatacatttaggagtttatcatggagaattggctcacatgattacaaggtgaagtcccatgatacgccatctgcaagctgggagaagagagaacctagtagcctggtgcagtccaagtccaaaagcctcaagaccagagaagctgacagtgcagctctcagtgtgaggccaaaggccttagagcccctgggaaatcactggtgtaagtcccccagtccaaagactggagaacctggagtcctggagtctgatgtccgagggcaggaggagaggaagccaactgccccgcagggcacaggaagagagtgagtaaacttaccaagcaagctactttatccctgttctcctggctttgttctagtctaactggcagctgattgggtggtgcccacccacattgagggtgggccttcctctcccagtccactggtccacatgtcagccttctttggctacactctcacagacacacccggaagaaacaatacttcatcagtgatctaggcatccctcaattccatgaagttgacacataatattaaccgtcacaacaagtattctattttcaagaaggaaaacctggaaaacacaattttggatcagattattaaacatgaggccatgctcactggtatggtttctcacttatctcatgcagttaataaacatatttattgcctgaaggaataatttttgcagatgagatagttttctaagaactaagctacattcgctaaaattgagtcatgtaaaccaactttatatcagatgacattaaacaatttgtagaaatactttgtggtagtattaagacaaattattttgttagacttattaaattggctgatccaatggaatggaatgaatttgaggtattctgattttcctgaaccttttagcaaagcctctgcgtgatactgtttattggtaaggtgagtctatctttctctatgagtgttcgtgggtgagtctgtgttttaatatattcctttctagtatctgatttacgtgctgaaaattctggggaaggaagccatttgaggatttagctggggctctgtgtaaagtgtgcccctgtaggagtggttaatggaatatttctgctcccatattaacttagaaggtttatagctatgtcctgaggagttagaatatcatatacaaatgttacatcctattgttttaagtcagaaaactcatgtttatagttcgaaatgttgctgctttttaaaaatgcaagtagtataaatcagttgaattagtttgagatacaaagggtctgacttcccatctatagatataaatgtaaatatatataaatgtaagtgtgtaaaaatacatgtaattttgtctatataaaaatatatgtataaatgtgtatatagttaaatttatatacatctctttatgtttctatatatatacatacgtacatctttgtgcatatgtatatatatgtatatacatacatatacataaacataagcacatatgagatagagtgcacatgcttactttgaaacaagcttgatattaaggatgatacagattcttagttaatgcaatcacagactgtgatatagtgtctagattacatgaactaataattatactctatgctgatttgaatacactgtattttacgcccacgattggtactctatcttagcaggattttctcagatggcagcatcctgtgaagaatatttgtagagtgggcgattatttaattaaaaaataactaatcatagggaaatggcacatgaacactattgtgatggtgaaaaaggaaggcactttctctatggtttttcaaaatgtcataatatcagaagcagacagaagttggtaactctggatgtcttctgcccagatctttcctgagtccattttcttctaattatcttctgaacacatccttgaagtccaaacaacacttcaaactcaacaagatgaaacttacctcactgtacattgccttcctttaaacctgctttccttactgaatttcttatttttgtcattgcactggcacttatcatgacacctgtaccagaaacctagagtcatccccaaattcatccctgtcctttcccttatgagccctttgcatgcaatgtcaaaatatttctcaaccttatcttgtatttattatttcatctttgttcttgtcaacatttctcaaggtataggccatatcataagcccccaaagtccttgccttcagtcttaccgctcttccatccaatctccacattgaagtcagtgtgggttcccaagagcctgtttaatcgttctcctttgcttaaaatcctgagtcactttccagattctgatactttggcctacaaggtatttgattacctgactcctaccagtctctatagacttgtctcatgttatctgctttatgtccctcaacctgcatttgattcatacaagctgtttctgataccctgtatgttacgacctctttgcacataccaccgggtttaaacagacgactctgcttcataagatctgctttgataatttcatctatgtatagaaaactcatttcaagttttcctccatgaaattggccactctacctagtgatgactactccctctttgtgccatgtctgtaccctaattgtgtctgtttgggcaccgatcatatacttttgcagttaatattaatgtgctttactcttttattagaatctaaattacatgagatgtgtcttacacattcttgcctgcattgtcagatacaagtaatcagtaattcttgtaagataactgaatgaacctatgaacagacggttggatataattccaagaaagatttttttgacttaaaagggagagctttttgttgtaaggtaattaagaggagaaactctagaaatagacccttcctgctctgttccttatctacagtatacctttgggcaagtcacttaaccatccttggctttagtttccccatctttaatatgaagattgtattagaacctacattatcagatatctgtaaagggtaaaagggtagttgagaagctaaagcatttaaaaatcactgaaatatagtaagcaataataatattagttactattattatcatcatcagcccagagcattcttacaatgcgataagagctgtggaaagtggtgagctgttcttcattaataatatttaacacaaactggaatctcatgttcaagtatgttttaaaagaggtgacatactgagtgggaagttagacttgatagcctccaatgtcccttccaatacaggtggagtgcaagaaaataaaaggaaatactgcccaatcttatctagtagaagcataattctccctcattctgtagagaacttcagctttaaaaagcatgattctcaaaattactttcataagaaaaaacaatctgaatataatggcaaaatataaagaagtcaaatactacattctgccaattattttgaccaacagtgataatttttaaaggtgacaaatctggataagtagacaataagaatgacagacatttaatggtaacatctctttggacattgctgttagtgtcgttaatagttttaacttgtgtaacatgagtatcacacaggttacaaagggaatgtgctatatctcagttacaaagagaatgttaaaataacaaagccacttggaaagaaaatgctatactgtgaaaggtagttgttcagaaagacgataaagtcagatttttctctcatcacctaaatgtcagttaggtaactgaaatttttatagtacatatcttcgggatagtatgagaaagaaaattttatagaatgttagaccctatcaaattaagaaatagaagttatttatgaagaggaatatggttgaaacattttgatgtttcgctctagttcctaattttatatttggtgaattaaatgcatttaaaaaaaactttaaatgtgatggaaataatccacaaagctaagcatcaacatttgttgcccaagaagcaataattataattattagattattatttttcaggagttttacatgctttgtatgtaatgccaaccctatatcacaaatgagaaagccaatgcataatgaagttaaatccaagttcatatagcttgcaggtggcaaggctgacactggtattcagatgtgtgacaactcaacctgagatttctcccaatctctcaaattcatagtagaaatttgctatgtggccttgtgaaaattatgtgatttttttcagttttggtttactaatcagcaacgggggaatacagaaacctatgtaacacagtaatgtattcgtacctgtaaatttaactcattcatgcaaatactatctatctgtataaaatgcaatatctattcatatatatatgaatagatatagcatttgcatgaatgagttaaatttacaagtacaaatatatataatataaacatatatatttatttattttagcacctgtcccactcaattgcattagtacataaatatttttctcttctagaacaacactgttctagaagagaatggtttatatatgtatatagtttatataagcagtatatatatattaacacctgtcacactcgattgcattagtatataaaatttttttcttttctagaacgacactgttcagtaaggaagttgctatacacctttggctattttgagcacttgaattgtgactggtatgcttgaggaactggattttttattttatttacttaaatataaaatggcacatgattcagttattagaaaacttttgagtatgttttgatcagctttgatatgtgcattgttttttcaactgcacattgtatcaagtataaataaatgttgaatattctaatgaaatttgaacatccaaagccaatgtgctgtaagtatacagttaacgctagatttcaatttatgttaatacacggtctgttgtaatacatttggccaatagggtgttaggtagatttgaaagaacacaatgtctggattactcaatctgttttctattctgactttataatttatgagttgaacaataaattctctcatgataaaaattatcaaatgaaactcaaagataacagtgatcataatacccaccatacaaaattacaggggaaatataagcaagtatgctggaacaataatattctttttttttttttttttttttttttttttttgagacggagtcctgctctgtcacccaggctggagtgcagtggcgcgatctcggctcactgtaagctctgcctcccgggttcatgccattctcctacctcagactcccgagtagctgggactgcaggcgcctgccaccacgcctggctaattttttgtattttctgtagagatgggtttcactgtgttagccaggttggtcttgatctcctgacctcgtgatccgccagcctcggcctcccaaagtgctgggattacaggcgtgagccaccacgcccggccacccggccaataatattctttatgaatgcaagtgttaatacatttacaaaaaatttttaagtttattgatacataatatttgtacatacttatagagtacatgtgatattttgttacactgttgtatataattatatagtcttcctactctgctatcgaacattagaacttattccttctatctaagcgtatgtacccattaaacaacctctcttcattccatccacacactcttcccagtctccagtatctatcattctaatctctagctctatgagatccaattttttagctcccacatgtgaatgagaacatgtggtatttgtctttctgtgcctgcttatttaacataatgacctccagttccatttatgttgttgcaaatagctatatttcattcctttttatggccaaataacattgcattatgtatatataacctgttatctgtttatctgttgatggttctgaaaaaaaaatgcaaactttatggtactttttaaattgaagtatcaagcaaaggacataagttataattatagcttaaagacttattacagaagtaacatactatgattccacatccagaaaaagatagtatgttaccagcaaccaggaaacctccatcaagccctatggtatcataaactcttcccatctcctcaaaggtaacatgtatcttgagttataatgctgcaggttagtcttgctatatttttaacttgatgtaaatgaaacttttatatatgcagttttttaactggcttttttcactggatactatatttgtgagattcactatgttgcatatagcattactttattaattttcatcgctggatagaattactttgtatgaatataccacattttacatattctgttcagaaaattggggttgtttccagttcggaagcattacaaataattcatctatcaacataaattgtacgtatatttttgtgtatatatgtaaacttttgtattaggtatttacctaagaatagcatttcttaatcattgggtatatgcatatttagctttcaagatattaacaaagggttttccaaagttgtataaattcatattctcaccagtagtaaatgaaagtacaaactgcttcatatcttcttgaatacttgtttgttaaactttttaatttgagcctttctggtgactttataatgtcatctctcatttttcatttgtatatactgatgaccagtgaggcggaatactatttcagttgttattggccatttaaatgaactcttctctgaaatgcctgtttttctactggattttctatatttctcttactgatttattttagtttaaaatatatatattctgggtattctttgctgtttatattacatttttctttttgaatgggtaccttgccttttcactccgtaatgatatatctcttcataaacagaagtttaaatttaacatagttcacttcaatattttctgttatgtttagtgtacttttgtcctcagtttaaaaataaaactctctactttaaaattctgaagctatggtcctgggttgctatataggaactgtttgttttacctttcgtattacaatccacctattattacaggtatgaggaagggatgaatgtccattttttcccatatagatccaactgaaacaacaagttggcactgtagaatattgaggaaaagatggtcttattgcaaagattttcaataagaccatcctttcctcaatattctgtggtgtcatctttgacgaaaatattagaaataaaatgcctatacgtgcatggatcagtttatggactctaatcagttttatttctctacttgcctgtcctcatgctaattccacattgttttaattactatagcattatgacaagttttaatatatggtaatatttttttgagatggagtttcgctgtttctacccaggctggagtgcagtggcaagatctcagctcaatgcaacatccgcctccctggttcaagcaattctcctgcctcaacctcctgaatagctgggtttgcaggtgcccaccatcatgcctggctaattttttttgtattttgagtagagacagggtttcaccatgttggtcaggttggtcttgaactcctgacctcaggtgatctgccagcctcggcctgccgaagtgttgggattgcaggcgtgagctaccaggcccagcctgtatctggtaatattgtaaaagaaaaaatgcaccagacaaacaggcaagaaagactttattcaagactactgaattatggatcaagactattgccataggagagagagatggaaatcatttctactgaaagaaagacaggagagaatttaagcactgaggagagctagtagaaaaatactggaagatattagggggttaggatggtgattaggcaatctgtgattgttaattggcacttaatgaagttaggctcctactgtcccacagagactgggagataggcgtgctatcattaacaattacatttcaaagagatggctcctaggtccttgagaaagatattcccggattgtagaagatttacatctcaaagaggcagagaatatgtttttggttgcaagtttccctaaagtaagcgctctaagaaaagagaggtcaggagcctatagtcaaataaaagcctgtctagagtttagtcacattaagtttgttttggtcagttggtcagtaaaagccattttattttcttcctttttaaagattatcttgactgcttttggccatttcgatctccatatgaattttaagaacagcttgtgaaccctgcccccaaaaagaatctgctgtggttttaattggatttcatctattctctggatcaacttgtacagaatcaacatttttattatgtaaagtctttcaatcctttcatttagttaggtctttattttctctcaataatgttttatagtttttaaagtaaaggctcttaaactttctctgagatttatttcttgggtttttatatttttgctgttatgaatatatttttgaaatttcattttctatttgtgctgatataaagaaatacagttgattttttttcttggtcttgtatccaggtaccatgctacatttacttaataatttgaatacattatctgtagtattattcagatgtacatatataggttgtttttgagtaatgacagttttctttctccctttccaattatttttcatgtcattaattttccctgacatattgtactgtataaatactctagtacaatgggagtattgtggatatttatttctcattttaagtctcagagggaagaactttaataaataatcattaagtatgatctttcctgtaggtttgttgtagataccttctgttcttaatattctaagaggttttatcactaccggatgccaaattttatcatatatttttccagaatcatttgagatggtcgtatttttcttctttattctgctatatgtcaaatcacatgacttagttttctaatgctaaaaaagcctttcttcctgtaataaactaaacctggataagacgtataatcttttttgtgtattgctagattttctttgattcatagtttttcctttacgtccatgaaagtgattggcctgttattttcctttcttgtaatatgcttgctaggtttaagtacctgattatgcaggcttggtaactggcttcataactggaatttgcaaatgggaaattttaaaattaaatttttatgtatttaatacacataaaaatgtccatttttaattggaatttcaacattacatttttccagattttccgttttggagtcagctcgaatcatttgtgtctttctaggaattggtctattgcatctaaaattacagatgtatttagataaagttctatttagtccctatggtatttaatagtagtttattagctaccattgtttgaaattgaaaaaaatgtgacatgaactaagaatttctaacctctctagagaaagcaaatgatctgatgatccttagtctgtttttctacatagtaaccagagcaggagtcaagttgccctgttttctctagcacaggctcttcatttagccacagtccccattactacctattctgttacacctacattatcttatgcattttattaggtatgtacgttagaatttgtgatttcttgtggatgaaaagttgtgatgtcaagagttggcatgagacatagagggatatttatcttctatgcacttgctttcaaataagataccttttggagcccgtgctcagtggctcacgcctgcaatcccagcactttgcgaggccgaggcgggcagatcacttgaggtcaggagtttgagatgagaccagccaacatggtgaaaccccatctctactaaaatacaaaaaagagccaggtgtggtgtctcacacctgtaatcccagctacttgggaaactgaggcacaagaatcccttgaacttgggtggtggaggttgcagtgagccgagatcgcgccactgctctccagcctaggggacagagaaagactctgtctcaaagaaaaagaaaaaaaggatacctattggaatatggccctgttgtttaaaattgtaaaggtaaaaattttcaattcttgtataaaacataagctttatcaagtatagaaaaaaatgcaaaaaaaattatcattaattgtccttctaaaatgtttcactgtgttctatattaaaattctatcatgctccagatttatcacatctggaataaaggctgatttttttatcgactgagctctaaatccttactatcacaagcatctcaataattcatcacagatttaagagcactttcacatttattgatctatctgaccctagcagttacctgtctaggagagtctgtactattatctctatttcactggtgagaaaactaaagcacagcaagattgagtttgttcacagatattacaaagttgggcaacagtagaactgaagtgggaatgcaggaagtttatactttatgtaatgattagcagattgaaagatccaaaaaagatggttctaagacaaaagttgggtggggaaagccacctattgataacgacagtagtagtattcagttttgggatatttgtgcaagacattaacctcaaaggtaaggagcccacctcaaggagctcagagtctgcgaggtataaaacgataaggaagaggaaacctcaagctaccaaggaatgcctgggaatgtgatgaatgctggaaggaacactgttacgctggaatgctccttagaactcctgctctttattttctggtatcccaattgaacagactggtgggagctggagagtacagagtttattaagctgccaaaaaaaaaaaaaaaagacattaaataatatcctgcaaagaataacagcagtgacaacaacaaaaggcttttccagatttattcattagcactttgtatactcacacaaataaataatataggaaactgactgaaatagcgtagagaagaacatgcttcttcgtgttaaaatctcactacactttcagcacaattgcaaaggcagaatttaatgaacaaatcagtcatacttaccttttaaaaataagtcctgcaaaggccacatgttcttaatctggaagtgcaagtatttgctgacgttttatgattaaacaaatacagagttacagtgtcaaatgtttttgaatcaaattataacattaagcttcacatccttgtgaagcagattagattaaatgttaaatctagtcaaacttctgctaaaacaaaatatgaaaagactccaaagggattcggcatctggatatctcactgtaggttgtgtagcacaaattagaaggcatatcttttataatgaatgccctactgaatgaataccattatgaacgagcatgaacttgtagccaaatggatctgaggtcaaatcccagacactcagtactgtggcttctgtgacctcagacaagttacttaacctatctgtcagtttcctcatctgtaacctgcccctttggaagtgacagctaaaaattccttgagttcagacaggagattattacaggatcatttaaatagaagtaagaattatacttttgaaaaaacttccagtagttgtttcataactcatcaaaataggtttatccgccctgtaccatatgttatacagtgaagatataaggtacaccattttatagtatggtgcttcagttcagtttgtagaaatgtgtaaaactgagaaccaagccatacccttggctaaacactattcagtaggactctgccacatttctgcctcataatggatttttgtttttttcaatggtttttgatgtgatttccatttcaacatcagtaagagtaagttgcttatacgttttaactgcatagttgttgataaagtaagagaaaaatcaagaaataagggattttcagagggctcattacacataaaattcatttagcagagaagtgtattatagggtcttaacctgcaataaaataagatgggttgttttctgcctccctctttcataaagccccgttgctgatgcattgtgtggtccatggcacataattgtttccgccttagtggatatacgcctgggaacactctatctcttaacgccaatactgatgggcacagtttaggtttcatattctatccctggctccagtaaattcaagggtcaccatacttaagatttacctcccaggcttgtcagattttcctcagttacctttatccaaatgttcttttagtagccatttttcacttttgaattgaaatagcaactcaaccaaacaaaggaattcagatgagaaatgtccttggcacgtacaacaatatgacatgtgaattaaatgggaggaaaaaatcctccccgttgtggatctgagcatggacgataatggagttgtgatttagtccatgaaaatgttagacgaagtgagctgacctttagcttcacttactgctgagacaaaatgagaatataaataaaaattaacttcttttaccattttgtgagactttgtaattcattggttttacatttatgtgtagaatgtttagctctataaaaatatgcattattgctaaaagctcaagggattcctatacgtaaatagaaactcagagaaacagagttgaagttacatattttttttttctctagagaagaggtttctaatcctaatacagtggttctttaaaaaatatatgtattagccccattttatccaatttcttacacttgtctaacaattttgttatagccattcaggcaatgataggaaccagcatctttgagtgattccagagctgagggatatagtcttccaattgctttgcttcattctttgtaattcaaattaaggccaatattgctaagcaataaataggtaaatccataaatttaaagcacttcgtgtattatctatttatacttgtgcatatggcatcacaaaaatgtatgggcagatgtttacagcgtatgagcaagtaatttctaattcacttttccgcttacactgagatcagtggaaagcactatgcctgccttgctacagaagtgacttagattcaattcattgagtattttctaagagtaagataggtttaagcaatagaatatgttactaaaggatatgtgttcatgctgtcttgtgttggaaacctttaaagaatatacttgaagactaaacatttattcgtaaagatttaatgggtgcctttctacagtgaatacagtaaaatagatgacccttggcagttcttagatttgatgtaagaaccatgatcaagcaaattgtaaacaacgaccaactcttaaataacttgtttcaaattaataatactttcccatacatactcttgtttaacatttgcaattctttaacgggttggtattattattcgacagacatttagccaagtatttcttgaaaaagaatccatctatcttaattgtcttttgtattactcctttgtgagggctatcattaaaaaataacatggactggtggcttaaacaatacaaacactttctcaccattctgggggccagaagttcaagaccaaggtactggcaaggattggtctcttgtgaggcctctctccttggattgcagatgaatgccttgttcctgtatcctcacgtggtctctcctctgtgttgcacatatccctggtgttttgctgtgtccaaatttcctcttctcataaggatacccatcatattggactagagtaaccctaatagactcattgtaacttaatggtctatttataggctctatctccaaatatgggcacattccgatgtagtaggtggggcatagggcttcaacatggatttcatgggacacaattgagcctgtaacatcttctcttaatatttggcatatccagatatttggtacatatttgttatataataaattcatgatcaatgaatgaatgcattgatggctgtcattaactgtaacctagatattagctgaatcataaacttgctccattatttggatataaagaacactttaagtggcattttttaaatagttatgttaaataggttgcctatgtacctaaaagagtgtttaattacagcaatccctccctccctccctccctccctccctcatccatggttttgctctccttggcttcaattactggcagtcaaccacagtcagaaaatattaaatgaaaaattccagaaataaacaattcataaattttaaattgcatgctgttttgagtagcataatgaaatcttgtgctatcccacctctgtctcacccaggactgaatcacccctttgtccagcgtcttcatgctgtcaatgttacccgcccattactcagtacctgtctaggttcttagaaacactgtcatggtatcgcagtgcttgtgttcaagtcaccctagttttacttagtcatggccccaaagtgcaagagtagttatggtggcagttcaaatatgccaaagaaaaactgtgaagggttttctttatgtgaaaaggttcccaacttaataaggcaagaaaaaaatcgcatgctggggttgctcaaaatctgtggtaagagcaagtctatccgtgaaattgcgaagaaagaaaaataaattcataaatactatatatagggttttgtactacctgcagttttaggcatccacctgaggattttgaagcatatcccctatggataaaggagaactactctattagttttttgtgactcatacagtgaacaaaactgcaatattaaatgcatcccattagtacatctcagaatttcaataaatttgaaaatgttatacaacctggaataggggatctttatttggatttgtattcccactaaaattaataaattatacatttccacctatggggttacaagcttaaaatgctgcttcagtggatactatatgtcttgtagcactagagagaagatgctatatatacttgaaagtcttttttgtttatgaatatgatgctatagcttgagtttgtcccttcttcccttgactgtcttcttcactggagttgatgggctacaataaatttcccacattttgactttgtagatctgcatcatcacgtcaggtagatggtgtagtttatacttaagagataagattttctccatttgaagcttttttctcccacaactaatctattaaccattttgttacgtgccattttacctgacatgcactgacagggtcactaggaagttagctaaaaaaatgcaagtatgttttagaaaaaacctatatatactgcttcgtaataattagatggttgaagtgactaaattcattgatttaagctcgcacatttcctgtgggtatctcgcatcactgtttgagcgctatggcttttattgtaaacataattcaaaataagttgagtagaaagtgaaactacaaaaaattaacagttacattatgctgaaagcaataacattgatatttatgaagaaaaactgaaaactcacttatgattgagctgcatataagtacatgattatgttaatactgtaggaaaatgttgactgccttctgtttacccatgcgtgtatttttttttaagtggtgatagattaaacaatttaagaaacgtgactctcctagtcacttagaaataggtggattagggccaggtgcagtggctcatgcctgtaatcccatcactttgggaggctgaggcaggtggatcacctgaggtcaggagttcgagagcagcctggccaagatggcgaaaccccgtgtctactaaaaatacaaaaattagccagacatggtggtggatgcctgtaatctcagctactggggaggctgaggcaggagaattccctgaatccaggaggtggaggttgcagtgagctgagatagtgccattgcactccagcctgggtgacaggagcaaaactctgtctacaaaaaaaaaaaaaataggtggattattttcatgatgctaatttcatttgcattgtttaaatcatgtgttaatatcctctaggtgggttaatacacatatgtagtataaagtaacatagaaattatgagaccttagacactgagtagatttttcaaaaatatgagttataaacatttttctaactctaattctatataaaataaagcacgtcaatattttatgatttctagctttaaaggtccaatatatatatgagaaaataagtttcttatttatatgaaaaagttacaaaaagttgaaaattcaggctataaagtgcatcataatgaggttgagctaactgccattttgaaatgcttcctttgcatagaaagcatcacaatatttgttttccttccaaaaatcattgatagttggtttatgttacatattaaaatagtgtgtgttcttagacattagtgacatgttaatgatatagtagtttttactcagagattgttagttttctcactagagtagtttagaaacagaaaattttaatacttttgtaataattgagaaaattgaaaaatctacatagtaatagaatttaagttactaagaattttcttctacaatccaaatggtaggcaattctcattatgcaagattgtttcaattaagagtcttttgaggcattctatttagtagttagacttttattctttagggtgtattttcaaacctaaggaaaatacaccttttacttgttctcactgcaaaatcctctctatatgtatgtctttgttatcttacatttgctatggagccattttatatagtggtataataaccacttcatattgcttgtctctttgcttttctatgaaaggtacaagacttggtgagataaagacaaatgacagtcacaccacttatttaaatgtaagcagatcagaaagagtgtcccttccaacttctagcgtacataggagactgagatactttggcaaattattcatgccatttttaataaaacgtagttaccaattgtttgctgatgctgtgcttgattgtctcttctccaggtattgggagatcgatgggcaaacatctgtagatggacagaagaccgctgggttcttttacaagacatccttctcaaatggcaacgtcttactgaagaacaggtgtgtcatgtgtgagaaactagctgtaaaagacacggggggatattaaattggaaaagtaaagatttatgtttatttattccttggaattctttaatgtcttgcagtgcctttttagtgcatggctttcagaaaaagaagatgcagtgaacaagattcacacaactggctttaaagatcaaaatgaaatgttatcaagtcttcaaaaactggccgtatgtactttctagctttcaatggtcttataaaaacccagtactgtatattatcactattatttagtctcttctatgctattgaatattaaatgtttatttttgcttggatcatagattattcaaagatgttatattgctacttttctgaattaaagtgggaaaaaactataggtggattttcaactttgtttttcaaagttgtactcttgataaaacatagcataccagaataagacttcaattaaaattaataaagtaatactaagaaatgtctgtgagcctttcataaagttctaagcagcatagttctaaaaaaatagactgacgttgattctcagaataatatgtgagagttacaagcgacggttatcctgacattgatggagtttaaccttagtttattataaaggggtacctgagactgggactgggtaacttatgaaataaagaggtttaactggctcatggttctgcaggctgtacaagaagcatgacaccagcatctgctcctggtaagtgcctcaggaagcttacaatcatggcagaaggagaaggggagccagtgtatatcacattgcaagagtggaaacaaaagagataagaggaaggtcccagactcttttaaacaaccagatttcatgtgaactaactgaatgggaactgactcatcatgaaagggattgtgctaagccattcatgagacatccgccctcatgagccaatcacctcccaccaggccctacctccaatgctgggaatcacatttcaacatgagatttggagaacagagatccaaacaatatcacctagtttttcaagcaaaaaaaaattaaagcctatcaaatgacattgattataaatacctcgagtgttttgagaatgagatttctttggcaataaatggatttcagaaaagacttcattgaagcatttggtttcagcaggaatttccaagatttaaaaaaaaaaaaaaaaactctaaagtttctcttactctgtgaattttatcatttctagtaaaagaggccggtctgatactatgagtttaatttttcacgtgacatattctactttatgatttcttaaaatttttgatagatttgattaaatgttcatttgatatgaacttttataaaacaaaatggttgtaagtagtgttccataatttcacctttattattgcattgtacttcataataatgcaataatttctaaacttaagtaaatttttccactcattttaaatacgtaccattttaccagctatttatttgtttcatacattttttttgctccataaatgctaaccctcattggtcttttaatttaaaatagattcacttatgtattacttgttattacaagctagcttattattgataagaaattattgctcaaagaatatggactttattaagtgatgtgactgccgaaaatagagttcagaaaagtaacctgtatatgtttgaaaacacgagtgcaaaaatatcagctgtatttgtagttttggcctgcagctgatggggagccattgagagtttgcaaaagaatcatatttgcatttttgtaattctttttggtaggaagatgtttgatggtacgaggactaatcagaagacctgaactaagtagcattgggcattaagataagaagagaaacattagaatgttaagatgtgatgaatgaaacttgtgataagaggcagaagtttgaaatggttcctagacatttcatttgggtgactgggttcctaggagggttattagccctaacaggagaatagaagaggaattgctggaatgacaaaaatgataattatttcagatttggatatattccgtgtaaaatgtctttgagacatccaagttaaaaatcctttccattaatcagttggtttacacaactagaatctcagaaaatggttcatgactagttattgattcagaagcaatcaaaatgcttctgagggattgtgtagagtgacacattaagtgaaacgaatagatttcagggaggaatgtctacaatcaaggagtaggcagaggataagatgttgaccaaaagattgagcagataccacaaggggaaagtggtatcacaaaagtgaggagaataaagatttcaaaaaagtaggaagtggtacacactgtcacatgccacagagaggagaggataaattcatgagggattctatcatatctagaggaatggatgcatggattacatctccttaaagcagaatattccttacaaacattgttcttctcaggcaaaatgtgaatcctttcagtaaataagtgagtgaccactgattatcaaaatgcagtcatgccctctgattaggagcgaagatatattgctagttaaatacagaatcatgtgcttcagacggtcaatcataatggtgatggtcagtcatattctgtgtgctgaaaaagtcacaagcctgcccagattcaaggaaaagggaattagatttcatttcctcatggagaaacaccaaggtcaagttatagcaaagcatctgagatgaggatattttacagccatctttggaaagtaccacatgccagaatagtacagttattttacatgatgataaattccaaatcttaatatctagtcaaagttcctgcatatattgttgactagatttaccaatcaagaaagttgttcttaggaagccacaaactgacaaaatccaaatatgttaaagctagatgagattttgcatctcatctagtgtttcttcaatctcattacacatgtaaagttcattaggaccatctactcagtttgtttccaagagaaaatcgagatcaagaaaaaacacaggatctgtatcctacaacattagtatcagacttaaaatgaacactaagacatccagactcaggtccaggcctttcaatctatttcagtagtcctcatatcagttgattccttggaaaaaataactgcaactgagaactgtcatttctaacaataatgtgcctctatgttaacatttttgtgagcagaaatcttggctagcctcagggccataaaaatgctcttttaagaaagtcaataattttccaataggattaaaatttgtgttatgtcaccttgcttgtgaacaaagagaaaatatgttttctataggtcttgtcatttgatagtttaagccaattaacaaaacctgacagctggtctagaatttgaggtaaaattcctttgctgactcaggcagtgaataagaatttaatgttcattaaaatatgtcacaatctgagacccaaaacaggtaccatctgtcaccagttttcactacatgtctaggtatagatacactgtgctaaactctcttctctttacaataagtgtaatttgtttcaaaatagtatcactgataacccatgggattgtgtcctgcttgccattgaggtgggaggtggggattatgacatttaatttgctctagatctttgggattcatatccaaatcatgtagatctattattttttataatcaaaactgatttaagttttaaactgatttggcatcagggataaaaatgaagggaaagaagaaacagtagcttttatgaggtgaattataagacttgtagaatcacgtaaattatcgtgggaagatccaagtcaagaagaaacctgttcctgagtaaatgtatttctgctgtggggactgttggcgtttgctggggaaggacagctctggggaagcagggtgatccaagagattatggtatataagggctacagaagtacttaggaattgaagatattctcaaatggctgtgggatcaaaggacatggatgaagtgctcatggtaactgagcaagttcctgtttgacttgctacctttacctcaactcctgggatggccctcaaataattaattcagacaggatcaatgcttctcaaaatgtgttcccccgaccggcagcatcagtatcaaggaaatttgttaggaatgcacattgttaggccatcttcagacctactgatttagaaactctggaagtggagcctagtcatctgcattctaacaagcctttcaggtaattctgatgttctttcaagatgagaacctctgtaatagatcaacctcccaaagtacaactggtgattagaatgaattggagcacatcttacatgtagataagtaactacacataatataggtggaaaactcaattttgccaatataggagaaattgtcttggcattattctcttatgcgtattcctgatgagagtgaggtgaaggtttcctgggccttttgtaaggatacattatcttttcacttcaaatcatcttgaacagcttatctgtctcttctccatatccactactgacccagtctgatttattgactgtaccttcctccctaccttggaggtaggtctacattcctggcttctataaaaataaagtctgtttattcttttactatcccagctggcctttgccttgtacacattctctagatcttccttttgccacctgaattttctagagctctatgggtctctggcactcatagacctatggttaattattgatatgtagaaatacatattttatgcaataattagtaacaaatcatagttatttaatatgcacatgtaagacctaagcttaaaagaatcagcatcaatggatagacaggacaaggtaattctaatgaattctatgatctaatgtatctggccccatcatggattttctttcttttcctccctcagttaataatcctgggggagttctggaactgggagatgactactgaaagacagaaaaagagagagaaactgagaccaaacaactaatctgccatcatcatttttgatactcatatctaaaatttactaggtataagtctgggttcagtgtttttgtcatacagacatataaaaattcatttattcaataatcacacaatgtaattataacattgattttactttaccttgagtgcacttttttcctaattggatttttttttttttcttgagatggagtcttgctctgttgcccaggctggagtgcagtggtgtgatctcggctcagggcaacctctgcctccctggttccagcgattccttgcctcagcttcctgagtcgctgggaccacaggcatgcaccaacattcccagctaattattgtatttttagtacagacgaggtttcactatgttggccaggctgatctggaactcctgacctcgtgatccgcccgcctcagcctcccaaagtgctgagattataggcgtgagccaccacctctaattttatttttaatggtgactttcactttcatttttgtaatgcttaccaaatgtttcttcatgtggcttaataataaaacaggaggcttattttcatttgtttaggtaccatgaggttactcataggtttttattgcaatcctcttctttaaacataattctcacactcctcttctgacatgtttccaaatcattacatattttgtttaaataatgggtagaccattcagccttacacatatggctatttaaaatagtttctaacattctgagtaagtaagtcaaagaggattgtacttagattttttttttatttttagatttgtgtctttgtgtatattgtgcctctttccatagtaaagaaaaaaaatgacactataactggaggaatatacattgaaattcaaatatggctctcagcttgggacaggtagcatcaacctttgttctagtactaatgcaaatattcacttaaatttaatggaaaactaacaagtgaattaaacaaaatgaatatgcaaaacctatctattgggctgggtatggtggctcatgcctgtaatcccagcactttgggaggccaaggcgggtggatcacttgaggtcaggagattgagaccagccaggccaacatgttgagactcctgtctcttctaaaaatttaaaaattagctgggcttagtggcatgtgcctataataccagctactcgtgaggctgacaggagaattgcttgaacctgggagacagaggctgcagtgagcagagatcatgccactgcactccagcctgggcgacagagttagactccaactcaaaacaaaaaagaaaaaccacctacctattgctaaacccccacaccgtgagttttattttgatttgaattcagtgtataatatcttaatttgtattttggtctattgcattctttcaaacttagaaaaatactgaacttattgttaaggaaaaattagagatgaaacttaaatcttgctttgtttccccttaaaaatggcatgaagactgaactataacatactccaggtgaagcagattctgagtaaaagacaaactaattgaaggagccactagagcattctgcagttcagagctatcaatgcaggtgccatgccaaaatgggctacttagattgtccttttcaggaaggtgtattgactgctctaggtttggggcactttgcttcatgggcaattggtgcatttgtgtcatgacaatttgctctgtggtatgttagttcttaaataaacttacatttgtttcggaaagacaggtatcgcgatttagtttacattcattgtatttgctgccaaatatggggttgttaagtggctgtaagataattttctcctttatttctcttccttcttctcctttgtttacagattaagtcagggagtaatgttcagtacccaggaattgaatttgtctgtgtatcaggcaaagttactgagtcaagtaaaagaaaaactgccctgatttactgatttcacataaaccacttattcctttcaaatcaaccaaagggagtttgtaaccctccacagctcacaggaactttggaaatataaatggtataaaaattgcttcataagacacataagtatttataaactctgaaaagagatgctgaagcatttatgtcatgcccagcgacttagttcttttacttaatgggctctacaattagttttaaaaaataattactcaaataaccagatgttaattgattaatggatgctacaaaaattttatggtcagtaaatcacataatgagattttatctccaaataatgaaccgaatgttaaaactgtggaaacaataatattgtaattttatccaaataatcacagcatttcagaatggcaagtttccttagccattctcattttctcagctcactagcttttcttcagtactcctggtacctgattgtcagttttcgtttgaattccgtcaggaattaaggggaaatccaagatccgtgccttctaatttccacatgttgatctctgttttgccttttgaagcaatattaccttttcacttggattttcttcaaatatttcaaggtagctcttaattacctctagtaggtctttattctacgtttgagtttcttttctcttcttttctcttcaaacttcttgggataattagatagattataactttctacctctatttttctgaacttttgatcctttgcgggcacgattgaaatattttcttatctatgcaaatgagcaaatacacgcaaaagcagattgaactatagtggtgtatggaatgcaacccaggcttattctgtgatctttcttgttttaacaggttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacaggttagtgataccaattatcatgctacagactatctcagagattttttaaacctgcattaagagagtgacattataaccctacaaaagaagcaaccagattagtttttgccctgtgtttagttaaataaaaacatgattcttttgcctgtcttgttgttggagaatggtggtgaggtagagtgctaattaactgaacttgttactgccctagagtgaatttcttccagcccaatagtaacggggaactgagtgacttagagcaggcgaacaaaatgctgggaactgtataatcacagtctaaccccaaatcagagattgctagaaccacgaggaacattagccaactccgttttactcttgagaaaaatgaaacttagggaagaaaagtaaatttttcaagagaagttagtggtaggagaactagggttcaggtcttttgatttcttggaaagttttttattagtgtagttaattatctgactattgtaccttttctgccatagactgctgatttcataaaattatgaatgtggcttagttatactaacacatacgggctgtagattatgaaaacatctcagctacatttggggtatgtggttttattataataatttttaaagatttagtcactaaaatggggtatcgttaaaagttgaacctctttttgtcttatgtagttggatggtagaataatgagtagtcattcaagatataaacattatatataatagtatttaacatattctgccacatagcctggcattataaggaataactttactcaaaattcatagctcaatgcacaggcatacacttccatattcaatagattttaggcaaatatttcctctatattgagacaagtacatggaatttgttttcttgagacctgacatctgataagtagcacttaggaaatgccttttggagacatgaagtttgtagtattgcctccaggaatacaatttaagacagcgtaataaaccagcctatatgattttcaatcacagttcaatgttacttttaatccaattttacgttaaaaaattataatttgaagaaatatgaatataaattgtaataatttcccacacaatcattacataataaaaactccatttgttttccattaaacatactttagcaattaattgacctaatagtagttttagtactatattatgattcctcctgttttatgtgatctgcccatggcttctttgcaatacattggtatttatgtaataaatacatgagacattagtcaatttgatactttttaacccaacactgagagtattcccatatgtacccattgcttccacagattattgctgccataaaatggtcagttgccgtgttaagaaagattgccattatttgataaagaaagttattttgacgtgcatcccttttaagggacatgtttagggagctgtaacagttaactgtaggtcatcttctagttcatttgcattgcatggagtggttctcaaacttgagtctgcatagtagccacctgaggagctaattaaaatgcatattcctaaacattttgctcagaaaatctcatccataagctgtgataaggacctaaaaatctacatctttactaagcctttgatacaatctgcagaccatagaggggatcaacatacactgggatctacttgaggtgggagggtgggaggaagtagatgagcagtaaataagactattggatactgggcttaatacctgggtgatgaaataattggtaagcaaacccctgtgacacacatttacctatgtaacaaaccttcatatgtactcctgagcctaaaataaatgtttaaagaaaatagacagtgatatgtgtgtgaatcccaacattctggttttccacaatgctccctgaaatgtgaaaagggagagcttcttgggaatacactatataaatatgctcattcccttggaatgggactactttttgatgaagtttgtacatgtcatcgaaatattactgatttgattattccaattggtagaaaagcatttgaagccttatttttaattccctagaaattatgagaccaccacctaggcaattgacgtgatgtcttccaacttgtataattctataataaaagaatactggttttgatttgcatggttctttatgaaataaagtccaacatgcattacagcatgtatctcttcacttgctcatagggatacaatgaagataaaatggaggcatagacaagaaagcatttgaggggaaaaaggttgagtttgatatgtaagtcatgtagttcagtgtgtctggagggctttttgtggttctctatctgcttttttttttttttttttttttgagatggagtctcactgtgtcacccaggctggagtgcagtggcacaatctcagctcactgcaagctctgcctcctgggttcacaccgttctcctgcctcagcctcccaagtagcagctgggactacaggtgcctaccatgacaccccactaattttttgtaattttagtagagatggggtttcaccatgttggccagggtggtctcgatctcctgaccttgtgatcctcccacttcggcctcccaaagtgctgagattacagacataagtcaccgcgcccggcccactatctccttttaattttattttcaaacagttacacgctcctattgtgggctagaaataaataaaaggacttaacatcatgtaagttgttttccagaacactaagcttgagtttttcttaagcttatgtttcagttttctctcattgcctttccaaaaattatgctgtcatgggattgatccaaatctttgctggctgtttttgagctcacaggaaggtagaaatggagctactcaggaaaagagaaattaaaaggaggtaaacagagacaacagcgaaatagtatcatataagagcaactgattttcttttatccatgttaaattgaccttgattaaaattacataaggagaattccaagaatatgagctgtaaggttgtgactttgaagaacaaagctcacttgtatgtacattttctataatgattgtgggagaaaaatgagtttcattaatgactactcacatgatatactcaattgtttcaaaaattcttttaaataattagtataaagaatgagcaaagttctcataatggttaaaacctattgtgaggcagggtgtggaaatcgtgattgagatgacaaggcacccagttgtactcatataaagaacactgcttgcgcgtatgattgctgttcaggtcagagctttgaggcatttttgaccttttgaagcagttgcatggcaagagatcaaaacgtgaaaaaataatcagctaggaggactgctctcttgcatttcaaactcagatttgacttgaataatacctggacacaagctgagggtatttaagttgattagaaggtagcctaagaagatagaaaatactttttttctaaatgttggagagataataactcttgctatctggaggcttacaatgagaaaagagggcaaatataccctggattgacttctttaaaaactcaaatgatcatgattccctgtaattttttataaacatacttgtaatttgtgcagttttttctaattgccttggccctgatcgatatatattttatcttgatcataattatgaaatacgatagtgacgaattccatcaacatttgcttgtctggaaaagattttattcttccttcacttatgaagcttactttgtctggatatgaaattctgccttggaaattcttttctttcacggtgttgaatattagcccccaatctctactggcttatagggtttctgctgagagatctgctgttaccctgatgggcttccctttgtaggtaacctggcctttctctctggctgtccttaacattttttctttcatttaaacctggagaattgtatgattacgtatgttggggttggtctgctcagtatcttgcattccctgaatttgaatgttgggctggcttctgctcagtgagtatcttgtatttcctgaatttgaatgtttggctggctttctagattggagaagttctcctggatgatatcctgaagtgtgatttccaacttggttccgttctccccgtctctttcaggttccccaaacagtctttgcttcagaatttacataatcccacatttgtcagacgttttgtacattcatttttattcttttctttttctctaatcttttctgcctgtcttatttcagcaagatagtcttcaagctctgagattctttcctctgcttggtctattcaggtattgacaatgtgatttcattgtggagttgtcgtattgcgtttctcagctctatcaggtcattcatgttcctctgtaaactggttattctggttatccgctcctgttacgttttatcgtggttgttagcttgtttgcattgggttagaacattctcctctagctcagggaagtttgttattatccacctttgaagcctacttctctcaattcatccatattagcctcagcacaccatctcacgccagacagaatggtgatttttaaaaagtcaagatacaacagacgctggcatggtttcagagaaatgggaatgcttttacactgttggtgggaatgtaaattagtttatccattgtggaagacagtgtggtggttcctcaaagaactagaaccagaaatacccagcaaggccgttactggatatatacccaaaggaatataaatcatcctattataaagatacatgcatttgtatgttaattgcagcactattcacaatagcaaagacatagaatcaacccaaatgcccatcaatgatagactggataaagaaaatgtgatacatatacaccatggaatagtatgcagccataaaaaggaatgagagtatgtcctttgcagagacatggatgtagctggaagctgttattctcagcaaactaatgcgggaacagaaaaccaaacactgcatgttctcacttataagtaggagctgaacaatgggaacacatgggcacagggaagagaacaacacacactggggcctgttgctgggagaggaggagagcatcaggaaaaatagctaacggatgctgggctcaatatctacctaatgggtctgtaggtgcaccataccaccgtggcacacatttacctccataacaaacctacacatccaatacgtgtaccctggaacttaaaaaaataaatgtgatagtaagaaatttattataattaatattttaaaatataatgtatgtgatttgaagcattactttcctcatttgactgaaatcacatgtgctgttgaaagggtatattagtcatatgctttacaatttggtatgctaattgtaattatcatattacgccataaattgtaattactgtatttaatatgtaatttatattaagtagtatataccaggtgctttggtgtaagcatatatatatatattttttttttcaagcgagtctaaaggttttgtagttttgtggatttttagtagaataaattgtcttctttctcaggaataaggaaagttgtatgacttattaaggttcaaatatctcattcccattttgtgaatattttgctatattgctaacaacaatttttgcaacattctcaactgtgagcacctctttaagataaaatacatatgctcagaatttgcctcttcttgtacatggcagttcatgtttatgctgtatatgtttgtgcctacattcaaggatgcccaaaaagagaaaatgattattatataattatgtgtaccttctatatcatctatatcctgatgagagatttattatgtgtgctgccgaagcaagcacctgatgggagatttaaaactcctatcaaatagtaatataaaacatagctgtaaatgataagccagtgctttttattatacccaaaatgcaaatagaaatatgccaatgtaccaagatgaaaatttctttacatgttcttcttttctgagttaattctcattctttaaagatcctctattttaacccttcataaaatattttatgttcacgttctggctgtacccattctcagagcatcattttgtagacctctttgtacaagggggatatagttgcaaatggtttgcctctcttcttttttggccagtaagtttaattaaaaatactctaaggctttttatttaaaagaccttttcattgcttcctgaaagctctccacgactagtaagcctgatgccaattaaaaaagaaaataattttttaaaatctggaattaaaataaaaataccttacttattttgtgtttccttcttacttaaggtcatagaattaactcccttaaatttgagaacatgttttgggtaattcctcaggttaaagttttattagaaaaatttgaagttgaccgagtgtggtggctcacacttgtaatcccagtactttgggaggacaaggcaggcaaatcatctgaggtcaggagtttgaaaccagcctggtcaacatggtgaaaccccatctttactaaaaatacaaaaaaagtagccaggcatggtggcaggcgcttgtaattgcagctacttgggaggctgaggcaggagaattgcttgaacccgggaggtggaggttgcagtgagccgagatcatgccactgcactccagccgggatgacagagcgagacttcgtctcaaaaaaaaaaaaaaaaaaaaaaaaaaaaaagaaaatttgaagttacatctcaaataactttggaaattaactgtatcattttgctatctccaactataataggtatttgagaatgggccttgtatatcagtgcaataggttttaccttgtaaatgcattgtctgtaacaatataaaatgtaagcactaaaaaatttaatacattcagtctgagttaactcttggaatctctcattctttatttataaatttaaaggaaaggtaagctaggcagatttctatagtggccatcgagttctaaatgtctttgatatgtttctctttgcttttatgtgaaactctggagtacttagtgaagaagattcctacttttgccactggaaaggcagctaaaaaataatgataataacatcctatccctattcaaaggagacttaattatgaaattattacactgtattcactgagtatgtcattaaaataccatacagacaaaatgctcagcatctgtatgatacgcctattatctcctgacaaaaaaatgaaataacacataaagacaaatacaagtctttttcctaagcctatacttgataatatccatccctaattatagaatgtgtttcattacttcagtgttagatggtatgtagaggaaggccagatggatcagaaaaattaaatctcattgctttgcaatttttgcaggtgcagttaattcacacagttgctcaaattccgtatttaatatgaatccagaagacaacatacatctcttctttctgatacaatttgtactaaagacaatttaaaatgaggaacaaaatacattaaattggacagacagttttacagaataaaccttcttaattatcatataatatttatttcgaagaaacaaatgacttatgatgccttctaagtatttgacaataattttgctcatgatttcaatgtcagtacttattcaagaaattttattaccttacagtaataaattaattattaatataaattaaattattattaaattattgtaataataaattaattacagtaattaatagtaaattttagttaccaggctactgtcctgaactttggcactcattgtatgctacattcagctatgggaagtcctctatacttcataagataaagcattttacatccttgtgattagtaactcagcttcctttgtgaccatctgatcttttgcccaaggattctcccaaagttcaacatataaatattttcttttgcttagagatgcaaatctttaccagatttttgtgccttgtgctaccatgcctgtggagttggtttttaagcatggctatcaattattatctaaagctgttgctatgattatgcagtatgttttaaactgcagaagtgcaattcctccatgcccattaaaacttattgatcactccaaagggttacatatacatagacagacaacgcaatgaaaagccttgatccacagttgtcaacctgattgtgtgtgtgtagtgtattttgactaattttgcacagatttcaatatagcatgtcaagagccaaacatatttaacattgagtaattcttcctatataatagttatgatgtgccattgtttacaatttcagtattctgaatttatatatgtgtgtgtatgcatacaaatacacaccccttaaaaggaaaccaccattcaaaaaagtgtacaagtgtaggagcaagtgagcatagctgataagagttggatgaatgaacattcagacttggatttatatctatgctttgctactaaaaagttttatctgcctcaacaaggtcactttcatctataaaataggaataatattagtacttactcttagggccattgtgaggtcataatagctaccatttattaaagctttacaacatagcaagggagtttttctagatcttttgaataagataatcaattcaaaacacttattgtaatgcctggatcatgcagaaagcttcataactggtacctgttattgcaagtattagtatttgcaaaataaagattttatgctaaattagtaactaatactttatagcttgaatctttctagtaagtatctaaatattcaaatactagaatatctcaaaaggcaagaagttgaaatctcttatcccagcataacaaaaaagttacaaaggcaataatatgtaaataattaaatggaaagttaaaagtttcaattaagaatatcagtcaaaaataaaaggaaaatttattagcctgttcttacactgctataaagacatacctgaaactgagtgatttatgaagaaaagaagtttgactcgttcgtgtttgtggcattatagtattccttggtgtaaatgtaccacattttctttatcttgtctatcattgatgagcattaaggttgattccatgtctttgctattgtgtatagtgttgcaatgatacacatgcatgtatctttataatagaatgatttatatttgggtatatacccagtaatgggattgctggcttaaatggtttttctgcctctaagtctttgagaaatctccgcattgtcttccacaagggttgaactaatttacactcccaccaagagtgtaaaagtgttcccttttctccacaacctcaccagcatctattgttctttgactttttaatagtaaccattctgactggcgtgagatgttatctcattgtggttttgatgtgcatttctctcatgatcaatgatgttgagttttctttcatatcgttttaggtcacatgtatgtcttcttttgagaagtgtttgtttatgtgctttgcccactttttaatgaggttatttgtttttttcttgtaaatttgtttaagttccttgtagactctggaccattgtcagatggatagatggcaaaacttttctcccattctgtaggctgtttatttactctgacggtagtttattttgctgtgcagaagttctttagtttaattagatcccctttgtcagtttttgcttttgttgcagttgcttttgccattttcctcatgaaacctttgcccatgcctatgtcctgaatcttattacctaggttttcttctaaggtttttattgtttggggttttgcatttaagtctttaatccatcttgagttaatttttgtatagattgtaaggaagaagtccactttcaattttctgcataggactatcccagcactatgtattaaataggcagtcctttccccattgcttgttttttcaggtttgtcgaagatcagatggttgtaggtgcgtggtcttatttctgagttctctattctgtttcattggtctatgtgtctgttcttgtaccagtaccctgcttttctggtgactgtaaccttgtagtatagtttgaagtcttagcttttgggctgagacaatgggggttttctggatataggttcatgtcatctgaatacaaaaataatttgacttcctctcttcctatgtgaataccctttatttctttctcttccctgattgccctggtcagaacttccaatactatgttgaaaaggagtggtgagagatggcatccttatcttgggccagttttcagggggaatgcttctagcttttgcccatttggatgtgggtttataatttatggctcttattattttgaggtatgttccttcgatacctagtttattgagaatttttaacatgaagggatgttgaattttattaaataccttttggttgtctattgagatagtcatgtggtttttgtctttagttctgtttatgtgatgaatcacatgtattgatttgcatgtgttaaactaaccttgcatgctagggatgaagcaaacttgattgtggtggataagctttttgatatgctactggatttggtttgctggtattgagaattgttgcatcagtgttcatcaatgatattagcctgaagtttgcttttctttctttctctctttctttctctctctctctctctctttctttctctctccctctctctctctttctttctttctttctttctttctttctttctttctttctttctttctttctttctttcttctttccttctctctctctctctctctctctctctctctctctctctccctccccctccctccctccctccctccctcccaggttttggcatcagggtgatgctgacctcataatataagtttgggagaaatcccttcttttcaatttttttggaatagtttcagtggaaatgataccagctcttctttgtaccgctagtagaattcagctatgattccatctggacctgggcttttgttggttggtgggatatttattattgcctcaatttcagaacgcattattgatctattcagcaattcatttcctttatggttcagtcttagaggggagaaatgtgttcaataatttatccatttcctctaggttttctagtttatgtgcatagaggtgtttatagtattccctgatggttgtttgtatttctgtagaattattggtgatattcctcttcaaatttttcattgtgtttatttgattcttctctcttttcttccttattagtctaactagaagtctaccttttttatttttatttttttccaaaaaccagctcctggattcatttagttttttggagggtttttcatgtctttatctccttcagttcagctctgatcttggttatttcttgtttgtttgctcttggtttgctagtttttttatttgagatgttaggctgttaagatctttctagctatttgatgtgagcatttagtgctataaatttccctcttaacactgctttagctgcgtcccagagattctgataaattgtctctttgttctcattagtttcaaagaactgcagaggtggcagctggtcttcctcccagaagctctgtcccagggagagatcagagctctatccattgaatcctgggtggaatggctgaagccccctcagggaggtcccacccagtgaggaggatggatcagggtcccacttaaagaagcagactggccacgatctggcaagggttgccacacactttcaaacaaacaaatctcatgagaactcttatcaggagagcagcaagggggaggtccacacccatgattcagtcccctcccaccaggcccttcctccaacactgaagacagaattcaacatgaggatttgggtggggacagagagccaaaccatatcataaaataacagcataaacaaaatgaatttaaaattaaagaatagctgaatagttcgtaattgcaactacagtcatatgctgcataacaacatttcagtcaacaatgaaccacatatatgacagtggtctcataatattattatactatattattttttacttttatttttgcttcagaggtacatgtggtggtttgtcatatagataaattgcatgtcacaggggtttgttgtacagattatttcatcacccaggtaataagcatagtacccaataagtagtttttttaatcctcaccctcctcttaccctccagcctcacatagaccaccgtgtctgttgtccccttctttgagtccgtgtgttctcaatgtttatctcccacttagaagtgagaaaatgtgatattttgtgttattgtgttagtttgcttaggataatggcctccagctccatccatgtttgctgcaaagaacacaatctcttttttcatggctgcatagaattccacagtgtatatgtaccacattttccttatccagtctaccactgatgggcatttaggctgattccatgtgtttgctattgtgaataatgcttcaataaaacatacatgtgcatgtgtctttagggttgagggatttatattcttcttggtatacccaataattgttattgctgggtcgaatggtaattctggttttcgttgtttgggaaatcaccaaactgctttccacggtggctgaactaatttacactaatatcagcagtgcaataaacgttcccttttctgtgcaaccttgccagcatctgtgattttttgacttcttaataatagccattctcactggtgtcaaatggtatcttattgtggttttgatctgcacttctctaatgattattgatgttcagcattttttcatatgaatgttttctgtatgtatgtctttttctggaaagggttcatgtcctttgcccactttttaatggtgatgtttggtttttgcttgtaaatttaagttccttgtagattccagatattagacccttgtcagatggaaagtttgcaaaatttttctcccattctgcaggttgtctgtttactctgttgatagtttcttttgttgtgtagaagttctttagtttaattaggtcccagttttcaatttttgtttttgtttcaattgtttttggtgtctttgttatgaagtctttgcagtttcaatgtccagagtggcattacctgggttatcttcttaggtttttatagttgttggttttagatttaagtctttaatccacctcgggttaatttttgtatatggtgtaaggaaggggtccaatgaataggcagtccttttcccattgcttgtttttgttgatttcattgaagaacagatggttgtaggtgtgcagccttatttctcgactctctattcttttccattggtttatgtgtctgttttttgtaccatgctgttttggttactatatccttgtagtatagtttgcagtcaggcaatgggatggttccagcttttttctttttgcttaggattaccttggctattctggctcttttagtggctccaactgaatttttaaatagtctttttcttattcagtgaagaatgttattggtagttttttgggaatagcattgaattaaaaagtgctttaggcattatggccattctgtcaatattgattcttccatgagcatagaatatttttccattttttgtgtgttatctctgagttacttgagcaatattttgtaattctcagtttagcagtgtttcacctccttgcttagctgtattcctaggtatcttatttctttttgacaattatgaatgggactgtgttcttcatttggccttagcttaaatgttgttggtgtgtaggaacactagtgatatttatacattgattttggatgctgaaactttgctgaggttgtgtatcagatcaatgagcttttgggcagagactatggccaaagtatagaacctcatcgtctgcaaacagggataatttgacttcctctcttcctatttggattgcctttatttctctttcctgattgctttggctaggatttctagtactatgttcaatgagatttgtaagagagggcccccttgtcttatgccagttttcaagcacaatgcttctggcttttgcacattcagtataatgttggctgtggactttttaaagatggttctaattactttgaaatatgttccttcagtgcctagtttgtcgaggatttttaacatgaaagggtgttgaattttataggatgccttttctatatctactgaaatgatcatgtggtttttgattttttgttctgtttatgtggtgaatcacatttattgacttgtgtatgttgaatcaacctcgcaaccctgggatagaagctccttgatcatggtggattagctttttgatgtgctgctggattgggtttgctggtattctgttgactatttttgcatctatgttcattagggacattggcctgaagttttcttttttggttgttgtgtgtctgccaggttttggtatcaggacaatgcttccctcatagaatgagttaggaaggagccgctcctcaatttttgggagtggtttcataggaatgataccagcttttccttctatatctgttagtattcaggtgtgaatctgtctggtcctgggctttttctggttggtgggctttttgttcctaatttaatttcggaactcattattggtctgttcaatgattccatttcttcctggttcaaacttggaaagttgtaagtttctagcaatttatccattgcttctaggttttctagcttgtgtgcataggggtgttcattatgaatagtctctaagggttttctctatttctgtggggtcaatggtaacatcccctttgtcattttttattgtgtttatttgagtcttctctctttttttctttattattctaggtagtggtctatctttattattaattatttcaaagaaacagctcctagattcattgaccttttctgtgcttttttgcatctcattttccttcagttcagctccgattttggttatttcctgtcttctagctttggggttagtttgctattgtttctcgttccttgtgatgttcgttttgtaattagagatccttctaactttttgatatgggtgtttcgtgccataagcttgcctcttaacgctgctttgtgtgtgtcccagagattctggtatgttacatctttttaaattttcattagtttcaaataatttcttgatttctgccttaattttattgtttacccagaggtcattcaggagcagtttgtttgatttccattttaatgtatggttttgagcaatttgcttaacattgatttctatttttattgcactgtggtccaagagtgttgttggtataattttgtgggttttaaaaaaattttctaaagattgttttatgcccaactctctatatcatatttttattgtacctttcgatatgtttggatacacaaatacttaccattgtgcctacactattcagtatagtcacatgctgtacaggtttgtagctaggagcaataagctgtaccacataggttggccgtatagtagtctgtaccatctaggtttgtgtaagtacactccacggcgttcgtacaaggacaaaattgtctaaggatgaatttctcagaatgtgtcccagttgttaagttatacatgacttgtagtgattcctaataaactggagacagtggtagaaaaaaagtattttattttattgtatgtccttttgtattctttaaatttgctttgatgtacttatgtttctttttttaaatgtgcattttttaaacaagtggaagagaagatggaaagaaagaacttcatttcttgagcatagtttgtttttcccaggcctatcaaaataacacaatcttactgcaagaagaggcacaccctggaataatatcaggatgctggcaaatgctcttccaatttttctcagaatgagaaaatgtaaattttaaagtttaaatctttttaacatatgtaatcttatgagtaagaaggttgagtatagaaaaattcttcaaatttccctgagcgtttagaaaagatagtggttactgctgatatttaccattatagagcacttattttattcagatattatatcatttaattctcaaaaccaggactggctacataatttgtgggcccagtgcaaactgaaaacaagggcttcctgttcaagacctaagaatttcaagacagtggaagcagagcttgaaaacaagcatggaagcctcctgagcaggggccctgggcaactgcataaattaccagcccatgaagctgtccttgcttgtaacacacctgtgaagaaatgtgttactcttactttaaagatgaagaaaataatgcatagatttgagataagaaccaaccagccccaaatgtcacagtgtataaactatggatctggtgtttaataattgtggagactggctccaatgcctctacttataaccactctaagaggaatcagctcccaaatgtaaagacaagtatttctaaactatttcccatttttactagggaaattaacttgcagttaaaatgaatagtattttaaaaagaaatgtattttcttttcatgatatcattttagagtcttaaatagactcataatcaaaatgaagaaaggtgactgggtaaaagtatagttagctagatacaaagattgttgaatataggtcaaactatattctattctagttttgactctgccatattaaacattttagtgaaggcactacgttattcttatcatgcttgaagttttcctcattctaatgcattgagtgacaggagtatgattccatagatcttaatatataaatagaaatgatagatttaaaacaaacagtttggcaaaactttcaaaatttttctttgcttacaaatgcaacattttgcagataatatcttatagaagaactttggaaactaaaggaatacagaaatatacactgtgcaacagaaattttctctactttctctgtcaaaaatcaaccaatgtttatgtctagcattgtttactcaatagtgtaaagcaaacgttttccaatgacattaaaatatttgaaatataatactccatccacattcatataccataatgtacttaaaccatcatctatgacatgaggttgtttccaaaagttactgttagaaagaccctataaacaaggataaatattatatctagccttcagcatcaaattaaatctaaatgttaaaatgctagctgagagaaatctgttttcataacatttaaagagaaaattacttgattactgtatgtttggtgtatgtaattattttgcatactggtatttttcacgtggcattcatcttcacaattatttgtgtgattatcatcgtccctattttgccgtaaggttcctaaatatggagtttctattttactcatttctgaatgtcctatagtgaatatatattcaataaacattagaattttatagaaaccttgtggttcagctgctgaataacttacacagttttagaattctttgattgactatggtgtccaaagccaagaaacattggttttggatgacgaatcaagttatatctacttctagcaaataactggcattatagagtttgaaaatgatatttatcagggtcatgattattagatttcaaatcttagaatatcaggtagaaatgatattcaatttactctgctttcattcagaactcaaaacaagttttaacaagaggaagtcttaatcaggcaggattcctctggttgttaagaacatctttcccaatggggaaagtttgcttgcatgctaagaaaggagctttctgtttcagggagtagtgagctctgtaataatcaggaggtcatgttaaatggccttcgtagtccctctcctgtctatatttcctaatgattctaacacataattaagtgtcaataatagttatagtcaataactataagccataaggaaatttagtacatgactgattgttttttattctgattgtatgaagtaggttttgagagtgattattaatttgttatatgtaatgagttctaccctatatttacagggtgaatgcacagttttcttatttctccatcccgaaggaaatgaagtagtatttttcaattacagtgtagtagtgattattatatagaacaattacagactcatgtcttactactcttttattaaaaatgattcatttttctttcttaaaaggttgagtatatttttaaatgccgcttcacagtatatcatgttgtcatttccctttaccctccatgggcacatgtatccaattttataagtagataccacgaaaatattaatattacagaaattaatttaagagtcaaatttttagtagcacaaatgttctatgagattggatataactgcatgaattagcttggtattttcagaatctctgcattctggtctgtatgtttaaaattaggtattttcttaatctgcaaaatattatcttctagcctccactgtatgcaaagaaagtgtgctcatggttaaaaaaatattcaaataaaaaaataaattatcttgggatcctactaaaaactgcattttctttgcaaagcaagttttctcatggttaaaaaatattcaaattacaaagtaaatgctcttggaatcctactaaaaactacattttctttttgactagaaataaaactaattttatcacgtaatggtcattttgtgttgggtgcaatgtttgagtttatattttaagctttttttagagctatgttgctttctgctttcatcttgacataacttgtcaacagacttataattaaagttgtttgaggttcagtgattcattctaaataatgaatctatggagatcctagagaagataaaacctgtgcttggcaaatgtagaaactgtaattcttagtatccttttagcctaccaaaatggaaatccttcagtccctcacataggtaaagatatgtctttaacaaaaggtagcctttttaagctatgtatgtcaaagcaatttttacttaagacatcatggaaaagattttattccttcactgttcattgccaatttggaagctgaaataagaagatcctgaggcttttcccatttcctcacatgaaaggaatcagtcctcgtgtatgaggcagggagattactacaaacccttcccttacctcttggcaaattcaggaaaattgctaaaatgaatcttgacccagccagatccctgctcctttgcttgtaaccagaggcagtttcaatgcaggcctcttgtgacttccttggaaacagaccttgcatataagttggattgccagaaggataatgattaccatcccaagaggtaacgttacaatcgtcatgagaggagctctgtgagacggagaatatgataaggaatgattgtctcaccattatatgacttgtctatctcgtaatgcccatgtattgaggtgatggcctctcatgtcttggctcacaaaatgtattattccaaagatggatgaactgttgcccccggcccgctgccaaaagtatgaacaggaggtaattgagattctaaaccaagaagtgtctccagtgatgaatatgggaactcaaatatttgaacataatcactaatttaaatcaaacaagagtagtgtgttttttagcatttgaataacattcaacataaagatatatatggactaatacatactttatgttaaccttttattgtaattttaaaagctgtttcacttatttgattaaagagtcgttcattaccaagttgaaataattttatttaaaaatgtataacataaaataatcaatgtgtatgataaccaaaaatgcattctacaaactattaataagcatttaaaatgttctaggcaatggaattggtactgatgtacgttagtaacattcatattaatgtaaacattttaaacagcatgtagaattaactatcagaatgaattatactctacatttttctcctctgcccccaccccttatttcctacagtttgaccaatatattgaaggggcgctaaattgactttcgatgttgagattactttcccttgctatttcagtgaaccaaacttaagtcagataaaacaattttatttggcttcaatatggtgctattttgatctgaaggtcaatctaccaacaagcaagaacagtttctcattattttcctttgccactccaagcagtctttactgaagtctttctagcaatgtctgacctctgtttcaatacttctcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggtgagagcatcttaagcttttatctgcaaatgaagtggagaaaactcatttacagcagttttgttggtggtgttttcacttcagcaatatttccagaatcctcgggtacctgtaatgtcagttaatgtagtgagaaaaattatgaagtacattttaaaactttcacaagaaatcactatcgcaacagaaagtaaatgcttaatggaaatggtgttttctggggtgaaagaagaaactatagaaactataggtgataaactactgtggtagcattttaatcctaaaagtttctttctttcttttttttttttcttccttataaagggcctgcttgttgagtccctagttttgcattaaatgtcttttttttccagtaacggaaagtgcattttcatgaagaagtacacctataatagatgggatccatcctggtagtttacgagaacatgatgtctcagtctgcgcatcctaaatcaggagtaattacagaacacatttcctgttctttgatatttataaagtcttatcttgaaggtgttagaatttttaactgatctttttgtgactattcagaattatgcattttagataagttaggtattatgtaaatcagtggatatattaaaatgatggcaataaaattttatgagtgcaaagctggcataaaaattattttaaaaggtacaatttccctttcattccagttattgtaattctaagattaagaaagaacgttaaaatctgccgtatgtttttaagcagcatatgtttagaaactcatggaacacttgacattagaatttgtgtataccagggtagagaagtttgaaaagaacacacatctaaaaataccatgtcagatgttctaagaaaaaaaataaatctagagaagttattcaaatatattatttgggatgtttagtacttctctattaactaatgacttatgacctactttgataattccaaagtaaatcactgggccttttctccctggttgtgtcagcttggctaagcaaatccactagtccaggggtcaccaaactaagacctgctaaccaaatttagcatgctgccagtttggtatggctcatcagccaagaagtgtttttacgttttcaaatggttgaaaataatcaaaagaaaaataatattttatgacatgtcaaaattacataaaattcaaatttcagtgttataaataatgttttagtggaacacagccaaactcatttatttatcacttatgattactttcgcattacaacggcagagtttgaatagttgtaacacaaactgtatagtccacaaagcctaaaatatttattacctatcctatcacagaaaaagtttggcgacccttgctccagtcaaatggctctcaaactctatgaatattagcattctttttgtggcaacaactttcaggaacttccaagcactctactcacgatggtaatagaaaatctaacaaaaattgatggagtgaaaagcataatggcacaaatccgtgaagcttttgatgaatttcttttattattcctagtaagatgtacattaacttgtttgttgtcacattaaacatgtgtttatagacaacgcttagtggacatacagatttatggatactttgcaacattccaacaaccctccaacagttctccaaacagagtaatagggacacctagttgcctaacacttttaatgtcttcaggacttgcctaatacagaaattaacagagcaagctgattcatgtcaatctctgtcttcaaaagcttattattggctcctgtttggagaatggattgtgttggaaaaaaaaaaaaagtgtgttctgacttctttttgttttcaggaaagagtggctagtggtgaaataccttctctccaaaatttgtttgtatcataagttttcggcaatttttgtatgtgcctaaatgagaagtcccattgggcacatacagaaagattcttcaaataaaagctaacataaattgaggatttattatgtgctcagtagtagattcagtgctttattggcatcgcatgtatttttcccagtaacctcccaaaataggtatggctataattactttataaaattatacacagctacagtgtacctcagacaggatttgaactgaggtagctacaaaacctgggctgtatagtaaaatgtctttttcatagatatatgactaaggtaatcctattgatttacctgaagccatcccagttacacctgttgtcccagcataattatatatagcatcaactttcactctcaagtgtgtcctgatttggacggcaaaattatctgaacacgctatatacgacacttgattgataaatttagactgaacgaagatagcaaaaaggcaaacatttaggaacaaattcattaattgataattgtctacagggtggaatcttgttaaagtattgtaatgattaaagaggcatcatgcaaatataaccataagctttatattagctagtgccccgtttttgtatcatctgaagcccactaatatttcactgaatattgaggtcttgaccatctgttgaatagtgttttatttaaatgatgtcctcttccagcttctgtgacacactaccagttgtcacccacgactctttacctgacttgttttattccttctgccttattcctatgggagtatcacacagatccatctctttgcctttctgacttcttttattttgagacagtgtcttgctctgtcacccaggctggagtgcagtggcgggatctcagcttactgcaacctccgcctcctggtttcaagcaattctctgcctcaacctcccgagtagctggaattacaggcaccctccaccacatccggctaattttttttgtattttttagtagagacagggtttcaccatcttggccaggctggtcttgagctcctgacctcgtgatccacccacttcagcctcccaaagtgctgggattacaggcatgagccaccatgcccggccttttgacttctttatctggattatctcctctcattgattcgagcctggctctaagtgactgactcccaaatcatgtagctccagatgtgacactctccctcaaattaaagctttatatctctaaagctatttccgcttgtgcatccagcaactgcctcaatgttcatcaaatgcaaacatttgttccttccaattaaccatacctacttatacattgcacacatattttagttataattcattgcctgtgtgtctagagaagtagcaaatatggaaaaaatcattgcttttggaatcagaattactgaggtttgaatgctgccctttttttttttcccaacttttagtttaggttcaaggggttaacgtgtaggtttgttacatgggtaaattgcgtgttgtggctgtttggtgtacagataattttgtctctcaggtaatcagcataatatctgataggtagttttcccatcctcacctgcctcccaccttccactctcaaataggccccagtgtctattattcccttctttgtgtccatgtgtactcagtgtttatctctcacttataggtaagaacctgtggtatttgtgaaacctgcctgttttaattactagcttatgagcgcaggcaaattacttgttatctgtgcctcagattccagtattctcactttataaaacaactgtcatgaggattaaataagcatttaatacattgcctttaaggtggtaaacattcaataaatgcagtggttcgattcttatttggtggtggagaccatagagatgatgaagatggaggaagattgtggtgggtaggaggagtagaagtgatggtgggagaggtaacgatagtagagatgatgatgatggtggtggaggtagtgatggagatggtagtcatctattatcgacagggaaaaattccataataaacattatctcaaacctaagaaatgtaaaattaccttcctgttttcctcttcaaaacagaatttaccacctgacatctctagttctgtgaatttttcttctactttcttttccttatttattataattagattgtattattgggcaagtgccatcatttccgtcatttcatgttcattcgaattgccaagtccataacctgagccatatacctcactgtggagagaactgccctcctttctaattgatttactaaaatgaatatatctaaaatgatgctttttgatgtctctccagacatgcgaattcccataaatccagatacctccaaaataaaacccaagtgcttcctatggcattcagtattattctcattctccactaattttatgtctaccttcccaataatcattattccacttcagccagtaaattacattacattcgttttgttgtatgccttcatgccactcacataaaatttctcattgcccgtcaaaacaaaggaagcctattattacacttctttatgttttacttagattccattgtagcaaataccgtggatacaataagtaaccaataaatgtttgttgagagagtgaatggtatataattcaaataattgcagtaactaaaatttgacatttcaatatcatttaaaaattctacctagctcttcctggaattgttcttaataataaacgtgaccatcctgatgatctttaataattccaattttacccattagggtatccttatttacccaaaacaattaagggatttaaaattcagctttctaccacatagtttcttaactatctaaggtacatttagtcgattcctaaataattatacagtttctacatatgttgtatttattgcataaatttttctctttacactgagatttgcaaaagtgtctgatgatcttgggtcacaagataattatttctaatagcaaattattcctgcaattcagtgatattattgtacacgtaggtaattatcagagtaaggaactcagcctagggtaaaactagatctattatctagttaattggtatttatccaggagattacttcctaatcatgtagcagttattttaagggatttttaaaaaaagctttaatttatacttttgtagcaaccaggcagaatgaatggcaaattgtttttaagtgaatgccatcttaataaagataatttcccccaagtaaagcgttcataaatgaatatctttgtcctcaaggataatgtagaggcattttgaaatgcctcagttcacctggtctgttttttccctccagggtaagcagacagaatgtaagcttgctttctcggctatttcctgcatcctaactacataggaggataaattgactgatctacatacctgaattattattatatattctacttttcagtttgtttctgttttttgtttgtttgattttctttttatggctgctgtccagatgaagttaaattgtgtcacatctctggaaagaaaatagataacagataagaccgctctgcagttttgtgagactcatgcctaaaacatttttgttttagatattgattataacttcagtttctaaactaaaatctgaaagttgtatggcaaaatataccaagttatttgaaggacctaattagataattaatgtgtccgtgaactttttttttttaatgttctatatgataaattgatcctaaaatatctgggatgttaaactcagtaatgacacttttgcctattggcacagcccatagaaacaaaacattttagatgatttgcttctttttttcctaaggagactagacttatgcatgtttacaggttaattgaggtccagaaaggttaaataacttgctttcagttgcaaaataaggactggtgctgactctcctaaatccattctagtgttatagttgcaatgtcatgttactttttatgtattaaaggaaaatgaccttggtcataaattcaaatttcgctttagacactattttttgttaaaaaaaaaaaaaaaagaaatagaaatcttgcataccatcttcacatcctcaaaaagataaccatctattaaatgttcttgagattatgttgtcttatgcatcaagaataaatcaatagcagtgttttgaagaatatagtaatgtgaattctagagaatgctatgggatcagagaatacttagaacagtaatattcaaactgcagtgcatgaaacagtatcatcacctgggaccttctttgaaatgcagatttggagggcccttcccaaacctgctgaatcagaaacactgctggtgggcccaaaaatattttacaagcactctcggtgatacttatacaccataaaatttgagaaccctcgcactggcatgacaacagtggttctcatgcttcagcatgcgtcggagtcaccagagtttctaattctaataggcgtggagtggtgcccaagaattttaatttctaacaaggtcccacgtgattctgctgctactgatttagggcccacactttggaaatcagttcactggagtgtcttgtcatttacagtctgacccctgattctctttccttatgacagcccccataaaggggctttcacgtatgtccgtgtgaagagaccaccaaacaggctttgtgtgagcaacaaggctgtctatttcacctgggtgcaggcaggctgagtctgaaaagagagtcacggaagggagataggggtggggccgttttataggatttgggtgggtagtggaaaattacagtcaaaggggatttttctcttgtgggcaggggcgggggtcacaaggtgctcagtgggggaggttttgagccaggagaaggaatttcacaaggttaatcgctcggttaaggtggggcaaaaacaaatcacaatggtggaatgtcatcagttaaggcagcaaccgggcattttcacttcttttgtgattcttcagttgcttcaggccatctggacgtaaaggtgcaggtcataggggaaaggatggcttagcttgggctcagaggcctgacaggggccatctattcctgggcaggttaagggatgctactgttgcatcttgtgacaccttactgctttatgatgaaatgatctatccatatgcttgtttcatccactagaattaaagcttccctgggccaggatccatttcttgttcgttacctgtgtgatgtcttctgtgtagtagatgctcaattcaagctgtgaatagaaatgcactatattgagaactggtcctatgagatactatatctttggatgtctggctacagtagctatgtgaaaatgtattcttccagaatgcaaggcgtaaaagaatatcaacacgaaagaagacaggatcacattcccagagctgttacatataattttgttcgttttttgagtgaagaaaatggtactcatacttattcatctaaaaggagaagcatagttgagtgcaaataaaagtcagtttttaatcagaagacctgaactatctgtattcccttacggactcctgattctttcctttaccctctcatactctacatcgagcactgaaactgctctcagcaaggtcgccagagagctccttaattgccagctccaaaggtcactcttcagttcttttccctttttgacctttgtcttgtgcttgacagaaatgattagtcccttcttgaaatttttctctcctgcagtttctgggacattgttctctcctgttttctttcagagtatatcttccctgtcttctattcctgccctttaatgtcagtctacataagactcaaattgtgattttattttcttcttatgatgctttattttttggggaaatatcatttataatctttatcatcacctatatttttgattcacaaattgatatttctacctctccctctctcctgatgttcatccctgtataattcaaatgcttataggctatgtattcctggatttctgactggaatctaaaatatagttttggagtttagatcgtataactctagagagggtcattcacatcatagtctctaagaatggtacatcctgaacttgtgcagtgagcaacctgtgcagccattcacagtggtcttgatatctgccacatcactaaatccctccaaatgtacctgttaaattctctttagtttgttatttttttctacatccttgctgccttcactctagttaaaactgaaatttttctgtatgaaatttttaactgatttctctgcctctgatctcacctctcttatccatgctttttacagcctcccgagggatatcttaaaatgcagttttaattagattattcccctgcccataaatcttgaaatgcatggcgtagaaattcttttgtgatctttagctgcctacctctccagcttcactcccttctcctctgctccttttttaaaaaaaataccagtgctactccaaataatctgcaaactttttagtaccagtccacaattgagataagaagcttgagccagaatataaatcaatgtactccttcctttgtcaagaaagttcggcaattaaaagcaaaataagatcaaatcgtttgttcagtgactcagttgatttatactctggtgaaaactcttttcttcttacagactaatagcaaacagttcactgtctgctaaagtctgaactttgttccgcactgccctatgctttagcttaaattaaccactctttgatctccaaatgctctgtgctttcttaagcttctgtttctttgtacctactgttttctctgcctaagattctctttagatacctttctttttcccattcccatgttacctgccaccgtgctactaaccaccttgtctttctggttatctaaccttgcagaggcagttctcagccatttgtgtgttttttttttttttttttttttttggagacggagtctcactctgttgccagtctggagtgcagtggcgcgatctcagcttactgcatcctctgccccgtgggttcaagcgattgtcctgcctcagcctcccaagtagctggcactacaggcaagggccaccatgcccagctaatttttgtatttttagtagagatggggtttcaccgtgttggctaggatgggcttgatctgttgacctcatgatccgactgctaaggcctcccaaagtactgggattagaggcatgagccacagtgccaggccacttctcagcctttttaacacttctattaaaacacttgccaaattgtatggtaatgactttatttttgcatgcctgtatctccagtaaacgccttgagggaagaaatcatttcttgtcatctgtacacctataatgcataaagcagaagtcagctcatagtaggtattgaataaatatttattggatgttgatgagggattttccaggttttgtgcgagtcttgtcagaaaaacaaaatcactgtgatttaaagagaggaaacgtaatataaggaattggctaagcaggtagtagaaaactgagacgcagcgcaggggatggagaggcaactcaaagcactagtaacgtaaggaagctgctaatatccctagagctggagaaacaatacagaaaaagtgatattaccagagctcagaagctggggctttctaacagagattaaactaaagttaggactgccaggcagaaaattggattgttgaagagggagctagctatccagagaaaacagaagccacagcagagatacatctgctctagaaatgccacccaaggtagttggagaagaaaaaagaccttggcttttctcttcctcccaccttccaatattctgccattgcctccaaatgaacaattaggagggcaagtggtgttgggaaatgtatatccctctaatacagaaagtacagaagaaatgtggggaatagatctgagagcagatgggcatattactgcacagatgggttctggccgtgcatcttctgctcataaactatgtgacttaagccacttaatctccccaagaatctatttcgtcacccctgaaatggaatgtatatggccttccctgtttgccctcacactgtggaaattatattacatgtgtttgtcttgaagaacgtttacatttaaaaaacaatgtctcctttccccaggagaaagttgagtttccaattattaattcagggatggtatcttcccatgaccacatttatatattattcttattctgacatcttctgagagtattcttagtaaagtcttccctggtcagaaacctgtctctttacaaatgaacacatattatgctaccacagagatataaaaatgatgccaggctgggatggcctgaattgtgtcctccctaaattcttatattgaagctctaatctccaatgtgatggaatttggaaatggagactttggaagataatttgatttagatgaggtcatgaagatagggctcttctgaggagattagggcccttataagaagacacaacaaagagcttgctggctctttctccctgccttgggaggacacagcaagaaggaggttgtcttaggctgttcttgcactgttataaagaaatacctgcaactgagtgacttacatgaaaattgatttaactggctcacggttctgcaagctgtagaggaagcatggtggcgtctgcttctggggaggtctcaggaagctttcaatcatgatggaaggcaaaggggaaacagtcacatcacatggaagaatgggacaaggagagtgagacagtgcagggggaggtggcacacatttgtaagtgagttctctcaggagaactcactatcgcaaagacagcactaagccgtgagggatccgctcccatgatccaaacacctgccaccaggccccatttccagcactggagtttacaattcagcataagatttgggaagggacgaatatccaaactataccagaggctgtctacaagccaggaagaaggctgtcaccaggaactgatcctgctggtaccttaattttggaattgtagcctatagaactgcgagaaataagtggctgttggttaagccacccagtctatggtattttgttatgtaagtgctagctgactaaaaaccggctttgttaagcaatgagtattacttctgttttgactaaagttcatagtgatgcttactaacacagtagatggattgaaacaggtcatgatgctggcagtggggcattaagtacacgtcagattgaaatggctttccacattgcactagatccttttggaacccgggttggaagttatttaaacttgaaagacccacaagcatgttgacttctcttaaactcaaggacctttcacactgagagagtttaaagtttaaattgcctcccacagggtccaagtcatcatccaatgcatggtgggtttctttgaacacttctgtagtcattatgagtccacatcatttcaagaaagaagagacagcaacattagttttcatgctaattttcctattcactcaactaatatctaatggattgctatggtatgtaaaacactccagttactttaactgtaaatctaagctttccctcaggaagcttgcacccagcataaactgtcatgaagaagtactaataaaatgttagaaaagttttaaggaagaaaagttcacttcctgcttgagaggcatggaagacttatgggaaaattagcatctgactggataattaaagagtagggaagcattgggctcaagatgaggaaagtgacaattcattgcaggggaaagcctgtatgcgaacaaaacttacatgggattaagtattcttgtttgcctccagcagaagtatgaagtaaaggaagtttagaagtaaggaatgaggttgaaaaggtaggttgagttcataataactaaaggtattcaataaaagattaaggcatgtagacttaaaccttctggtcatggggagccattgcatatttttgagagagagaaatatgatatggctactgtgaaccatatcattttgatctcacttgagagttgggagagagaggccatcttaccttggtttcatagactgggaagggggaaagaaaagttttctctaaagggccagagagtaaatattttaggttttgtgtatcataaaatttattttaaaactactcaactctgctgctatagctagaaagcagccataaacaatgtataaatgaatgagcatgactgagttccagtaaaattttatttaccaaattagatggcagaccatatttgtcccatagaacatactttggggattccggcactaatgggtaaaatgagactattttgctgttgatttttgtttatatgtttcattgtctttgttatagctgtgtttgcagtttttattcttgttattccaattgtggcttttactttatcagtcattaagaagacactaaaacaaatatgactactctcacacgtgagaaagtgagaaatggcatagggcttaaagccagttaaaaaaggatcatggaagatattaataacaatagctaatatgtatatggcttctaccaagtatttgctacatattaatgtatttcacacttaaaatagcattacgaagtaagttttattattgtcactctttgccaatgataacaatgtgtcatagaaatttcaagtgacttgctcatggtcacatagtttacaggaagcatcgcagctaggatttgaacccagacagcctagcttagggtgttgccttcggaaattcctcgccttgctatgttgtaataagttaaaggtgatttcatcaaattatttagctgaaataaaatgcttgactgggactccttaagaatttgccaaagtctatggaagctgcacttattctagattatgtctgttctacattctgaagtatcattgactctagtgtcccatggcaacacttgattatctttaaatacagagacctttttcactgaaaagatttctttaaaatttagatgtctttttcagcatcaaaaataagtggaatttccatataattgaacttttttttccaagtgcaagacttttggagctcaccatggtcttaaccacattatataataagtagtaacttttttcatctatgcttaatattttctctgatgtgagaaattgtatcatcagattagaaagttgaggattttaggaaattaagggaaattccaaggtaataataaattgggaaataaattattttatattgccattagggtacaaagtatacaactaaggatcatattttaatgaaaaatttcagaattaatatcctgatattagagacttcaatcaaattctcatataatccaagatagcgtagtcaaaaccactaaattactgtactgtgtagcaatgaacagtaattctatattgacttatccttattttttttttaagatgggtttctcgtttatttggaacaaaagaaaaatgtagtgttgtagaaatctttggattcagacagacctgttcttgagtcttgactcagtgcttcactgtgtattgaaactaaatgaagatcttcaacttttctattcatgatcaatctgcaaaaataaaagctattacagataacatacaaggtttcttgagcgattaagttttctttttgaaagcctgtgacctgattaagatgcttaaaatgatatatatgtctcttttctgttctttaaatttgaatgaaagtttggcattttaaaaaactttaggtgatttaggagtataattttaagcagatttttagagtacgagtgtccacatatttaactaaacattcaaaaattagttaaaatcaatgaacttgggaaggaaaactacttgctacataatccagaaaattttactaaattatttgaactaagcatgactctccaaactgtggacatattttctcaagggattctatgtattatggcttcaaggtacttttgtgtgtacctcaaaatggctgaaggcattttaacagtgcatctgagagtgtcttacttacatattatttgtacactattttatctatatctttggacattttatatttctgtgtaagtaaaacttccatgaaaatttcatttgtcaccatattttcgttatgcagataagaaaacgaaagaagccaaattgaagacaagctctgaaagggaatgtgcgccctctagtgacccacatttatttatcataaggacataggcagcttttgggtttcatcattttaaataaactttacatttgattttaaaatatatgactcaggattttcaacttgagtatattatattgtatgatcatagatttattactctgacaggatttcatctatcatttaagagaatatttctattaacctgtgttaaggtgattttcttgcacagaagtgtgtttcaaagggactttcaatttattgaaaatgaaaaataggctttaggcatctgtggcttagcagcattttatttcccatcctctgggtcatgcagtttttgcccacgtgttttcacactccttggctttataactaattcctctaatgtagcagtatctgacattttagaatttgtgggggtttcttaccttttaatttttaaggttgtttctctcaaagatatttaaacaaaacttataaatgtgacatctgttcaatcatgtcacactttagaaataaatattaccaatgaattttgaaatgattaagatttaataccaaattaaggtaggaagattattttaacatcatttctacctaccagacgtcaaaatattttaggtaagttttactttgtgcagagaagcaatattttacagcagttttattctcttcactgcaatcaacgattctatgggtgccaagatgaatatcaataccaaataactcagacatttttggcattaatagcttaaaacattaaatcattcaatttgtatgcaagggcatgtattttaaaaagcagaatttttaaacatactaagtatataattcggtatgccataattgataataaagaagatgtacaattttaaggacaatattttgtgcttggactagaattcagcttttgaggcacatgttaaataggcatattttaggacaaggtaaacgccacagaaattgattttttagtatcttttaaagatgcctttcagtgcaatctgaaatcattaaattttactgtactgaaacatattattttatgagtgatgtgcttaaaattacacatataaaactagaaatacatttgagaccatgcaaatataaggaaaaatagatttttgataggaatgttaatatagcagtttccactaactgaagacagagtcctctgtcatctgtcacattgttccaggtgctgtgtaaaccactgaagagtttataggctttttattataactgggaattataacatctttagattttatttaatttgattgctagatgaatagactaatgtaattggaatatgaaagccacaatataagcaaagctgatctcagtttttgtatcttgggtcaaaacctctttaattagagaggtaagtaaacatatttacaagtaatttttaaaaagcatttgtattgtagacccagaaaatctgagacaggtctcagttaatttagaaagttgattttgcctaatcctaggtactcgggaggctgaggcacgagaattgcttgtccccaggaggcgggggttgcagtgagattgtgccactgcactccagcctgggtgatagaatgagactttgtctcaaaaaaaaaaaaaaaaaaaaaaaaaaaaaaaaaaaaagttgatttttgccaaggtggaattcgcgcgcctgtgacacagcctcaggaagtcctgacgacatgtgcccaaggtggttggggtgcagcttggttttacacattttagggaggcatgagacatcaatcaagtacatttaagaaatacattggtttgacctggcgcggtggctcacacctgtaatcccagcactttgggaggctgagtcgggcggatcacaaggtcaggagatcgagaccatcctggctgaaacagtgaaaccccgtctctatgaaaaatagggaaaaaaaattagccagacgtggcggcaggcgcctgtagtcccagctactcgggaggctgaggcaggagaatggtgtgaacctgggaggcggaggttgcagtgagccaagattgtgtcactgcactccagcttgggcaacagagcgagactccgtctgaaaaaaataaaattaaaaaaaaaaaaaaaaaaaagaaatacattggtttggtccagaaaggcaggacaactgggtgggggtgggggcttccaggctgtaggtaaatttaaacattttctggttgacaattggttgagtttgtctaaagacctgggatcaatagaaaggaatgtttgggttgagataagacattgtggataccaaagttttatcatgtagatgaagcttttagctagcaggcttcagagagaagaggctgtagagtgcttcttatcagacttaaagtctgtgttgatgtaagtgtcagagaggtataatgaggcatgtctgacccccacttcccttcttggcctgaaccagtctttcaggttaaattttaagagccctggctgaggaggaagtccctttggagggggagttagccttttatttttggtttacagtatgtttttacttcaggaccagtttgataacagcttttaaatttttacaatttaaagcaagaagtcgctgaagatcgaagaaattaatttacccaagaaaataccagaaagataaaaattagggattaaaacctgtggtgcctgatttacacacacatatatagctatgttatttttttttcttttttgagactgagtctcgttctgttgcccaggctggaatgtagtggcacaatcttggctcactgcaacttctgcctccctggttcaagcaattctcctgcctcagcctcccgagtagctgggattacaggtgcccaccaccacagctggctaatttttgtatttttagtagagacggggtttcgtcatggtggccaggttggtcctgaactcctgacctcaagtgaactgcccgcctcggcctctcaaagtgctggaattacaggcatgagccgccacgcctggccctcagctcagtatatttttaaatgcacatttactttacatttaaagcaacttaaacatacacacaaacacacacgtatcacacatattacaaaatacaagacaatcatgtggccctatcttccccccttccacagagggagacacacttacactatacaaacgtgtatgtgttgtgtgtgtgtatacaaactatcttgatttggagagggaactatttatctaaatattagcttgttttcttttggttaaataggatttcccctttaataatattctgtaattccaaaaatataataattgccatgtagtcaatgcatctcaaagtcctaaaaatatttttagaactaataggatttatactgaatttcatttgatatttttataagatctatttgatgcaaattgaatttgtattctattactcgatttttttttaaagcaaatgccatgtggaaacaagcagagagggacaagttttcccagaaggaaagttgaaaggggaagagtagagagaggttgatcaagaaaaccttcacagatgatgtgcatcttgaactgagccttggaagatgaatagtaggtcatcttcaaatggttggggatttagggtcaggaaagtgcctgtatagtaatatggaattaaaatgtcttctcacttcggaaaactctgaagaagaaaggtgatttttaaaaatacagcaaagttggaaaatcttacctccaaaattatttcttctttaataccaacaaagaataattatagttttgttcctattaatgttaaaacttgcttcctagctaattaaaatgttcattaagaattggtttcataaattatctggtctaggcctagagccctgggaccctgcaatggttaacgtatttcacaggcatcagcattttcctttcaggtttctaaggatgaggcttataagtttttatgaaattctacatgctaagatgtttaaatatgtaaaatggccattcataaacctagttcactaatcaaattagttaagtctgggagcttggaggacttccactctcaaagtttacacatttgggaatgatgagttgcaacttgtatattgaaagtgactgaattaaaatttatgtaaatgtgtcatcttagtttaataggttatgtggcagtcactgtaaagaaaattaacagaacacagtgcccatcaggaggctcttctgacataattagcacagttatatagcactaattcatgtaatgttttactattgacaattcaaaattgacaacttcttaaatggcaaacatttctctagttctttgagatgtttgtatgtgtttttgcctttgaatttattttaaacatttatatacacaggtatctctcagtatttaccatatgggatgtaattaacctaatttacatcatttttatgggaaattcaactggatgaggctgagtctgtttgtacaatataatactgagaaaaattgtcactctctgaatatttggtatatatgccccaggcttttgatattttgaaacttccaaaaaatggaaggtctttttgaaaaattgtcttggtgtagtaatacacttttgccaagaaaaaaaaaaatcaaagacttacttgccctgtatgatgggactttacaagttttaatttcaggggtttctgatgagtatatttgtaaaggagaaaaaaattgtcgcttcactgctaaccataaataataacaaattgaggttttaagatatacttgaagaatagaggacagaatattcatcaataattatagaaataatcattttgtgaacagagaatgagaagttatttttttattagctaaaggagattttaagctaggtaaagttagactgcatttaagggatagagtctgataacattcggaagtacgttaagtacagagttaagtatatgaggaaagtaagttaagcactaaggaatatattagtggactgattccaaaggtgtagggacacattatgagcaacttatgatacataagttcattagcaatggttttatgtgagttgttaaagtggggaaaaaagaattattagaaacgagtaattttatgaagaagcaaaaatacatgtacagaatccaacgttgaatatggcattgaaaataagtcttcagtgttttccttgagggttttaaagaaggtaactgagttgcatctgaatgatatatttcgttcgtaattaaatacccaggctcacttagtgcaaagtatgatagaaaatgccatctgcaaagcactgggaagagtagatagcacccaatttaaagcatgaagacatttaaatcagaggtgtctgttcatttgccatgcatctcagcaaagatatctgaggaatatctagtagcagtgaaatacatgaaaactacacgacaaaccacaaaaagtgatgaagcgatagttgctaaattgataaggaataaaataaacgtgcaattgcttcttggaagccagggtctgagtaggatccgggaaggagactgagttcattgtgcattgaaaatgtcactgaacctaaaactaagcgttggatgtaggccattggcactcagggagagtacatgggaggccttgaaaccctgcctctgcttcctcttcacccttccatcctcattgctggcataaagagatgaggctatccactggcagaatattggagagaaaacaatgctagtagctgacagttaactcccagaactctaagagatggtggtacatgttaagtattagagtgtaggctgactgcacattatgtgtggacaaaaagagttttagcaaggaaatcagagatgtttgaaggaagaagtccaaatggaagcaacataaaataaatattaagattaggttaggaatagctcagagcttgaattgtgtaagaattgggttcagtgtccacctgtttcccatgaaatcaagatatcacaataatgatagaaatgaaagggaagaactccaacaggtgagaagagtccaaactcattaatatgtttctttgttccattttagaaaagaagtataacattaacctctgtgcttatgaataggttattttccttagacaaaacgctctcctcaccactgccctagtaaaatttgaaattgcctttttaaaaatctgtacatcaaaaaacgagcgtaatcactctccatacgatctttgtataaaagggaagttcacgcactgtatgtgacccctttccaaatttataaagtcagacaaaaaattgaatgaggaaagacctttctgtagaatttcacatcctgttgtttgaattgatttgaattatcagaactacgtgccaactggtgtccaggcctcccttaaaatcttcacagacagagaagcaaacagacagttaccatggtgttgactccacaaagccttctttgtgtggagataaccaatatacttggcagagcctctaggctagaagctgatttaatcctaatttacagagaaggtgttttttgattatcctcttaaaaagaccagtgtgagctgagccccagttctgtgtctaaaccatttttatcttgtcaaacaaatgcttcactaaaccaaattacttgataatgtggactaatgcattctcgtctctgttctttatggagttaatagcatgtctggcacatagtaagcacttagtatatgctttatgaaggggaaaaaaaggagacatttgaccgttttaaaaggaaacatacaattttgcctttttcaggaaaatacacctctaaaagtgttacaagatttcttctggggccgggcgcggtggctcacgcctgtaatcccagcactttgggaggccgaggcgggcggatctagaggtcaggagatcgagaccatcctggctaacacggtgaaaccacatctctactaaaaatacaaaaaaaattagccgggcgtggtggcgggcgcctgtggtcccagctactcgggaggctgaggcaggagaatggcgtgaacctgggaggcggagcttgcagtgagccgagatcgcgccactgcactccaggctgggtgacagagcaagactccgtctcaaaaaaaaaaaaaaaaaagatttcttttggaatgaaaattatttactttcaaactaaaaacaaacaactttgtttcttttttctgcagtgaattggaggtggtggtataacagttacatcaacatgcatgttataggagcagaaaggctgtgatccctttccttcctccttatacaggtcatagcagacattcctataacaaaagataggttaacaagagaaaagcatgagatatttatctaataaaagttttaggtgacatgggagccttcaaaaatgaagacccaatgacccaaaggaaaactgtttttatgcttagagttgataaagagtagacagccatgtaggaatgtgattggacaaaaagggaatgatctgatagtaatagactagggacaaccagccaggcctgtctgtgtagaattccttcctcctacacatggggtaggaccccacttgaatgagggtcttatgatctactatcaaacaaaagtatgtcagagaattttttatggctagctaatagagagaaaggtgggcaaaatacagagttataattctggcttttatggttggctttggaggagagggtttttggtttctatgacctaccttgaagaagaagaattctggttactatgactcacttcagggaagaatgtggagttaaagacaggaggggaggagaaggtcagagggaccttggttttgaggctgcttttgaggccttccagtgttctttagttcaaagtttcagcatgccaaagtgccatactttggggtatcgttttctgagcccctacagtgtgcaaacaagagcaatgtcaattcaacgcctagtagaaatctttctccaacataggcttcagcagatttctttcagctgtcatgccagcctagtaccttgaggcacgtttgagtttcagggacctctaagtagaagtgagcaatctttcttagagatagtctaaatcaaatgagggtgagactagagagattaagtttaaagcgtgaatttgaaagtgactggtggatattcctatctcatatttatgagtcagagggtatttgatgtataattgagtcagacaaataaatttcaccaaagtggcccaaatgcattatattaacaacccagttttcaaaatatttatggaagagtcagtgaaggattttattccattggaggaggaacaagaataaagaatagctctgaattactttagaaaatatgaagcgaaatttgtttctacaagtacttgaataaaagacaaagtagaatatacagttaagaggtctatgaaggccagattataaaggatcatgttgaaattttgttctttattctaagaaaaatgagaaagtctttgagtggttttacgaatgaaggtaacataatcagatatgtttttactaccgtatatttcaaagtagctagaagagaataatttgaatgtatctagcatagacaaatatttaagattatggatatcccaagtacactgatgcgatctttacaaattatacggatatgttaaattatcacatgtacccccaatctaagtacatctattatgcgtcaattaaaaaagatagaaatgataatttttccagtagtacataaaagagagagttccataaatactgcccagaggccaagtgaaaagctattgcggtatttttggtcacatttaatggcaacacagatttgggttctggctatggagacaggaagaagcatacatattcaggagacagagaatgtatgtgtgacagattagactttgcaatacattaaacatgggaaggaagagagagggttttagttggtttgctgtaacaaaataccataaactgggtagcttataaaccacagaaatttatgtctcccatttctggagtttgggaagtttaatatcaagtaactagcagatttagtgtcttttaagggcaggcttcctggttcatacttggtgctctctcactgtgccctcacacggtggaaaagaacactgatctcttcagatcattttaaggggactcatttcatgagggctctaccctcttgacctaattacctcccaaatgccccatcttttaatatcatcacattgggaattaggcttcaacatacgaacttttgtggggcacaaaattcagtccatagcggagatgaagataacaaatatgagggatggtgatgctaattactgatctggggaatactgatagagtactagtttgagggagaagatcaaactttaaaccttggcatataatgtttaaggagattttgcagcatgcaagtggagacatccaataggcagatggttatatagctgtggaattcagaacaagtgcctgaattagagatatacatatcagaatcattgataaatagattgcaattcaaggcatgatgactgatgtgttttctggtgagagatagtagagtagaagatgattggtaatgaactaggtcttgacatctagtacataatgatagggtggaggaggatggacctgcaaagaaaaaattaccaatggtcatagaaatagaaggcaaattagaatagagtggcatcatgaagccaaaggaagaaaaattacaaacggatagtatggtcaacagtgttaactgtagtcctagctacttgggaggctgaggcaggggaattccttgaacccgggaggcagaggttgtggtgagaccagattgcaccactgcactccagcctggtgacagagtgagactccgtctcaaaataaacaaatactagaaattggatggactcagatgcttgagcaaaagtaagagaataaagttcaaaatgtaggtagtgggaatgactttaattaaaagaagggaaactcaaatgtaaaagaagggaatgagaacggtggctacatatgcgggtctgatggtgtttggaaataggaagtgaaagaagttctactctgataattgcacttgtttctgtaaggtagggaacaagatcatctgagagagctgcagaaagaggatgggccagagctttgataaaaggttttaatagttcctgtagagacttagagcccaacttgggaaaaaaaaaaaaaaaaaaaagtatggcaggatgctaggttcatttgaggctgttgattattgccttagtttgggttgccccaagagtagatctgaagagaaggatttaggtgcaagcagtttatttggaaagtgatcccaggaaacaaagtagggaagtgaaataagaaaaataaagcagccaataaagtatggcacaaatatagggatcaggttactgctggaaggaactggggctcaatcatgcagggaaccccttgagacactgtgtatcatacttcaggattgtccaactgaggggcaagggagctgggaaattcaccaattccaagctctcactggttaagggacacccctaaagtattaacattccagcactccttctctgtccaatatactggcaaatagatgcttgcagatagagagacacaggaaattttatgttgggccaaagcaaaaataaaaatgttttaagacattatgatgataaatatgcataaaagatgattgaaatataattcactggtttgggtaggtaatcaaataaccatagtaggagagtatttaaggagttaacatcgctgaagagagtgtgaaagatttttacagcatataattgtactgtatattttaatcaacattatgaatgaagaaacaggaacctgatagtcaaacttgtggataaaaaatgtaggaaagataaaaatcatatatgacacaataaaaatccataaacatttgtaatgcatacacagataacttactgacattcagtgacatgggatttagaggaatcaggatccctagtctcttaatttcaagttggatagcctcgataaataacaactcaatctgtatgctatgaaccgtcaagtttctgacccatggtattgaggtcaattaacttaatttctctgaagctccatctcatcctatgggcagctggaattggtgatacctaaccaaagaattttgtgagaatataaaatgcgaatatgtttttctaagggctttgtgttccattaatttctgtatctgtttaatttttaaacaatagcctgcaacaaatgtgagaaattctaactggtttatatgattcaaagtcccaaaactggagttcaatagatcaggtcatatgtttgtgatagtaattaggttgtgatataactggtttaatgatagtttatgtgaaaaaattcctagaagttttaagtcaattgaattgcaatgtgagttgaaagtctaatattgaagtgaaaatatttattgaaatcatgggctatatcaatgaaagtattataaaccagaaagataattattcttccctgtttattttacacactgctgatatgttccctttaagtacccaatttaaggaaactaagataacaacaagccatagaatatccgttgaagtaattaagcatagggtaggctgatgatcaggtatctactgataaatttaaagagcggatttcaaatatttataattttgtatccttttgccaatatctttccaactactctccacccccaccagctcctggaaatgaacattgtcttctgtttcttttagtttgatttttttttttttttttttttagattccacttgtaagtgagatcatgtggtatttgtctttctacacctggcttatttcacttaacataatttcctccgggttcatacatgttgttgcaaatgaaaggctattcatagtcttaaaggcttaatactattccattagacacttgggttgattccatattttggctcttctatacctaaatcaccagattagaatgaataatttatccctggtggctccaaagatctcttccaaaaaaaaaaaaaaaaaaaaaaaaaaaggtttgaaaataacaggataggtgatctgatatttatggcagcataacaactcacaccaaaatgtagtggcttaaaacagcacctatttattatttctcctaattcttcaacgtaggcagtgccctttgggtatttcttttctctatgtggcatcaactggagcactcatttgtctgtcttcagctggcattgagatgggtcacagagggctttatttgcatgcctggtgccccatgcttcttcatgtggcctcttcacatggacagatcaagtttccttaaaacatgatcacctcaaggtcattgtacttcttatataattgttgtcttctcagaatgtgtgctctaaaaagtcaagctctgacatgcaagcacttctcaaaaccttacttgcagtactcttactattgtcccatttgtgatagaaagtcacgtggccaaacccagaggcagtatgattggagactacagaaaagcatgtgtttcaatggtgaccaccaacaggaattttttttttctcataaatactttccaaaaagaaaaggttatcgtgggaagtagtactttttcaaatagtggaaacattcaagcagaggctgggtaatagcttacaggatatattgtagaagtgatttttacattgaggtgaataaaatgacctctgtgatcataagactctagatcaaagctgactccaaatttgagtctacctaacagggaaaatagtgctgctattaatactaatagaggtgtcaggcaggagtctcagattgagaaaagaatgataaatgtggataaattgctttttttaatatagaagaaagagataatcaagaaataatgacttttattttttgctgtcttaggttggatgttgatataactgaacttcacagctggattactcgctcagaagctgtgttgcagagtcctgaatttgcaatctttcggaaggaaggcaacttctcagacttaaaagaaaaagtcaatgtaggttatgcattaatttttatatctgtactcattttgtgctgcttgtaaactccgtgctttgttatctgtgattctactagttgatagattaatgcgatatgataaaatgctgtttaatatgtcttaaaaatatattttagatagcaagcaaaatcaaagtttagcctagagaaatctttctggattcttctgtgactgactagggatgcctttcataaacttgccttaacttacatattatttaactataaattaacaattttatgacattaattcatgttgattcctttcatatattgttcagttacctcaaggctaggccttagcaagcttgcacaattgtgtagagtagaatagagtaaaatagaatagaataatataatagataccatacttaggactatgtctatattctcactgttatcaaaaagttattctttatagtcatcaatccctgtcatatattataagatatttaaatttcccagatatttgtgtattaccttatctaaaaggtgtccagcctttctcagtatttacatgtggtagcagatgctttgttgttgttattcccttctgagatggtataattttgaccttcacaaataggaagttttattaatttaatataaagtgtttcatctttagggaaattgtcaaggctttaatttttcaacttcaacaattataaaacatgcatctttgtatatgattggcaacagtttgtaaaataatttctaacaggcagagtaaataaaatgggcaagctaaggaagcagtgattatgaatgaaaagtaattttatccatgggaagatcacatctaaatgtgtatattagctctgctttttctctccaggattcaaatcatgaagttcaaaatccattgtatttttacaaatacgacattacctcagttacaagctaatgtttgctgttggggttggaacttttggagatcaacaaaagatatatatatattctggaaaaaaaatctattttttaggctgcttgaaaaagggaagacaattttgtcaccagttcttcttagagttaactacttataaattggaaagctattttaaattacttattagctttataagacatgctgttgtcagcattataatagactattctaaattgtttcaagaaatgggaaatatgaaaactgaaagataatatataattgtagaaaattagctaaatgtcttttttcaagtatacttctttgaaggtaaattgtttgctgtgatttttgagggaaattctcttagtagtagaaaattaattagagaacattaaactctaattttcaaacatcatgttacatatttgaccactgaaagtatgaatcacctttagcattttattagctaattaaaaatgattattgatctgattctcacaggtttctgtctgatactctgtttctttatcttaagacagctttgatcaggcaggaaaattgagtttcagtatttcaggaatataaattttaaaagttcctgttatcatgtggttacctatgaacgatttgcattttatcaatagcgggagcatgacagactaaaagtgctcaaaaatgtacagtgttttataactggttttctgataccttgtgagtcccctttatcaacctgaactctcattttctgaaataacaacatcattcttaattgcctactaaaatgggacatgaaatgatttaccttgatgtttccctcaggctaaatacaatgtatatgtattaaaaatccttgagagaaatacataattacgatgatggatattcagtttaggtatccattaattttcttactacatcacctgtcggtttatataggttattttaaactcatggcaggctcgtgtcatgaacttgagtggtattaatccatttttaggctttcattaaaaatggctaaatattaccaactcttttttttttcacttgatttcttcatttactcctttcaaatgcttttagccagttagcatatcataggccattatcagttcaatttcacatattttaaaaaatgcaacttttaaacctaagcataattttttccttgtatattcaccatgtgttttattcatataattaacaaaatgcacttatttaaaagctgacttctgggggacctttctaatcaaaatgtccctggaccaccaatattgacattatctgggagcttgtcagaaatatagaatctcagaactagtaaatcaaaatttgcctttgaacattttccaggagtgattcctatgcacataaaggctcgagaatcaatattctaggacacaatcttgggctttacgtagcagttacctctcacattcttttagtatcactgcagttcagactttttagctgaattaacagattctaacaactcgaattttttccgtgagcacatggtaacgcaaattggtaatgaaacaaacaaaaaaaatagcctcctttgatcacaaggggatttgataaggtgtctgaaaatctggagcttctgtgaggttctcttgaaaccctccctatcaagtcgttatggtcatctggctttgggctcttcctcggatctgcacttgattaccctctttcagaatcaactttttaccaactcccgctggaaatcatcaagccagttaatgcttccaatttctcctatctctgttatctgtgtttactacccagagtataggtacctcgagtctatattttcttctatctttctctctctgctctattgcactttcttttccttgcttcacttcctctgctttcccacactctcactcggcaggctcaaacactttttcaagacaagccttctatatacttattctactcatacgtggaaaccaattttaccctcgaaaacagcactatgactcatccctcttttgtacccccactactttagaatgactgactccctcacctaacagagacaattccaaagatactgctctcttcatgtaaaaatacctctttccttgcagttaatgacttctggccatctcttatctaccattttatcatattttctcattgaagactttggcactaggttagtagattttttcaaccaatttgttctttcattcttagttatttcagcatccctgtgggctctcctgctatcactaaaagctgttgtttctctcatctcctcaattcagctacctgctgtcatgattgtatgtatgtagatgttgtcattgtcaggcattactccatttctttaataagattatttttttgagacggagtctcgctctgtcccaggcgggagtgcagtggcgcgatctcggctcactgcaagctctgcctcccgggttcacgccgttctcctgcctcagcctcctgagtagctgggactacaggcgcccgccaccacacccggctaagtttttgtatttttagtagagacggggtttcaccgtgttagccaggatggtctcgatctcctgacctcgtgatccgcccgcctcggcctcccaaagtgctgggattacaggcgtgagccaccgcgcccggcactaacaacatattttaacaaaaccagcagttcttcataagctttccgtgcatcctaagtatattttcaacttagtttctctcaacaattatttcaagcttttgtggggtacctaaactttccccatcattcacagtaaatgatttcatctcctactttagtcgaaataatatttctcaaattgtgggtatttgtgctcatagtatcttttttttttttttttttccacctgccttagtggaagaggctatccttcacctggttgaggctcatctctgggtgtgtgttctcagcagcatcactgactatgtattaagccacctggttccattcagctgtatatccagattgtcaaaaatctacatcccaggtctttatcattagcttttaaaccggttgtgttttcatcttttagaacgtgtcctctcctataaacatgcatgtgaatacttaacgtgccttatcttactcaatccctctgtagaactagaacctattaacctcttttccctcatgaaattctttcctcgcttggcttatgggatactgctttctcctgattaattctttcacattcttggccatttgttccaattcagtttttctttaatattgatattcttcagagtccttgtgtttcttctctggatatcctcattcattcccattcaaatagtgtctattttcaaatgaacccttctcccatatgtatctttagctcatctctttcttaaaacccagggtgatatatctgactgcctaatagacaattttaattgatgtttgcctgatatcttaaatctcattatttccccagacctcctttattctttctccttcctttcaccctgcaaacagcctaatccagaaacctgaaagtgaactgggtcacctagatttttcttctaccattcacaagtccaatctttgacaggttcaattaatcctgctcccttaacagctcttgaaaatgtccagttctctctattcccatcaccaaaaccctgattaaagctaatatcatggcttacttctatttaagatgacaatcctgtagctggtcttccctgctactaatgttatattcctttagaagtttccacatcacctctgccaaagcgaacatattaaaacctcagtatgatcttgttatgtctgtgtttataatcatttgagaaagataaaatcagctactgatagccaggagctggcttggcacttcagttaggctttggaactgctagatgttgccttggtacttgcagccagtctgatgttctctggttgaatataaataattgctagggatgccagcatcatacagggacacgctatggttgtgatgaatcaagataaaagcaagaccactttgtaatcatatcttaatacagtaaaaaagaatagcattgtccaaaccacgcctaatgaccaaatatccctcatcttcattaatgtgacacattatgcttctttactaaacacagctttagcctctctgcattcctcctgccatctagataaaaattttaggacactcaacatagaattaccctacttccttacaacatccaatcaaaacaaagccccacttccttgatgccccctatcatgtaacacaagcccacatcttaaaataagctttttctaacatactcttagagacagccccatagttccctgtgatgcgctgtctctctcgttgcagcgtgtaaatcaggttaactttgataacctacaaatatgttccagtggtctttgtctgaagagtgttgacaaagtccatgtcttcatattgccctcttaaagcctacaatgatctaatttttgtttacttgcacaaactaatttctagccattttcatttcaattccattgttggtttctagaaatcaggacttgaacgtgaagtggctttggttttatgtgtgtgtgttttgtttttggtgtccccatgcctaacacacaaaccaataaatgtttaactatatggatatgtgatttttttcagttctgcagttgcatttaagataggatctattaccaatatgaaggatagaacaacttctgaataaacatttgagtgaataagttactcttcagtcaaagggtaaaacttcattatagaatgttaaatgagtagattcttaattacttctaatgtcggagtaggactgatagagatccataacttattttcataatgttagagaagatacagaaagaggaggcttttaagaggtgctaataaagaaggaggaacagaggtctgaaagaggttttaatcaacttattgaggaatttgtgaacttccctgtgttgtattctttgcttcaaattattttacttttcttccttttattgaatattatataacttagttgccttttattttgcatttaggttacccattttagtatttataattcttcatgatctctaagaattttcatgagcccacaataatcactcatttctgatacattgatttactgatgccttttttagcttctgtatactttacttgaaattatgtgtactaaataatttagaatccgagtagtggcttctaaacatgtgatcatatattaagcatatattgagtaaagtatttagtattctatatgttaatagcataatttaaaaactgtatgttatgaaatatagatcctttcaagattaaaaatgtatatgcatgtagacacatatatgataaacagctctatagaaaaacacacatacagaaaagctggatgacttcatgaggacgaaatttaagagaaagataatattgtcaagggcagaggtatttttatgaacatggcaatttcgaggaggtaattgtagtttttatcagtactgaatgttgtaagaagcatttttcctaacaagaagaaaattaatgactttcttttctttttttttttttttttttttttcccgagacggagcctcgctctgtcacccaggctggagtgcagtggcgcaatcttggctcactgcaacttctgtctcccgggttcaagcgattctcctgcctcagcctcccgagtagctgggactacaggcacgtgccaccacgtccagctaattttttgtatttttagtagagacggggtttcaactgttggccaggatggtctccatctcctgaccttgtgatccacctgccttggcctcccaaagtgctgggattacaggcgtgagcccctgcgcccggccaaattaatgactttcacaaaataactttttgtacagtagtgaaggctgaagtctgactgtaggtatttggagtaatattgaaatactggaatttggactaatatggtaatattagtccaaatttcattgaagatgaaatatataaaagaaaatgaagactgtggttgaagagtattcagatgatacccttggtcttgaaaacatgggaaaggggtatatatacagtatgtatgtgtatgtacatatatgtacatacacacacatagagagaggaggtggaagatcagagccatgaaataaaaacagagaggtaagattctaccaagttttgactcatggattgtatatggtactctttcttttctacttaggtattggtttattaccagtatcaggacttgagctgaagaaaagatggatgtgcccaactccctaactaatatgcagtttctagaatactttgatttaatccatccttcctttactgagcttgcagcacctgtccccatgtactggttttatggccactttatataaagctattagagttcgttatgaatttgcactttaagagagcattgtgggtaaggggagagaccataatattgtatatggacgcgttacgctaaaatagagctcgccttattatgtacctataatgtaccagccactttcatggagacttgggatagagtagagaaggatatagataaggatacctgaccttatatagtttacattctagtgggaaagatggaaatgaagcaagactaatatgtaaagcatgtggaatgttagtgataagttccaaggagcagaataaaatgagagggtatgcatgtgcttgtagacagagtggcactaaaaggcctagctgaaaaagtggcatttgatgggggaaaatgtccaagtaagtaatttagggcctttttaggcatggggaaaaataaatgcacagccgtgtaacagcagcatgcctgtagcatcagggaaaaggtaagcgtgtggctgcagcagaaaaatcacgatgtttagcagcagaagaattcagaaaggttaaggaagttaattaagatcagaccatggtaaggacttgagcttttattcagctgtcagcgagttgagctgaatcctgttgtctctgtctgctgtgttgataatatataatcagagaacaaagggtgaaatataaagacctttagtatcctattttgaaacattcatacccctcagagatgatggggtactttgtctaatgtggtagtagtgagcaccatgataactcactttctggctatgttttgaggttagagccaacaggactttgtgatggattgaatgtgaggcttgagagagagaggggagtggaggattctgtttttggcctaaacaaaggaaaacacagattgaggcctaggacactccaaagtgcgagctcagggacatgattaggaacctgcaaaggagatggaggaaaggtgacctctgaagttggaggaaaactgtgttcaagtagtacgtgaagccaaattagcaaatacttctaagaagaaaaaggaatcctctcaatcaaatcatggtgataggtaaagtgagaactgaacatcagtcattgaatgcagtagcttgggggccaatggtgagactgataagagcagttttgatgggactgagtaagagaatagatgtgagagccagtttttgtttttgttttgaaccagtttttactttgcaagatagacctgtggaaggcctatgttcctctttgttgatacacagtcacttaaaatgaggacagttatcttcctttttcagcaaaatatatctctttagactttgtttttggtttttgtgcttttctgtgctttttaatgtatatttctgtgagttaatgggagacggtagaaattttaggaactactgatccaacctacctgaaaacagaagttcatatatttcatttgaggacgaacgtatgggtggccagatcccaggagaaatggcgattttcagtgatgtttatttacttaacctttttttttttttttttttaacactttttatatgtggttatttggacatttccacgaacaaggtactctcatcatctcttgtgtcaaaaatgtttccgtggccaggcacggtggctcacgcctgtaatctcagcactttgggaggtcgaggcgggtggatcatgaagtcaggagatcaagaccatcatggttgacaccatgaagcctcgtctctactaaaaatacaaaaaattagccgggcatggttgcgggcgcctgtagtcccagctactcaggaggctgaggaaggagaatggcgtgaacccgggaggcggagcttgcagtgagccaagattgcgccactgcactccagcctgggcgacagagcgagactccgtctcaaaaagaaaaaaaaaaaaagtttcctaaatttctttttaagattattgaagttacctttaagtagaatgagcacatatttcagtttgtcgggtatagtcttagcttatgtcaaaccatttttctcagcttaattattcctagctccccattttactataaaaactatctcattttgggaaataaatagcgagcttcctttaatcccctcagaagtcccacatggtaggtatctttattgctattttacataggaaatactgaggttcagaaaggtcgaagtactttattagggacagatagtaagcagtagagacagaactgataacagcagagcaaaaagggtgactgcaggcccttttgttgtagtatcttctttaacatctctttgttatactaaattttattatttttaatcaactatctacagctgtgtctgaaatgaaatgttttctgggctcttcactgtctcattcacactcttcaaggcatacttgtatgcatattcctcttcattttgcaatgttcctcttgaaagtaatgtgccctaacagaacccagatatcgtctgaacattgacaaatatgcagataccattgactgcttctttctggggtctatgtgtctctttatgcaccagttattcagtttatttgagctgtatacagagttggtaatcagcctatagactgtcagagaccattctgagtgacccggcattccttgtgatatcttgttggccctgctgaattaatagttaaatatgttgaacatccctaatacatccaaactataagctctgtttgctctgatatatattctgatacgctcacacctttttgaataatatccattgaaatacccctagcaacagcagagcatgtctgaaagaaagctgaaattataagtagaagagcagggttctaatattgaatctaaaacttcctaatatgatgacctttgatatacgatttaatcttactgatgctcagttttctcttgtataaaatggtatacaacaatgctgatttcttctttcttacaattattatgacatacatatggaaattatgtacataaactataatttggtagtataaggaatcttattttcaatgtggctattgcattgttttcaaaattttcacaaacctctctgtgcctcacttccctcctctgtcaaaatgggaaagtaatagtacctactttatagattattgtttttgttgtagttgtggtggttgttactgagactatttatattagaataactggaacaatgtggttaacaagatattaaaggtcaaatatgattcctgagatattcaaatataagttttgttctctgttagtaatattaattgattctagtaagcttagaataaagagattatgatgataacatttagagggctattgataatttattttcaatatttataaagaccacatagtgttctcattctactttttatatcatttcacaaaaactaaagcaaaagctcaatgtagataaaatagaaacccctctgataggagaagataactctaaaagtaactcaaagaacatcactttactcagcttgttgtcattgttcctttatgtgttgtattgtggtatatattttttctttcatctgtatattgttttctggataaagttcaaattctggacaccccaaatcctcctgtctttcttgatatttacattacatatttacttaaatgtgcttattttttctcctctaagatgctcagggtgctttccatataacatttaccttttaatggagaataaatgtaagtagtgaaaaacaagtatgccataagctgctaaggacagataacttagatcacaaaaactaataagttgagaaaatagaaatattggagcttcatctaggatcttacttttaactagatgttgtagctactctattttcatggacttttcagttcaaccaacaaattagaaccatccatgattgtgcacgttcctggaaacaattcaatactgtctttgtgaaactgaatttcaagacaactcagaagttttacctgctaattggaaagggatcctgggaacataaaatcacaaaataccacaaactgggtgctttgaaattttcaagtggaatgtaagatattaaaaagtgtctgtcactttcagagtttcttaactaattagacaaaactgagttttcatttgttgcccttcagagcaccatgtaaaatgtgtatctttcagctaagagataggtatttaagaaaataaaacaaaattactaccttatagattttttttaaattttactcttaatttattctcagttttaattagtattttatatattacagctattcctgatggagtttattctgtgaatgattggcttttttttttttttttagcattttgtactcttgatattgaatccagtattcctaattcatgaaacctttttttgtgattttaatagactccatttttagagtaattataggttcacagcacaattgaacagaaggtacaaaaatttcccatataacccggctcccacagatacatagcctgccccactgtcaacatttcccactagagtggtatatttgtttcaacagatgaacttacattgacacatcattatctcccaaagttcatagtttatacattagctttccctattggtgccacacattctgtgagtttaaacaaatttacaatgacatgtatttatctttagagtgttatgcggtgtaatttcactgccataaaaatcctcaatacttttcccgttcatctacacttctctcctaatctctagaaaccactgattgttttgtagtttacatagttttaccttttccagactatcatatattcggaattggaatctagggtgaaatcctgcggtaaaatatatagccttttcagattatcttctttaacttagtaacatgcatttaagttcttccatgtctttttatggcttgatagctcatttttaagcactgaataatattccattgtctggatgtctcacagtttatttatccattcatctactgaagaacatcttgattgtttccaagtcttggcaaatacaaacaaagctgctgcagcattcatgtgcaggaatttgagtggacatatgactcctttgtgtaaatgcctaagtgcatgattgctggatcatatagtagaatgtttacttttgtaagaaacctccaaactgtcttccaaagtggctgtgccattttgcattgccaccagaaatgaatgagagttcccattgccccatttctctgtcggcttttggttttgtcagtgttcttggattttggccattctaataggtgtgtagtggtatctcattgtttaatttgtaattccctggtaacatatgatgtgaaacatattttcatttgcttatttgccatctgtatacttcctttggtgaggtgtctgttaaggatttttgcccatgttttagtttgtttgtttttgttactgagttttaagagttctttgtgtatttcggataagaattctctaccagatatgtctttcgtaaatattttctttgagcctgtggcttttcttttcgttcttttggcagcatctttcacagagcagaaccttttaacttagtactattcaacttattaattctttctttcatggatcatccctttggtggtgtatctaaaaaactatcaacaaactcaaagtcacctctgttttctccactgctatctgctaggagttttatagttttacattttactctagagtctgtgattgattcattattaattaactttatgaattatatgaacaccacaattactttcaagcagttacacaaatttctaaattcagtggaaatgtatttatttttggtatgtttatttttcatttttattttattttttataatttcaacttttggattcaagagtaaatgtgcaggtttgttacgtgtgtatattgtgtgacactgaggtttggtgctgagcatagtatccaatagctactattttggaccttttcccctcactccctccccactctagtagtccgcagtgtttcttgttcccatctttatatccatgtgtatccaagaaaacatggttttcaaccataatgctgtgttccacaaaaatatatgttcatgttattttattttatttatttatttttgagacagagtcttactctgtcacccaggctggagtgcaatggtgtgatctcggctcactgcaacctctgcctcccgggttcaagggattttcctgcctcagcctccagagtagctgggattataggtgcctgccaccatgcccagataattatgtttgtatttttagtagagacagggtttcaccatgttggccaggctggtctcgaactcccgacctcaggtgatccacccgcgttggccccccaaagtgctgggattacaggtgtgagccactgcacccagcccatgttatcatttgtacagatatattcaatgttgaaattttaaagtgaatttgtgataaaattcacaataatgtcagatatttcaccatcaaaagtataaacttccaatgaagttgatccagtgaataacatgaaagtaaataaattggaattaaataattgtaattaaaacaaaagaagggtgtaaggtttatgcctagataaacttttttgcatgtagatgttgtgttgttcaggaccatttgtttaaagactttttctccactgtattgccttggttcctttgccaaaaatcaattgattatatttatgtggatctgtttctgagctttctattctgttccattgatttacctgtctgttcttttgccaatattactctgtcttgattactgcagttttatatcaagccttgaagtcagatatcgtcaggtctcccacttaggaaactctttaaaataaatttttaagaaaacctttattcaggccaggcacggtggctcacacctgtaatccccccgccccaccccagcactgagctgggcggatgatgaggtcaggagtttgagaccagcctggccaacatggtgaaaccctgtctctactaaaaatacaaaaattagctgggcgtggtggtgcacgcctgtaatcccggctactcgggaggctgaagcaggagagttgcttgaacccgggaggcagaggttgcagtgagctgagatcatgccactgcactccagcctgggcgacagagtgagactctgtctcaaagagaaacaaaaacaaaaagctttacatttgtagctatttctttaaattagatagtcttttcagatacataaaaatatgtggattattgtataagcatttacataatttaatgtgcttagtaaatagtgttgtctagatgattactttttctctgcaactatttctgatattgccatattatatgaaagagtttccctctgtcgcccaggctggagtacagtggcgcaatgatagttcgttgcagcctactcagactactgtgctcaagcagtccttctgcctcagattcctgagtagctgggactacaggctcctgtcaccacgcctgactaattttttaaaattgtttgtttagagatggaggtctctcgattttgcctaggctgatctcaaatccctggactgaagcagtcttcctgcccaggccttctgagtagctcggattacaggcctatctcttaactatttgcttttaaaggaatgtattagatctgcgctgtacaatcacagttaacactggtcacatgtaacctttaaattttaaattatttaaaataaataaaattagattaaattaaatattcttttattttcaagtcatgctgaccacctttcaagtgctgaatacccacatgtggttattggctatcatattggatgacacagatacagatcatttccatccctgcacaaatttatactcaacagtggtgcagactgtccatgtatctgttatttgccctcccatctgtactccagtattttacctggaaatatttttttaaatgcctgtggatgtaaatgaagtcttaaaaaatagtctcatgtagaataaccttctgcctcaaattcaagagaaatctttgttataatatgattgttaagtcacaggtgtgttgttcttactatattttaattgcgttatagttatttgaatagttatgttttaggacatacacattgttatagtcaacacttcttgatgattatagtaatgtagttctactctgtcatagtttaaaatttatgtctccataggaatattattagctaaactcaatagtatgaaattctggctattgttaactgaaataattttgcatttgtggttcaaaatgtaactcttaagggaaataaaggaattcagaaagttttttgaaactcaatcttgtcttccttggaaataggagtactttgattatttttgaaagaaaaattagcctacagcctggtatttaaatatatatgtacatatattatatatttctgctaaattatttatggtagtttattttttccatcttatatacatactggattctcaatttgatttttaataccgcctatatacttattagtaatttcaatggtgtatctttaaaagataaatttcattttagttatgtgacactttatctttcattgttatgaattgcctttttactttttgcagtcttgcgttgaaatgtatcagaaactataatgtaaaaaaaagctgagtagaaatcttataattaaaagttgtagcaagtcatgaaaatggctcatgcttttattgccattttgatgtttttgatggcaaaagtgttgagaaaaagtctttagattcacgtgataagctgacagagtgaaacatcttaaggcttgaaagggcaagtagaagttataattattgtgtagattcacagtccttgtattgaattactcatctttgctctcatgctgcaggccatagagcgagaaaaagctgagaagttcagaaaactgcaagatgccagcagatcagctcaggccctggtggaacagatggtgaatggtaattacacgagttgatttagataatcttcttagggatttgataaacacataggttcatatttatcagctgaattatatcagacaagcacttgttaaatacaaatttaaattaaaaggtgtttgtatgttttttattattctttttttaatgctaaggaaattattaggagaaattcaactttgagttcattggaagaaaatgggatgtggtagaatattttatcagtctgtagcagagaaataaattttaatgcaaatctgctagaatttatccaaataatttaagaaaataaggttaacagaaatttgaaaacattaacagtcatgttatatgtgtaaaactgatcatcatctgattttaaatcatttttgcaatatgtttttccaaacactaaaattatatggaatgttttaccgtcattcctgttttgtaataatatatatgacattttctgtgttactttttatcacttcctctcatttaaaaaagaagtctcttcgggataacctttacttttaagtaacttttttagagtgagataaaagcacaaagctagccaagtttttgtctttctttttcaagaataaattaaaattaatcttttctaatactcagtgcctcaaaagttatgtgtaccaaatgtgtcattgacatgatatgtaaacaaccttctttcaaattatcattgctatactactatatttccagataaaattttacgaaaatcagggataatgctatttccaaataagattatttttcattttgtagaagacgtttacaagaacatcataaataaatacaacaaatgtttttgttgtgcatgtcagcttttttcagaatctgcctgcattttggggcataaattctgtgtataagttattttttgccttaattgcaaatttggcattcaaaagttcagtggtcttcctagaaaatcaattcattttcttcttctaatgagtcccatgactgactgtatttggttaaaaatgaaaacaaacaaatataacaggtgagacttgagtgaacaagtttaagaacaggtaatgaaaataccagtagatttttatttagatgtatgttgcttggtaattttaactgatcaacttaacagcatattcatgttaaataaaattatgtgatctaaaaatattctcctagttgttatgtaagttccccctagaaactgtattatcactttttcattttaataagctgatgcaagagctatactttaaatggtctcatgtcatagttatatatcaagcttacctacactgaattaatcagaaataatttaaacatttagaaattacgggaatgatttttaatttttggtaagtaaaactacatgcaggatttaaatgatcgtgtgactagtgagaatattaattttcttgattatttccctcatagttctaatttttggaggcatgtagaaaagtcaggacacatagtaggtgcttagtaaatattaattgaccagattctgtttagaaaagcaaaattaaggcagtcgttgaggtaataacgttggtaattttggtgtgaaaataataatccatctgaaggaaaatgctaactttggcagataccagggaacactggggggtaggggtgtgatttgagacattcctgtttggttgactgtgttaatcaaattttatgctacccttttgttctaccagtaaagatatggtcgaactgatacgtcattaggctcaagtttgggccataactaggatgactacttaaaatgaccatagctctgtttccccattaaataaaataatttatgaaattacttaaaggctcaaatattctaacttatctatttgttccgtttttgtcgttcaaggaacaaattgcataatatttattttctgtgattgtgcaaattgtgagataagctagacacatattaagtgcctgaagtaccccttcaggtgtatttcagagggactgctaccctaaatcataatagctcctttagtatagagcccaaaagtacagttgagtggtgtagctcatgaagctgaaagacaaatgaagctttctgtaaactaggagtccagcaattattgcattaaagctcttaaatttataagtccagaatcttccttcccaagcttaggctatggagatataataaatctcacaaccacgtaagacacatacattcttgccctttttgtatagaaaggaaaatgagagctgaatcagtgtgcttcatttaggacctcatgtaaatggctgttcctcttaaccacgtatagtttcctcagaagttaagataaagatgaaccactcttgtataaaccactcatattattatgccactaataaaaatatgtgcgtatatatttataaatttgatgtgtgcttaccacagtgaaaatatttaacatatattcatagtgtaaaaatatgtagaatagcataagtatagctattatagattttaaaaaattctgtgaactatattttatatgtatctatactggtatatgcatagcaaactgaattttctacttaaaataatttgccctaagattaaactactttttaaaaatttagaataattttgtaattcatcagtttgcttttagaatgaaattccaagatggaaaaaataatttctcataacttaaattttacttcagttttgacctgaaatggtacatcagacatatttccaaatgatttctgtccgtttctaaatgtctatgaagcattgaagattcaacatcacttaagtaatgcagaaaacaaaatctgtttgtcctgaaggcaatttgttgaaggaatttaagacatatgctgagaagacaggatagggtgttaaggttgttgaaagtacaaaatttaccatggttacaatgtagaagggaacctcatttgatggtgcaaagtattgttaaaaatcagttgtacgttctagaaacagtatgtctagtaacatatgtacagtttttcagtgtcacatacaagttttatgatcaattggaagatactttttattttcactgtattttatcaaatgtgaagagttgtatgcagaattttaaaacagttaatattaaccatatcattaattttacagcaataatttgtatattaagagtttattgaccgtaagagattcttactaatttatttggaatttttaaccaaagaaatgagttggccaaattccttgcctgctttaaaactatacatggacgttttccttatggatgttccagttcttttggtcagagtagaagtgatctttcacgatcatagactaaaaagagaagctactaaaaggagagtgttaactaaaaaaaaaaatcacgtttctggcattttggcatgaaattttggtataatttttaactgatttatctctatcttagctgtattttttgtttgaactaacattaaaattaatttactgttcttatgtcagcattaattggttggataaatgtgacagaatattggatggtgcaaagtacctctttttactagagacatttttggatagctgtaattttcatgcagcttaccgtcaatatgtaagctttggatcataaccctggtctcaggaaactgttaacttaatgagggcaagtgagaggctagaccaggtatctagtgatgtatttatatattcatgtagctgtgcatattgaaaagggagtttccaaattctttattttactttttaagaaagatgtgatataactttaaggtttatttttacatttcttaatttaaatacaaaatgttataaataatttagaaatttagaaaaatttagccattaaatatagtaagtaatctttctaatgctttaataatattgctaactaataatggttttctaagattttaatttgaacagtctttaaactgatgcctttcatgaccaaggcctttcagtgtattattgagattgtggagttttaggacaacctagggctaaaataatatacatatgattatacctaaacatatgtctgtttttatctatttaggattagacgtaatcctttttgtaaaacagtgttctcgcatgagtacatacagtctcatcaatcaggcataacacaaaaaagcctagtttagataaactggttttccatattaatactgaaattaccaaaagatgaccatatcaaaacatttatttgaaaacatatgtaggcgtagctcaggttctcgttctttagtctctaagatcctttcaccataatttctagaggagatactataattatgtaatagggttagttaaattgtgattcattttcaatttctatttgtagttttctgtgtgttaattaagagtctaaggacagtcacatcaaggacatgtttaaataaaagtagtaattattagtatattagactaaagaacatctcaaaactatcattccctgagtgctagattatagtgtttaaggtgatacctgataataagtatgctaactgttgtaattaaatggcacagaatgataacactgacgagagctcttcttatccataacattaaccaagtaactatctttttttcttgtattttggttcatagctcattagataatttcacatgaattatgttatttgaggtgggcaaccagattttgtcagatgggtgagggtagggattatggtcagtctggctcatctcaaagctaaaactctcatgatcactggaaaaactttcagtagcagcaagtcttctaatcatatattttaatggcaagacatattgcaaatagtctgtatacaaatgtggcatggagactgtaccacttgtagtagcccagccccttcatcatgaatgagtagccttccacagttgcatatatttcctcttctcttattccttcctcagtactgggcagtttgatttatatttcttctttctccacatgacacttagtataatgctctacacagagttcacattcaataaatgtttttaattgacaggcacatttttcttcgtttaagtctaatctccaaaaggaagagcctctgtgggtgtgtgtgagcacggcgtgcatgcacgggtgaactcgcatgcgcagacatgtgcgtgtgtgtgtccatgtgtgtgaaagaaagagactgttgttgtcactgttgttgtgggaaatgagtggccaaaacaaatatgagtaaaaatctgactttttttaattttatgatgtttgaaaataaaaacgcaaaagggctatattagtaaaatttatattgccctcactaggggtattacttttatatatactattaatttttaaaagctattactttaagtcagtgtggtcacagaaacctctaaaatttagcctcagaacttgtcttcacaggttttgaatatctctatattacattttagactattacattgaatgctaaatggacttgtaataaccctcacttaaagttcagcaaaaataggagactgtttattagcagctttattttaagtttctattccaaatattcttttaattcaagagctctggaaacacttgttttgtgttattctaccctggcttcatggctaatgatgaatatacttgatgaggaatacttcactttaagtggcagttctgaagtacttgcatggaaggtggtgcacatttaacattattctaacagtctgttatgcactgtacacaagtaataaaattaatggatacacttcaagtaatgatccatttcctctgggtgcaatatatttattcacagactatttcaggggttgtttagaatatgagatgtgaatggattatgatccattatccctgagattctaatgtgctacaacaaaatggtttccataagtattgctcataatgcctggtgtgttagtatttgtattcttaaatagctaacacaaaattagaaaacagatgctcagatgattgatacttaaaacttttcagatatttacacttacaaactcttagaaaagttaaaattttccattgagtcaaggagcataattctatggaatacatataaaacaattatatataataataaaatccatatgcaaatatttacttggataacgctttgaaccctttttcattctagaaaggttttaatggactttcttagaaaatcaacagtagttctggcatttagatggtcaattaattcataaagttgaagtaatagcatttctcattttaattgaagagaggtacattaagtaatgtgacagtgtcggttattaacgtgacagtgtcagtaagtaacgtgaccatcctctccatcccctgcccaagtattttaaagcaaatttgatacaagagagattgtgtgcttgtttgtgtatggcttttggcttcagtgtacattggtctcataatttttatattcatatagagtacactattgatttggtattgaatgagttcatgagtacagtgtagttatactctttctactccaagctgagaattctattagatactgccagtggagacatttcctataggagtttatagtttagaaggacagtttatgcccttgttgagcaggcagcatattcacaatgaattaatacaatgtttgcatacaaatccttcatagcaagacttctgattttctgtgcccaacattatgtcttttctagtaacatctagaaatttccacgttttttttgaaatgttttcgtttctttataacttcaatctcacatgattataaatgtggcagaatattccaggattcccaaataaactctttttatttttattttagttggtgacaggctcttgctctgttgcccaggctagaatacagtgatgcaatcatagctcagtgcagcctcgaactcctggtctcaaaggatccctggttattgataaaacttctttaaaaaatgtataaatacaccttctatatcccatattagtcatatattatataaaattaggactaattttaaaatagtattattaactttttatacatgtcctgtttcagtcattaagaagacttcctctccccctaattttcacacaagagagctggtcccttgttttctgaatattctttttcatttcctctatatggcattgtctaatatgtctttgttgcctagtatgtgtcagcatttgttataagtaagttatatatgttaactcagaactttggtaagtatcctatgaggtcgattctatttttaatcctcatttcatggatgagaaaaacaagatccagtgaaattaagtaactgaacccatttcacacatctagtaaggggcatcaaatttgaactccggtctctttaacgccagaattctcaccggtcatttctctgcctttctgcctgcctccccctttttgctattatagatgtcgttcttttacctatcactgcattttcattgcctgcattcagttataaagatcaatatgcaaataaatagagcgtattataaatttcagtgttatgaatttgtacaaagctgacttttcttcaccatttaaatttcttttacagtgatatattgcaacattttttggggggcaaaacatagagttttgtgtaatgatcaacaatgactcattaaaacctgtccctagattttaacggatactgcagagcctattggtacttcactgtagttttatcatttaacaaaattaacatatccatattgaaaatcaacttatagtttcattttttcatttgctacgatttgtatggttgacctttctcagggacacaaagtgatttctctctgtgttcccgtctcatttagacaaatgttgaataagactcaatccagcatcagtctatcggtccctttaatttagcatttcttttttgcctgtttaatacctggttcatgttgacgtttcacccttcatggacttctaactgcttgttcaagttcaacatatgctgaaaatatttctcctaaatatctgatcatttagatccatgccacattttttgttattaacataatttaaaaattctgtccagtatattttctaattatctttttattttccagaaatgttaacgttttatcataatacttttttcaaacggagtgctcatacgattgaagtttcatattcttctcttacactttataccaaatgtggtcattttataacaacagttacttaatcgcatcgcttaacaaatattttggtacaatttttgatcactcctcaaaatctaacgatcaaaaacagcatgtcacaattgcttccttaagcattaggaggatattagaatatgtagctcctgtaggccacggacttcttttatacttagatatatggagccatgtatatattctttttacattctattatttccattgtatctcattaaaaatatatcagggaagaaggaggggaaaatagttgacgataatatttgcaaagtttgtctccttcaccgccatcctgagtagcattatgctttgaaattagtgaagttacagttgtgtttcaaatgaattgagggacatggtttggcagcattaatatcattatgacaaatagaacattagactatcagggcagagggaagtgaaagaggataaaataatatagttgttgaattcacatctatattttttttagtctttaaaaaggataaagtgggaggcatgtgcaagttagcaaaaccacaggccttatgtttctagagacgttcttcagactttttaagaacttagcttccctttaactaaattatattaccagaaaattaagtaaaatgaacatttataaaagtagattatcttaggcaacctactcttctaccaaactactcttcgaacttttaggtattttaacctagagaaagaaccttacagtgagtttatgttcttttgagatctctgtaggtacatgagggaacataaaacatttaaatattcagtatttccaaagtataagaaagttatcagtgctaatgtagctatgtttaaaaatgcatgatatcatatgtaatatattttctcttttatattctgtcattaagaaaactatataagctaataaatctaagaaagtctaaattttgtaaactaactttagagagtttgaatattttaacccatagcacagcgtgatgttgccatgctttcatgctatgtatggaataatatgtacttggactggcgttcgtcatatatgaaatgacatagcatattccatggtacatagtaggtactccagaatggtaatggtgataatgatatgcttgtgtttccatttttcccttgataaagttttctgggtttggtattactacagatgattttaaaactttgagatcaacttctacatttataaatttaaaaatgtttcacattagaaagattatttttcctagtacttgtttttcttcctcgcatccatggacaatatgagacagagtctcgctctgtcacccaggctggagtgcagtggcgcgatctccgctcactgcaagctccgcctcccgggttcacgccattctcctgcctcagcctcccgagtagctggaaccccaggcgcccgccaccacgcccggctaattttttgtatttttagtagagacggggtttcaccgtgttagccaggatggtcttgatctcccgatgccgtgatcccccacctcggcctcccaaagtgttggaattataggcatgagccaccgtgcccagccgacaatctgtttatttctaatcttctgtaaatgaaataaagaataatcttggattttttttcctctttttaaaactatgaaaatactatttaaactaatttccaagcccatttttaaaattaaaaatgtaagttagtttggggaagtatatttgagtaatatgtatgatatgtaaaatgtatctgaaaacatccaaaatgttacttgttcatgcagccttccagctcccatcagagctttgagcacttttgtttttatttaagtttttatttaatattttatttacatatattctaattttctacatcttatgtcttattacttgatggcattgatattcattgttgtgacgcaagtctgataattcacattgaataatctgaaatcatatttacacatttatatcttagaaaataattgatctggtttgaaatcattcatgtggtgaatacttttataattaggatgtgttggctttcagatcatttctttcagtctgtgggttcaggggatatatttaattatttttttctttctagagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggtaagaatctcttctccttccatttggagcataatcaataggtatttcttggcaatttccaagaagacagtaacaaattatttagtaatgaaacgttcaccttctaaggatttagctaagcgcaataaagttcaaaatgtaagcaacagaaatctgtttaaatatgtaagacgtagatacccggattctaaaattgtatttggcgtagttacacagcgctaattgattgtgtcggtttgcgtaagcatgaggcagtttaggagtgtggaaaccacatgtatcctgtaaaaaatggcctctcactttggaactctttctttgtgacgagtgaaacatagtcattttgaaaaagtggaatccatggaaatagttagaaacacgggtcaacaacaagcttggatgcagtataactagatacataaggaaaatatttaaaactgatggacctctcaaattacgataatttgaggaaggtttctttacaaaaagatatttttaaaatgtagctggagtacagaggaaccacaccggatagtgtagtaacccagcatcagagttcttaccccttttagtccagaaaggatcagtgagagagcagttatagaaactcagaaggagacagtcagatcctcatggtaaaagcagcatggccggcttaaggaatcctcatagaaatggagtcagacaaataaacaccccacttcacttttttccctgcctccagaatcttgtcagggctcctcactgactaaacttaatcgtaagacaaaggacaaggaaccgtcatctgtaaatatcagtctcctgggtaacaggagaagagcggacagtggatctggaggggcaaacaagatgtaagtggacaaaagggcctgagaaagagatgaaaggattatgccttcaagtgtaagaaaacaagagctgtataataatgaaaatagcctaaactgttttcattgttactatgagctatgtgcttttcgcggggaatgagaaactgattagaggatggactaaaacgtttccaggatgaacgtttagtgatagatcgagatgattacatttaatacaaaaggcaaggagtggagattcatttgcatactgtaaaaaagaatggcttaaataaaggtagaatagacatggaaaggtgacaaggttgatttagaaaaggtattggacccaaaaagtgatgagaaattcaaagctattttgaagagaaaaacaattgaaggacttaatggttcttcaaatatcggacctgtagcattattaggttttctgttcttgtgttagtttgctgaggaaataaactcagaaagtatacttttggataaagaataccttggataaggcacttgacttgttaggcaaatacacacatctaaggaatttctacattgagatgcattttgtaatttaagaatagaaccaatgccgcttttcctgtgaatcagaggaataatccaaatacattatttcttgccacaaaaatctgatgttaccttatccgattcttgagattcagatatagtagttagtaatagtacctacacagtacattcatgcataaaatatatacattaagtgtctctaatgtgtttaagaatgctactgagtgtattaatcagctgagtctgccacaataaataccacagactcggtggcttaaacaacacaggtttattttctgagagttctagaagtgagagaaagtccaggatcaaggtttggtagggttcagcttcatcttctggtgaaggctgtcttcctggcttgcagataaccaacttctcactctgtcctcacatggctttcctctgtgtgtatacatgcagagagagagaatgagggctatttttctttctctctctctttatctctgcctccttttataaagccaccaatccctaagggattagccccccaccccgccacccttacccaaccctgatgacgtcatataaacatcattacctcttaaaagtcctatcaccaaatagtctcaccaatggttaggacttcaacatgtgaattttggaagacacaattcagcccatagcactaagttttgggaatattagagtgggcattcatggactctgcttttattgtatttacggaaagcagagaagagagatatgaaacaatggaatcaatatttttaaatttcctgctaggaacagtggtttaaactaagatgcaaagctttgggagaatgagtaacagggaaaaacgaacctgatacagccaccaagggcatcttccttgagggaggaacatttgagttgagacttttgtgataagttagaattaggtaagagaacagttaagcaagattccaggcagaaggaacatggcaagagggagcaataaaggccaagcacctgaatgaagaccattgtaaatgctgaacatagaggggcagatgaatgagaggagagacaaacaggaatcagtcaggtatataggagacaaaccaatgacttctgggacctgctagtatcttggtcttgatttgaggaacaaatggagatcaccagaggttttatatattaaatattgtctggaggttgaggaagtcatcctaagggaaaatacttctcttactgcatccaaattccgttgtcacctccttatcaccccttactctttctctcagacccattggtgtctattaatttgaagaatcactttaggtaaaatatttagcaagataagcttaatattattcatacaagggcaaatatatatactgttctgctgagattagtgataggtaaataaattataacatgtttctcagcgttttattttatttggagaagttttataacattagagcgcatatttagctcatattctaatgatcggcagaactggtttttaatattgtgggggttagagagccttatcagaattggaaaaaattcatgaaccctttcctgtgaaaaatacaaaagcttccatgagataagcatataattttaaagaataaacagactcaaaggagataccatactctggaggaccaactaaaccaaatccttttatggaaataatggctaattgttcacatctttttaaacacagaatacttcagttgaaaagtatctcttctatgatttattctcagaacattaaggtctcaactgaacatttgcccaaatgttttattagtttcaaagtcccctttgtttttcagagcacacttggctataatgttggctctttctatagccccctgaacgggaaaaatggcagccctccatctggccaaatataaatcaggttcttaatggttcacagtagatgccaatgctgccatttgtaaatctagcatacaaattatttgtatatatttctgtactataaatacagaatattaccctttacctcttgtcttatttcttatccatggatatataccaactttctagcactggtttgagaggatttatatttgaaagagaaatataggtcaccttccattttgctaaacgtctttaatcttcacccaccaaaacgattgaatcgtcagagattattttacctgaatcagctcataccattataaccacataaacacattcctctgaaagctgtatttatgtttttttaatgagaataagtggcattgtacattagtcttgcaaccatgacagaatttatgtgataaatttctcagcctctcctaatacaaaagttactctctcccaaagagtatgaatgcctccataaatattaactttttttttgccttttcactttgattttcaggaagctcagatttcaattcgttcagaattggtataattctttccattttctctttcttctaatgggctcatgttccaatttttaaatttcaattttcctgttgttacatattaaatagtaactaaccctcaagtatttttttctaaagacagcatatatatgaattgtaagtaagcagccatgataataacacttttaaaaagggcagtgaaaactttgagttcaaattatatatgtattaaatacgaaacaattccaacttcactggaaacaagaacatgaaaacatttatgtagagaatagcatgcccttcgcccactttttgatggggttgtttgtttttttcttgtaaatttttttgagttcgttgtagattctggatattagccctttgtcagatgagtaggttgcaaaaattttctcccattttgtaggttgcctgttcactctgatggtagtttcttttgctgtgcagaagctctttagtttaattagatcccatttgtcaatttgtcttttgttgccattgcttttggtgttttggacatgaagtccttgcccatgcctatgccctgaatggtattgcctaggttttcttctagggtttttatggttttaggtctaacgtttaaatctttaatccatcttgaattgatttttgtataagttgtaaggaagggatccagtttcagctttctacatatggctagccagttttcccagcaccatttattaaatagggaatcctttccccattgcttgtttttgtcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgtcctgttggcttaggattgacttggcgatgcgggctcttttttggttccatatgaactttaaagtagttttttccaattctgtgaagaaagtcattgtccaaaagaaatacagtgctagccacaaattcaagccacatatgtaatttaaaatggtctagaaactatattaggaaaggaaaaagaaacggtaattgaatttcaatagtacattttatttaacctgattcatcaaaaatattatttgaaagtgtaatcagtatttaaaaactttgagattatgttcttagcttttcttaatcttcagaattaaacatattttggtaatttcatgcatctaaatttggaccagccacatttcaggtgcccagttgccacatgagctagtgacagtacagcagtgttcatgtgattttatcatacaaaccagggtactactgagagtgaaacagggtgctactaataattatgccaggacaacaagaggaaacctggacagccaccgtaatttaaaaagtggcaattggctgggcgcggtggctcacacctgtaatcccagcactttgggaggccaaggtgggtggatcatgaggtcagcagtttgagaccagcctggccaacagtgaaactccatctctactaaaaataaaaaaaatttgctggacacggtagcgggcacctgtaatcccagctactcaggaggctgaggcagaagaatcgcttgaacctggaatgtgaaggttgcatttggccaagatcgcgtcattgcactccagcctgggcaacaagagcgagactctgtcccaaaaaaaaaaaaaaaaaaaaaaaaaagcagtggttgcctgtttggtcaggagaagtaatgagaccatacaaaacatagaagattatagatatatttttatatttgggtgtgtacatacatatgtataagtattatatagattttatatgtgtgtatataatctatataattgtatcaaaatatatttataattatagtatacacatatacatatatgtaggtatatatgtaatttatattttgcagaaatgaaagagaaaatattgttcattgagtgagcttaaaatttgaagcaagcgcacatcattttgatataagaggggtgcagccaaacacctatatttgatttatggaaaggatttaaggtcatgcatagtatttttccactgtacgcattcatacccattaatgctctaaattatgtcatcttgaaatttaaatatcattatataggatgatacatattgaacaaagagccaaggtatccttaaatgtatggctggtgatagaggcttgtctatactgtcatggatgtttcttatcagatatttgtgaagggtattaagctaaacttgccttactgctttttaataccttcttttgcaaaatgtaatgtatgcaaagtaaacgtgttacttactttccatactctatggcacaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaagtaagtaaaaagcctaaaatggctaacttgacattttccaaaatggttatttgtggggaaatccagaaggtactaacatgaaacaataatttctgtaaatggaaccattctccctacaacctgtattaacaaggaacgaaatactggtgtaacagataagctgtctgtagatttttttgtcctcataataattttgtgactttgagaaacaaaacatgttttgtatgggaatagcttctccttgggggattgtagatttcaaaatcagatgttttgaatatagaagaaaataaaagagcagttgaggtcatatgaatacacttcaattaagtctggctcgctgtatatacaaggatatttgctaggcatcttctaatatttctgtcaatttatctgaagagtattatagctttagcatacatgtggcaactgaaactcagcaaaggacaaattattctttgggctacattttactactggatcactataattacataaatcctattttttcctttgatgataaaagataaaagtggagcaattatgcaaattcatgccatgcgactagcaaatttttcaagatgtttcttttgtctcttcctgaattgctttaataagatgatgttaatacatagtatctgctccaaaatatctctactcatcaacttagttttaagacaaaaattcttttcagagacagatgaatgaccacctttaagaaatagtaaatggggttttgattcactatatacatgcatatatgtgttcatgtgcacacaaaaggaattattgagtaaaatcgggtttgaaggcattaagataaaagtatttttctgaaaaaatctctgtcccaaatttgtcatgagaagcacaggaacatgtgtttgtttactactaaaacttaaattagttggaaaatatattatcctattgcttttctttgtaaatatttaaagaattcaccatataatatcatttccagaattaatgtagtgatacacaacgcttttctcatttcccagcttttcattttttacaaaaatgaaatgagctaaataaagcaaaggataaatactttttttttttttttttttttttgtacttcagagtcgtttttgctaaggggtttattttcctgtacaggtagtaaaactttataaatagtatcagctccctctagtggatttcagtatacttgttactgtgcctctgcaaaatcaatttgggaaaatattttaaatgtcctagattttcaaatattgacatatttaacaataatgtattttcacttgtcattacatacataactcccccttaaagttaaatacatttagtggctatgcagcaattgttgtgcaaaggagccatttcactggaaatttactttaatctgtatatacctcttaatcatattaaagttcaactttttatcatttactttaaagatgttcagaatagcaatgtttgataactgagatttgtctatgatgttacaatataaatacgtaataatatatagtctctattcatacagctctccatccatccatccatccctatcatctttcttctcttttttaaatttcatacctacaaacgatgattgtttataaaacttcctaactttttcactgctattatatgtaaacaaattgtccccacttccactgtagctacacatctttaattttactattcacccttttggaatgcttgtctagattaataaataaccctttaattaaatatggtgtatatatatatatatatatggaatgaaaaatgtagcatatgaaattacatagcagttgattttgttaatttgaaattaattcaaataattgcacatgtgtatgcattatatccgaactggcaccagggagtaaatctcatttcttgtattcctccacagtactttggacgtattaagtatgcaggaaataagagctaacagaagtgcctaggcatccatactgacttttatttcctctttacttttttaaacttgctttttcacacaaaaacctggcttttaaaatatactatcagtgttggaaaatggcataaggaattggtagttgttacctgacataagtgatagaagaaaataatataaaaagataaaattctattttcaaagcactttttactctatgcataactaatttatacatcattttacctaaccctcagagagaaacacattgagtatttgttattacaactatatcacaagtaagctaatggggtttgaataactaaaagcatggatatgggatgctgtaagaactagatcgtatacacgaatgtccataacaacattattcataatagccaaaacgtagaagaaacccacatgtccatccagtgatgactatatgaagaaaatgggcacatccatacaaggcagtgttactgagcaataaaaagggagaaagtactgatacatgctacagcatggagtacccttgaagacattatgctgagtgaaagaagccagtcacaaaagatcatatgttatatgagtctcttgatataaaatggccacaataggcaaatctgtacaggcagaaataagattagtggttgcctaggtctgggaggatgagggggtggaattgtttcccatgacagttgataaaatacttttctagagactgaaaaccagtaaactcatgttatatgctagatgaatatagaaacacagcatctagtctgttgtagataattgtttcaacaaagaaaaaaatgaaaccttatttcttaatgtaaagaaggaaaaagattggtcatataatttgagtttatttcattaacaatttggaaatcatgttaaaataattattagggattttattggtttggtttagttttgcaaaaatggagaaagtgacattattagttatgacaaagccagtgttttgactgttctaaagtttcaaaatgattctcttctgttctacaccattagattgctttcagaacagagtcttgctcactttttcactaataaattcaagaaatatttttgaacacctggtatatgccgtaaaagtgctgggcactaggtaatatacatggtggagaaaatcaagagcaatatgtcttcatggagcttattgaaagaaagataataaaattgaatatctgaatattattgcagattataattactttggcgtctgaaaccgtgattctggggagatgatgttagaaccaaacctggagaatgtgcaggtgccagctatatgataagttggagaaaggacattaggagaaatgaaaagaaacacaaattgccaaaggtgaagaatgagggcttggcatgtccagaagacataagggaggccagaaaggctggaatgtaacaaatcaatgaaagattaggacaagatgagggtagaattgctcttatagaacttctataacaggtttggattttaagagcagtagacatttccgaaagaatttcaattgaggaaattaagtacccttagttgtattttttcaaaactcaccctctagctggtatgtgaagaagaaatgcaatacaagtctgaggagaagcaggaagacttgtggaaagaatagccacacagaggagagtccattgaaccttaaactacagttgtgataagataaagaaaaatcatttcaacccttgaagaggtgatgatctggggaggtgtagcacagaagatattcttgccagaattgaaagaaaataacttttacctcttacagagacagtagaagaaaattttaagggtagccagcaaggatgctctccatggccacaatttcaagctctatggttagtctctacccctccctgttaggatgctgagactgggaattaaaacaaagtttgatgtgaggtaactcttctagctgcagttcaggaaattgacctaatttactttattaaaattttaaattttttattttaaaattttatttttaatacatctaggcaaaggaatgttttgttccagtagacacataatctgttgcattgctccttcactccagaaactaggtaaactgtttgtaaatgttccttttaaaaattgtgttatttttatcaataccatcaagagcaagcatagcagacatgtttatttaagcaagctatgtgcttattgtgagataaaagaattgttccctgacctcaagaatcatgggaaaactcgctaaatgccaagttaaagctatacatatatatatacacacgctgtgtgtacatatacgtatatgtacacaagttgtgtgtgcatatacgtatgtacatatatacacatactgtgtatgtacacacacagacacatactgtgtaaatactcacgtaggcaaatattgtgtatatacacacgtagacacatactgtgtatatacacacgtagacacattctgtgtatataaacacgtagacacatactgtgtatgtacacacgtagacacatactgtgtatgtacacacatagacacatactgtgtatatacacatgtagacatatacacacacacacacacacacacacacatttataaaatttatgtgacaggaacctcatactattttccaaaatggctgtactaatttacattcccaccaacaatgtgtaagtgtacttttctccacagcctctccaacatttatctttcatcattttgaaagtagccgttctaattttaacatgtgtaaggtgacacatcattgtggttttcacatttttctgatgtttagagatgttgagcattttttcacatatctgttggccattggtgcctcttattgcgagaaatgtctgttcatatcccttgcccatttttaaatcaggttatttgttttcttgctgttgagttttttgaggtttctatatattttggatattaactccttaccagatatttggtttgcaaatattttctcttgatctgtgagctgcctcttcactctgttaatagtttcctttcctgtgcaggagctttttagtttgatgcaatctaatttgtctatttttgcttttgttgcccatgccatatccatttgagcattattcataacagccaagatacggaaacaacctaaatgtctattacaggacgaatggataaagaaaatgtgatatatatagtgatatatgcatagtggtagatatatatagtgatttatatatactgatatatagagatatatatactgatatatatagtgacatatatatatagtgataaatatattccagtgtctatatatgatatatatatgcaatggaatactatacagtctttaaaaggaaggaatttctgtcatttgccaccatgtagatagaactggcggacattaggctagctgaaatgagccaggcaaagaaagacaaatactgtatgatctcacttatatgagaaatccaaaaaaaagtcaaattatagaaacagaaaatagaaaggtagttaccagagactggggggaagaggaaggttgggaaagggaaggtgttgatcaaatgatagaaagtttcagttagactggaggaataaattgtagcgatctctagtactgcgtggtggacacagttaataaaaatctatgtttcaaaattggtaaaagaatagattttaatatccgcatcacaaaaaaagataagttggtgaggtgattaatatgttaattaacctgagtgaatattttacaatgcatacatagatcaaaacatcacatgataccccataaatacacataattattatttgttagttaaatatgaaatagtttaacatgatattttgaaaataggattgctaagtggatagagctgcttttagaaaaagggaaaattcagcaaaagaaaaaaactcttaaattctaataaatatttctgtagtgtggtagtttatacttacacaaagttggtcagaaaaatgagacttacctggaaaataaatcagttgtccaggaggtgaataatagagcagtatttatgaaaatgaccccaatttcagttggttcattggagttttatgacttataaaacaaattctatggtgatcttagataaaattcctataaacccatctatttcactcatgtcagaccacaccaagtgccctttgtgagaatggagcctgagcagcagcgactttcagcagagcaagttgcataagcaaaaaggcgtgaagtaattaaaaggcatattttgactggaggatagaatattgattttgataggaaattgggctaaaatgttgattgaattcccaatcacaaagatccttgtatttcaaactaaggaaacaacttatatattgacattagaaattcaagttatactcagacttccttgcacttgtaattatctgaaggaccattcctagtatgttaatcatcatatatcatgcatgggtcctgttgtatttcttgacacctttgtcagtgttcacattttagagaaatgcttacttttgtcatggtctatgttatttaataaagtttggagcctttgctgattgcattatctccttgactttagattgatcatggggaatgaggaaaaaggtgggatctggttggcatggaattaaaggctcaagttgagcattttgccgaagtaggtatatgtcattagttcagcttcttcacacatgtgcagtgcatttttttccccacaggtaataatggggaattcaaattggactcgatttcatattcacaacaggacttctaatgtttttaaatgctgtcaatattaagactactaacatatcatctctttctccccctaaatggattacatgggtgccttttccagcttctatctaagcactatccaacagaaaaataatgtgagccatatatttaattttaaatgttctagaaaccacattaacagatcaacaggtaaaagtcatttgaaaatattgtttcatcttagaattaaaattttaaaatgtggaaatagctttacattctttttgtatgaactgtccaatatctggtgtgtctttatatatacaaaacatctcaactcaaactggccacgtttcaagtgcttaacggacgggtagccagttgctaccttattggttggcacagttacgtcttccttctctctattgtacattctctgatgcttaagtgcctattttctgagtagttctatttttcaagaggagagattttttttttcagtaaagtgttatatataaccgattgctctggtatctctttatctcgatagttatgtctctcagaattttcaatatacttctctgtttactttgctttccagttaaagtggtttgcccttgacatagactcatgtgtattagaaaatgtagcatctaatttcatacttagctcttttgttatcacaaaagaatcttgctttgcctctcttggtctgtcctttgctctccttttttctctcttcttttccctttagcccctccctcttttaagagttaaagacaagcagtttttaaacaaaaggtgcagaaaacttcttttttgtattcctttactataattttagatgtcagtttgcctatactttatcacttccatccctcacatggctatattaaatgtctagatattaatggaatttttttttttacttttcaagataaacagtagtgcaggataggagcccttaatttttattttcccaataatttacagcacgtgcttccaagcttgcaatcacttatattgattttcattttgttgaatatatttcactaataaaaccaaaaagatatctgcatttttaaagtggtcctttagcagccgaatagtagaaactgtcataggaatactttctttagagaaaaaagttacatatttataagcaatatattggctaaacgttaaatcttcaggccatatttttcctgagtctgtgctgagtctaatgatgtcagtagaactctcgaggtcttttaagatggtaggttattagattggatatgtttattgtcttattgctgtcagtaaagataaacttatctgttggattattaatctctatttctacataaaaggaaaaaaagtgagtttccgtagatggagctggtctatttctgctcctatgttgggatcacaagggcagcatctacagatatctcaccagctagtaggtggggcagctcatactgtgtttgcccttgggtacattagcttctgtataagactttttctttcttcttatctgaaacagatttagaattcttcactggcattccctggcctgcatggtttaaatgagatactctataccgttgcaaatttgtcaagcatttcctgaaccttgatagcaattactgctgtcattacatagtgtcattacattccacataagaaaatcagaaaaagaaattgtgatatttatgttagtaggtgtgtatttttttttccagcttgcctcacaaactatattagatggacaagttcccaaaccaatctttggaagtttatttcttaaagctacaaaagaatttccaagagattagattttttgaaatgaccagtttcaaatgaatttaatacaaaactaggatgagggttggaatgcaaggaggaattaaaatatgcatgttttaattatagtttaccaatatgaagtgattcctgtgagattcagttgttggacagatcagaagttatacagaaaaagatcaataattcagagactgaagtgtttcagttttcattaaacagaaagaccagaaagaagttaaagaggagacatgttcaagttcaattaaaccaaattttatgaagcttatgattcatccaacataccgccatgtgtctgcccatagtcccctctccttctagatcatttgctgaaatgacatctcagacacaatcatttgcttcattgtaactaaatacctctttacttcactgctatttataaggtcccttttggattttgtttattaataatcatctagaattcaaataaatgcatatgccactcttgccactcctcttcagcatagtactagaagtcctagccagagcagtcagacaagagaaagaaataaagggcatccaaatcggtaaagaggaagtcaaactgtcagtgtttgccgactatatgatcatttaccttcaaaaccctaaggattcctccagaaagtttctagaactgataaaataattcagcaacatttccagatacaagattaatgtacaaaaatcagtagctcttctgtataccaacaacgaccaagcagagaatcaaattaagaactcaaccccttttacaatagctgcaaaaaataaaataaaataacaacaacaacaacaaaaaacttaggaatatacctaaccaaggagtcgaaagacctctccaaggaaaactaccaaacactgctgaaagaaatcatagatgacacaaacaaatgaaaacacatcccatagtcgtggatgggtacaatcagtattgtgaaaatgaccatactgccaaaggcaatctacaaattcagtgcaatccccatcaaaataacagcatcattcttcacagaattagaaaaaaaattctaaaattaatatggaaccaaaaaggagcctgcacagccaaagcaagactaagcaaaaagaacaaatctggaggcatcacactacctgatttcaaactatactataaggccatagtcaccaaaacagcatggtactggtataaatataggcacatagaccaacagaacagaatagagaacccagaaataaaccaaaatacttacacaaactgatcttcaacaaagcaaacaaaaacatacagtaaagaaaggacacccttttcatcaaatggtgctgggataattggctagccacatgtgggagactgaaattggctcctcatctctcacattatacaaaaaccaactaaagatggtttaaagacttaaacctaagacctgaaactataaaaattctagaagataacattggaaaaaactttctagacattggcttaggcaaggatttcatgaccaggaacccaaaagcaaatgtaataaaaacaaagataaatagctggtacctaatttaaattaaaaagcttttgcacagcaaaaggaacaatcagcacagcaaacaggcaacccatggagtgggataaaatcttcacaatctatacatctgacaaaggactaatatccagaatctacaacaaactcaaatcagtaagaaaaatacaatcccatcaaaaagtgggctaaggacatgaatagacagttctcaaaaggagatatacaaatggtcaacaaacttatgaaaaaatgctaacattatgaatgatcagggaaatgcaaatcaaaaccaccatgtgataccaccttactcttgcaagaatgaccataatcaaaaaaattttaaaaagtacatgtttgcgtggatgtggtgatcaggtaacacttctacactgctgatggggatttaaacaagtacagccactatggaaaagagtgtggagattccttaactaaaagtagaactaccactcgatccagcaatcccattactgggtatctacccagaggaaaaaaagtcattattcaaaaaagatacttgcacatgcatgtttatagcagcacagttcacaccagcacaatcgtggaaccaatccaaatgcccatcactgaatgagtggttaaagaaactgtggtgagtgtgtgtgtgtgtgtgtgtgtgtgtgtatgtatgtatgtatatatgatggaatactactcagtcataaaaatgaatgaattaacagcatttgcagtgacctgaatgagattggagactattattctaagtgaagtaactcaggaatggaaaaccaaacattgtatgttctcactgatatgtgggagataatctatgaggacacacaggcattagaatgatataatggactttgggaacttgtggggaaggttggggggagagagaaaagactacaaatagggtacagtgtatactgcttaggtgatgggtgcaccaaaatctcacaaatcaccactaaagaacttactcatgtaaccaaataccacctttacccccaataacttatggaaaaataaaaaataaatgcatcaggttaatagagaaacatattatttatgtaaattaaaacagattttaagtactacaaatatcttttaataagaaatcagaagtgctcagattaaatataatctcttaacatttttatgagttcccaaataaatgcaatataaacatattgaaaaaaattatccatttctaacatttcagcatccattgccaacacactctctaagattatcgcaaccatctgaatactacattaaatacatgcaaaatactttcctatattcttctcatttagtgtagaaggaattggtatattgaaatgacattcatatcccagcaattaaaataatatgatttagataatgttatttgatgtggtgatataaaccaggactttgcagtgtgatttcatgtatttagaaacattattagccattatctgtttaaatatggcttctgccacattctgggatgcatatatattagaccgttttactgtgttctctatctttttgtgtctccatgcttcattccaggtatttccttctgaatcttaagatttagtaattttctatttacccctgtcaaatttgctgttaaacccatgcacttaattcttatttttcacttactgtatttttaattctagaatttcttttggattatccctaaaatatgttatgtcctttttatggtttacagttctctgcagcgttctcaatcttgtgtctaatctctttcaatatagtccatgtggctgcttaagtcacatttcatatatatacatatacacatacatactttaaaacgtataaacttgtttgtatatacatactgtatatctctatataatactttccctaatataattatacatataaaagtatatacatacacatatgcctctttaatagcctgttttctcaattgcaattgggattaacaatgtatatgtctcacaggtttattataagaattaagaatgataatatttatggggttattactagagttcttgatacatatactaagcatgcgtacatgggtgttctttcagtaaaattagacatgacatgatataatttaaaaatcaaggtcttcggataatgatactattttttttccaaggcaaatgataacactgagagagagtagcctttcagtatcagatacaattggaccctgctcggtttctgcaaataccatctgtatcaccttgggcaatttacttagcttctctgtttttctgtttcctgcccttatctgtttttctgtttcctgaccttataaaacgaattgaacaatatagattttacaggctgatttgtgaatttaatgtaatatgtgtaaggtccctggcatattacacatgtagcaggaatgtatcttcataatcatattaaatatatttttcagattttctaattttgttaatatttgaaactagtaatataattgagtttgctgacaatttaggaaaacatggcaaagtgtgaaacaattaagtgattctcattcttttttcccttttgataaagtttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggtctgtgaatatttgaatgtcaaaacaataaagcacgcttatcaagcattcacattgatataacctttaaataatattagaatttaagtcattctgacaagtatggtagtttgcccattgagcaaatgaaaatgagactttacagtattatttatgcatatactctatctatggatatatatgtatgggcatatatacatgctgtttttgaaaacaattgtatgatctatttatgaagtatatttttaatttagcatgcattttcagatgtattgattttgattattagaaaaaccattgttttattccccacctttgcttctttatttgtaactcctgtcacattctcaaactggtgggtaaaatcagtgtacagtcatcccttcgtatccatggggaagtggttccaggaactcctatgaatatcagaattcacagatgttcaagtcctttatatgaatggtgtaatatttgcatataacttatgaacatgctcccatatactttaactcatctctggattacttataatgcctaatacaatgtaaatattatgaaaatatgtgttatactgtattatttaggaagtagtgacaatgaaaaagtcttacatgtttagtacagatgtagttatttttgtcaaatattatctattagtagttgactgaatccactcattcagaatccacaaatatggagggctggctatatttataaaattggtttaaatttaaacattaattttctgtaatgtaatgagacatttgaattctaatagctacatttttttaacatccttctatcaggaaagatatactaatatgggaaatgaaagaaataatttgtaagagattttataatacttttcctactttattttatttttagacggagtttcattcttgttgcccaggctggagtgcagcagtgctatctcggctcactgcaacctacgcctcccgggttcaagtgattctcctgccttagcctcctgagtagctgggattatagtgcgtgccatcacgcctggctaatttttgtatttttaaagtaaagatggggtttcaccatcttggccatgctggtctcaaactcctgacctcagatgatctgcctgcctcagcctcccaaagtgctgggattacaggtgtgagccactgcgcccagcccttttcctacttattataaaatactacattatatgttcaataactttttatttctgaagacatgaaaacgtattagttatatttagaagctgagataatatgtgcattttaagaaaaatgtttaaaaattcaaatttaaactttatcacatagaattttttttggataattaaatatttttttgaagtaatgtattcaaagaaaaatacatttaaacaactttcattatgtattgtcctatttagatatttattctactacaataccaaatggtagctgtttcaccttttttgtttccttttgttgtggtttttaatgcttggcataatgattccaaagtctatctggaaaaatgtgttgcctaatagaactagtaaacttttaaacataagaataaaaatgtgcaagaataagagtggagaaaacacaagaaaaggcagttagatgagcagaagagactatttccactgaaaaagataggaaagaaaataattgttcataaatattattgggaaatgtattaactaactaaaaaaaaagatatgaacatttcccccaaagttacaccaaaataaaaaccacatacaataaaatgttcaaaaaatgtggggaagcccaaattttggaaaatatttaaaataataatgttataaaaatttaggtggagaagcataaaaatcgatggaaacaatcacaaacattgtaaaaacaccagagacaattttaaagaaatatgataccaaggaatctttttttttctgtgagtaaggaagaaagtcttgagtaaggtatcctccaaaaagagacatatatgaataataaacctatgaataattgtaacttaaattgtaaaggaagaagtaaaaaaattacaagatgagaattttttttgcatactaaattgcatacacacaaaagatataagtaccaatttgcaagtggtgaaataaaaattgtctcttactgctggaaatgtaaattcaatatgaattttactgaggttaactcttcagtgcatcctaataacatacaacattaatataatttccatgaaatctgtatctgatggaaataatcagaatacactcaaagatgtaaatggaactggagatagataggatattgattgattgagggatggatggatggattagataggtaggtagatagagataaacataatttacaggagtggaaaactagaaatgaatgtgtagaactaataatggaaattgttgaactagaaaagccattacaatttttgtttttgaaaaaataattatttgacatgggcaaatgctcacactaaaacacctagctcaaagtgtagttatatgctagatattgtctaaataatcagtcataggggaacaatttgaaaaagtgaaataaacttaaaaaagtaaagtaaaaaaacaaattaagtaccaccaaataggcataggatactatgaaactataaaacttagatatttgacaaattttgggttgatataggtcacattataggggaaagaataactgtttatatgtgcatacatgatcatatatttaatatttagctatacatagaacaaattgaaaatttatataaagtactagtagttctggtttttttttccatttttgtcatgagcctttattattttataaagtaaaagtaacattaaagtaaatattgaacaggggaagtctaaagttatgatcctactgtaagaaattacatgtgttatacagaataagtataaataaattttataaattctccacaaaactatccttgaatcccaccataatactacataacagaataacattttttgaaaatatattaagtacatagattgttcaataagtttttctattccatatatcaatattattagctatagttttatgtagagtttactttcctgaaagctcagtataattaatttcaactccattaactgtatcacaaatgcagttattaatatatatacttaattcagtaaaattagatgcaccaaaactttttggctctgtaagatatagttttgagatatatttgacattgttcagaaaaatacatatggagtgttaaataccactaaataatattcaagttactcttaggataatatgtaaaatttaaattaccactagaagtttataactgatagaagatcatctactttgtttacatgtttgaatcatatagatttcaagtacagttaatttcactaaaactcatcaattattattcatcaattagggtaaatgtatttaaaaaattgttttttaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcaggtaattcaagattttactttctaccctcatttttatttacttgttttttccctaacgatacactgtaaactgtaaaggtacataagcatttgaccttcagcatctttcaaagttagtgagaagatgaaaagacatgagtcttttacaaaggatggcgatttgcttattccttctaggaaaagaataggagttttctcagtgtttttagaatgaattttctattttcaccattaccaataggaattaaacatgtttttagtttaataattttcaaaaccaatcatccatttagtctggttgtcttttaagatacgggtaatcatttagcttatgactagaaaaaagttatgtatatatacattatacagaggtatattgtaatcattttatatatataatgtatagtatgtatatgattatttcctatattacctttcatttctgctgttttgctacttataaaaagtaggagtcaactatgctgtctatatgtgctattatatataaaatatggtgatatgttcataaaattgcattatatattcatcccattatgtataactccatatatgtatatgtgcagtagaaatgtaggtgtattaatgtcctatgatactcctaagaaattagcagaaatttaatggcttcaaacaacacaaatttattacattactgttctggaggtcagaagttcagaattaatctctgtgggctaaaattaaggtgttagcagaactgtgtctgttttggagactttgaaagagaatgtgtgttattggcatttttagcttccatatatatatgtatatatatacacacacatacatataacatgtatatatgtgtgtatatatatatatatatacgtgtataatggaattatatatcatgtacatatatacatatctaatgtaatatatatcacatatgtaacctgttgtatatgtatattaatgttacatatgtaatatatagtaataacttattttatcaccatatcgaatttgtaattatatgcttaaattttaccacatcaccttcttcctgaaaccaaattcccttgacttaatttgtttgaatagtgccaccatactaataaccactcaagctaaagaaaaacagtaaaccaacaattgcattaaggtctaaaagcctaaaatattcaataaggtaagtaatgtgtcccttgagtggtcaattattgtgacaaatgttaatgctgggaaggaaatgtcgaaaacgttatggtatgatggaaaaacattgcaacaatatgctcctggatttaaatcccagtctagctgcttagtttttgtgcttaccttttacaaaccaaagcactaagcaaacctaaaacattttttaatgcatagcatttctttacttataaacatatgtgtacatgcatacctatgtaaatactgcatgaaaatatctattatttgtcaagaccagtggcctaagagggcacaattacatggctcttgttatcaaggagcccacattctagtgaaggaggaaggtaggtgtattcatttcctatggcactcctaacaaattgccggaaatttaataacttcaagcaacacaaatttattagagttctggaagtcaaaagttcaggattagtctcagtgggctaaaattaaggtgtcagcaggactttgtctgttttggaggctttgcgacagagtctgttttattggcatttttagcttctagaagcattccttgtctcatgtccccatcctccatcttcaaagtcagcagtgtaacatcatctagtgtcaatttctctctccctgtctatctccctctccctctctttctacctctccttctcaccttcctttccctatcctgttccctgtgttgacttccttttaattaggacctttgtgattacattatgccctggtggatgatccagtataatctccccatctcagaatccttaatgtaatcacatctgcaaagtcctttctggtaatatactcacaggtttcagagattagggtgaggacatcttgggggtagcattattcagccttgcatggtaaataaattaaacagtatgggaaaggttgtcacagtaggcaggaaggaaatccaacataaactaggaaaaaggattatgaaatattatcggaacataggttgtctctgctatagattaaataggtagaatttagttagctaataccgagaaagaaagagttcttgagaaagcatagcagcattttcagttaaatgatataagttcaacactgggtagacaatatatatggggattaataaaatattatggttggaaaactggattgagagtagacagtgaatgtccttggatgctatgttttacaatctgagttttaatctagtggtgatgggactgataataataacaataaaaacttaataagaaaaaactgctattggttaaagagggaaataatatgattccacttgtgttttcaaaacattcccaagatgagaggaaggaggagaggagattactggcatcactgtagatcagtaattagaatgaggtgagaccgaggcagatatcaaaacgagccagtgcattaatggagtcactaatgagacctgaacagcccaggcgtagtggctcatgcctataatcccagcactctgggcagctgaggcaggtagatcacgaggtcaagagatcaagaccatgctggccaacatggcgaaaccctgtctctactaaaaacacaaaaattagctgggcatggtagtgcacgcctgtaatcccagctacttgggaggctgaggcaggagaatggcgtgaacctgggaggtggaggctgcagtgagccaagattgtgccacttcactccagcctgggcgacagagcaagactccatctcaaaaaaaaaaaaaaaaaaaaacaaaaaacaaacaaaaaaaaaaagacctgaacaaggacagtgaagatgtgaaataagaacaaatgtagacttgaaagataacagcaaggtgatcgtcttgaagttctcttagataaatagtttaaaaattattattaataatcacattaaaggggaaactttctgtggagcacatattttcaatgtaaatttaagtaaaacagaagaaaataacacatgtagacagcatagttgaatcatactttttagaagtggcaaaacagcagaaaaaaaggtaatacgggaaagaatcatgggtgagagatactggctatttataaatgataaaagatgatgatttttacctgatcattacttcgtactggtcagacaaataaaagcaaaagctctgtctttgaagatgacaaaatattagtccaaaagttcccaactggaaggactatttaaactgtcatctgtagaaaataatttgtgaaagttcgggtttagggaggctataaagacaccattacattgagtttattgttcatagtttgttttatgtactgtaaggacacatttttagtattctcatgagttgttttgtaacttaaaatttctctagagggggatatgatttaatgttctcgagagtaacatcataaaaccacatttggtagtaattttgtatttttaacaatagcagacttcacacaccagtgctcatacagtagaccataaaaatgcagtcttagtaaaaatattctttgcctcaagaactacttagagacatcctttaaacatgggaattgtttttgggcctgtgtttagacataacacaatgatgaattgtgttaaaagtaatcagcacaccagtaatgccttataacgggtctcgtttcagaatcacatacaaaccctgaagaaatggatggctgaagttgatgtttttctgaaggaggaatggcctgcccttggggattcagaaattctaaaaaagcagctgaaacagtgcagagtaagatttttatatgatgcctttaatatgaataattttgtatgaatattatttggttagatcagtgttttacagctggggtggattttgctctcctctccccagtggattttttttaatgtttctagacgtttttgattgtcacagctgggttgggggtggtggttagatgctactggtgtctaataggtagaggagagagatgctgctaaatatcgtacagtccatagaacattcctccagaacaaggaactgcacaatctaaaatgtcactagtgccaatgttgagaaaccctgggttgagtaaatgaggaactgacaaaacattgccttgtactcaacctcatttgataacattattttactataaaatgcagtataatttaaaggtaaagaatcctttgagctacttgttatttcttatgataaattactattcatactgtgttgttctcttcatctataatgcactgtactataatataacacagtatgcattttgaaataatattcattataccattgtcatgcagcaggaagaaaacaatcttgctctttaaggaaatttttttacaatacaagctaaaaaagcaaatccacctcacaaataaccttcacacccattacactgtaaacaatttctgcagtatcctgtgtttgaaaatgaaaatactaacaaagataataaagtatgaagcccatcattttcacacatttttctaaccagaaatattaaatttatttccttttgtttctgatataagtagaatacaaataattccccactggattcatgccataataaccattgaacatttttgcaagactgttaggcagtcatctatatcaatatctctgtatctcagattttaaaagacaaaaatccatatgcaatgccatcagtcccaattttacattttctagctatgtttcatatctaatatgtggcagtaatttttttcagctggcttaaattgatttattttcttagcttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtatagacaatctctttcactgtggcttgcctcaacgtacttaactaagatttcctaatgtctcccttcaccgttacttttggttaaggctttgttcctatgtttttgctttaaagcacaattaattctgacaaattaatcttttttctagcatatctaaatattttcatggtatatattttaaatagtacacattcatcttattttgatcctaaaatgactttcttgaacacaactgtcatactaaaaaatgaaatcctattcttagtcattatttccaatccatgttttcttcagaacataaatgtataataataatgggattaagaaaaatttgttacacggagatatttggtacaaaataaaatgcatggctaatatatgtgtatgtagaaataggataaataattataactttcgattaacatttccaagtttggcctcttcgacacatttattatttatttattttattttttgggacagggtctccctctgtcacccaggctggagtgcagtggtgtgaactcggctcactgcagcctcaacctcctgggctcaagcaattctcccatctcagtccccacaagtagctagaagtacaggtgtgtgccaccatgcctggctaattttttgttattttttggtagagacagggtcttgctgtgtttcccaggctggttttgaattcctgggctcaaacaatgctctttccttggcctcccaaaatgctggaattataggtgtgagttaccacacctggctgacatctagttttaaataacaattaagattcagtaaccattaagaatagctgaatttcaaaaaaaaacacacacaaaatgactgtacactcatatttgagtttctcatttttctacagaagaatattttatagatatctctcttatatttaaatattcaattacggatagtaagatatattcaaaaatagtgtatatcaaatacttcttgttcgaaagataaaattttgaactaaagcaatgaatacttttaagttcaccaatacattagtccccgatcatctgcagttttgctttccctggtttcaaatgcttgtggtcaattggaatcctaaaatcggtgagcacagtaaaataagatattttgagagggagaagaagagagataacttgttctattttattagttgttaatctcttactatgcctaatttataaattaaattttataggtatgtatgagtaggaaaaaatctagtgtatatagggttaggtatcatctatggtttcaggcatctattggaggtcttggtatgaacatatcttccaaagatacaagggaactactgtacctttttggaaattaataaggggtttcaatttacgtgttagaggcagttggtctttggttactgctaagtaaactttcaaaatagaaaagaagtaatgtcaaaaggcaaaagctacatttgaaaatgaaaaaaaaaattagaaaagtcaagggaaatcactcagctaatacaatcactgacaagtgttcattggttctgttaattcacagatgagctgtccctgggtcagctagctcacattcttctcctgaagtaagtcagtgctagaagagttgtttaggaaaaaaaaaaaatattacttaaataatagattataccattgatgttttcctggaaggccagtgtgaaaggtatttgttttttgtttgttgaatgttcttaatggatgaataaaaagaacatcaccaatttatgtagagcaaggggaaaacatcagccaaaaaaaaaaagtataaaaccaacaatattactaaaacctcaaggtttttacattttacaggagtacaatttgtaaaggctctctaaaaatgtctttgcttaagaccttatgtctgttatatgtactaagaatttgttgttcaagagatatattttaaacacactcatctgttgcatagcaaaaaagctatagatccaagctatgttctgatctccattttctaatcttagaatattatatgtatctgtgcttttcctacaagtatcactctggccatgttctgactttgtagccaaatgagttaggttgtaaaaggaaggaacaatggcgctcaaggagaagaagaagacgatgcggtaaaaacaaggaagccatatgtgaatattgttaccaattcagcattccagagagaataatggaaatgaagtgtaaatctatgcattacagaaatatctacagacaaaataagtgtgtgatacactcttttgggttaaagataattccttttttgtcaccagatgccaatgtctgcgaaaacataaataatttgaaacaaaattgtccaaatatctgatacatttgaagatgctttcacatcccatgatctaattttgggtatataaaatggttattattttaaattttaaagggtatgtatataagtttaaaaatctagattctagctatttctaaaaaaatgatcagatataagtgagggaataaaatagacattgtagttaccttcacggagataatagtttagtggtgaaaatggaaagtaaataggttaacacattatcacaacaatgtcttgtttgaagtcttgcttacactctgaatgtagcaataagaaccctttaaatgagagtgacaggagcaggaaaactactttctattgggtagtcagtagagtgttttctgaagaggcgaaattaaagctgatacccgagtagtaggaacttgacaatttgttgtgtcaaggaattctgccagaaaatgaagtggagaaaacatctgaggcaagagagggcttagcatgtttgaggagctcaaaggaagccaggagaaaaagagtgggaaaatgagtcagaaaggaatatggaagccacagtgatgatttagtcattatgtcaagtactttggaaagtcatctgacttttaagcataggagtggcatcatttcatttcatttaaaatggttgttttaagtttgctgcatattcctattagaagaagaataaatcaaaagggctgaagtggaagcaggtagggattgcaattgtccaggtagaaaaaaaaaacaggcaggaaaaaggggatatttgtggatattgtagttttctgaggaacctccatgctgttctctacagtgactgtaccatttatattcccactaacagtgtagtgtagttcctttttatctgcatccgtgccaacaattattttttgtctttttggcaatatacatcctagctggggtgaggtgatacctcattgtggttttggtttgcatttatttgatgattaccgatgtggaatttttttttcatatattaattggccatttttttcttcttttggaaataactgttcagattatttgcccatttttgaatcccatcacatccacatatgatatgatgttttatatcataaaatcgttatttttctttttatgatatctgagtttctagcttctgcacagcaaaggaaacagtaaacagaatgaaaagacaatccacagaatgggaaaaaatatttgcaaactactcatccaacagaggattagtatcctcattacatttttgatgaggactttcacacttacatctacccagaagtattattcctatcctaacatgacacattcctttattctttttaacagatcccattagatctggcagtacttgctgaaggagagtgtttgttgatagtctagaggaagaatgagggaagaatcaaagtgttttcagatatatttctgttatgagctacattgtaggtcattgtgattttaaagaaagagtgggtactaagagaagaacaaaatggaatagcttactagagtgactagcggttccatcttagccatatttatttcggagaaaaagacaatcagacatgtatctggaagtcaagtacacttttcaaactgggcatataaacgaggtacataaaaataaagataacatgtatataagatactgtttcttgcctattgagaagatttccccatgctcccatccctaaaatgcttggtcaaattggataattcgtaaactcttagagatggaagagaatctatttttgtttaaaccactttgttgaggtatgactgacataccaaaagctgtacatatttaatttatacaacttgattagtttggggataagcgtatacccatgagacttattaccacattcaagatgataaacttacctatcacctccaaaagtttccttctgccccttaatttatttattttttttgttttgtgataagagctcctaagatctatcctcttggaatatttttaacaatacagtatttttaactataggcccaatgttgtacagtagatctgcagagctaattcatcttgcataactgaagctttgtatcctttgggcatcattttgccattttcccctctctcagcctttggaaaccactattctactctctagttctgtgagtttgactattttagattctagggaatggaaggaaatattcacaaatcatatgtctggcaaatgattaatatccaaaatatataaggaacttctaaaattcaatagcaaaaataaaactgaaaaataacctgattaaaaatgagcacaggacttgaatagtcatttctctaaagaatacgtagaaatgaccaacaggtatatgaaaaggtgcatcactaatcatctgaaaaatgcagttaaaagccacaagaacctcttcatacctgttagggtggctattatcagaacaaaacaaagcaaaagatactaagtgttggcaagaatgtggagaaaagggaattcttttatggtgttggttggaatgtaaattggtgcagccatttgggagaacagtttggaggttcctcaaaaaattacaaatagaattcccatttgattcaccaatcccgcttctggatatatatccaaaggaaataaaatcaggatctcaaggaggtatctgcacccctatgtttacagcagcaatatttacaatagccaagacatggaaacaatctaaatgtatattgtcaaataaataaaacatggtatatgcatataacggaatattatgtagctttaaaaaagaaaattcttccatttgcagcagcatagatgaacttggaggatagtatgctaagtgaaataaaccagacacacgcggtcaaatactggagaatattttttttgtggatggaaaggcacagtgtgtaagaccagaagctctgagatcagatcgcctgggtttaagtctatccacatcataaactgcctgtgtgattctagaaaagttgtttaacctttttgtgcttgagtctcccaatctttaaaatgtgatgatattaatacataattcataagtatataataattaaatgaattcatcttttcaaggtgtatagagcctcatctaacctagattaatcactgtacatgtttgttagatagaaaacaaatagaaacctacatatatagaattataaaacatgtatactttctaagtaaataatatatggttatatattttaattattagtggctttaaatttatagtaaatagttatcaataaatgggatttagaggttacgtggatgtctttctgccagcttgcagatcattgtctttctctgggtcagtatactctttgggtgtagtgatccccagatctctttcgtcagatctctaacagtctgtttttccatctttctgcaaaaaactagcttcttgttttaccgagaaaatataagcaatcagaatagaagttgcagtactcccactgacctgcatataagctcacagactctactttccctttgtttacatagatgaactttctgtgcttttgtctaaggccagcttttccacttacgtacctggatccctttcccttgtctctgcacaaggacattgtaacagctaatgaacagccctctacctcctacatcttctccacgctacatcattcccatcattcccatcagtagagaattattctgtaatatctcctgtcatttaaaagaatcctcaattggacaacaatctctctagcaacctctccattcccgtttccctttacagacattcctttctctccatttcactccttcccttctctcttgatgccaattaagagagctaatcaaactgttatcctcactattctattaaagcagattttgtcagggtcatcagtgaattcgtattactaaatcgctaaattcagttggcttctgtgtcatcattctttcttaattatctcttagttttccctgaccactgtcaatatccttggtggttctattgccctgaccactaaatttgaaagtgttccagggctcagtctgtggactccttttttttttccccctattaccacccactctccgggtcaacttatcaagctccatagttttaaatgtaatctgtaagttgttcctgctgtaagttttttttttttttttttttaacaatctggaccctttctaatgatcctagacctgcatacccatttgcccactcaacacctccacatcaattaataataggcatattaaatctaacatgttaaaacaaaattcctgatgtataccccagtctactaccctagaaatttgcctgttattacaaatggcacctccatctttccacttattcaagccaaatcccacgagattttcttgtctcctatatttctcttacagccgaacatcaaatctatcaccaaatgctgtcgtttttgccttcaaaatttccaggatccaacaatatctcaccatacttgagcacgtgcacacacacacacacatacacacacacacacacacacacacacacacacacacacaaagtatgtatgtgaatgtatagtttttactagaagtcttggctgaattccattagtccctctaatatttttgtagcttcaccaactgccttaaaagattataacagagcagagtttctaagtagaaatttagcagcaggatttcttaatttataaaatagcaaaaatagcagcatgttttcttaagtttattataggttcattgactgcacaaaataacatttataccttttctagtacaattgcaagacatattgttctagatgtgttagggtgaaacatttatttacattgtagtagatcaagtactacatttacctaggtaagtaaagaacctaaaatgaagtattatctatattaggctcaaaatggttgtaaattataaggaaaatcaatgcgatagtgattctacacatatttactattgggcaaagtaccatgaacacttcattttactaaaactgtgcattatatattaatactatgaaaactctgttacttaaaatgtataatgttgtttcaaccagagagaagaataccatcttttgaatagagttactttttaaagtaaaagcactatgtataatgattgtaatactatagagtgccttgtaacaaggtgtatgattttcttttagatgttttaagttttgcatttttctggttaatgagtaatggagtccattgtagaaagttttagttttcaaaaatgcgtgaggctttaaatagcagatgttttctataaccacagacagactcttttgcaacttgcattttacacgtaaaactttatattgagccacttttcatttcagtaaagatgtatttgtgatgcacagtatcccatagtatatatatgtcataatttaatctctcatgaaagcacctttgggtttgttttcaagatgtttggtctttaaagctgaattaaatattgtacatgttagtctctacactttggttggcatgattcactctcaaaaaatggagcagttgactcagattcgtggacattaacatttttatatgttttgccatcttactatctaaaaggttgtattatgttggatatttccctcaacaagtataaaaactttgattttcccacatccctgcccaaaatgggctctttattaattattatttttccctgtcttaacatgtgaaaatgcattaattcacttcgatttgcaatcatttaactataaatggtattagaacatcttttatatacatgtattgccatatattatcttctttgtgaattgccaaactacgttttatgcacttttcgttttttctttttaatttatgagagtttctgtagatacatgattatgaagttcttagaatatttaaaatagtaaaacattatgaaagaacacaaagaataactatttctatgtatgccaataaaattacttttccaactgaaacatattattttaaaaagccttgtttttctccattcacagaaaagcattgtcacacaaacagctgaattatcatcatcgggcaatacgttcattttattaagtatgccaaataaacagacatgtcttattttcacacttatgggaaattgagtgtatctgatccccatgagttattttcttatgcatataagctttttacttctttatcattactatctaagctttctgttatttacatactgatgaaataatataataataatgtttcatcactgtcaataatcgtgttttgtttgtttgttttgtggaaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaaggtaaaaaaaaaaaaagaaaaactaagtaaaacaaaggaaataaatggaaaaagaaagaaatgcaacaatgcttgaagttgtatacagtctgctctttcctggttctaagagaagaggttgatttttaattaataattttaatttagcttcaagtttaatatacattttaacaaccttaaactgtttaattttaatgcattgtggtcaattatgaaaattgaaaatcacaatttgaaacaattttcccttgaaatcatgtagtattaagagagcagaatcaactcatttcattaactgtctgtagctgatgtaaatgtacgttgaaactgtgcaaaagtattcttgaaaagacaaatttataatgtagtcaacaaactgtgttaatttggtagtttgaaggcatttctgagaatttggaaacactaaatatttgaacccgtagcctttaatatggatagaaaggactgagtttacatgtacttttcttgaaacaataggacaaaatataacattgacttattacgaaggaaactggtatgtagtatgtagtatggatttggaggtgaagcctggacttgaacctacatagtggcatttcgtatggccttgggcaacaatataatagtcaatataatcctctgttttatcatgtttatatcatcatacttcctcacttgaatgtatgaactgttgattgtaactaccatgtgagtaaattgcctaactcagagttggtgctcaattagtagctataatcataattattatttttatgtgctagcaagaacttagagaatgacttgaaatattaatactgtagatctttttttggttcaaggattgtgacaaggaaaaatcaatgtggagccagatacttgagtttaaaacttagttcggccccatgccaactgtataaattggggtgagttacatgagcttactgagccaaattccttcgtttgtgaactgggtatcagaatgtctgctttcagaatcattagagggatgaaatatgaaatttctaacacaatgcctagcacagtataaatgaccatgactcattatttattattttaattgtgaaagggccacatggtaaaaaattatataattaaatggtaattcagaaatatctattatagttaatagcagaaagtaactcacatgaaaactcagatgtttaaatatcgaatctgtcatacggctttagtcaaatgttgaaagtaaatatctaatatactccataaatatgtataaatattatgtgtgtataaaactataatgaagaaaaaattagtataatcatttctagagtattaaaaacacagaattattctaatctagcaatagcatatttatcaactaaaacttattgcatacttactgtgtgccaaacaccctctggctactgaatatagagggtggtgagcaagaccactgccttggaatttacattctagtgttctagcgtgtggtgaggagcaggcaataaatggaaaaataaatgaaatcatgataatttgcctagaagtaaacatggattttgaaatcaagaatgaataatgttcaggcaggatttgagggtggtaggatgctattttagaaaaacttgacttatagagcatttatgaagaattgtatgtaatatgagagaactgaatcataaggaaaagccaaccacttaaaaaaatctttatggaaacacattctattcagagagcatagcttctgcaaagaccctgaagctaattgggaagagaaagaaatctgcctgaaggaaggaaaatgggataaaattacctcagataagtcttaggaggtgggcaaatatctgttaacaaacgggttttgttagagtatcacagtttttattctaaatggacaagaaaaaccattggagtatttcaaaagaccaaaataatttaaaatttgactttggggaggtcacccctgaggaaaactttatcagaatgtgagagctagaaggtactttgaaacttgtgtaattcacacttctctctctgcttatcagaaaactgcaattcccagataggtcaaatgatttagccatagtcacagactttatttgtggtagagcccacaggattgaaggtattttattctatttcatctcttttttcctttcctttcctttcctttcctttcctttcctttcctttcctttcctttcctttcctttcctttcctttcctttcctttccctttccctttccctttccctttccctttccctttcctttcccttccctttccctttccctttccctttccctttccctttccctttccctttccctttccctttcactttcactttcactttcactttcactttccctttccttttcctttcctttcttttccattgtgtgtcactcatatggccttttctcttgtatctcaattcctttctcactgcgtctatttatatatggccactacctcagatccgtaagtagatactatagagtcatttgtgttcagctgctctgattatccctgggttcctttggttcagtgcctcttctggccctcttccctctccctatgagcgatttgcctatgtcaccaacaacccagtcagatctctcttattttcctgtgctctagagtaaactgtctcaaatttttaaaatttgaaaaccatccttgaaatgagtgttccaacaaatttgtctacattgattgacatgttttgataattggtctagctacaaaattggtttagtatgggggtgatagtaaaaagaggtaaactctggaagcctctggcaacaaccactggaagagttggcaggaagatttcatttcttgagttttcagcctgctactcaagacagtttctttaaggcaacttcactacctggaggttagcaatagtaccttgtccagacttctacctgtgctcatttgatagctaatttttctttattgtcagaagatactaacagacctattttgacatctctccctgatactcaaagaagaaatagagacccccccttctgtttatgttctttcctgtgttttacctgaaaatggaagtgctgttttaataacttatttttcccctgaaaaggaaagtttttttgacataaaagaacccagggtacagtttgataaacaacctctgactttaaaacttttatggagatcagcaatcactatatggtaaaactttatactaaaaccctttgaaaaacactctggaaagttattaactggttttatttttttttaatttttactctattataactctagtactagtgcttaccagaacttacacataaagtgagaatagtaaatacacaaataaatttgtataatcactacagcagtgattcctgcatctgaatggacatcagaatcacctggaagtcttgtttaatacacagagtgctgggccctgaccccagaatttctgattcagtgagtcttgggtgaggcctgtagtttttcatttttaacaagtttgagtttgataccaaagaacaagttgcagagtgattccaagggtgctcactttaagaagcacgggtgtgaaatcctagcaatgaaagatggcagagcatatcatagttagattcatggaaagaaacaagagccaccgtttttatgaggatttgtatagaaactgtaccagtcatttagctttctaccttttctcctagtagagaaattcatcatcatcttctttcctcatatgtacctggattaataaattttgctgtttgttcttcgaacctttcccaagatctgagcctcttattaaaccaagaatatatgaagtctaaaaaccatggaaagaagtgttcttcattctacatttttatatagttgcttgggttatttataatgagcataaattgtaattttattcattagactgactacagcatgctccttcttcagctcatggaacatttgagacccgcttaacagaaactatgagaaagagaggatataactctgaggatgatttccttaaactctctgaacctcagttttctaatgtccaatatagaggtaacaaaacacatccgagaaggtttgggtaaagatctaatgaggtagcacttatgacatggctggcacagaacacagtagcacatattaaatgatgaatggtaatcaaacttgttgattatactataattactaaagtcaaaatgcaatttgtgtaaaaacaatctctatgctcagtgatgccaaaaagctgatttatttagaatattgaactaaagatttcaatcaattaaaatcggtgaagttaagcattctatagacaaaacaatttgcattttctgacataatgcatacttttaaggaattgtgggactaaatccaaaggagtagggtgattatgctgacacatacaaaggcattttatagctgaccttatccatatcctgccaataagcccttaccttaaccaccgcattgtatgcaggcccaacttctacattatagaacctgagttcctttacttgagggctttctgtggccactgaatcccacttttgcacttgtgtggtaggcttgcaagtactgggaaattaacatttccccaacagcctttaacaattagggaagatgatacagaaataataccccaatttcttcacccctgaatgggataacccgcaggcatatatttctcagggctttctaacaggattaaactctagtcattaacagtgtttgctgggattaataagtatgcccatatggatgtctcttccctttcttgtctcaattccccattcagctaccagaatttcttttacatggcacacataaataaactacttatatttgaaagctaatgtcaggtttgacccctggaggaacacagactaaagatacagtgtgtatgtgtgtgtgtttctaaaatacatgtacgcatttgaagttaaggagtgtaaatgtctcccaaccgaagaccaccaccaactctcttgtagctgaacaagttgggttcattattttttgcaatgagggagaatacacaacatggaggccagggggtgcgtgtggatgaaaaaaaaaaaaaacattgtaggatttgtgcttgtgttaggggatttgagggagggtttaaaagctttactttggattgcttgtcattagtgtgtagggatagctatatgggtatcgtatcttgtccagaaggagagaagaccagaatgaggctaaagttgcaattaataaagaaacggcgttcgttcatattaaccaggataggagagtgttgggcgttttgtggtttgggtaatgttgatgtttttgtctggattcagacatgattatggaatgatcttgtcatggtcttgatccattatggaaacaaagtggccttttccaatgttgaaattctgtgaaacagtttattttccacttgagaagaccaaggcatagctgggtgtcaggccagcttctgatatcagcagctccttttttggtttctctttctctcatgtgttttcaattctcgaacgaaactttcttttatcaaaatatgttcctaaatatagcatcaaggggacctttctatgttaagtatcctttaacttaaataatgatatttgtgatggtttcaatattattcatccaagtaatttataagtgatttcaattctagactgccaaatattttttaacctagttaatattgaaatatttgtttcttgccttttccaaacaattgtatttatatcaatgtgtatatatttgaccacaaatccatacctccatgcagactacttttcagtctattcttgttacagatctgttgtattcttataataaattatttctttaactttccaatttcaactaaacttaaatttatggaagagactggagttcatattagatttatttttgtaattctcattctaactgggatgttgtgagaaagaaattatatgattcatagaaatgcattttggatgtaaagttattttcatgctattaagagagcattctttatttttcagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagtcagttgcttttcttggtctttgtcaatgatatgtcaatacatggtcatatgtgaggcatagtggttaagaacatggataccagtgcaaaacaactttggcttgaattcctcattcaggcacttataagttgtatgactttgggccatttgcttaacttgtgtaaacctgttttcaatctgtcaactagacataatacataattcataagttgttgagaaaattaaatgagctattctctttaaactacttagcctagtactcaatatatgtgagtagctatgcttctaattctcattactattattaggtcataaaatcctataaattttctccagatttatagacaatgatctttattttttcttatttttgtatgtacataaacttatttaagtatctttggggaaaagcattctgtagagaagtatgtttttactacaattgtctttagtaattgccgtgccccatagagttctttgttagacatgttacctaaccagctctatattttttgatggtttgcattatatttatgtattatcacaacttctgctttaacttttatggatgggccttactgtctagattatgcttatctgaatttagataaagaaagcaggtgcctcaaatgatggccatgtaattgcatcaaaaataagctatgacctttcttatgaaaatactgtgccaaggggcacaaaactttatccactacaaatgctgatgctgccagacattgcacatgagttggactttaagcccccttccctcacacagactgagttattttggtgaatatggttaataaagtgttcaggtacctctttacttttgaaaaacattatttagtttgcttcctatgttgagggtttgatatttaaagaaagatacgattcagatcaataataaagtacacctttaaaaatattttaaaatgtatttgtagctaaagtaccccatatattcccaatacagtattatcattttccaattgtaaaatgtgatccgagtttctccattatcagttctaagctcttctttactcatccttattcttttcttttaaatgcaattcactcctcagactcttgaaaagtgccttctatatgtcaggaaatattacagtttctgaggatataatgacgtatcttatgtatcagtgttatgtgagtgctatataaaatataacaaagaatgggaagggaagggatctgatggcactgtacatgtctcaagaaaaccacaattaattcactaacatgttacaatagggagggactttttgtacccaggaaatgctttctgacaatgtttaaataaaacacctactattactttcttatgttcttaatgtccttaaataagcatcattgttccctattattcatgttgttcatttaaatgatactccgtgattcattagaaatttatattggagtacattttccgaagggattttcttaagttttcgtattaataacaaacttttcaagaccaattattggattatttttccatttccttctcatgtataataacatttctaacattccctattcatattgaagttatcaaattattgagttccattttagtcctttttcactggtttggaatatgtactttattttatcttataaatatttctctatacctctctaacaataatatggtggaaacattagcatagtttaactctgaacctacctcttccgttttccgcgttattgttgcctcatatttcattttcaccttatttcccccaaattagtccatataattgctgttgctgctgctgttgttttaactatttcatataatatttatttagatttaccgatgctattttcccagtttttgtgatcagttttgccttttgttcttccctttgcttctgtgttcagtttctttcttgctctttccttgagtgtgagtagcaaatgtgttcagattttacatattgaaaatgcctttattttgccctgagtattggataatgatgcagttgagcaggaaattatgtaaggacaggtttttttttttcctacaacactgaaaatattatttgtcttttgaaattttttgcctttaggaaatctgctgtcaagttattgtttctttatcattttctctggtacctttaaattttctcttcgtcctgtctgctctgcagtttcaccctattttgtcttctacagtttcactcaactttgtctgtgtgtaaatttgctttcatttatactttgtcacctggtgtgttaattagaacagatacgttatttctttagtggttctgcattgtctttgtgaagattttctttttcccaatctcttcattccttcctaagggaaaactttcttagagctattaagactatccccttcttatattccagttactggtttccctttaatattttctatattcttatctctatctgctcaattttggatacttttctaaaatctgtcttccaactctcaaattctcgcttcagctgcctgtggcgtaatttatccttcaatagagaaatagtctcatctttgtctgtatatatatttatctctctacatttatgtatgtgtgtttatattttttcaaaaaacatattttccatttctcaatattttattgagttgtttcacaaatctgttctttgttatggttttcttcttttttgtgattaattctatgtattcctttaaacaacttaaacagataccatctgtttgactgaaatgtttcaacttaatgagtaataaacatgacaccgtcttatttttccaataactacacccaactctgtcaaatttcaccttctgcctggtagttggcttctttaacaatatttctctgggatctcattactttttattcacttttagttattaaaatgtactctaatttaaatttaaatatcataacttaatcaaatatttcacaagtttagattaatctgttgcttcagcaatttatacagacgcaggagtgagaataaatggtctcacagtctcctcctccatcccagtttctggatacagatctactgtcgatataagggagggtgaagagggaaaaatactctcttcatgtgaaagtcctttttttgctgctcacaactgctgttcccttttgttaaaacccacacacatctataatgcctagtctgttgtccctcttctatatattatcaccactgacctggctcgttctctatagacttgattcgctctgttgaggatccagattggccttattcatatgagctttgaaccccccaaaaaagatctcctaggcttttatagtacctcgtagtgtttaacaagaatttcaagctgacgcttgtcaacagctttacacaaactgctcttgaatattatgtctttttaaccaatgctttagtgatgccctggagtctaatttacctaccatatctcaactcagagcctatgggcactggaagtacctatactccgtacctttcaggaatgagaagtttgaaagagttgtttttgattccttcttggccataccaacagctcaacaggaaatgaataccaaccaccccttcctgaatatatccacccagtagatgagtggttttgttttagatcctgtaaataaaatgattcagatgagtttaccctacctatccccataaaagggtgagaaagaagaattgcctaactattcaaactctcttcacctcactcccctcaagtctccgtcagctctctctgtttaaaccagggcttgtgaaaacaagaaagagatgatctcccaaaatgaaatgtaggcaaccaagccctttttcttaggtgtgaattccacttgccagtctcaagcaaataaactctatgggaaacatacaccatgaggctaggcatatttattgtacagttctccaaaattgttctattatctttatgtcataaggtatggattctaccatttgttacaactaatgactccctctaatggaagtgaatttccccatgtggctagtaaggtttttgtttgtttatttgtttatttgcgagctcatctataataggaattgcctttactggaatttttgtctttttttttctctgggctattgagtttttgtattgttgccatcaggattgtagagattttatgctctgccctcatgtgtgatacaagcttaagtttccgtttgttatgggtggatctttatttttcagcccaaaatcccccaacaatagtttccttgctaaatcataatattccaatggctagggatgttctacttcttccttacagggtggatggcacactgcttcattctttcccatttccctggcttgcctcatttcccatctcaagttagtgttaaatgccccagctttgatgtcgtataccctgttctgatacgccagtatttttataagcttgattttccactttctactttcatttccctctttttctttctcacacctgaggttctatatacatgttttacagatcagctatgaattaaaaatgtttcctttgtattttaacatgtattttggtataactgaagcaggatatgttgggagttacctcatcagctccatctactattttgaacagaagtttagttttttatttgtactttccttcaaagccactttggattctgtgatttcaaagtaattttaagatccaaactgttaagcttaacagttattctaagtggcttttagctccaattcgggcttcaagactatattttattttgcaaaggtgacctgtaaagctggtacattcagcctctccagctgtgtccttcagatgcattgaggacagaagaagctatccattctgacagttaaatcagcaaggtagttcattacctcaatctgcaccaaagttaataagacacattaccaatcacgtctccttgtcttcaaagctctaaggtaccctcgggtatttaagaagatatttatattttcccactgggatctttgcccagaatgaagacagcctgtagtccagcaggagctggaaatgacccagattttagatttctatcaccttttaaagcaaaacacttaatttcactttttgcaataaactgtacataagatatcaagcaggtatgaaaggttggtacgtttgccaagcaggtgagactgatacttttcatcagatagagatcgaatactctgtgtcattctaagggctatgaacatagagaactttgggaaatctgattaattttttagatccttctgaaataaatcttcctttcaagcctttaattttggtggtagtgaggcgggggcaggtggtagtaagtggtgatgattgctgcattgtgtttactgtacttataggttcattcaacagttacaaagctaacagaaaatgaccgttgttacattcttatcctctctcgcatcttcctatcttttccccaatagacataatcaccatctagaaagctacctttgttattcctttgtttaaaaaaaatccacacacatatgagtgaaaaaacaattgtgcttaatttcagtattacagtaatggtaaactataatatagtttttttagggctttgtctttcacccaacatatttgtgtctgagattcattcttatggttctttttgatgagatttttcattgtcacgtctgtattctctgtttaaagatgacggtatatttttccattctccttgcagtggacattatttccttttttttgattactacaaaaagggctgaaatgatcattgttgtaacagtcttgttatccatgttaaacagtttctctgaggatgcacatatcaaaaagtggagttgttgtcttgatgggtatgtgaatgttcaccttattgagaataacaaattgttttctgaaatggccatttcagtacacacacccaccaacaataaatacaaatttttgttcatgtatatcttctctcacacgtggaattgtcaaacttctcatttgtgtcaatcaacatggtatctcattgtaatcctggcctacatgtccttgattactaatgagattgaacatatcttcatgtttaatgtatatacatatttctctttaagattttggttcaggttttcttttcattatcgattgggttattcatcttctatttgacttgctggcatttttcatattcttatgtgttacagatgttgcagttgttttcttctattttgagtctgtttttcaattacttgatggtgtcctttgatgaatagaaggtcctaattttaatgtagtcgaatgtattcatctcttttttcttacggtcagttttttacgagatgtcttacttaagatattcttctctatgccaaagtcagaaatattttcttctatattttcttgtagaaattttaaagttctgcttttttatgagtacttctgtgtataaatcagtttcataatacaaattaatggccatttaaaataatcaaacctttgaattagtggtaatatttccgataatatacctcaaggaaataataagaatgtggaaaaatagtccatattcacgatgatgtttaccataaatttataatagcaaacaaaactaaaagtagtctatctaaaaaaaggaaattgctaaactaagatagagccactttaaagaagtcttagattttcattaaaaatatgtcttcttagtaatacagaaaatggtatgatataatgtttagtgaaaagagagctatagttaaactcacttaaattttaactatcaaattatatatgataaatttcagaggaggtcacagaatactggtaacagtgatgtgtgagggagttagatttacatatgcatttttacatatgcttttatttttctgtttcccagactgcaatgttggtgcttatttttattttaaaaagtaaattactgtcttttgaatttattcattattcatgtaataaaatgttttcttaatgacttttgattgtagaggtattagatgatgaaactgtctagctgcattttgaattacctgctacaaagtaaaggtgaaaaatacaaagtgttatattttcagaagttttaataatgaaatggcaaaatttcacatttacttttctaccataatatttaatctgtgatatatatttctttcttaggaagtttgggcatgttggcatgagttattgtcatacttggagaaagcaaacaagtggctaaatgaagtagaatttaaacttaaaaccactgaaaacattcctggcggagctgaggaaatctctgaggtgctagatgtaagttgtaaattaagccaaatgatgataatttatatgcagtattaaaagaggtcaagtaccaaatagaagacaaatccaaagaaaacaacccaagagagtataattactatgttatcactcagcactggtactttggataaagcctttgttccccctaataaccttctaggtcacaagattttgcaaagggtttaaatggcttctcacagaggaaatttgcctttattatatcactaagttctacatagatgcttcacctaattaaatgtaccacaaacctgcaaagacagtgtgaataaacaaactcactgctttagggctaatcgggatgataatatgaaatattatttccagtttaaaagctgcacgtattgaattggaacctattttatacttacttaaaatcacaaatttacaccttacggaatgttttgagttattaaatggatatgctttaatattggaaatatatctttaaagtattcataaaatgtaagtacatttttaagttttactttggagactttcaataattaaatgagtttgcatttataaacttgactttaacttctgacatttaatcattcaagctctatgcattttagtgtacttttgacttatctatatgtaatgaatatgttgttttagaatatgtaatatatgtacgtaaagctataagtagtatagcccctctgtaaatctataaaataaggagcataaattattcaagatgtgaagaaaatgtaaggtatttctttagacagaatagaatttgtaatcctagaacatcagagtagacacctatagatcattttatccaacttcctaattttcaaaaggaaattataaaacctgaaaagatattaaagtacaatgaagtagatctccagtggactttaattttggctctatctgactatgactataaatttgtcgtattcagagaagttaattgaccaaacatttcttgtgaatcagcaatgtgttacatgttctagaaaagttgcagcaaatttacagcacattaataaaaggacagtggccagaacagaagataggatgatgctgttagcctatgaaattgtcaaatcgtacatggagcaccatgctaaattcttgctctcacagtttcagtgatgtgctgaaaaactagggcatgttcacaaaggaatgttaaggaaagagagaaaatttgaagccataatgaagagcatttagaaaagatggggaaacaaaacttaccattactatttactattttagacgaggccctcacaatgcccacaacacagacaagcagggaggaggaaaattgcgagtgctcttatcttttatttctatgttgtggtcataatttcaaattgttcctaattcagataatggagccaataaatgaaattccacagtgaaaaaataaataaatacatacataaaattggctctttggtagtgttgctgatgcttatccaggaggacattttgagtgaaaagggctagatcaccacgtatcaaggatagaaaaactgcacgacttctaggttttcttgcaactcaagatatttataactgatcccttaattttgctttgttgcttttcatccacctttaaaaaaatttaacaaggtatatactttgttaagacttataaaataatgtatccattaaaattatttatatccattttgcaaataaatatttacaaaattaagatttgttagaagtaataaggaatataaattattaggaaaattattaacaatcacattgttctactcaaaaatttgatggcttttaaagtattttacaggttatagtgattttttttaatataaatgtatttaggaagtctctttattttcttgaaacttaataggacaatgtattgagtttgctcaaaattcaagaaaaatacataaacaggaaaaattacaaatatgtattggaagattttcatttttttaaaacaaggaaaacagaagatttaataaatttgtgagaacatatgcccatcacttattttatagatatgtttgaggtccagtaagatgaaattgaatcccttgttttctggcatgcctatgacactgagattcactttcatcatattatctagccaggcaactttgtcaattttgagcagtataggagatgggtattattgggatgtacgtaacagagaatcagacaacggtttaagctcacaaaatgatcttttctcaccacgaaaagaatagtgaagggaggttactcagggttgaggatggttcagccatattatgaggcgagtaggcactctctgctctctcttcctgagcatgaaggacctcacactcaaagtcattgcctcccagtgcaaagatgattgttatacctccaggccatgtatgtgcaaaaaagtaggaagggcaaaaggattcttcttgagagagtactctttttcagaattgtgtcacgtggacaccactagctatcagagaagttgagaaatttagtgttttacctcttctggttttagagttaggggacgtcaaggaaaaaggtggttgtgaatcaagttttaagttctcagtccgcaacactgtcataatcccatgaagattcatatagaatgacatcctattttttgaagcaaaaatgctccttggtgtttttaatcccaattaaaatttgctttaaattgattatgacttaattatatgtaaatcagaagatactgagcatttgctgataatccaatgtatttagaaaaaaaaggagaaatagtaattattgcaaatgtgtttcagtcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggtatgaagataagtgaaaaatctctttaatctaatttgcattaatgtatagcagatacaggcctctcagataaaatgagcaatagtttaaatattagctcagctttcaggtttcagagacaatccaatgccagacactgggtaaattctttacatgtgtattatagcatgtgatttcacaaaaacattgtaagttaggattcttaaaaggcaactgagacatcccaagaaggttactctgaccacagagttcttttccttactcaagatagaccagtatgtgtgggtatcctttctctctcgctgtctcattttattcctctccctccattccacacacatttgttatgtcacatgtaatctgctaataatacatgcaattctgttagtaccccatattatttattcttcataaataacactacatttcttatagataaattttcatatatcacacatggtgtgatttttcaaatcaaaactaaaacaaaatagcaaatttctcctagtcagtgttttgcatactatctcctaagaatggattatttgtcaagaagaaaacccattttataatgatgtttagttttatattcacttactgagtacatctactacatgtgagatatggttctatggtttgatgagtaggaaaaatttgctaaccttcataacttaaaaacattggttagttaaggaagagttactgatttcctagaatgtgcaagacataaaaacaaataatataacgtatgaagagaaaaaagagaataagggggggtagtaactagggtagtatgcatgaaaccattgactaatgacttattgaatagtcaatgtcggggaccttttgacatgcttacagattgaaaaggaacgccttgagtaggaaaacctcttctctatccaattctgaagagaagtatgtgagggtagggcagatatctgcaaatgtaccagcagcacctccagtcttgaatcctgggtggcatatccatattttatccaaatcaacataaggaattggggattggaaaaggggaattccaaacaatctctggtccttcatcattgttgcactattgctggatctgagtcaaatagatattgctatgtggcaagtaaattgaagatcatttcaatgtgggttgtgatatggaattggaatgtgtttttatttctatttgaatatcagtgtcaggtaggagacagcagttgcatcaaaaaattaaaagtcattgtgaaactgaccttggcttagctgtgaaaagactcaaatttttttttttttaaagacagggtcttgctctgtccctgagactggagtgcagtggcatgatcgtggctcactgtagcctcgacctccctgggctcaggtgatcttcccacctcagcctcctgagtagctgggactacaggtgcatgctgccactcccggttatttgtgtgtgtgtgtgtggaaatgttgttttgccatgttgtccaggctggtcttgaactcccgggctcaagctatccacttgccttggcctcccaaagtgctgggagatacacctggccaagatccaacttcagtgtttgacatttttcagtactcatctattctgtccttaggaatagcttactctctaacttgatcttggtattaactctattaatgtaattatattgcaatcctttattaacacaaaactacttataaccttctattttaaaggtttttggtataaaccctgacatttcccccaaagaaaaaataattcatttcagcaacataccctgattcaacacgtattatcttattttctggactgagtttttaaagcataaacttttgaataagaaaatacttgaaacttgggctagaataacaccttgtattagtagtcagggtccagacagggcacagaaaccactcagtcacttaaacagagatggtttaacacaaataagtattaactacttactggaaattaatttttaataggaaataaaagagatctctaaagaataccttaagcctgaggaatagtacacaaacaaggaactaatatggaaagataggagctcaacccaaggctggattcaaacttctttagaaagtgtgtgtctgcctcccatgggatgacagagaagtttccttcattgacccaatccagaacaagtctatagccagtgagctgaagctagtgtgaagagaatattggaggggaatgctgacaaaattcacagggaagtagcctatggtggggaaccattgaatttgctagaaagctgtctggtgtattcattggacatggtgggaaactacctgtagtggatgctactaaacttgaggaaatgaggtggggctccaggaagctgcctatggatttgccacccatcctcaatttgcttattgggtacccatagaacttgtcaaacacgacccatagtgttgctgaaagtcttctgggtaaagtggggtggatgaggtgagccttactgggcattccataggccagcccagagtcacaggtttgaaaaagaattaaaagcacactgggacagacaaacctctacctcccccattgtcactccagcatcctttactgacagaacttaatatcatgtcagctggcaaggggagaaatgttcccgtgtcaaaaacaggatcatgttgaaaggcaaaaaattgataactggcaaatccctctgtaattcactggctatgtgattttgagtaacagttttaaacttacgtttcctcatcctgtttcatagggggttttttttgtgagcaaaatataaaatacggcacttaaagtactatggttccaggaacacagtacatattcaataaattattcaataaatttaatacatgatcagcctttttattttgactagatgatattctagagtatcagccctcaaaaattgtgtgtgtgtgtttgtatgggtgtaaatatatatatatatatatatatgtaagtatatattaaaatatgtaaatatatatttaaaaatatgtaaatatacatatatatatatcccactgagggcagtgattggtaaataaatgcagatagtgcaatatgaaatataatgaaatgcacatgcctccattagttaaataaaatgtgaagacagataaaaaggatttttatcaccctctaagtcttaaaatcagaagctctccacttgtacctcaatgattaagcagagtgttaaaataacaataaatctaaaataagtaaacttgaaactattatcagtcctagctgtgtttatattacatatttggccagtaataacctgggagttatttgacaatgaaaataaagcatatttagtttttacggctttcatgaaaaccacatcatgttaaacataatatccttctcaaattctgttgtatcagcctgtgataagctgattagacctgaaagatacaatgttaaattaaaacaatgtgtagtaataggacttttgtatttctcaggctttgctcagcactttgatcaatttcaaactacttaggtaaaaaagacacacctaataatttattagctaaatcaatcctttggatatttccactatctagttaaaaagactgttgtttcgatgcagtagaataagccttgggataaattatctgagaggctgaagaaacaaaatgattacagtaactgagtttttaaatcaatttaaaaaattcttgttgtacattaatgtgttataatcaagaattctgaatttgttttaggccatgattctcttgatttttggttggttaaacaaaaaagtttttattttgtggttattttctatttttattttattttatttttttgagacagagtctctccctgaagcccaggctggagtgcaatggcacgatcttggctcactgcaacctctgcctcctgggttcaagcaattctcctgcctcagccagatttgctattaataaacaaagtgccttttaatttgaagatgagccttaacctattttttaaaatcaattaagtgcctatgtcagaggtttgtgaggtttttatatcacctacctaatgtttcttatagctgcaattatgcagaactaaggtaacattcaattgcctgttaaatcagtcaaacagccagacttttattgcctatgaatatttaaaagagatttgctagatcccatccctaatttcagagtgtgagtttgcattcaaataagtaataaattatttccatcacttcaaaaggcatctttcattcttgataatcatatagcactatattttctactcacagtaatgatttgaaagatggttagcaaaccaggcaacatctccaacagacgtaccaaatcatatcatttttacaactattgtaatagctttattctctaacagggtaaccaagcagcagaagatgatttagtaatacaacaaaatgaataataatattggtaatagtatttggttacagaggctcaggtacccttttaattgtcagatatgcattttctcatttagttctcacaatagccttatgatacatggtggtttttgtttttgttttttctttttttgagatggagtctttccctgttgcccaggctagagtacaagggtgcaatctcagctcactgcaacctcctcctcccgggttcaagcgattatcttgcctcagcctcccgagtagctgggattactggcacatgccactacgccaggctaatttttgtatttttagtagagatggagcttcaccatgttggccaggctggcctcaaacacctgacctcaggttatccgcccgcctcggcctcccaaagtgcttgaattacaggcgtgagccaccgcatccggccgatatatggtttttcatattcccattctacagaaattgaaaggatattaaaggccctaggaaaaagctattgagcatttagacccatctctttacacttgaagcctaggcacgtgaccatttggctacactacctccaatctctgtgacccttttcatatattaaaaataaaaactctgctaataagtgaatatggcaattaacgagtttccccgtttttaaggaaagcttaaaacatggccttaaaagtattatggctgactaattaaaataaaatttagagtcttaaatattaaagtcacacattgagaagtccaaagcctttaccacttctcttgatgagtgattatttcacctctttcgtggcttattaatgcccgtatttcagtccctttcaaagatgtctgtaagttgttatgcctgacatgaaatagcaaatttactgaaagggacaaaatctaaattggttaattcttctgtaatagtaacatttatgatagactcagagagggccgtattaatttttcctggtaattatgactttgaatttttccctcagtgtcacatctaccttagcatagatagaccagaacggaagaacattgcttgaaggaagactataaagtaatctaggaaaataagtggcatattatgctttattaatttgtcaatatgttttgtagacaatatctgtctataataatagtaaaagccattactttttgagcacagttttacgtcagtccttttgctaagccgttagaagcaacatcaaacttaaatcccacatttgctttatgaaatagatttgattagcttacttcacagttgttgtgatagggctgacttctgttctcaagggctaggacagctaagtcttctgtaatgccctctggaaagcactaggatgctggaaaatgtctagtagttgtattttatgttgctttcaaagaagtataagtaaacctttaaaggctaggaaaaaaatcagatgaaactgaagtcatgccgtaacatgcctatgaccactgacatttgtatggtggagataaaagctaagactgggaaccccaattttaggtgaattaagtcatttgatggaaaagaaatatgatcctctggctcacgaaaatggtggagctaaacacagattccacataaaactggggttctatcagtaagataatgggcagagagaattctatctgcagagagaacaaacataaaaagacatctgtcttctcactgtgagtgcaaagtaatagaataattataataatgtcacctgaaaatgtgtgttggcctattcttgtaaggtgaggaactcttgagtgtatattatcacaaagggtaaagaaatatccaaacaagtgattaagtcagggtagcaccaggttaggagcgtcctagcattagttagaagcaaatgcaaattgtttaccatgaaaagtgccctcagtgtcctcacagattaaactcaggggaacttgagctcatcataaacacatagacatacacacactcactcacacgcacaagaaaagccctcatgaagcacagtcagcctatacaacgaacggtgagtttacttctagaattccggatattagaattgcaagatgtatagtataaaataaataggtaaaatattatagaaataaatgttattgaagttataaaaaagaaaacattgtaaaaatggaataaagaaatcaaaattaaacaactacaattaaaaattagaaaatgaatatatcatatataaacatattagttgaaagaaatgatttaaaagaaaactaaaagagaatgtacagactgtgttaccaaaaactaaggaggtggaagatgtgaacaataggtaatagatacaggggtggggagtagaatatgaacatataacttatctcaatgggagttttcaaagaggagaataaagaaaatggagattattattattcaatataaaaaaattatataacccaatttaaaaatgagcagttgagctcaaaaggcatttcttcaatgaagacctacatatggccaacatatatatgaaaaggtgctcaaactcattaatcatcagggctatgtaaatcaaaaccacaatgatatatgtcttcacatctgttagaatggcagttacttaaaaagaaaatcaagagatgacaagtttggcaagaatgtggagaaaagggccccttgtaccctgatggcaggaatgttaattcatgctgacactatggaaaacagtatggagattcctcaaaaaaaaaattaaaaatagaattactatatgatccagcaattccacttctagggatatatccaaaggaaattgaatgagaatcacaaggagattatctgcactctattgtttattgcagcattatttacaatagcaaagatatagagacaacctaaatgtccattgacaggtgaaaggaaaaagaaaatgtgatatatacatacaatgaaatattattcagcccttaaaaaataagcaaatcctaccatttcgctgtaacaacatggataaacctggaggacattatgctacatgaagtaagccagacatagaaagacaaataatacatgatcccaatcatattatgaatctaatacagtcaaactaatggaaggagaatgtggaatgcttcctgccaggggctaggggaagggaaaaatggagagatatttgtaaaagggtacaatgtttaggttatacaatatagataattcctagagatctactgtaaagcatattgcctatagttagtctatttacttaaactttgctaagaggatagaccttatgttaagtgttctgttacagaataataataatattagaataggaggaaagttttggagatgatgaataggtttatgtcatagattgaggtaatgtttttatcagtgtatatttatctccaaactcagcaacttgtgtatgttaattatatacagctttcttgtatgtcataatttttttgagaaatggagatggagtaatatatgaaggatattaaaggaaagtttccaagagccagtgacataaaccacttaaacagaaagcacattatataacaggcaaagtaaataaatagaaatccaatctcagacatatcacagtgaaagtgcagaaatccaaagacaaatttatattagcagctagaggtgagatggataacctacaaagcaattaaatttaggctgtcattagacttcttatctacaacaatgaataagaataaaaaagcaatggaaaatattttcaagatattgaaaaaattaccgtcaacctagaattctgaactcaacaaaattagttcttcagagtaagaggaaattagacattatcagagtgaaaaaaaagtgaaattttaccccaatagacccttactataaaaatgtctaaaataagtatgaagaattagaagtagtagaaaaataagttttaaaggttttagatgcaataagtatgatgaaaaaatagttaagcttttaaatacaaaaggcatttgttgcaaaaaatatataagaatatctaatttcatttaaaataatgttgatctaaaatactagattaaaaacaatatggaggggagttacagccacaagcccttttatttagaaagagggtagagatagtgattaaatgtcgactttatgctgtaataaattgtcaaggataaccactaatggagcatccacctgggaaacaatcaaagaatgataaaaggaacagttctcaatcagtacgcagtaaagcaagaaagaaggaaaacaaaacagaaaaatgtgagatgagcataaaataaaagaaaagatggtagaaaaatagaaatagaaaaaaatagatggtagaaaaataccagcggccgggcgtggtagctcatgccttaatcccagcactttgggaggccaaggcaggcagaccaggctgccaacaaggtgatacctggtctctaccacaaatacaaaaaaaaaaaaaaaaaaaaaaaacccaaaaaaaagtatccaggcttggtggtgggtgcctataatcccaactactcgggaggctgagacaggagaatcacttgaacccagggaacggaagttgcagtgagctgagatcatgccatttcactccagactgggtgaaagagcaaaactctgcctcaaaaaaaaaaaaaaaaaaggaaagaaaagaaaaagaaaaaaaaaatacatctgtagtcctagaactatttgctcaatacatttaatatataaatgtagaaattttcagaataaagcatcaaaattcaaaatacattgtttttaagaaatacataaagacacatatatcgaaaatggaaacagattttccgaaaaggattaatcaataaaaagcttagacacctaatttatttccagcaaaatagacattatggtcattatcattattaggcaaaaaatggagtaaaatataacagttctaaaacttgtacatacctggccgggcatggtggctcacgcctctaatcccagcactttgagaggccgaggtgggtggctcacctgaggtcaggagttcgagaccaatctgggcagcatggtgaaaccccgtctctgctaaaaatacaaaaattaaccagctgtggtggtgcacgcctgtagtcccagctgcttgggaggctgaggtgggagaattgcttgaatctgggaggcagaggttgcagtgagctgagattgcagtctccactccagcctgggttacggagtgagactctgtcaaaagaaacaaaaaaatctcgtacatacctgggaaaatacctttaaaacacgtaaagcaaaaatccacagaataacaagaagaaatacacaactatatcagcatggtgggagatttcataatgcctctttctttcaagacaccagacaaaagttagtgaagatagtgatgattaacagttgataaggtggatataaagactgtatagagaaccccaaatcagagtgtaaatttcatctgaagtacatggaaatgtcaatacatttcacatatttggtattattagggaaatactcttaaatttgtaacaagctagaatcaatagtaaaaacttgactaaagtaaataatttgtggatcaaagatgaattcaaaatggatggttaaaattcatagaaccgagtgataataaaaataaaaattaaaactaattggttcctgttaatttttgtagaagagacggaagggctgaaaactagtgagctaactgcccatctcaagaaaatagggaaaagtataataaatgcagagaaagtaaatggaaagagaagaattcaagagcagaaataaataaaaacaacatggaatcaataaaatttaaatgcccatattcatgttttaattagacaaatcaactgagagggaagtaaaaacaaatataaaatcttaaggatgaaaatgttataactacagttataatatatttttaaaatacagaaaatactaaaagctatgcaaataagtttagaaacttacatgaaatggatgaatttctaggagaatattgctacaaaaatgatggaaggggatatagaaagcctgaggagacagaaatttaatcacaaattaaaagtcttcctacaaagactatattagactgaaattattttacattcaaatttgaacacactttctaggaatagataattccagtcatcaacaaactcagtagaacatacaaggcaatatacatgtctggaaaatataaggttagaaaatttttttttttttttaccaaaatcagacaaaaatgaaacaggaaggaaaaccccatgccaatttcagtcataaattaataaggaaaagttctgaaacaaattattggccaactggatccaagtgtgtatgaaacagtgtttaagcttaatgttctccctttcctttctatattcactctttataatactttatgcagtgtcatggctttaaataaaatttacatgctaattattcccaaaatattatctctggcacagacttttgcccttaacttcagaccatatatccagccttctattgtgtatttttctctttggatatctcataggctactcaaacttaacatactcagatgacagctcctatcaaagctacccaacaccgttttctccacctctgttaatgccatctcattcctgaaatttctcataccaaaacttttaaaatgaactttgattcttgtctttctttaccagcctttctcttagcagatctgaaagatggtctcaacagatctagctgttgttttacttttatgttctgggtatatatgcaggtttgttatacaggtaaacagtgtgtcatggggggttggtgtacagattatttcatcacccaggtaataagcatactacctgataggtattttttctgatcctccccttcctcccattctctatcctcaagtaggacccagtgtctgttccctcattgtgtccatgtattctcattatttagctcccacttataagtgagaacatgtgatatttagttgtctgttcctgcattagtttgctaagtagaatggtctccagctccctccatgttcctgcaaaggacacgaactccttctttttgtggctgcgtagtgttccatggtgtatatgcaccacattttctttatctagtctaccatggagggcatttaggttgattctgtatctttgctattgtgaatagtgttgcaatgaacatatgtgtgcatgtgtctttgtggtagaacaatttgtattcctttggctatacacccggtaatggggttgctgtgttctgtttttagctctgccaaactgctttccacaagggctcaactaatttacacccccaccagcagtgtataaatgttctgttttctctgccatcccaacagcatctgttattttttgacattttaataatagccattttgactggtgcgagatggcatcttatcgtggttttaatgtgcacttctctaatggttggtgatattgagcattttttttcatattgttggccacatgtgtgtcgtcttgtgaaaaatgtgtgttcatgtcctttgcccatttttaatggagtagagtttttaaaataaatttgtttaagttacttagagattctggatgttaaacctttatcagattcacagtttgcaaaatatttctcccgttctgtagtttgtctgtttactctgttgacagagttcaacagaggaactctgtgaggaagttgtgtaatttaattaggtctcatttgtcagtgtttgcttttgttgcaattgcttttgacatcatcattacatcttttcccattcctatgtccaggatggtattgcctaggttatcctccagggtttttaaagttttgctttgacattttaagtctttcattcatcttgagttgatttttgtatatggtgtaaggttttattcttctgtatacggttagccagttatcccagcaccatttatggaatagggagtcctttcctcattgcttgcttttgtcggctttgtcgaagatcagaagggtataggtgtgtggcattatttctgggctttccattctgtttcattggtctatgtgactgtttttgtaccagtactgtgttgttttggttactgtagcactgtagtatagtttgaagtcagctaacatgatgcctccactagctgtatttctttgctccttctctcattaaatatagtctctgtgttccaaagtgaggaggaacaactgtgagattaagatttggtaaaagagaaaatgagcagggcaaatagagacaataaatctgtgatgatgaaaaaatgagaaagaaaggccagtaactgaaattgaatagtaatagggcagaaaagatgtgttgttgattttcaggataataaaaatttaagcatgtttgtagtataagggaagatccaatagaaagacataatatataagagcaaagtcttacaagataggatacacgagcaaaaaaaatggaaggattgactttggaagtgggaaagagaaaattgagataatacaaggaggttctgaggtggagagtagtaagtttgagaaagtttatccaccaaggataaatttatccctgagaagtaggtaactctgttttcaggttgtttaggactctgcacggtaaagggggttgggagaaaggagaactggtgtcattgaggaaatgagagtgaaaagtatttggaataggagctcttttgttttaaagattcgtttaaaatcaggagaagtgttagagaataatatcgtggactcagtagtagccaatgaagttattcgcaatggaaataatcagttatctgactttctcccgtaattttctgcaaaataattttatttagaaccacacacatacagccgcatagaaaatcaaaagcgaagggatttttctttgcgttatctttgattagcatctccaggttgtatttgattatattctgaaacaactaggattctagtctgaagtatcttcttccaactatattcatatttgcaagtcattcatctggttaccgccagtatgtcaaatgtgaatttcatgtatttttttttttttttttacaatctctctaacttaaccaatttaattcagatttttatgtcagtcttttagctgttggctgtttttcccaaaatgtcaggatcggctccataatttgggggactcagggaagaaagaaaatactgggtcccatactcaaaaattaagcattgtaagatggcaacagcagagcattaaaccaagcatgggctctcctaagcatgagttactgcataactgcacaggttgcatggctttgaagccaatttcgggtgtcatcttatacatttggttatttgtacacctgaaatgcttttgataaggtttgggagttaacaatttaggctcacttttatagattatcattacttgaaaatatttcattgaggataattaattaacaataaatgctttaatatttagaaaggtgaaatttaatcttattcttagtgtgttaataatggatatagcttctaggtttacatctttccatactttgaattcagggctttctttccttaagtagtaaaaaggatattggatatcttgaatcttgacttctcctaggttgaatgctctgcaaaaaacctttgtctttatataaaaattgcactgcaagcagactattatggcagacctctgtgttcaaggtgactgcaattttcagctgagtggtggactatgcaacttgttctcataataatattaattgaataaatggtcaagagtgattacattttgaggggaagaaacccacttgtgtaatatttacacatagataataaactcaatagcccagacctctttaatgtaagaaaaatagacatgaatgtgtatgctattttctttgtaaattagaaatttttccttctctatttcatgtatcttcttttgttatttgagaaagggatttttcttgtcctaccatcaattgtgtgagttaccttgattcttgtttttaataatattttaaaatacatcttgtattttaaatgtagttaccctctattttatagctacaggaactgaaagagtacatagccttcacaaaagggtctgtggtgaatgtgtttaattcttattttaatcaccatgaatcatggattttttctttgtaagtagtaattccattatttttagatataatttaccctacttcaatcaataatgtttccttggacagtcatatttacttttccgaaatattatataaaacagtagttaaatgtttttgttcgtctgtatgcctattatagaatattagcatttttggggtccagacacaaagggacacacaaacacatatatatacttgcatgtatttatatatacatgtatataagcacatatgtatacatataatcatgtactgcatttcaatatatgattaatatttaagtatttaatattcactctagacaaattatgtttgctcttggagggcattaatatctttgtgaatgagtgttaacatatccatttaatggtatcttgtcttcaaatatctcataatttgatagttgagttatttcttctgaagttggaatagcttttctacaagggcctaccaaaaaaaaaaaaaaagaataataaagttggaataacaaaagagggagttaatacataaaggaaaaccattaaggccgaaaaactaatcagttgtaaaagctaaatcagtagtatggattgataaagtagcattttagtgataaatttttggattgaagtttctcttttaagtttatcaatgtaccttttcagaaaaattcctcgagtttatatctttatgttaatgaaacttgtcaataactttaattatctatgatgattgacaactaatacttaatttctataacacacaatactgttctgagggtacatattcatctctctctttcatcttacgttttaccactctcaactttttaaaaccgttttctttgcaagctacttcatagattcttgagattgaataatcaaatctgttatttaatattcaggccaaatttctgaaaatgtttatttttttaaaaaaaatgataaatggaaaagggaatgttaaacaacatttctttgcagtgtattccagtgtccctagatggaatgaggaataaaaatatttttcaagttcatcatgctgtcttttaaatcataaaatgcatatatttattagtaatttttcattgaaagtatcaaagaaaattggagaatttccttactgtttctacctcactatgtttcgtatattctgaccagcattaataccaatttcatagcactctactgttcgctcttttttgctgtaagcccaactgattgcattttcttacctgttatttttcgttgttgttatttaagacatcttttctttctaacttcggtcttcatagaccttctcaatttcagctcatcaccaaaattacacagatagaagaatatagggactttggtgtacacatacccacttttgactccctctgattttctaatttagtagattttaattgaggctgagaactgtatttggaaaagttcattctgatgattattcaggtttgtgaaccccagtctagatagacctttatcagcacatgtataaggtgcactttgctaaggtgcattatgtgtcaggttcattcccactgtggaccagtaatttattcttgcccaaccactgctcatgacagatagatgatctctgtattccagaaatgaagctcctttccaattcctcaacaactaaaccaagcagaggaaaaagtggttttccttcacagccatagttccctgctgaagtagaatgaacgctttctaggaaactgcagcagatttttgatgacacggaaagggcatcactaggatcctcattatatattacctctctccctcacccgaaccacaatgttgacggaacagatacttcctgtggggaagatgctaagcagtcctgcatggctgtaggcattgtccacatcttaatcttcagctatatctgaggtatgacaagtttaacaatcctacaagttaaagcgtcacaccggaaacctgtttattcttctcccatgccaaataattccagcacgatgggtttcatctatagacgatgagaagatgccattgtggggtgaggacatagagaagagaggaagtttggaaccagtttatttctatttcagcaagcttaatgtattgtaagaacattttgtggcagatgaccctagtctgtaacaaggaatcgattgtaatgcatcattctgccagtgtttatctgttccctatgctcatataaacacacgagtcatctttctgcactcccaacctactcctaaagcactatacagaatgtttcgaaagcagaaggaaaagcagctgttccatacaccatgttcctgctgttcaaggtgcacatcccatccaaatgaatcatatcagagccaaagatcctggtaggagttcttttctacaaaactgcagtcttgtctatcctaacaacttggaggacaaaatattagaaaaccttgtaataaccttaggacacaataatgtagatactgactgagctagacctgaggactttttcaatgtagtgtggataagtaagatgacaggaagccataagcatactgtgccttgcacatcaacttctccagagccatgacaatcatctggagtatttgtgataaataaatattgttaatcttcatgtaattgggtaggatgaaaaaggaccagtcgtcccagacatcccaggagagaggagcatttttccagttgctcagatacaatttcaagttcgaaccaatatgaattacagttgaccacagaggccggcaaaatccatggcactgtagtccaagagaacctgaacactggccttagagtattatgagcctacatcacagtagaaggaatccagcagagatctctaatgcacatcagaaaagcaccatttctagttatcaaggctgtatttcacactgcttgactgaagattggaaactattttattcataggcaacctgtgtggccatccttacctggtctataaaaggaagtgtgatgaatttgcttcccatacatcatattaagtccagaaagccagagatgctgtgttgagtttctttcctgagagtctgaattcctaagtagagggactaacgagttccaaagttctttcactctgagatctttgtcacactactgtactgactggatatcactgaccttatttaagaggactatcaactggctagttcatctacattgtaaggactagtttgctcacaaccaccaacctatctgtaattggcctcagtatgctctctctcacttgggtacttctgtatttggctaattaacctataccacttggcttagaagcaccagctacattttttctaattttgacttctcatcttttccaacttgattttatccccagatttggacttttgtctcatgtataaactttatattttgcttgaacatgtggtctcaatgctgaccaagtcatccctagaatctgattctgtctcactattccatatcaggagacagcgacttaaatattttaattatttcctgtatcaataaattattcactgcctaaagtttagactttaataatatgaacacatgtgcagtcaaagagtacctcgccattgggccggaaaaatttcactgacttagggtggctcctgaaggtaccttgagaaagcttggatatgatgaatcctgtagacttattttatgtttactgaataatgcttcattcactttctttttgaagcttaaataaagcatcagtttgctcctgtcagggcagaagaccaatttcacttgtctacccatgaggataaatggatgcagcaagaatccagaaatgtcttagatatattactctatagctcattgaccattctatcaatgctcaatgctttacttgaaagtgatggctatctgatgtcaagttccattgataaaatgattcccaaacgttactttcaagtatgcttccttcagaggtcacagaagaacttcagtaacctgctaaaacctaaaacaggtgaagttcctattaaccatgacaccaagagttttcacatttatattctttcctggtaaagaaaattataggagctccatgctcacggcttttgagttttctcccaggtgtgttcaaacctagtgacattaacaaaacataaatctagaagcctttcgtgaataatgtaaccttctttattttatatttaaaggatatatatgcagacatgtacacatctttgtaattatttaccgcctatatccctattaaatacattaacaaatatgccacaggaaaaaccactgtaccaaagcccctcacaagagttatatttaaagtgggttaaagcaacatggttttaatttacttagtctttcttgtccaaggaacacagtgtgagacctcctttctttaggaaaaaataggatgaactaatttgaaaacaaagaaagcaacaaagtgaatcttgtgatgagctatgagcattggtaaattatttcttctgttgtaaattatcctcttctccctctgcttttctcttaatctccatttaattcccttttcaaaatcctaactctattctttttggaaaacatttcattaagctggtataagcatatctagacatctggaaatttttgtataacttttaaaggatctattacttaacaccatatgaaattatggaaaataaagtgttcctatctaatcaatctcaaagatttttcaagtgtacaatacaatgtgtgcttcaagtgtcagcttcttttttttttttttttttttttttttgagacagagtctcactctgtcacccagactgtagtgcaatggcacgatctcagctcactgccagctctacctcccgggttcacaccattctcctgcctcagcctcctgcgtagctgggactacaggcgcctgccaccatgccaggctaattttttgtatttttagtagaaacagggtttcaccgtgtcagccaggatggtttcgatctcctgaagtgtcaacttctttaaggctgtcatcttgccggttctaaacaactaaaaattgtaagaaccaatttctgagacaaatagaacattcttagtggtccttaaataattcctgatacttttatggcatgcttctttaaagaccttagaattatgcttcaggaatttaaattggttgttcagcaaagttaccaatcagtaggcaagttgttgcatttgacaggagcaatagttttcacgtggattatttatattcatgtatgttggtagacggatataaaacatgcaacttgcagttgcatgagacaaaagcatcaacatatctatcttagcttttcaatcatgtgatactactataatgctccatttttcacagatatttcttaagttctttatctcttcagacctcccgtaaaccattttctgtcttctgctggaccacattctagatgatctggatgtctatcattctcctttgcctttgctttatttgagtaagtgctgaattcgtggactgtgttagtagtttgatgcgtagtttcagccagatagatcagaaacatgaaatgcttttacatcatccaggtagatggcgccatgaatagatccctttgctttctggcctctgaggtaataaagacttaaatctaattgggttcagcttaaaatctcaatgtcatatttaatttaatatgcttccttgtttccagctcaagcttaagccatggtctaaaagactttctctggaaggcaagtgtggttagattccatcttacacctccactgcctctttttcttttttttttttttaactgcacttcagttatattattctccaatgtcttgggaagtaggagttaaggaaaataggcaaatgtctcctgttaactagctatttgtagctttgagtttatgatttgtgtgtgtgtgtgtgtgtgtgtaacagagatacaaagttcgggtttatttggggtacaagtatgggatctttaagaagtcttgcagaagctcttttgttttccccatctttaagaaggaaaatatgctctataaaaacatcttcaagcctcttgatcctgaggtactcttgctccataaagagtgttcctggtagatagctcaaacatggctgtcttcttccacgttcacttgacctattgagaaacgtttgccacaccaagcactggggagtacaggctgccccccttcttcactgtatcatttctcattcattttttacctatcaagtaggcatataatttctgaagcagacatcttcagaagcagagttggtaattaggtgtcatccctatctactctggactcccagaccctgtgatcagtggtcttggagctccacttacttgcatgggacaaaaaggttgaagtaccatcttcttttcccccttacggaataaacagagggagccatccctactctccctctgggccatgaattcagaagaccgattctttctaaaaccttcagagagttttagtataagtgggtatggtggagcaacaaaggcagggccagttttcccagctcttttgtaagccctttgctatgccctgctatttccatctcttagaatgagagagacttattacttgttattttcagtttaagactatacccaaaattctaagacaacagatagaattcaatgcattcatatccatagtgacagtttcacacttgctcttaagttaaatagaagagttaggtcaggaggaaatagtttatcaaaaatgatatacacccaccagtattcttagtacttggcacttgaacaaattgcaacctgttagtaggtaaaaaagaaacactaaaaggaaatagttggaccactgaactattgcttgatccactgaagcaagtgttgcttggtccactgaagttgagactctgggaaagaaaacttgactggtaaactctgtgaagtgaagcgtggttgtcaaatggagattaatgtcctctcatgggtctccactgtagtttctgaagggcaggttgagtaggatttggttttagcacatctcttgcaggactcctatcccaagacactttctataaaataaaacatattccatattgctctactttctgcaaggtacggacagtcaggttggggccaattaatgcactaccctaagcagaaacttcaagactttgtcgttgctttgctttatttgaattggaatttgggatttagttttcgttagttcatttactactaaaatcactcataaaaatgagggctttattttgacattggcaaaaatccttctttactcagaagaaaatatttaaaactgctggaaattgaaatgttttacatgtctacatcacaatgatgaatacaatgatgagtatttaaacaccaaaaataaaagtgtcttattacgagatgattgtaaacagtgcacccacattcttaatccatttgcaagcataagcttacccatcacctcataaatgcagtaaaattgctttttgtattgagtttaataagtatagtataggatacctagctcctttaatgaatgtgttttttgtaaaatattattaaatgattttttttctaatttggctttttaaagcatgcattcatatgttaaatacattttttggtttcaatattcggttttttatttcacatgcagagttttctcttccagagtttcttagacatgctacactttgatttatgtgtttgtaatattgtggtacaaaggttagtacattatttttaaaatggaaatgtgagaaactgtcaattcattgtagagatgactttacattgccagcaaaactcattaaactcttaaaactttttcttaaacttattttatatttccatagtactttaaagatataaaataattaatttgtgttaacttttacttagttttaattttcattgaaaactgggttaaaatatattatgtgtttttcttggtaaccattactaggattgttttctatttttatatttttgtcattgatcgccagttattaaaagatgtctttctaactttccttatatttgctgtttctgtctagctatataattcctcttactgctaagtggattagctaaagacatgaaataacattttaaaacaacagcggaacagtattctggaacaacaacaaaaaatcagattatggttgaagactttctacaaacttcattcaatgagacagcacaggtcaagcgggcagaaagtcagaaaattcataagcctgacattccatcagggtgcgcctaatcagatgtttagaaatagaaggcagcttatgccatgactagttgaaagaattctgcaagcttgcattgacatgaggtcttttcaatgactgagataatcaaggaatctgtgtaaatcagcctctcttattgactgtcaggccaggaaaagagccaacccacccgaagtcaactctgccatcatttcttaagccacactgttcctttcagctcatagaatctcatgaatagaaaaagttaggtttctaaaaagaattttgaggctagatatgtggtttaatgttattctatattacatcctatacaattaaaatctacagatgtgccttgtagagtacactgtttttgcctttagccagaggaaggaccaaatttaatacctggctaggcaattattacacgctgtgattggaagttttctccaaccacctgtcacaatgctgaaattttatcactagagatccatttctttggaagagctgtgggtaggctgcagccagtctcctctgcaatagaggctctgattatagccctgaacactgttatctgaaatagtaaattacctgatgtaaattttagttgaaattttgactgagaacaaaaggaagctatgtttgaattggaatatagggcaaagcctcggtcaccaatcttggatacagaattttaatagaaagagattaaaattttctccaaataatgtcccacccccattctgacacttttaatacaaaaacagatagatttattgtccaaaagatacatctctgagcagtggtgacctttgtttacaatttcttctgtaaatccattttcgtctttgactatttaaagttttctgtttttctcattaaaatttctccttatacttttcacccagtcataaataaagctattgggcttcattctaggaactggtattgagcaatgaacaggacagccgtaatccttgaactcattagagttgatagtctaaagtaaatgcagaccattaatgggagattaaatatgttatggcacatacaaagtgcaagaaagaacataatgtcatgtgagggaatgcataaatagcttaatttagccatcccgtaacatattcatatattaaaacatcatgttacgtgctctaacttgatagaatttttacttgtcaaatcaaaaaaatacaaaattcaaagaacatgcaagaattacctccctgaacttagaaggtgccagaggtagccacttggaagagatgtccactacattaagaagataaatgtaaattagccaataaaaggaagtcagaattgagattatgccagtaaaagggaacaacatgtttaaggccaagaatcaagagggccacagtgtaggttgggaaataaaaaataaaatttctgtatagctagagcagggagtaaaagacaccagcaggacttatattatgaagggacttttaagccacattaaggataaagcttttggctgcgcgcaatgtctcacgcctataatcccagcacttagggaggccgaggtgggtggatcatcttaggtcaggagtttgagaccagcctgggcaaattggtgaaaccctgtctctactaaaaatacaaaaattcgccaggcatggtggcaggtacctgtaatcccagctacttgagaggctgaggcaggagaatcacttgaaccagggaggcagaggttgcagtgagcagagattgtgccactgcactccagtctgggtgacagagagagactccgcctccatctcaaaaaaaaaaaaaaaaaaaaaagaatagagcttttatttgaaggacagtaaagaatcactagagaattttagacaggaagccccaattcgttattgagagaacacattgcagctgctttacaggtgggatgtggcagagtaaaatgccagtgaagaaactgatagcatatttgaggtaagatatagtaatgattttaactagagtaaagacaatggagagagagagaaaagattggaatcaagaactatttagaaggtataataaataattagtgattgactgattagatgcaacatgatgaaggacatgatagaggaagtagaaatatctagaattacatctaataaagggaatcattatttgtttttcgctgaaaccggaaaaaatacagagaaggaggaaaagcaagttggggagttgagaagtaggtgagaagagtatatgcaaggagttcatgtgtgggagtgttagcttttggtggttgcagaatattcatgaggagatgtccaatagggtgagataacatgcaagtatggagatcaaggggagatctggacttgagagatgtagagttgagagttgtcagaatgtgaggaggaattgaagttaaggtatgggtagaatgagaagaaaggaaagcccaggataaaatcttaatggagtcaaaatttatggtacagggagaagtactgggaaagccttccctcttcctgcagcatcactaaacttcctgttcttttgccttagtctagatgcctttaactgtagttttacttgggcaaagctgtgttataggctggcttcactgaagaataatgacatcactaatatttttaaagcttaaaaagtatagtatttatgtaatatctaatattctatatataatataaaaaccaagatcatcttaaaacctcagtcatgctctgtgggaaagaaagttatattgtacctgataatcatgcctttacattgtatattaaggaaatgtattttaaatgacacataatgaattcccaataagttgcctgccctatttcttacttttacaactactctgttaaaagtgaacagatccttgaagggagactttccaatctgtgcagcatggtatttatacttgaacattattgaattatcctaatcatacttatagttacaatcaagattaattgcagctatattaggattacttattattttttctacttcagcagtaacataaacccaattgtacaaacaatttctgtaatccaaattgtgaaagaaagtagggagaaaaaagatcatgcaaagctggttgaaatagtattcaaaataaatctttaaccagactgttatctaaaattctgtttttgacaaggagctgattctgaacagattgtacatgtatctcactggtggaagcagattatctgtcttgaattggattgtgatgacgatgaccctattctaagcaaaccaaatctcttgaactatataatgagatcaggaggaacattcgacctgagaaagacagattgcaatgactgagatgattttgctaattttttttccagcctatttccttaatgtacgtgatattgtgattgattttcatgcagagatccctgatcctatagttttgtttgctatttatttttctccttcacattttttttctatcaacagagctgaatgagtgccaggaagctgcgaaatctgtcttacaaaaaggtgattgtggaagagtctagaatcttcatttattgttcagcaggattacagaaaagctatcaagagtaaacatttaactgatacactcttattccttctttttaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccaggcaagtacatctgggaatcagcttccattcttttgtttttattacttcaacaaaatgttgcagtgtttctaactttaaatttattcaactagttttccatggggttgttttgattcactgatttgactatttggaggtaggtaggaagaaaagggggtctagatcattagtctaagatttatttttttaaggatgtaatggaggaatttgaaataaagacatttcaaagacaggagcaatacgttctggtgtttctgacttcaaactatactaaaagctagagtaaaaccataggatagtaaatggtaaagaaaatgttttttggccgggtgtggtggctcacacctgtaatcccagccctttgggatgctgaggcccacgaatcacaatgtcaggagttcaagaccagcctggccaacatggtgaaaccctgtctctactaaaaatacaaaaattagccaggtttgttggcacgcgcctgtaatcccagctactcgggaggctgaggcaggagaatcacttgaacacgggaggcggaggttgcagtgagccgagattgcaccactgtactccagcctggaacagagcgagactctatcttataaaaagaaaaaaagaaaatattttctatggcattgttggaaagcagtctcaaacattttattataaactcctcgtttagtcacatggtctatattgttttataaaaatgtgttagttacaagcagtgagtaacacaaaattatcgatataaatttacacctcaattattaatgatcatgctcaatatagctacatgcactcactcccatgcttcattcaaacgaaaatataaaacgtgtttacctgtttttctagaatgagaattaaaatagtgttgaaaataaatctgagttgacttttaaatgagtaaattttaggccataactaaatttacattcactgtaagaagtatttttaaaatgctgttctcattttttaattaacatttaaacatatgtgaagttatcataggtattatttattcaaaagtctttagggttgtgtgatcgcaattactagatctgcttttcaaatcttatatacatgttgtgaacccaatcaccaagtccatgctatgatgagaggagcactagaaggttagctgcaaatctcaaagccttctccctgccagttggtgaagatgtctgaagtttttcactttaaaatgaatttgggggtgatatattagatttgtagatcatggttacaatgcaattacagttaatgaatcaccgttaataggtgttctgggcaacagtatacacaatagcatgagttaatttaccatattgtctaactttgaccaagaatgtccctgataatatgtggcagagtataggtagttttgataggcttaaaaagtccagggaatattatttccttatggagtgcatacaattgcaatagtggatgaagaaagagaattttggggagaatcctgatgataaaatcctcatcatagttttccactgggcaacaagagtaaatattgtagtagaagtgagggataatagtaaacatacttgaggattcaatttttaatttgtcttgatatataatgattgtacatattttagagggtaagtgtgataggtttatacaaacctactccagtatatatatttttcaaacttacacaagccaggttctctagaattaactattcctaagtccgtcccagtttgagtcataatgaaaaaggttttttgatataaaatatttatacatatttatggatacaacatttatgtaatattttcttacatgtatagaaagtgtaatgatcaagtcagggtatttagtgtgtctaccacggcagggtttagtaaaatgcatgataggaatgagtaattgtttctgaattgagaagaactacatgactataaatgaaatacagagtagaactgctttcatttaaactaatgacatgagttttgaaggaatgtttgattaaaaatgcttgtgacgttctgaatggaattaaggaaaaatttgagcagtatgaatactagacattaatattgcaagtttgtacttcaaaatgcataaagaattactttgtgacagacttgcggaatgaaattatgagtagcaaatttgataggcaaagctattatactattgtctttcaaggaaaattggagcttttagggcgaagcatctttagttgaacaggttgtgataaggggcactgtgtgttttttcttatttagaaatggattcaggattttataaacattacttgtttttaatagcaaaatattttgcttggtttttctaaaaaaatactacaataaaaatgttattaactacatcagtagaaaagtactagtaaacagcagaacacagataaattatgaaatttcagatctacttcaagaaagagattttgggcattcagatcaaatctattttccatgcatttcaggtcacacctgcattatcaacatagttcttgacattgagtctccccaatggtaatacataatattggagaatacaagccatctgaaagctcttaaaacattcttctgctccagggttttattttaatatggcagtaagtgaattgttttctagaacagagttctcaggtactcagatttgcttcaaggattatatttcctgaaaagcagctcgaaattcccatgaaataaaatagagagtcaaaagttagatagtgaaataacataagcacagtgtgtaagatgaaggatccactaagaatgccaccaaaatgacattttaaatatagagatggggtggatagatggatggatgtatggattgatggatggatagatagatagatagatagatagatagatagatagatagatagatgaaagaaagaaaagaaaggaatagaatagggactaacttcaatgcattgtattaacaaaaatgtgtttctataaatttgcacttaaagataaaaaggttattgctaattaaaatattagtgcactataatttcttttctcataaatggtatatttagcttaattcatcacggagaagcaggaaaaaatgtatgaagttaccatattaagtcctctttgaaatacctgctcagattttctgtcatatactggtcacgcagatttgtgggtgtctgactccaccgtgtggtgcactgagagttttgctagttaatttgaatcttttagagcattattttttctgcattttaagatcgtttgagatcctcagatataaaagctatggcactaaggaaatgcatactgtatgtacaactttctgacaaccatactcttgttatatataaaagtagatgtagatcaggatgcttctttacattcacattggcatttattactataggaaagaaaagagctgctcacttccttagtgtgttaattgatcagttatttctctgggccctcagattctgaattggatttaaaattatgttacttattttagtgacatgagcttacctacagaagcaaagcttacacttttagaaaataaagctgcatgctgccaggatgtaacagcatgtgttgacctaggagtattttatttcaaaagataacacttagccaattcacagtctttttttttaatactttaagttttagggtacatgtgcacaacgtgcaggttagttgcatatgtatacatgtgccatgttggtgtgctacacccattaactcgtcatttaacattaggtatatctcctaatgctatccctcccccctccccccaccccacaacattccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccaaggtgtatatgtgccacattttctaaatccattgtatcattgtgagacatttgggttggttccaagtctttgctattgagaatagtgccgcaataaacatacgtgtgcatgtgtctttatagcagcatgatttataatcctttgggtatatacccagtaacgggatggctgggtcaaatggtatttctagttctagatccctgaggaatcgccacagtgacttccacaatggttgaactagtttacagtcccaccaacagtgtaaaagtgttcctatttctccacatcctctccagcacctgttgtttcctgactttttaatgatcgccattctaactggtgtgagatggtatctcgttgttttgatttgcatttctctgatggccagtgatgatgagcatttttttatgtgtcttttggctgcataaatgtcttcttttgagaagtgtctgttcatatccttcacccacttgttgatggggttgtttgcttttttcttgtacatttgtttgagttcattgtagattctggatattagccctttgtcagaggagtaggttgcgaaaatcttctcccattctgtaggttgcctgttcactctgatggtagtttcttttgctgtgcagaagctctttagtttaattagatcccatttgtcaattttggcttttgttgccattgcttttgttgttttcgtcatgaagtccttgcccgtgcctatgtcctgaatggtaatgcctaggttttcttctagggtttttatggttttaagtctaacatgtaagtctttaatccatcttgagttaatttttgtataaggtgtaaggaagggatccagtttcagctttctacatatggctagccagttttcccagcaccatttattaaatagggaatcgtttccccatttcttgtttttgtgaggtttgtcaaagatcagatagttgtagatatgtggcattatttatgagggctttgttctgttccattgatctatatctctgttttggtaccagtaccatgctgttttggttactgtagccttgtaatatacagaaaaagagaattttagaccaatatccctgatgaacatcgatgcaaaaatcctcaataaaatactggcaaaccgaatccagcagcacatcaaaaagcttatgcaccatgaccaagtgggcttcatccctgggatgcaaggctggttcaatatatgcaaatcaataaacgtaatccagcatataaacagaaccaatcacaaataccacatgattatctcaatagatccagaaaaggcctttgacaatattcaactacccctcatgctaaaaattctcaataaattaggtattgatgggacaaatctcaaaataataagagctatctatgatgaacccacagccaatatcatactgaatgggcaaaaactggaagcattccctttgaaaactggcacaagacaggggtgccctctctcactgctcctattcaacatactgttggaagttctggccagggcaattaggcaggagaaggaaataaagggtattcaatcaggaaaagaggaagtcaaattgttcctgtttgcagatgacatgattgtatatctagaaaaccccattgtctcagcccaaaatctccttaagctgataagcaacttcagcaaagtctcagcatgcaaaatcaatgtgcaaaaatcacaagcattcttatacaccaataacagacaaacagagagccaaatcatgagtgaactcccattcgcaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagtgtcaatatcgtgaaaatggccatactgcccaaggtaatttatagattcaatgccatccccatcaagctaccaatgcctttcttcagagaattggaaaaaactactttaaagttcatatggaaccataaaggagcctgcatcgccaagtcaatcctaagccaaaagaataaagctggagtcatcatgctacctgacttcaaagtatactacaaggctacagtaaccaaaacagcatggtactggtaccacagtcttaaattaaattatatggccacagcatcaatctacccagtgtcagctcatttaatgagagattttattaaagtacaaaattaagaaaagatttattgaaacagaataaagcaaatggggaaaactcttctagatatggaaatatatcttagaaaacagaaactaggattatttccaaagtactatgattaaaaatgtaacaacctatgcgtgttccttggaaataaataaaaaattaaatcacgaaattgtgtgactgcaaagaaacacatggaacaaatttagtcatttactgttcaatttttcagaactatatattgaagcacagagtttagttttggcacctaaaatcctatagcaacagtctaagtaaccatgctgagccccggagcaatcaaatcaaatctttaggtggatttggtcttcagaatttttggaaacttttttattcattctaatgtgtagctaattggagaatggctttggatggttccctactagtaatgactaaattgttccagagtatttttcatacgacattttctatcactcttctataaagattctcttctatgactgtgtcaacgtttcaatgggagggagtcagagtggcaatcaaactactggtgagattctctcctattttgattttttcctctaatggaaaatgggtgatggaagaaaatatagctgagagctatcgcacaaattttaatttagacaaaaagaatgttcaatatagatgtttgaggctgaactctgcttggctttcttcaattcatttttttctaaccccatttgttaacatgtcaattaacttgcatatggctcttaatcattttaggggacagtgacaactatgtttaaatagctacttaaatgtcttgcaatttttaaaattacaaagatactttcacatacatgatttttttccttttctactaattttagttttgaatctttgatatgtaagaacaacccaacatgggcacctgttgaaagtcaccatgtccttatgtgttgatgcacattttgtaggggaaaacatggccctgttgcttaaattactgcaagcaagagcggagttgcttagcagtggctccagtagctttactgttctatttgttttttcccaaagaattctgatctcatttttttgtaacctcgtgtcccacatagtagatttatgagcaggaatagaggaaggaaacaaattaccttcaaagaagagtgcctcataattaaatattgaaaaatactgccgtggtttgctcaccaagctaggacgtcaggtgttccagagtccactacagaccagacttcctccttctctttttccctcccattaacaatgtgagtacaatttagaaaagaggggatttttaaagcaaagaaagctattaatttaaactaattacgttaaatgcactttaagaagaattcgtaattgcaatcttcccgtgtttatcaaagaagctaaatcttataactcacattaaatataatcggtcatctttaaatgttaacattccaagctatcaaaatcaatggcttaaaaataaagatataactgcagattttggtctatcagattgagcttttgatttcattaaggaataaaacagactcttatagtgtaaataggcatatttgattgccaaacgacttggaacagtgtaactttacagtctgctttattgatttatgagttagacagcagaaacctgcaaaggggaatttatgtggtaattggataatttagtcaaagaagaaaaaaatggagaactaacccagagatttgggttcaaatattaaaacctatctagccatagatgtagactttttattttctttttacacagcccagtagatggtaaacctagtgcatttaattttgaatctgttctaacattgaaaggccacccctatgtgttgctatacagaacttattactctccatttaagaataacttgttagtttcatatgtttaatagtgtgggaaacagtcataaacacaagttgtaggaaatgtaaaatactagaaacttgccacacgtcactgactgtacttggacaacctgtacattattatgtcctcactggctatatgataaagatatagatttctttcatattattttgatgtgtacattttaagactgcaattaaactatagtatgcttttgtaaaaatctatctacaaattctacatataaggatgaaattattaaaattaatggcaaaaactgcaattacttttgcaccagtctaataacttcacgctacagccacagtgaacactattgcaacactctgaatattttgaagtgatccaaatttatcctattatttcccaattttgtcttatgcaaatgaatatttacttcaaagatagcacacagaaaatttatcgatctaaaatgcacagccagataacacttagcataacatactatgttttatttttctttcagcgtttatcgtgattgttaaatcttttatttgctttttaaaaattttccccgtctattcccattctctaaccactaaagttcagctgtaagaccgtgggccacccagcagatttctaacaaatagctggcaaatttattgaattccactgaggtttagtcactaagtatgtgtcagacaaatgtgataggcagtgtaaaatttaaaatgtgaataagcctaacgtggtccttgccatcttgccactcattagatagcaccaaagaaagataaaatttagaaattgctggccacttacgtttaccataatagtgaagaaccatttttccaatggaacttaatagtatcataaagacttcttgtcataatgccttatgattgcccaactttgaagctctgaaaacctttccaaaatactttgaatagtataaaatggaactcttcacatgaaaaggaaagactgatggaaaatatatattttagcctctttatgtattacctagtttttaaggattataccatgtgaatatctaatattttgaaagcattcacgttatttggtaattacagcagcctaatgaagtataaaagttgtgtttaaaagggaatatttgaaaacactagatgaatggttgaggcatgggttgagaacaggatgtgaatgaaaatggacacacaggtttaggggttaataaaaaatgtcctaaagttggattgtggtgatatatacatgactctataaatttcctattgttcattgactatatgtttaaaatgaaaattttatggtatgtaaattgtacctcaaagttgtttttaaaaccctattgaatagagaatatatcaattactattatatatttaaaaagataatttaaggttaccatcaactttttcactccattattttgatgcatagcaaagggtgaaatgtgatgaatgttgttaaataacctggaattaacttaaatggtagatatttattgatggcctactgatgtccgcaagatcttacatagtaatatcataatgttcccattgtttacattctattccatttaatgaattttaatgctaaagcatttttactgaagctgatattttaactcagatctgctttctccactttaataattagccctttattaagtgaaaattaacctagaagtacaatctcccaattatttctaggcagcattccaaaatgttccctagagtttgatttactcatttatctattttgaaaagtaaccataattacttgaaaatacgttatttctattttcaatgtttgtaggcacgtagtagatgtataaacgttacatgagatattttgatacaggcatgcaatgcgtagcaatcaaatcagggtaaatggggtgtctatcaccttaagcatctatcctttgtgatataaaaaattcagttgtactcttttagtttattttaaaatgtagactcaaattacttttttattatggtcatcctgttctagcaaatactaggtcttgctcattatttctaatttttgtacccattaaccatccccacttcctccccaacccctgactacccttcccagcctctagtaaggatccttctactctctatctccatagttcaattatcttaatttttagctcccacaaataactgagaacatgggatgtttgtctttctgtgactggcttatttcacttaacgtaataacgtacaattccatccatgttattgcaaatgacaggacgtcattctttttatggctgaatagtactgtattgtgtataggtaccatattttcttttttttattattatactttaagttttagggtacatgtgcacattgtgcaggttagtcacatatgtatacatgtgccatgctggtgcgctgcacccactaactcgtcatctagcattaggtatatctcccaatgctatccctcccccctccccccaccccacaacagtccccggtgtgtgatgttccccttcctgtgtccatgtgctctcattgttcaattcccacctatgagtgagaacatgcagtgtttggttttttgtccttgagatagtttgctgagaatggtggtttccagcttcatccatgtccctacaaaggacatgaactcatccttttttatggctgcatagtattccaaggtgtatatgtgccacattttctaaatccattgtatcattgtgagacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatgatgagcattttttcatgtgttttttggctgcagaggtacaaggaggaactgataccattccttctgaaactattccaatccatagaaaaagagggaatcctccctaactcattttatgaggccagcatcattctgataccaaagccgggcagagacacaaccaaaaaagagaattttagaccattatccttgatgaacattgatgaaaaaatcctcaataaaatacttgcaaaacgaatccagcagcacatcaaaaagcttatccaccatgatcaagtgggcttcatccttgggatgcaaggctggttcaatatatgcaaatcaataaatgtaatccagcatctaaacagagccaaagacaaaaaccacatgattatctcaatagatgcagaaaaagcctttgacaaaattcaacaacgcttcatgctaaaaattctcaataaattaggtattgatgggacgtatttcaaaataataagagctatctatgacaaacccacagccaatatcatactgaatgggcaaaaaccggaagcattccctttgaaaactggcacaagacagggatgccctctctcaccactcctattcaacatagtgttggaagttctggccagggcaattaggcaggagaaggaaataaagggtgttcaatcaggaaaagaggaagtcaaattgtccctgtttgcagatgacatgattgtatatctagaaaaccatattttctttatccattcgttttttaatggacatttaggttgcttccaaatcttgacttttgtgaacagtgccgcaataaaacacgggagtacagatatttcttcagtgtactgattttctttcttttgggtatatacacagcagtgggattgctggattgtatggtagctctgtttacagttttttgaggaatctcaaaacttgttttccatagtggttgtactagtttacattcctaccagcagtgtatgagggttcccttttctccatatcctcgccaacatttgttattgcttgttttataaataaaaccatttgagttgaagtgagattatatctcactgtggttttgatttactattctgttatgatcagtgatattgagacccttttcatatacccgtttgtcatttatcttctttcaaaaaaaagtctattcagatattttgcccatttttaatcagattattagttttttcctatagagttgtttgagctctttatatattctagttattgatcccttgtcagatgggtagtttggaaatattttctcccattccatgggttgtctcttcactttgtgggttgtatgctttgttgtgaagaagatttttaacttggtgtgttaccatttgtccatttttgctttggttgcctgtgcttgtgtggtatggttcaagaatttcttgcctagaccaatgttctggaggtttctcccaaagttttcttgtggtagtttcataatttgaggtcttagatttaagtatttaatccattttgatttgatttctgtatacggttcaagatagaggtctggttttattctgcatttggatatccaattttcccagcaccatttattgaaggactcctttccccaaagtgtgttcttggcactttgtcaaaaattaggtccctgtagatgtatggatttatctctgtgttctctattctgttctattgggctgtgtgtttgcgcttaagccagtaccatgctgtttcggttactatagctgtgtagtataatttaaagttaggtaaagtgattcctccagtttcattcttttttgcttaggatatatttggctattctgggtctgctgcagttccatataaattttaagattgttttttctatttctgtgaagaatgtctttgttagaaaatacattattataatgaactcttctattatcgttgtcgttattatgactaagcgtaacatcgtttctcaggtatattacaagtaataattatacacaatgtccaattttttatttttaaacggttctgtggtcaagattacgcagaaaaatttatatgctttacttctctgctggagatttttgacccacttttttgtattttcaaaaataaaagtttaacctaaatttgataagaagccacagacactttttcctccagaaatatgttgatataccacaaaactcatatgtcaaggaacaatgtaggggagacactgaaatagactgtttcctttggcctattgcatatttctgataaaagtcaaaacttctttagctgacaaaatttaatttaaaggtaatatttttctaagtaactctacttgggggggggggtttaaaaaaagagtagtacaaagctgtgtgaatttcttctttttttacttgttgaattattataaagtataacctgaaacttttcaacattttttttctatgaaaataattatatttcttgcattttcctatctttggaaagtacatatcatcccaaatcttttgatatattttgtttctttcgttttctaagtacgtgtgatatgtggccatttccctttcttgaaaatagcaatttcaaaattactggctctttcaaaattactaatctaacagtggtacgttcctccatcaatcagtagtctcaacatgaagtattttaatatcttttactaaaatattttcttattttctctaaatttttcctttctttgacaccacagaaactccaataattatttgatatcattttcttcattctgttaagtactttagcctgctgcagtataattttgctggccattttctgttactatatatatgagaatggtttgatgaggtaaagcaagattttaaaaacagccctgctctctgctcagttaactgtaaagtcctatatttaaaatgtgattaatgtttgaatgattttttggttctataattttgccctttaccatattcaatggaaaaatggttaattcgatttcacttgttttattttcctactttgaatatatagtgctgtgaacatagttactgcatgctcaaatgccttttttataatggaatgttgagataagctcaaatgtcttttttaatataatggaaagatgatataatttgctttatattacttgactttgatgaagaaaatctagtgattctgaaaggtactggattgagaacacctcatagagcatatgtgagtgttcacatcagtatccgtgatttgctatgtcctctcactttgtttccattagagtttactgattttatacgaagccaggctgataatttcacaagaatagttgtatgtggttggcttatttgttttcttcaaatgcttactatccatatccccctagatgtatatattaggtgaaaatataactcaaattatacatccctcacatctttaggacaacttagaaatctagtagacaagtagagagatcattttccttcagattgaatcttctatccccaatgttttcttccacaattttattttctttcatcatattctcataatgtcaaaaaagaaaatgattacattgtctttttttatgagtgatttttacataggagattgttcttcccagaagtttcaataatattctgttatttgtacaagttacttttctatttcacaataagcctgcgctaaagtgctaagcattttttacttatgtggttccagaatacagttctgacgaggttaggtaaagtagctggtaaaagatatcctaagtacaagctaaaagttaattacaatttaaatgtaaattttgtggaattaatgtgtaaagatgctggcaaatatgtgtcatgcatgttttacagcttacccatagtagaatcaattggaaatataaagacattttattttataattttagtaatgaattgaattattattaatgaatatgttaagtatatttgatagcctttttccaaatctacttgtatgatgcactctggcaaaaaaaagcaaaaggataacatctacaaagtgttgtatgattcttggatatacacaatatatattaataaatattctgagaagttctgtggtatagacacatgttcatcttcaatttccaaaatatgtttaaccactgagttctttttaatgcataatctactcaatgcataaagaaaattttatctctaatcatattggaacagtactacaaatatgcgaatttcactagaaatgcctatacattatgataaaagtctcacttttatatgatgttcaatgatgatttttttcaatgttaataattttagtggtggcgacctttctaaaaacacagaagctcatcctcaacagtttttctaactatttaatggaaatatgtatatttcaaattccatggaatgctttgccttgagctccaaattgcccaacattcctctcacaggttacttggtccttcatgtcccctgccaacagataaaagtcgagtgtttggttatatgtaagctgttgttgttcctattatttatgacttatgacaacaatatgactcatttgggaaaatgtggaacttatcaggaaggcctgtgttgcagtgatcacttacgctatctttgctttgctttgtaatgctgagcttctagaatttccaggggcagtctttgaaaaaaaaaattataaatagaaaattaaatgctggtttatagaagggtctcttgcaagtgagaggcactgaaacttaaggttctgtagcttcatactaattcctcatctagatagtaattcttactaactcacattcagtctttcctcccattaaattaagcacacacactctgcatgccccaagcctaatctttgctagcttgtttcctacagcctaaaataagatcctatattcttattctctgaccctccaaaaccctttctcagccatatgctagttaaatcatgtaaatttcctaaaaatcaccagattatacagcagatattaatatttatctttctgatcacagagcatgggtttttctgtttttaaaatttttttaaattatactttaagttctagggtacgtgtgcacaacatgcaggtttgttacgtatgtatccatgtgacatgttggtgtgctgcacccattaacttgtcagttacattaggtatatctcctaatgctatccctcccccctccccccaccccacgacaggccctggtgtgtgatgttagtttttctattacattgcatatatttctgctttgtaatttacttatatatctacagtctgcctcttaaaataaggcttctgtaagtataggggcaacaattttgttctcactgtgtggaattgagtagtagaagctgaacgatttgttgaattaaattgactaaatgctatcaacatacgaataagattaaatttctttttttctcacaaatgtccatttggaggatacttttattttaaaatcataattaaagaggcagtataattgttagagggcagcaagtttgttacttcctagttatgttaccttgggcatgttgatgtttctaccttcatttgtacatgaagatgataaatacttatgttaatatgattaggagatggaattaattatataaagtgttagcacataagttcccacaaatatctgtggtggtgaggatactgatgatgatttcttttctttttttttttttttttgtttttttgttttttgctcttctttgaccactctggtataaaaggttaaaggactatgtgtatacttcattttttcctctactaaccttggaggctaaggggatggaaaaacttttaaatacatgtacacagatatgattacagatgtataatttgggccctctaccctctctgagtgtattcttatttttttaaatcagtttcctttcacagtctccacaattgctattgaacttttatcactttgatttaaattccaccttgattctctcctctcatcctcagcagatacctagggttttgtgcttacgaggaaatgacatgttatatcgctgataacttataactaaatatttgtgcaaataacatggacaggtatttttacatatactgtcacatctgatctttttgaccaaaaccaatgtagttgactactgaagaaatgagaatttctcagataagaaaacttcattgctggcttgctattatcattcttgggctagacatgagaaaatcaaggttcagaacatgttgatgctttgcccaaggtggcaagagagagccctgaaatttaaatcctggttactgttaacatgatttcaccctgatactctgagagcaccatgtaggaagcattcaacttcttgcgtcttcacatcttacttttgttttctgaaaaagagccacctctcctcctgttgatattttccgttggccctgagctttgtgcttcactctggttttcttgctttaaacaggtttttttaaaatcaagtttatcttcttacatttaaaaaaaatcactttatgtgttggcttctttcatgtagccttaaagtatgttcaagtctgattgacctgaattttattatgtgtggagacaaaagtctgcaaaagtaatttaaactatttttattagagtgctccttgatccttaatcaggccagcccttgaaaatacgatttctgctctcgtcatccacttctctcttctagctgcaatggtcattgacgagctcatgtaccctgattactattgatcccattgaacctatctcaaactgtcactgttgacctctctctctcattcttaaaattctcacatcaattgatgtgagattttctctcttttctagttcttcttttctttctctttgactgttctttctctttatttggtgcttttctttccatgtcagttaaatttgtgttctccatggttctctctttgttctctctttctgctttcctctaacgcttgaaaacactgaaaaaatacatattatacaaatgtaccctgtttccctctttctctctgtacagacacacatagtgattattaaaatgcaaactcacttcaacatactgctgatttacagtcgcatttcctccctatgaatttccttagttatcggatcaaatattagcaataaaactactgttatctgtgattatgatcaatttcaaattttgaaatttatcttcgtgatcaaaatagtggtaaccattcatttgggacataaagttatttaatacctgatttctacctacatttcttgttaaattttgccaaactccttatgctcttcagtgccctgtctccacaccttgtctctcttcaaccagaaatgcttttgtttttacaactcctatatccttgcgtatccagtatgcatatacagtatttaggactctcatttagaagtaacaaaattgaagtaactaaagcaaaacaaatgagagagaaaggtttttcatatggaaacaggaatgtgtcatagaatccaagggcagtaataaagttttgactcaagaagggactaatgcctgtgttttggttatttatgatagccatttattattcccactaatggttttgcgtgttgagaaagctcacctggatggttctcttttgtggtttcttatgtgattttagtccattgttgtctgatactatagtaacctgaatgctcaactgggctgaacgtccaagatcactcattcacatgcctagcagttgttggctgaaagccttgttgtgattgttgctgaagcacttatccatggcctttcgatgttacttagctttctcagagcataatatgttggatggattctaaaagggagcaccctaagaatgactgttctaaaaagatagacgtggaagctgccaggccacttaaggacttttgccataactggcacttggactatattctattggtcaaagcagtcaaagagtcaacccagatttaaagagctgaagaaataaacttcacctcttgttgagggagtggtaagaggagcatgtgctgtgggagctattattgcagccctctttcgaaaatgctatctacgggctgggcacggtggctcacacctgtaatcccagcactttgggaagccgaggcaggtggatcacctgaggtcaggcattcgagaccatcctgaccaacatggtaaaaccctgtcgctactaaaaaatataaaaattagctgagcatggtggtgggcacctgtaatcgcagctacttggttggctgaggcaggagaatcgcttgaacctgggaggcggaggttgcagtgagccaagatcgtgctattgcgttccagcctgggtgacagagcgagattccatctcaaaacataaataactaactaaataaataaataaagccataccgcattggaagccatcagtgtttttgttaccacctcactccctatgcatctacttctttcttctctctctgttcatggacctttgctcttcctcaatccactctgcaaactagggacttcgtaagcacaatttgctagtatatgtgacacaattcgaagcactcacagtttgaccagactcttctgtcaattctaattttctgagagagattctgatgattctctcttaacacaagcattgtgtgtattctgatcacccataacatggagttggccagaattacgtggcacagacatggttgttactggcccacctttttgaggaggattaacatttccaagatgaaaggccctagccataacccctctaaagcatctgttactcccagcaatgcttactaattattgaaagttctactttaacatcaactcccttatgacatcctccgtacaagcatcactccaccctgcatacttccatccaattttatagattctgtgatgtttcttgctctataaataacgtcatgcacctagatggatccctactcccagattctaggttcacgaaacatatcaatatttctcacacaaggtagttattcaaccaatgaagatcatcgatatggtaataaaataagatacatttatatgcgtatttgctctcatttgttttaaggcagaattctaactatttaggtaattcataattgatttgcctctataattgttaggattaatattctaaggaataatattgaggtacatctgtgaatttataaccttgcataaggagctccttaaccacttagtccatgttcttggtataattctcattactcagttcagggctatagttcgctctggaaactgctaagcaaaactgatgttatcttctaatgatatgtatcagaatttactccaattggtgtaaattcacttacactaatatacgttatgcaaaatgatctgcatgataatgttatgggcactctggtataatttagtttctgctctaaattataataatctaataatgactgaattttaaattagaatgatttgaccgctagctgattttgtatggatttgacagaaataaataaataaatgtattgtgttcgtgtccacatgctgcagagatccctgcctataactggctcagaaattcatatgttaaatgcagaatatactttactatagaacttgatcgaaaatgtctttattgaatatataaatattgaaatgttttatagttatctaaaattcacaatcagtatctgccggaagccatcaaatatctatcagacaaatagcaatacctgtttggggcatttgacttccatttcttagattcatagcttccctgaaatttaactgaaatatggcacataatgactgagtagactacactaaggccaggcacagtggctcacgcctataatcacagctctgtgggaggctgagacaggagaattgcttaagaccaggagtttgggaccaggctgggtcacatagcaagactctgcctctacaaaataaaataaaataaaataaaaagaaggtaattaaggagtattttccacatgcaattttctcattatatctcatccctgtcacagttggctgaatcttacagattaacatcatgtctttggtccgatttgagtgtgacttcaaagataaaacatatcaattctacatataatatataaattacctattgaaaatgatatctgaaatagttgatattgactcaaaatgattattgcttttttcataataatcccatagggaagaaataaatcgtttcacttggataatttatgaaagtaaaaaatatttatgataattctatttaggtgatccacctgcctcgacctcccaaagtgctaggattacaggtgtgaaccaccactcttggccaatttacggtcattttaaaggaagctacatggtagaggtggttgaggagagtttctgaatttcgtcttcttggaaagttagttgttctttgtagagcatgctgactaataatgctatcctcccaacagaaaatccaatctgatttgacaagtcatgagatcagtttagaagaaatgaagaaacataatcaggggaaggaggctgcccaaagagtcctgtctcagattgatgttgcacaggtatatgttatttcagaaactaaggaacgtgttttcgttgggcattatactccagtctatattggacaacttgattattggcaagattggatttgaggacattatttgaaaactataatttgatgtctaaacaatgagtgttttgctctctacattttaaagataaaataggttaataaattaccttttatttagtataacattaagaaaaaactactgaatcattctcccaaatgtatgttttcctgtgttggatgaatggaaaaatactgctttattttgtttttatttttctgtatatcttcagaaataaaggcagatctatcaataaaaataggaccagttattgtttgaaaggcaaaattaaatcagtgcctttttacactgtccttacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtggtatgtatttctggtggcaaatacgcaggtaccccttgactttcctcattaagaagtaactgctcttttataagagagaattgttttcagataaccataataattatactatgtaattttaagattgagaacaaaaattggcacatgtattgtggcctattctgtgtgtcttttttgagtctataattctgctaagaactgtgcagaatataaaaggatgttgcttgtgtttaatttttatgattctttaaatatattttaaatggaaatctagaaaggaaatatattaatctaaaaatagtaacaacaacagtagttgcaataatcctaacaacttcagaaataatggatgccaggtaaactacgtgacatacagaagtcacctttaattcttaaggctacagattacctgagagaatttaaggacaaacagctggtgaatggcaaagcaagattccaattcaggtactcttattccaaactttaataactttcctttaaacaccagtactggatatacagtgaaatgcctcaagacaacaccgaattaaaaggcatggaaaggtacaaatagcctaaagtataaatctgatttaaactttataatattgaacggtgtcctatgttgctgttattggaaactcaccaactgagatgattcctctgaaaacaaagctgaggtatgattgcatctactcgagtaacataagtattattataactctacatgtactatcggccattagagtgggaagtcacataaaatgaaaacacagaatgttattaaagggaaaacaagtctatttagtacttgatattttaagtattgtttctacatctactccataatatcaatgaaaaacagagtccttcagatacatcgtagtcatatcatgaatggggaaatatttttctttttaacaaatatcttaaaataaatacatatatttatgtgtgaaaaatatgaggtattcttattcgataatatattttcataattcaagctgcattttagtggtataattactttaattattctcacccccaaaaagaaacttggaatagaaatgatagaaagtagttagttgatattagatgagtaaggataggaatatatgggaacatatcccatcttaaattttgccaaaaaaaaaaaaaaggaaagcataaatgacccaagtgccttattcatgactaatatttgcaaagtgagcacttttcgttcttttctagaaacaggtctctaatgttaccttataaaatgtatccaacagtaaatatgagctgaaaacaatctcacctgtgtcaagctgtgactgtgccctgcgtcagtacaaaggaaactgctcaaggcatttgctcaattggtttctggttctggtttaaatgtcaggaccaattgaagcagttctttcataagaatatccttacactgtttagttttttcattgtttacgatgctttgtggtgtataccataatcatagtcttgccttcaagacatgtttgtctatttataaaagtcttactttcatgaacacaaatataaataatatttctcccctttgtttataaatattttacttgcctattgaatgaaacaatgttaatggctaacggtaccttgagggaactttcttcatcaaaataaagcatttatattttttgaagttcagagagtaaataatttagaaaaatctctgattccaaattagcatcgttgatttccaacataataattaatttcagtgtttccagatacacagatatttttatatcttctaagaaaaaagtaaaatgaagtaaataatatcatctgggaaactcagacaaaagtcataattattagtgatgaaggaatgttaacatcatttgtcaaagaggattaatatggaaatatacatgtagcattgatcagataattgtccagcctttacaaaatgcttttttttagacattacttttaaactgaaaagagaaattaaacccaatttttgttctaattccataaaaacaattacctactgtcaggtttattttttggtaatactaaaataagtactgatagttcagatttatgactaaacaaattaaagcagagatacataatgtaaactattatatatacgtgtatacgtatatacacacacgtacatatatttgaatacatggccacatacatacaaagacatatatttctaggaaaactacaaagcaaaattaagacatcaagtggtgttggagtggtgttggtggtataattgtgaacatagctgtcttccaaagttatgacacttgtcttatgatgcttttttatagcaacctatgttttgtgaaaccgtatgtgtgtgctttatatttgtgatgtacatgtgaattgtcaataatatttttatatctggttttcatcagcacttttaagaaaataaagttgtgtaatttaattaacattgaaaaggaccttactttcttatatatgatacaatatatattgaaattatgatgtagaaatttaggtgctttaatgttactaatatgtaagtaccatgagaacaatagtgaatgtgtgtgttttggccaccactgacttcccagtgattcaaatactatctgattgatagtaaccactcaataaatacccgatgtaggagtgaattaattcatccaaatttatggctagaattatataactccaacatttaaaatagaagtcatgtaaaattcagaattgacatttatgttctttgattgaagaactaaatatatatatatcacaaaacacatatatatgattaactctctgtttaataagaatagctgcaaatgacacatatatgcatgtgtgtagacaattagaaatattaaatcaacagaaaatgcaaaagctagatattgaccaccgctgcaaaatgctactctattaaaatttcaaacatggaatagcaattaaggggatctctatttatttctgttcataatattatgaaataatttaactctactgattatcatgttttgttttatgtttaaacttagaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtgtgtgcatgctgagaccacaaacacttctttccactttccttataaattgtaaagcaacgggcaataaattatgtatgattagagtcttagcaattctaaacacctctctctctctatgtatatgtatacgtatatatatacacacatatacgtatatatatatatgtacacatatacacaaagataaacatatacacatatttcgatgtggaattctcattaagaaacaataattaatcagtgaggctctgcttattcagattgaaaaatacgtaacgctcagggaggtttttcctggtccatcagatagctctaaaagggtttcttagttgtaagtgttccttattttcattatatatatctacttgtgatgacttgaagactggtaaatattataaactgtatctatttatatgtaggtctaatgttgttaacatattccacagagaccacattaagtttaaaaattacacagtaattatttccctatatggccaagacttgcaaaatctaccacacttggctaataagatagcatggatagccagttaagacctacgtctctgtaattatttttgtatcattgtcctgatcagagtctcatgaccagctccacttcactgctaattcaagatgcctatatctctccatctcacttcgctcaactcaaatattctgtatagattatgatagtaagtagtctcttcactctgttgattgtttgttttgctgagcagaagctttttaggttgatgcgataacagtcgtctagttttcctcttgttgcctgtgctttgggagtcagatccaaaaaaaatgtttgcccagaacaatgtcaggaagctttttcctgttttcttcaaatcattttataggttcaggttttaagtcttgagtccattttgaactggttttttatatgctgtgagataagtgtccaattgcattttcatgcatttggatatccaatttctcagaaccatttattgaagagaatgtccttttttcattgtgtattctcggccccttggttgatcagttgatcataaatatgtggatttattattgggctctctattctgttcctttggtctatatgtctgtttttatactaccatcctgctcttttaattactagagcattatagaatatttttgaatcaggtaattatgatacctccagcttcgttcttttggcttaagattgctttggctattctgggtcttttgttgttcaaaatgaaatttgggattctttcttctacatctgccaaaaatgtcactggaattttaatagggattgcattaagtctgtaaattgctttgagtggtacagacatcttaacaatattatttattccaatccatgaatatgggatatctttccataaacggatatcttagtatttccaaaaatggacttctaacattttaatttcgttctgactgaaagaactgaatttcttggaggataaaaagttatatttttacaactcaggttctcaactttagtgaatagaacaacatcactgataaaattgtcacctcatcttagacagaaatatgaatgtccatgtttgagaaatagctaaggagaggcatatttcttgcatctcagcctgaaagtagattgaaggttatatcttcaagatattagttgccaattccttaccatagaaagtaaattttataattaagttgaaatctggaagtaatcatttttcttagatagtcttgtttttatattttaaaaaccctctaattaatatttgttatgttttaaacaagtttgttgccatcctatgacaaaagattctcctactttgtttcaaaataagaaacactgatactcaattgatgggaaagcattatgataatcttgaaataaaatacatttcaactgttcatttggtctaccaaggtacctttggaatgagatacctttatatcctctagagaaatttatcattgtttaaagatcaccacagacagaaaaattgtatctgcacttgataccttattccggtgcttatcaatttttatagatgccaattatttcatatttaacatcaattacgaaggactgagtaatctctagtctcaaatgtattagagattgaataatctctaatattaatcctaatgctacagcttcagttctggagatatattgtttttgtaattataaattttaaattaataaaatgaatgtatgttatagttataaattacaaattttcagtttataatttgacctgtgtgactttatactaaaataatgtatggatgagtattttttaaattaagaaaatatatgttttggtaaaggggagtttctcagtttactttttaaaatagaggttttttgtgtgtgggctttttatttgtcataggaatttttacgaaatcattgcaagagtaaatttaacataaaataacagaataaatcaattagaatttaaagcaatgaaagtgacattagacgaataatagtgccctgagttgattattattcagaaatgaatgattctcgtaatgatgtcaaaccctatttattcctgaaaatacatatctgagagcttgtgtttattctaaccatttgccacatagtaatatccttaaagcaaaataaaagtgtatgaagaaatcatatttaactttaatagtatcacagaatacagcaaaaacataggccaaacatttatttttgaagtaaatattgatgtagaaacatttgtgactaagggatcatgtataaataccatcttataaaaatgctgtaagtcctatattctttgcctgagaataaaaatattgtctggattttgactcaaaatattttcaacagcagtagctttgtctaatgaaagcaaaggcaacaaaggaaatgttattacattattctttttatgtaagaaggaacccttctattttaaccatcttcagaatttatatggttgtgtctgccacaattgagtatgcattacctttttggagtaatcagctctggctgccataacacaataaaataaactaggtaaattgatttctgcaagtgtggagtctgggagtgcaagatcaaggtgctgatccatttcattcctgaggagagctttcttcttgtcttacctttttgctgtattcttacatggtgatgagtggggagagaaaatataattaatttattaagagatattaaagctggcaccattgatgtaataatacctataacccctttttatttctctatgctctgatttttatggaaatttacataaatagcaatactaatatcatcccttaaatacattgttaacttcgtgaaacaatgactactaaaacattttactgcaggtggcattgtgttaaacgtatccattcctcgcatacacacacaaagtataaaactcaattttccttaagatggcagtgtctcctgttttttaaaaatgtatttagctggaaataaacaaaatgaaataaataaaaatcaatactgcattagctctgggaagatagaatttctttgaaatattgaatctggaatcatttttctaccaataatgcataggaaaaatatgcatagaaacacaccataaagtatattttccctcaccccccacacacccctacaacacaaaattcttgcagtcaaaagggcagatgcttttacttaggaaaaaaaaaaatagaagggaaaatctgtttaaaaaatgaatttacagcctcagcaactaaatgttttctaaatgtacgcacacctctcctaaagaaaataaggaattttattatttggaattggaattgttatcaaggttccagaatatttatttcgattgtagcattttagatgctttatacatatttttatcttttgtgtttttcttgcttatagatagattcttattttggttgtacacacacatacacatagacacacacacacatatatatgacataaatatatgtatcagtcagtggtgcctattgggcttagggcataatgcacaaataacgcacttgtggtggtggtattgttttaaccaattccattacaattgaaattaatctggagtctacctttcagatttcttagcaacaaaagccaaatcttgtccatgttttatttacctgtaaggtagtaaaataaatgtaaataaagcttttgctctatacattcaggcacagttttttattgaaccatccctaaaggtaaataatgagaataaaggaagggattgaggtggtacaatatgtcatgctctctcaaactgttgtctgcctttaccctcgcaatattcctgtgttctattaataagtatagtaatcccatttgacagatgtgttgagaaaaatgaggtgttctgccaaaaatcatactcaagtcgagagtccactacgtatcgcagagcctaacatacttacattccatcatgctgtttctgcagagccaaatatttatatctattgttcagattcccaggcttcatgacagacaagggttttttttaaaaaaaggtgaaaacacataccaaagaaaagaaaaccaggagcaacttgtaagagtataaactctttatgtaaattctaccagttatattttctaacttgtaattaacgatttgcaagtcttcattcattcctttattcaatacataaagcatatttagtgagacctttctttgttcaaggaactttcaggagtagagaggagtaatctaaagatgtgtgaggcaagaagatttgcctttaagaaattgtaatttatctggcttttgttgatgatttgactgcctttagtagaaagagatgctgggatttttattaaaccaaccaactgaaaatcttaacaaaatataggcacatctgagaaggtggtggagaaatacagatttgttcatttcttatgtgagaatatggataatttgcttttgagggtgttggtatcaaacactgagaacaggagcacaggatcaagtaattagtttttctattaatgggaatgaatattgtcttcacattcatctttttgtccctattggatggcaaaattatgtttaaggaggaagtgacctattcactgtattgtttttgagcagatgtgagacactttaaagatgtaacgaggatacagttgagaattctaggtattacacaaatacttttaccttttgagagaattaatcttctatcttcattttgattccttaccagcatgagctagtctcacttgtatatagaggattgtaaaccttcttgccatattattgacacatgacagtaagttttcagtgagaaatgagttttatcttcagtttgacttatatcattgtatttatcataaactttggctataaattatcttagagaaaaattcgtataggtttcttttctaccatgacgacatacaagaccctatcttttggacaaacgatgtcatctgccctagacagtttttattcactcttaatattcagaatatatgatttttataaaatattattttaaaacgtgtaagaaaatagttattttaaataacagaaatataaaagttccaaataagtggttataacgaaatttgaattaaagagtaaactaaattacatttcattataattcttttcaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggtaaaacctatatcactgaaggttattttgaacatacgtgaaaacacataatatgattttgtaaggaagtattaacatgtagcaataatagcattataaatattaatattgtttcatattccctttcttaaaaattaatctgtgcttttcaggaccatgataaaaccaatggtaagctttagcaggagtctctccaaaagcttccttagagttcagtaaattatgaataagaccttaagaaatacataggtcattagtctgaaaattggtccagagatgagatcctataatgtactggcttgcctaagaccatactgcccagatgaatcccacagccatgaagagggcaaggacacagagattgaagacagttgggctggacaggacttgcaagattagcatattgccaaagtcgcatttcagaaagaatctcaaggtgtctatgcaggggctatcatttccatcaccaaatgacacagcgactcctgtaatcattagccgttaaattcttgccctttctctgatggccaatcatttcatgctgcttagaacttagtcaagagactcatagcttagtatttttttttttactgtttattcattaccagattacctgaaagtgtgttgatataaagaaaatagctgatattgataacatgttttacctcaaaatttgccactgtgttaggccatttacacccacttaatgttttaaagttaccaaattaactagatgtataagacgtttatactttatttttaattcaatgtggctatccagattattcaaagttgggaaattttcaataccttatgtaaaaacttacaatcgtataaatgagacccaaactgaaaactgtctttatgtagattcagagaacaagtagtaatatattttgttacataaaatatttccaaataaatagtagggaattaaattgtttttcttctctttcagaataaatgtaatgttagataagatattgaattatagttattcaggatcatacatgagattactatagcaaggaagatacagtatatacaggttaaaactcacattagccttattttttcttatcattcaaacatattacttgaggtatttttgcattagcctcaccatgaaatcattcaaatgttataaggtaatgacctttgcagaggtttctaggttatccttctcatatagaaggcttgaatagtctggagaattgtctgcttgttgaatctgcctggaaagtatttttcataacgtcaaggagcaaagctactgtgagatctagtaggaaaaaaaaaaagcttagaaaactggcatttattttctttctttatagaataaagataatttatcactctatctagatcttttcaaacactaagctgttaatgacatactctaaaatctcttagttgtcaaataaagtatattcatttgcatctgaattacagaacttttttttttttttaccaatttatttggaaggttctcattatttctttaaaaataacaatcataaaagaatatatgccctgcagatctaagccagtcacatttatgataatcattctaatattttaacataaaattcaaactctcatatatgaaaccccgtgactattgagtacattctcatttctcatggtttcttggtaggtggagagcttaattcaagctataagtttcatctgctgtttcaaaagataaatgtcacatttttaaaaactaaattaaattcatttaaatgcaatacattaaatgtagttgccgatcattccaagtatttggaatgtgactgcagcaaatttgaatatctagagtcaatttcttttttattattttaaaaaatttttagacaatttaatttatatctgctgaatttctcccagttctgttgacccaagaacattatatttattttcgtatgaaagtatttgaacatctagtttcaaatattcaaatacataaaaatgtcaattactcatgaagtgattttttgacctttagtttatccaaacaaagcataatttcaagtacattgactatagttaaatagtatcagttttatcttaaagtatcttaattatatttaatatatattaaattccagaaaaattatttagtgtggcttgaagagatacatatggcacaacttgagaagcctaaataaattggaaaactaggaaaaggaaaattatagtagataaataataaaaaattcttgcatagaaatatatccacaatgtatcatgggtggtggaatggacagggaacattttaaagccacaaattggcgccaagcttcctaaaagacaaaaccaagaagtaaacatatttttgagacccaaagtttccaaattattaaaataataattaaaataattttaactttactagtagtatgttagctttttgctagaacttagtgccagaagaaaataaatgggagggtcataaaggtgataacacgctgattcatattcttataataaacaataagaatgtttatttttttctaccaacatggctccatgaaaaagaaaaatttagtgctaaagggccattcaggaaaagcaattctatgagaggaaaaaatattggagcagaagtctaaagtagtctagcaattgttttcagattttcagattctctattttattaatttttaattttgtatggatacatactgggtgtatatatttatgaattataggagacatttttatacaggcatgcaatacgtaattgtcacatcatgtaaccttctgtgaatatgctttcctgcaactgagcttttaagtagaattagacatcagagatttgaaggttatttattttctctgaatacagaaaaaaattttctgtatctttttcctggaaagaagccagattgtttctaactgagaacacatttctatacttggccctatatctaattggaaagcagggcttcatattcatgtgtatgtcatagtactagaaggcttcaatagctaaaaatttttgctaacatagagttttgggtttgaaccagtcacagagaaattggctattgagccttttcgtgccaagcataattgaagaaagaaaactcaccatcgacaactcaaaatatgttgacttctctaggaacctgtatcaatctctcagtgaatgtatttatttgaaaacacagttgggctattactttagctgtaaaagctattgaaaataaagctcagtagtactctcttacttgatgatggcatttaaaaggtgaagtgagaatgttttatagggggcatgaagtatcaagtactgagtgtgatgaaaattaatatactggttaatgataatactgagtctaaatgtactagtttttcctgtgatatgagaaaactagaattcacttttcaagatcaaaattagcaaagaatttggaagtattgctccaattggagaatcagaagtcaccttaaaaacaatacagattttactaatctatagtaatatatatttcataaagtcttcatgtgacacaaaagttttagggttttggtttttaactagccgtgttatataatcgaggaaatttcctatcctaaattagaaaagtataagcatatttaaagttcaattcagtttttcttacattacgaagctgagaaaaatgaatctaacattaaaatcaaaagcaatctggtctggcttactgtattcatgtcaccaatgcggtttatcaaaaatccctgtcatatcaaatcaagcccttccacaatgatctaacacttaagtttttatgagaaaaaaaaaaaattggattctctatactcatttcacctccttaccgtggctgtgggcaggccccagatgatgcattgtctataatataaactatgttggtgaccaccaaagcagccaggcattcttgctgttccttcatttcttactagattatgttatttaattaatttaatagtatttcatcgcctatttatagggccatagtccatgtgcaagcagttttccagtaccaccaaaattctcaataaggtcccatcacaactatcatttaggcctaccataaaatacacagaattaataaaatgagacaaccatcattgtgtgagcaatacttaagtcagccccatgcaccttcagagaggtactactagcattgagatgaattattccaacttgtagggaaaccaaatagataccgaaagaaagagtttattcttatttatttattttgagatggagtcttgctcttgtcaccgatcctggagtgcaatggcccgatctcggctcactgcaacctcctgggttcaagcagttctcctgccccagcctcccgggtagctgggattacagacacctgccaccataccctgctaattttttgtgttttcggtagagttggagtttcaccatgatggtcaggctggtctcgaactcctgacctcaggtcatccacctgcctcggcctcccaaagtgctgggattacaggtgtgagtcaccacacccggccagaagagtttcttacactggccaaaagatcagttatgttctttataaacttggcataggcttagggggcaattcaccatttgttttctaatgctgtgccctttaaaaaggaaggggaaggttgcctaaaacgatgaaagagatgttataaaaatcaagcttcttgagaaatatagtaaaattggaaacaccttaaatgttgcagtgtgttaccatttacacaaaggataaaatatgtagaaatatacattatttagttatatataatatatagtaaaagcagaaagatgtttgggaattaatataaactgaatacagaacaagagctatctctgtgaggaaagacaaaagaattgggtgggatatgaacaggacacttaaatgatacttgtaatatttcattccttaagatgagttatgcatacagaagtaatgattacatttggtatactttctgtgtgtctaaaatcacatataagaacataagaaaacatacaaaagcaaatgcttgggatttttccttttggaaactccactagccaggttctgtaagataacgcttagtaattaaggaacacccacttcgtgagtattattggtttcaaaagagcatggccactgttcattcggtttgcctaagcattggccaaagattctcctgctgattgagcaacaggacaggaacctagcagattaattccagcgagatgaataaggaacattgtctttccagtttttaaagaggatgtttctgtggctttttttttctttattatctacattgaagcatgatcgacagattcttatcaatgatttccttgtgaaagcagagtcaagggaatgaatagcgcaaaccgagaactgagaattttcatcaaagtggaaccaaaagttagcctgtgtatggtcagtttgtgtggcagcagtgctgttctatccttaagaacacttctattcagagagaatcgttattagagaggacagatctgtaagtcactgggtgaggtaacatcagaactgaaggtcctctgaaaatgatcttatttccctttttgtaaacaagaaaactgtgcaaaaagctccatatccctttctctgtttctcgattactttctttttaaaattactttagattcaggggttacatgtgcaagtttgttacatgggtgtattgtgtaacaattctaaaattcatatggaaccaagaaagggcctgaacagctaaagcaatcctaagccaaaagaacaaagttgagggcattacattgccccacttaaaatatactacaaagctgtagtaacgcaaacagcataatactattacagatatagacacctagatcaatggaacagaatagagaactcagaaataaagctgcacacctacaaccaactgatttttgacaaagttggcaaaaataagcaacagagaagggacaccttattcattaaatattgctaggatagctggctagccatatatagaggaatgaacctggacccctacctttcaccatatacaaaaattaactcaagatggattaaagtcttaaatgtaagccctgaaactactaaaaatcctagaataaaacctaggaaaagttcttctggacactggcttaggcaaagaatttatgaccaagacctcaatgacaaatgcaacaaaaacaaaaattgacaaatgagagttaattaaattaaagcttctgtacagaaaaagaaacaatcaacacagtaaacagataacctcctgaatgggagaaaatatttgcaaactttgcatctgacaaaagaataatatccagaatctataaggaacttaaacttgtcaacaagaaattaaaaaaaaacagattaaaaacaggacaaagaacgtgaatagacactcctcgaaagaagacatacaagcggccaatgagcatattaaaaaatcttcaatatcactaatcatcagagagatgccaattaaaccctaaataagataccatctcacaccagtctgaatggcttttgttaaaaagtcagaaaataacggatgttgattgctttcatagggtgaccatgattacatttgtaatagtcattcactcctaaggatttcaaagtcatgtgggtccaggatcctcaatatgaggattaatgttaccatgggaaccatgaaaagagctgacctaataggggccatatcaattctagccaacttcttgagcttcctaatagagaagaatgcctaagagactctctcaccaagaggaaggcaaattaactagtcagataaatgagagcagagatgggcaaactataattggtaggcctaatccattcagccaccttcttttgtacagcccatgggctgaaaattgtttttatgtaaatggttggaaaaaatcaaaagaagaactagatacttcaggacacataaaaattattaaaaatgcatatgtcagtgtctgtacataagactattgaagtgtatcaatttatatttgtttattttttctggctgcttttgtgctaaaacagcagagttgagtaattgtgacagagactgcatggctcacaaagcctagaacaactactatgtggccattcacagaacatattcaaactcctgaactagaggaaagctaatatagaagcagcaccctgtttgaccatagaattttgccatgtcttcttcttgaatgagtatcagaggtttgacatttctgggatccttttgataggccagtggcgttgtagaattggtctttcctaaatagaatgattcatctaagttttcttcctgctcagaattaaatagtaacatattccaaaccatagatactagaatgcatagcccttccaaaagatactgggtggtgcgtgacacaatttaagatgtttaaagataccatctacttgaagagaattacgaactcaagaatgtcttaggtattctaattcttaatgatcccacagagaaagaatgggagaacttccagaagtagtgaggatgtggtcaggggtgattaactgaagggacagctgcaggtaagaaaactgtcctgtgtccccttaccctgtgaccatgtttccaaattatagttacagaaaaaaagaatatattttaaaagtattccaaattgtttaaaaggtaaagaaaaatttttaaattaaaatgacaggaggaaagccatttgagaatattaacaaatgagataaaagattgatgatgaaaattgacaatttaaattattaatgctaattgcaacttcctacagcgacatagccctttcactgtatttttaaattcacccttcaatcagagtagtattaaagagggtaaaattaatgttaagtttttaaaaatatggatcaatcctagctagctgcatggtccagacaacagcaatgccacgaggcagccatcacagtgatatttatcaccccataaatgttcagatacttttccttttctgttaatggaattttctaggctgaggtgacaaacactgatagctgtagaatagagatgatggaaggaaatggcaaggcaatctacaggagattactagcacctgaagagtttgaatactggaactgcacaagttccttgagctttcatgataacccctactctcttggactgttatgtaggcaatagtaattcattcagcaaaaggacagggaaaatgtgtattttggtctctgatatttcccatgtacataagatattgcctgacacataggacatactcatgaaatatctgtttaaacgtaacttgcaaattaagagttgcaaattataatgacaaagcagttcttgagagaagagaaaaatgctgatttacatttaaaattgtacaagttttataacaaacataaataatcacctgatcaaatgttcccgttttatagatgaacaaatacaagtcctggtacatagcaaaactgtaatactatgcctgatttcaacagttttttccactataccaaattatcataagaagtcttattttctagtaattttaaagtaatctaagcttaaaataacaaaaagctacttattcacaataagcatgaaacaaaccatggctaaatttcaagtgcagaaaatataagtcctcattaaaataataaaatgaaaacccgtgtgtatctatcacctactacagtctgtagtctgtccccactgttgtgattttagatttcaaatattgtttgttagtatcttaatatcactctgattagttgagtgtaagtaaatcaatctgaacatcccattactggccaatattgtttagcatatgaattgatcacgaaaacataaccataggaaagtaaatatgtatgtgattaattagaggtttacttccctgaagatcattatgtttgggaaatacaagctttgacaaagtctaatctatatgattttctgatttaatcactaacattttatttctaattttgttttaagcatcaaagattccaactcagttaaataatttagttccattaaacccctaaatatccatggtgtcatctgaaagttcaaatggtagaataagattttctggaaaaaaaaaatttggtcctatagtatgttcatcctaccgcctgttttattaacagtagtcttagtatgccaagagttgcctgagaggaacacacacaaacacacacgcacacaaatggtattaataaatttaactgaaggtgttaaatgcagaataatctatgtctaaatagccacttgtttaacaaattaccgtgtttttcacgtttattttggaaacaaagttttataatatttaacctcaggaagaacaaacattggttgctcaattatcctttggctttcagttcactcttagaatttaatgactatcactcaataaaaactcagaatgcatctttctgtttgcctgtggttttcaacattggttgcacatcaaaatcacccgagaaacttgaaaagtatcccaatgtttggggcccacttccagagattctgatttaattggtctaactctaactagctctcttattcagcaaagttgagaatcactagataatgtgatacaagatccgcgaatttcaagctgtctgacgagagcctaaattcagctcagtcaaccatgtcttgtatatatattttttataacagtaagatttcacagtttaaagagatctggtttctggtcctagattatctggataactgcctcaactcatcattcctcttagctataaaaatataagaactattacttactctaaagtctgttatactctcattcccctgaaaaattacgtatcttttttttttaaagtgagcagagtaatttatctgtgaagtgaaataacactagcagatcattaacttggtgcaatgaatgcatcaagcagctgttacttagaaaatagaacatctgttacatgccattggagtcactattcactgtcattatagttagagctgttatttctgttcagttcattctgctttcatgaaattcttctttaataaacaatacagtgttattaaaaagtcaatacacattgctatagaatccactatttaatgctttatgttctttttgaatgtatcattatattattctgtcacattagcctaatagtaaaatatgtcctaaacctctagccatgatagagtaattttgggggctgtaaaagcaattagcatctcatttcctcatgtttaagacatgttagattgtgtgatgcaccattgatatgattacagctgctgagaatttaaaaaaaaaaaaaaaaacactaccactttcaaggtaaaccttaattgtatgttacatctcaatttccgaatccttaaaatgtgacaaatgcacatcttagaattgcagtaatatggcaatgtattccttttctttccacgaatatgttacgtagctaaaaggtgaaagaaccctctcctgttctctgtgatcagaaatggtataatatttgcaaatactaagtgcagaattcacctgggtagggggacttctcaagatgccttttatggatgctttagttagccttttattcatattacagggaacatgagtaagagaaaggaatagctaaaataagtctgaatttaattgagtcctagtaaagggaggaatctataaggaaatgatgttaaggtacgtaggtaaataaatgtggtgctgattgaagataagctctagagaacaggagactcttaagataataaaatttgtttaaaaagagggggtggaaaaaagagatcagacagagaagttatcttaagaatataagtccctgagaaattccaagaaaatctgtggaaggtactggaaaacttgtgaaaatacgaaatgggtggaggagagaatagaggttaagtgagctacatttctttacccctgaagggaaatgtttgtaaaggtgttcctataggaccagatgatttttccaataatttttaccgttctaccattaaataaaaataatgaaaaatgctgatggtataatcagcagagaccaatggagaaggtttttccatcttgctactgtatcagtgaagtgagccgatagctgaaccctgaaccgaacatgcctttttaaatttctacaagcaattatacttgtagatatggggaatgaatcagaatgtattcttcatccttcccatcaacatggggcatgacttcactggaagaaattaactcattatactcattcttttataataaggaaattagagtagcatttacaaattatggctaagaagtagacagcaaatttgtttgaaatcatggaagttagtgcttagtatttggactatttatactggagctatcaaatgttacaaagtaacatatggaaaataatatgttagacattgtgagaatttatagtttaattggattttacttatgtcagatattttcccctctatcataaaaacccttagtgccaagtatatagtttgcgttcaccttctcttgaatctcctgaaggtggacttacaatcatgtcataggtcaagttaaaactgagtgtacacaatcttgctttttcttcagccctaaaatcgatcctagcagcaatcacattactacatgactgaaaaacctaaagtgtctgagttataatttagtgaatttagtcattgaatttgaacttgctccttcagaagagtagatcttctagaaccctctccacttctcacctcacaaggcagaagaaggcatgtatgctgagaatcggatgcttttgaaaaggaggaaatgccatatcttttcagctgtttctttccatctcgccaaccctataaataaggagctccctttgagaggaatgagtacaggtataaagacaatggccaaggcaatagctctaggttggttctccatacatctgaagatgcagacattcttgtgttgtgggaaactattagagccagagaaaatggttcgtcaacaacctcatcaaatgtattcttttagtttacagtaagaattccctgttcctctatggcagccttgtattctaactttcataccttctcgttgcttcgtactttgtctttagtcaatccaaaccatcccatgcacactccgccttcaagtgtcacctttcccttgtagtcattcatgcttattccagccatggctcatctgtttccaaaaaaaaatgtgatttttttctagtatgatatcaaattgttttattgcatttaagctttcctctgcagctacactgtaggcatgattagagtgaggtttgcaaagattacctcattcctcatctctggcagtgaatagcacagtacagactggatattaggcacctgatatacattggtcaattagtatttcagatctccagaaagcaagctcagcatagtatttaaaggctaagtcttatttaagtcttatttcttaagtcatatctttgattaaaaacacatttgagggaaaaatttaaggcctactaaattaacacaatattttttcctaacccaaaacagcatgtatacaaatgattgaatactggttccttattgttgaatagcatacataaaagtttaactctaggtctctttttttacagagtgtaaattgtcctgtgaatcacttttgaccattagcagttataaaccaccatcatatcactgcttttttcaaatacaagttgataatggtgataaattgaacatcttttagttttaatttataattttgtggaacttaagaaggcactagaaattagtccacatttcctattttgttcccatcaactgaacatcactggacattgtttaaattagctggaggaatttggccagatgttgacacataatggtttctgtgacccaggaactacctgcaacattatcccctaagttcaaaacttttgtgatctcttctgagttttggaaaattccattgcctttaattgcattgcttgtcatgtaagaaacaaaatctatgtacacaataactttttacattgatgctaaaatatagtgtcatctttatgaagacttattaagagataattagtaatccaaatataaattaagcttcaactttgtgaagggttacctttgtgaataaatcaactacagcgagatgccagtagactggaatatagaaagtagataattctcatttgcgtatatgtccatctctttgacaaactcatacttggatataagtttttgaaggatggggacttctctaccgttttatcccacagagcctagtaacaatggctaacatctatggttgtagaggttgtatactacaaaaggttgaagtcaaagtattaaaaggaataaaatctagtctatgtctactctgaagttaagctctaaagggtctgtatctacccaaatgagagacttctaataatctcccagaatatattgaggagaattacatatgattctgctacagtagtaactggcatataataggagctcaggcaacacttacgattgataaatgaagaaattgcttttatgaattgctaagctcacctgtgtgcaacaaatagcacctacatatgaagaaccccatgcatgatagctgtcgagttcatctggcattaagtaccttaatttcaggcatgtttttattgaaaaaatgtgacataaaaccatatcttagaattgaagaaacagtgtttttgtcttgcataaaaatttttatacattgtttcctcatttatttctcctgtttatccgatgccaaaggcaaaaccaaaacagaaagtatgagaagtgatttcgagtggaccaggaccttatggcgtggcagaaagacagccacaggactacttaggtatattataaagatagaaaagacatgttgagagtgactctatgaggccagcctatacctaatttcttactcttgtactgtaatttttttcttaagaaattagatgtaggctggcattacagagctgctccttgtgtgtttattaattgattatttgtatctggactttctccactttcctgttattgctgtttctcaatgattttgttttgctttggctttctgtgattaagacatcagctccactcgcaaatagcttttcaactcgagtgccaatcacagtctctgtatctgttaaccttattgagaaaggagaaaaagggtctgttgggctctggctcagctctctgtgaatgtcccacagctggctaactagacaggcagggaaagaaccaggcacagactcagtggaatgccgagtggccacattgtctgtcagccgtgccatgtaccaggaaaggggctttatgcagggcaggtagtaaacctttgtactaagatcactttttccatcactactctctatcttttttcatgttaaatgtgattgttttcatgttttataaatcacctcttaggaaatagtggtattctcttaggagattttagtctagggtatgtggatagaaataaggtctgtgaacttggattgggggaaaactttatctttatttgtattcaattaaaaccaaaagtaagcagttttttcagttaaaatgtgagcaacaaactccagcaatagagatacccatgactttgtcactaatagaaatgacagatacttttataacgtgttccagacattgtacatacttaaaaataccagttatgctcgtcatcactacattgaaattatcctaaagacctgatgctagatcttgttaattaacatattaggaaataaaacatgtattactacatcacaaatatttaaaaaatgtgttgcacattgtatttcagtataattgttttcatttaaaatcctatgtattttgttttatgcatttaaaagcattattatgagaatgggtttttaagcttcaacagatgccaaaaagatccatggcactaaaaggctaaaaaaatccctgctgcagaaatacagtagcaccatactgtagaattttctaagggcagtttcttatttgtggatggattttcaaatatctgcctttagccactacatgtataaattaaataaatataaatatatttagttgaacaatatgtatgtttattaaatatttataatgaaaaataagacatgaattatgcttatgtacatatatatgttcatagttacccaacaatgaagcttcagtatatatggtatggttttcatgattcattaatacatagttataggtttaaaaccttgcagaatcatagtaaccatacagaaagccgtttcataagcattaaatcttaagactacaagacattacttgaaggtcaatgctctccttttcacaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggtaagagaaaaggctagaagcttttacacccttctctgtcacgagaaaaagatacataagtgaccagtaacaattctgtgtttgaaaatttctcaattctacgtatatgctggctcttaattcaatatctataacaatattttaatatatttttctttatatttacgcaatattctatatgaaaataccacttaaaactaatctcaatgaaactttattgttgtcttttaaacattttagaacataggaaaaattctttaagaatattgtctaaccaataatgccatggtatgtctctgtacaattaaggaataccagaaacacatggaaacttttgaccagaatgtggaccacatcacaaagtggatcattcaggctgacacacttttggatgaatcagagaaaaagaaaccccagcaaaaagaagacgtgcttaaggtagcaaataaaatatgaaaagtaatgtccaaattgtacaccagttacttcaatcatctttgtcctaaaagatactaaggacgtcttaataagagtaaaacaatcctttcttccttcctttatctttccctttttccttccttccccctttgaatggaaatgaatgattttgaagagttctgtaatctgactttctgttcaaatccatcactcagttaattatacccaatgtaaactccgttcagaaagatattccaagatttattttgaaatcatattgcaaatttctgcctttgtcaatggtggtactacattcttgtgtctaacacaaagaacaatctgacactatcattcatttagcccatctgaatgaacacctgaaatccagtcagctgatttttttgcctatgccatatccaaatcttggtaattagtcttaatgttgggcttatgtaaagctgaggttttcatttttaactacatgtaaactaggctttgggttctttcttttagtctcaaaactgactgttaggatgccctgtcttctttttcaaggggaacttaatcttttctttaaaaaatgattccgataaaagggtatgagaggtgtaatacgcaaatataccttatagacactacattgtttctatttgatgatgtctcttttcccaattaaataggtagagttgaattttaacagctctcttttcaataaacattttttattttgttttgctgcaatgtttgataaatttattgattagttgtttactatttaaagaaaactcaaaaattatgtttctttctatgcaatttatttttatgcctctgatattttccacagattacgatatacctttaatgaaaaactataaattcattccaggctatccccaaaacacatttatgccattgtctgaagcttattttgatgtggatctgtattgtgctcttcattatcccttgatgtatagtcagagatgtcatcttatggtgaatttccttcaaggctttttgaataatagggtctgagttatttaacttcaacctctgtgacccggcaggtcaggaagaacattcctcagtacctctgtatgtgacagaaaattcgtatgtgttagaaaatcactttttttcttatgacactcaatgtaataaagaggaacttgaaagtgctaggaaggaatagaaaagtgttcttcagctacctgacctcctgagcacatacttagttcattccacaactattaaattcagtaacgatataataaaataagactaaatagaatatattatgatagttgcaacaacatagttgggaaaacatccctgtccttcctcggactaaataaacattttaaatagacatgcatcaaacttaaggacggtgatctatttttctgaaatcacacgcattttcattttagtcctgttttatggaagttgtggttttatctccctttgtattttctgcatgtgcttgctctcattttcttactttctctctctctctttctcactcttctcgctcacttgctcactcgctctgtttggctctctttttctatcttgaccttcattaattactaacttcaagtcctatctcttgctcatggaatatagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggtaggaagatctactccaaggtggaaacttgtgctaaatggtctcttgcgaaggttgcgcagtactctgaaaggggcaagtagaccccacagcaaggttttcaaaaggaaaatgaatgccaaaatgtatttaaggaaattttaccactgattataatgggagataaacgccactcctccccgtctctgtctctctctgtctctctctgtctctttttctctctcatcttttgctgccatagatattctaggactgcattctatgctgcagtttacatacgtactttcaggggtcacctacagaaaaaaataacaaatagcatgctgaaggccaaaaaaataaataaaaccaaaagcacacaagtcatccatcaacataaagcactaccgataaattttgccaaaagcagtactgatacaatattgcttgtatgtaatgtggatcaaatatccaaaatgaggtcttgtacatcttctgcacggtctagggtgtttttttacctctttactggttgtgcaagtgtgtttgtttaacttgcttttgctagttgtagacactgtgacaaaattcattaggctataatgaaatgatcacgccatgaaaacaaatcattgcaaagcttacatatcctaatttttgtaattttatatgcctatttatattactgtttaagaagaaccagggaatatggaacttttgcgtgatagactttatatttgtgtatgatttgatgaagagaaagtcttatttaataagtagtttgcaaaaatgtataaatatagtgttatagaatttcagctctttgggaagatttgaaatgcaagtaattacctagaaatttatatactgtagtttgataaatttcaatatatatgatatgctttcaaacataaaaatgtatataaaatcaatatatgtatttaggtatatagataattgttagaaataatctgaaatgaaaaaaacattggagtatttatgagaaaatatgatgcagtatgtcaggtaagtattgattcctggaaaaatagaacattttcaaaaaatattttgatagatataagcaaccagtaatagcatggtttcacaattgctgcactttctaaggcattacagtgtctcatcatgttatataatagtacatatttaaagtagttttcaaaataagtgaaatgtgacatgataaattctaaatagtttagcttgtatgcatgagacacagttacccttcaaaattcaccttcccaaattaaaaagttgttagtttaccttaattcattgcaagttatttttaatagttaactacttagttctcttgtactctctctctccatacatagagaccttatatagttgacttttaaaaggctatattctctacatatggagagagacagcatgagagaacttagtagttaactgtcacaaatatatatatttgagtcagtcattattacctgcaaaaaaatgtgacaggctcttaaaattgattaaagttttgaaagaatgtattgttacttacaaagacaattgtttttacttctaaagatatcaatggcttatgtaataacaagacaatgaatggagatttatttcaatccttaaaaaatgctactacttcattactaagatatagacacacacacatgcacattttaataaatcactaagctatagaatatttaagagaaaataaggtattatctttggataaattgtgttacaagattgtggttcacagatattaaaaaatgggtagaatttgctctccaccacagatgtgacagacccagccaatacaagtttgtgaccaagacaagtttgtgagttttcatttcacattctgcatgaatttgtaagtatacttctggaaatcatgcataaagtgatccactctatgaacttcttttattttccctagaaacataaggcataagaaatttccagtgaatattcatttattattattattattattattattattttgtgtgtgtgtgtgtggtggagactctctctgttgcccaggctggagtgctgtggcataacctcagctcactgcaacctctgcctcctggaatcaagtgattctcctgcctcagcctcccaagtagctgggattacgggcgggcgccgtgacacctggctaatttttgtattttggcagagacggggtttcaccacgttggccaggctggtctggaactcctgacctcaagtgatcctcctgcctgggcctctcaaagtgctgggattacaagcgtgaaccactgtgcctggccccagattttcaattatatgttaattaacaaaataatcacatgtttgcttttcaaagtatttgtttttctctaaattagtaaaggcaactgagtgtaacaatgaccccattttagggctctgaagagataattatgctctattatcacgatgaaatgaaaaacacagaaataaagcatatctgacactttgcttatatattcattgcatcagctaatgggattgagcttccattgtgttagagattgtggtgagaagatacaagggtataaagatccttgcttaagaaatacatgttttcaaacagaaatgaatacttagtataatcataaaatatgtttaacactaattcatcttcatggggatgttcaaataatggtgagatgatctcggcagagagaacaatagatttagaaggtaatctcaccagagaaaacagtggatttagaagattgagatttaggcctaactttttcagtagtagccagaatatgtgatttttctgcatatccatttcattgtttgtaagatgaggaagttaaaatagactaacaatttttaaaagaaaacctatcctgcccaaaatattattatttaaaataaagtattaaatttaaatatttaatattaaaatcatattatttaaaattaaattaataaattggaaaataatagagttactagatgggggaaatatctgccattttatctttctccttcctatgattgaattcaggaagtataaattatgctcatagaacatggtttgaaatttctaaattagattagttcataaatccctgctcgttctaaaatttggctattcagtaatcttttgttgattacaataagaaattgaaaacatttaatgtcttgtgtgtgtttgctctggagtagggaagtgctgaagtgctggaggttttagggggtagcctttgatctcaaaatcaggtttctttatagtaggggttatacaggataatattaggttagaatatggcttttctatggttgagtctatgtctaagtttcatggaagagtaacctggggaaaaaaaatactatggtgataaaaaaagtagatttggattgaacacgggtaggtcatagactctttgtaatcagtaatttcagtatagcctttagaacataactctaaagagcccttgaatagagaaataacttatgctgaaaattcactggtgtctagatttactatttggtgaagaatacaaagtggggtactcccatgtctcctgccaggactgttcatgacaagaaattccgaagcccagaaagcagtgagtaaagggatcctcagttcagattggctgaggacttgactgtccaagtgcagctctctgtaatgttaattttggcctcagcaaggagcagtatggtgagagcaaaaagtccttaacttcaagacacaagacctgctttgagcactagctgagcacattactacttagtgattttggatatgcctctttacctctcagagcctcatttctagctacaaaataagggagatgatgcctgttttattttaatctaaagattgtaatgaggatcaaattatgtaatatatgtaaaaacatgcatttaaaatgtattaatcagtgtatagatatgaaatggttaaaaataattaatatcaatgggtatttccatcgttacgtatattacacttgaatggccgaatctggggggttgagacaaaaactgatggaaaaaaatgaaagaattgctgattttctgtggtctctgctgtaatcgactggagtcagaaaatcgtgtctttgctattttcatgacaaagaccagccttaaagataatgaagtggatgaatttaagaactactaaggagttatgtttgtcccacatacgccccttaaaatacataaaaatgctgccttttcccattttattaaggttacctaagagtatccaatgactttgaaaaaagcgtgttttttcgtaatctatgtgaaatcaatgtgaggaaatggcagttttaatggagaggatcagaattgcaacagtcaatcagagataatattagaaccctgagtaaattgacagaatcaatgaggagagactccttgtctcaactgtctctgttttagggcatcggagtatagtggcatggctgagggcaagtggataccatcgggaaaataaggtgataggagacaaaagtataggaaggggcatgggaagacaaaaataaactgattatttattcatattaattatgacagttctacccctctccatccctctagaagccaagttggagaaggggagtcagcaatttgggagagatgctagttgaggtatatctaaaagcactaatgagtgaagacttgagaaaagggattaatcaggatgaattctcaccaaccatatattattttccgataacagtgtttggtagtgagggggatctattgctaggtaaaatacgatggattcaaggagcttactgtttgatgatagggcaagatgtgttcatggatactagattgagagtgagtgcatggtaagtgagtttagcagtcactccagcaacacagaggaggtaacaattcggcataaacatatgagaaagcttaggagcatacagtgtgttcaatgaagagtgagttcctttagttttcagagtagagggcatggaagataaaacttagttgtggatgataaggctgaagattatggctagacacagtgtgaagaggtcatggacagccagactaatcattcatgcttaattcagtatgcaatgaagagttcttgatgtgctctgtgtgtgtgtgtgtgtgtgtgtgtgtgtgtgtgtgtgtatctgtgtatgcactgttgagaaattagtccagtgatagttgtgaggagaattccactgaataatgacatgaagttcgggagctattgcagtagtctagatgagatacactgatgacctcaaaaaaagggatagctatgggagtggaaaggaaatttcagtctagatcagtaaatcttttgtatgcacttgggtgaattgttaaaaccagtgtgctgggccccacactcagagcttctgactcactaggtctggagtggagcacaagagtttgcatttctaacatttttctaggtcagattgatgctgaaggtctagggaccacgcttagagaactgctgctgcggagatatttagaggtagcctagagttaagtcattacatacaaggacccaagaagatgatgaattcaaaaatgactccaaatttaactctgattgactaggaaagtctgcatataaattccaataataggcctggtgcggtggctcacgcctgtaatcccaacactttgggaggccgctgcaggcagatcacctgacgtcaggagttgaagatcaacctggccaacatggcaaatccccttctctactaaaaatacaaaaattagctgggcatggtggtgggcgcctgtaatcccagctacttgggaggctgaggagggaaattgtttgaacccgggaggcggaggttgcagtgagccgagatcgcaccactgcaccccagcctgggcgacagagtgagattccatctcaaaaataaaaattaaaaaaaatttcaataataaaatatgcatcaagttatatttttattgttgtaatacttagctgcaaaataattttgactaaacaaactttaggtgtgtcatattaataaaggcaattattttactttttacaaaatattatgtaatttctacataaaatttgcttagattgtatttttctagagatttagatatacttcactgttctaaggagctgaaatgttaaattatttattctgaaattgatactaaccagaaaaaagtgaaattattttctctgactttgatcctttactaagacttatttgctataggatatatctggcatatgttctttaatttccatataggccttgaaaattgctgctaaaattcatgtagcagtttctatatatatgtattacaactgtaatatgagatttggacaatcgggcatcaaatacttaaatattcattgtttgattgctgcaataattgtaaattaccaagtttttttttttttttttttttttttttacttccattcagtgtcagaagatataaaagtaatcattctttggataagagactttcacaagtttataggaggctgtgagagagtcagtgaccttcccatgtaatgtagaatatataagaaaaagaaacacatgattgggcctaatctatcttaaaatatggttctatgtgtggaaaataattaagcagtgatttaattattttggctctcctaaacttcggtgggaaataaatgatgcattttataaatgtgatctagaaggtccaatgaagatgtattggattgaaaatttttaattaaagcttaattttctgtagtcagatttatcaatgcaaatacattgatattttgcagtctctttctgatcgtattataacttaacacctatgatggaaaataatattgtatcttaattggaacagtattcttgctatatatattctttaaattttaatttttttaatttttgtaggtacattgtaggtatatagatattcatttttagtaaaattttctataaaaacatgaaaactgagatgaagacttgtaaatattgcataatttgtagagcattaaatatgtaatatttacaactaatatcttcaggtaatagtaacagatcactagtcaaactgtataatatctgcaaattttattttactaaaatgaatcagaaaaatatgaacctaacaacataattcttatgttagcttattttttccacatgtgtaattggttatccctataacaaggttaagtccattgaaacttcgctaataaatccctttggtaaccatgtaaaatatttttaaagtagatgtgtaattgagtttggtgagcagtgtcatttgataaaactatctgggtcttgttagcataacatttgaaataattaaagctatttggtgaatcttgattgttctcctttgataaaggaaaattagtcccctgatcagtgtcagtagatgtaaagcaattttgctttggaccagagactttcagatatttataggaggttgtgagagtgtcagtgagttgaccaagttctcacagttagacagtgtggttagcaaatactagatctcagtccattgctttgtccacttcaatacactgactcagcatagtttactgcctctatttatgtcataaagtagtttttgttggtctactatgtgttagtataaacatacccaatttcacttcaaatacagtgatttcgttatactttttgtattaaaaatgacaagaacaaaaggtggtagggaggaagaaatggaagaaggaagggggaatggaagaaataaaactggaaaacaacctaagtaaatgaaaagaaagtttaaaatacaaaattgcttaaagtgttatgtttttacttttgtctgtctcccccatacattttagagttaaatgttttcctcttttaattcatttcctactccaaaaagtcatgtaatcatgaaatagggcaatattctaagttaaactttataaaaggtcgacagtaggaagcagattcttgacccacgaatatattttgcatccagttttaaaatgtgtaagcatgaaattaacctcatccatacaaaatcaattgaaatctactgggtaatatcctctaattagcctcacaaattagtcacattttcacatttttattatcaaagcattaaaggtaaaccagtactttatctattctcaaaagaatgcaaccaatgaaatgtcactatttggagtcaatttatttaatttaaaaataatatttcttacattttcttgtttgctctaataattttaaaataatagaataaataagtttataaaccatattttaaataatctttcttctagcatagatgtagtatctttccaatacacttatttgtttttgtaagttcttttcctctacagatagaatgatgtgaaataactcttcatatcatatcagtagtctgtcttttctgtactatagtgtgttacttgtccttgaaatttttcatcttggtttccatgaattctttatttttctatatcaatattgtaatgataaataaattttcaaagctgcagaatggaaaaaggagactgatggatttgaagcaattttaaaccaatctgtagcacttggattatttattttcaatttaggttttagtgtgatttgaatatagtggtaatttatcatgattattaagattccatagtccagattaacaaatgtttacttgctgtctgtgtaaacacagtcgttattatgctagtgtatctgtgcatgccaaagtaatatttaaccaaggaaagcttacattttaaaactaataaagtgtatctgagtaattttgaatgctttcaatttacaatgaatcagtttgtaattgatcttgcttttcttcagtctgttatcctttgttaacttgttataaaattcagctttaatgccaaaacttcaacaaagccttaaatttcattaatccttaaataatccaacaaagcacaattaatagttgttaagcaatttgaaacattaaaaaatcaaggaaaacaaagtgttgtctttctcggtttctctgtctcttctttatgtgtccatttatccatttattatacttccctgtcttctaatttatatgtattttgtatgactgcacagtcatgctaaagctcttaaaatgaaaaggtaagtaaaaaattaaaagtgtccaaaacctatgcttggtatacactttctcatgcaatattataacttttgtttgattattttctatataactaaaacctattttgtgtgcactgtctaacattgtgtgatttaattgtgattccagttcttttgtggtcatctatttcctttaaagtcaatagaagtaacttacccaataattaagatgatttatcagccattgctttcaactgttttagacaatttatcataattctgaattgaaaagcaggcatgatatactttgtgttttaaaatttggtgactcaagaatgagctgttaaattataaacgctttcttattacatgtttcctttataaagttgcataagaattccaagttacaaagacagggaagaccaaggaatgacatgtagaattttaattgggtgggaaagtgttttctgttttagaatgggcatagcctaatgctgaactagtgaactcttaagaaaagcaatgaatttttttcatctctttgtgtccaaagactattaatcatatggctgtcaaatggctggtgctatcttgccaataacatagctaaaacaattggtttgataaacttattttggttataaaattggtcactggttgattaaattaatatataggtagttctaaaactaccgattgatataataagcaccttttcctgtataaaataaaaggcagtgttttcactggaaaatagagtagtataagacatattgccaactttaaggatggaaaatttatttagagagacaagcatatatctttgaaagccaaataatattatattcctgtctataagaaagcagtgcaacacaagctgagatacacataaatgagaatagaaactcctgaaataacaggtcaatcccactcccgtaatttttcctataccccgaggactgcctgaaaatttcactcagaacacataatgcaagataataagaccgacgtaagaataatctaaattcaccacaagttataaacaaaacattactattttattcaaagtaattatgagatattagttctttacaatgttatgagtataatggttaatagagctctatactgcctaataaggtggtcatgaaccacatgtggccactgagctttagaaatttggctactccatgttaagatttataaataagtgtaaaatatgtgtgggttttgaagagaatataaaatgtaaaatattcatatttttgtattgattatgagtttatacaataatttggacatctcagtgaaatcagtaaaattaattttatctgttttttgttttttactatggcaactagaatatttaaaattacatatatggcatgtattatatttctattgagctgcactactataaaagttctacttgaatttagagacaagaacttactgtaaggttataaaattttaagaaaatgtctgtgtgaaaaggattttgttcctaaaatgtgactgaatacatcctcatctagtctctgcttataaacatttagcattacttgaaaatcagtgtttttaaaaaaattgcagtcctcatcagttgttcttatataaacctaaaatttaggctccaaataatttttgcccactgattttagttaatcactttgaaactacacaaaataaaactactcaaattcttaatcttcctaatttttttaaacaaaatgcacggtagtctttcattggaaaatttagaccctacacattgaactaaagaagtctaagtttccattatcttgcctgaataattagcacttcagtttttggtagtctctcccaaagctctttttacatcttcccccttttttgtgtttacctggtggtatcatgttgcttagcatttgggcagcagttaatatacatactcatataatgctaaccagtcaggtcttttgacatttctacatagaaattgtgttatttaaaattccatgtcactaaaaaagctccttgaaatgtctattttggccctcaatttttagtcttttgttcatttattttttcaggaaatatttacttatgaatatttactatgtaccagaaatgactgtaggttgaacatgagaaactcagctccataggatgtctagggaacacaccccactgactgtatctgtggtatgccttttctgtctccaaataattcctgattaaaaaaaaaaaactgcaccctgtaaactaaatgcaaggctgtgatatcactttttatattgccgcagataaattaatctgtagttttgttcttcaggattatgtaactctaccaaactggaatctaaaatcctccatgttcaccattacaatgttatgatttcatcaaatcccttggtaaaataaagactcattatatcaataagcatgtattttatcctttaaaaccatagatttcaaaggaggaagggcttgacctgagccaatggatgattaggattttgagaggatcaaaataagacccaagatttatagagcatgtatttatattggatggacacatagaagtttgagagaaaataatagtcaacatttattaagcttttattatataccagacaccattctaacatatttgatcttagtaatagccctgtgaggtagatattcatcttatctccatgttataaagaaactgaggttcaatgaggataaataacttgtctaagttccctcagctagtaaatggtagagcccagattcaatctatgcattttcatacagaagtttatgttcttcactagaagatgaaaagtattctaaggtcattgaaggaggcataacagaagatcaccaaatggcctgcaaaaaaaggtctatattaggaacacttacataaggctggcaagtctttggggcaagattaggagaagccttgactactgtgctggaggttggactttattctatttatactcaatagatgcaggaggttcttcagcaaataaatagcataatgaaagaaaggtttttgaaacatagtaagctgatcattgggcacaggctggaactggtttgactgaaaggagattttacatcttttcaaagcttattgccttagttttgtgtaaggaccaggaacgatggagtctctgggaatacaaagcaagtggatcatagcaagtcaattgacacttacttgatatttattagacattagagtgagatgttcaaaaatagcatgacttacgttttacgcctgaatgactgagagaaatggtcttccattaagagaactagggaagttagtattgtaagcagtttgcgggaaagataatgtgctccatactaggaatgtgaaacttcaggtgaaaattcagctggctattggagagtctagatgggaattcaaaagtcagataacagcttagggtgaagacttggaaggcataaaaaattgttaaattcgtagaaaattgtatcttaaattaatagaagttaaattcatggagagatgagctagagaagaagcagttggaataaaacaggtaaatctgactgtaaatagacctatgttcttctgacatccaagtacacaataaaagttattttcaacattatcattatgtattcacaaaatcacatagaacatagttgctttcattaaatattagcaaatgtgaacaaccatttaataacataaaatatcaccaaattgataattgtatagttatgattctaagggttgttaatctttttacttttaccgtcatctaaacagtgtatgattttattgtaccgtaattgctaataatacagacattgaaactttaagcatgtttgtaccactaccaatctatactggttcaaataacttatgatatttcaaatggcaaatgatcattaggatttaaaaactggtactgtaataggtcacttaaaattatctcataaatctttcaggggtgtgtagaagtacctagaagatatgtggttattcatgttgcatatgagaatcatgtcatcatgaatagaatttgattattcacttcttcaatagtgacagattattacctttagatatttagtttttcttctacacttatccgtattgttcaccagaagttgccatctaataaaaattcaacctcttcctgggaatgtgactggagaagggtaggtggggaccaaacttgatgaatgtaatcgtcttggcaaaagacacgggggtcattcctgaattggttttacaaaagtaaaatgttttagctctgaaagaaaatcagatttctgtatgtcatctatgggttttcaagagctatcccatataaaatatgttctagtgttttaatggaaagaaatacagcataaagattgagagagtatcaatgtattttattaacagaattttaatctaataactaaaccttgcccacttttttgaatatatatttgattttccatgtcttttcacttatcactccttttcaagggttttgtttagaaagtcaagagattttaaagttttcttagactggtcattatcagttcaaaagtaaagaaactgatgtttacaaggttgaaaagcatagattctttatgtgaaatatattaggttcattcgtttgaatttatttgcatcaccaaccaaactgttcctaaggcaagctaatggcattgtcttagaagagcatgcctgtcaattgtgctgtgctaaaaatgtcatttaaaacatctgagcagattgccatgtagtttttctaaggataagatgacaattctgcatttctacctgaggttactgttacttgataaatgaggcaatttctgatgagacatatttacccaaatgtatttatatcagaatatttaaaataaggtcaaatttgactttagaatattaaaaattagcccattcaaatgtatctgtaaattgactgttgttgatatcaccaaatgatgaattgtactatcttgcatgtatgttcagctctggtgatgtgaaatgtttctccttatttgcatcctcaggtacttttccagttgtatttcaaaacccttcataaaacataatatggaaacataatgcatgtgattagtttagcaacaggaggttgaataaatgtatttcttttggtttatgtttctaataaaaagtaattttgatttaaagtagcactatctttttttttaggcctccattcctttgaaggaattggagcagtttaactcagatatacaaaaattgcttgaaccactggaggctgaaattcagcagggggtgaatctgaaagaggaagacttcaataaagatatggtaaattggttgtgataaaagtgtgaatgaactaggagtggaaataaatatttggaaagaacttagataagtctccaactgaattttcagagcacatattacacattttatgattctaatgaattttataaatgcagaatattcttggccttttattacaaatgctgaattactatggtatggtaatataggagcacttacggtttctaataaatagcccagcaattttcttttgacctgacctacttttgaacttatcaagggcaaaatgtaattggaaaaaagagtcgaatcataaaataaactaaaaatttaataaaatactcaactatcatagatgactgacattttgtatcagcaatgtttttggtagtataacatttatttcaatgaagagagaataatgcataatatgaacattatttattacaatttcccacaaagttgttttaccaaatagttgtttagttagtacattatatgtctaaaatgtgtataaattcatgctgcttatttcatgggagtaaagaaatatgaccatgtgtgctcttcccaacctcagaatattctccttcaatcccaactaatttcaaagtatctactacatttctctctggcttgaatatttgtacatcacatccttattaactgactttttttttctctcttcatcctccttttcacaattttttcccctctttcactgccatcacctctgtggcattcttaacctttacaattaccagtgctagagccttctcagacaatgcttgaaagtgacatcagaagacaatatataaattttaggtaataagtgtgtgaagcaataggagaactattcccaccaatcttagttcccacttcctggagctgcctcaatcaatactccccatgtatggggtttggtggccttgccaactcagcttgtggaaagacggaagaggctttccaagttgctgagttacagcaatctctacttcaggtcaaagaagaaactagagggcaccaagatgaaaaaaagtactgattacctcttgggctgaccccaactctgccctagagccctcaactggtatagggaaagaagtgaagtgggttttttaattttttgttgtttttgtcctcagccctagaaaatgctacagacttttacaacaccttttaaaataagtaaagtcttttacagactataagtatatgatgtgtctatattatgataagtatataatgtgtctatattatgccgtatgtttctttagattattgaccagtctctgacaaaaataatccctttcccccatacaaaatgaatcagtcctcagttgcgtgttgaagtttatgcattatagatttaaatatataacatctaattccttgaattgtaatacacacatacaaatacttgtgacttttgaaatttattatttgttttccttatgtcatcagtgtaccttgagtaccattacaatgtgagactacttgatacaaagttttcacattctgagttgaaagaaagaaaactaaaggtgaaaaatcacatggtcatatatgcgactatattagaccagcatttattcaaaacattttatttctaagtaaagaaaattaagatattgttcttgcagcctaaaggaacaaaatacccattgaaaatgtttaaagccattttccagtccatattttagtattatttgatcgtatttaaattaacatgcatatatgacatattttagaaattatttgatggtaacttagcacatgatttttattaatatcctgatatttctcctattaatattgagcatttaggtttcagaaatgaagcaggagttattagataggaattagtgtacatttaaatcaaaatattttcatgtagttgtgtgttaatattttcagatttgctgttatctcagtcacaaatacacatctgtattcctttatggatcagttaacattataaatgataactttagctcatttctctaatgttttaatttctagaactacactaaaaaagccaaaagaatactttcacagtaattcatgacttgtctgacatgatgaagtaccacactcccccatctttctacaggtgcccctaaaaatgtgttctttacaactagatgggaggaaacttattttgaaacctcaagtaccaaatgtaaaagaaaggctatgagcacagtatcttataatagcattccatgaaagttttaaattggatttttgtgtgtgtttaaataacatgtcttattatctctgttaacaatgtacagctttttaaaaaccaaaatgaagactgtacttgttgtttttgatcagaatgaagacaatgagggtactgtaaaagaattgttgcaaagaggagacaacttacaacaaagaatcacagatgagagaaagcgagaggaaataaagataaaacagcagctgttacagacaaaacataatgctctcaaggtattagagctaaaattataatataccttgcctgtggtttttttttaatatatagggtaaaatataatgtgcattaataaaatctgcttcagacttagtcatcagaaactcactttttctgttcaatgtgtatgctttatttaacatttttgagtggtatttgattttgaacgatgtgttgcttaaaagttatggctttttaaagacatatttttctaagtagtaattgaaagatgggaatgcattcatagtacttatacatttaattttctaatgtgctttatttttatcagctactttatattgaaaaaaacctgcctaactgccagaataaccgatctacatgtatccattattcctgctttctttacttaattgattttgcttgcattaggtccaattttttggtaacctgatacttgtttaataagccctagattcttttatttatttttaaaactttattatgcctttaagaaagtcactctttgcaactatctacaaagtcaaatttcatttatgtaggaatcctaaaaaataatcttagtgcccttgaataagaactgctactttcatattaagcagtgtagtgtatggcttcaagtccccaggtgactcatctggtttgtgcaggaagagcaggataaacttaatttttctataataatatctaggaagttcttgagactagacatgtggaaagttttgtgaaactttttttttgtatatgctttgcaataatcactatttgcatgcatggctgattttctaatacttttaattgctgagcttttccttgtaaatcactcttttgagctatgtagttatgaaggtggatccacctagcaggtagatggagtctgctttctacatgcaaataagagaataaaacctttccccctatagtcaaccaaataaacactgctgagaatgtaattacacaatattgtgcctgcaaggaatccacaaggaaagtctaattggccagcaggtgttctgaaggtaactgctgataaatatagtaaacagaaaaggcctcttcctcgagggagtgcaaaagcacaccataatgtgtctagaaaatcggaacgctatgtaactcacacccttccaactgtgagcaagctttcagaagtatctacactggtcgtatgatggtgtgtgtcctactgaatagcagtgtttaatggtcatctggcattcctctaaagaaatctacatgacatctctaaatattttacatattatacatcactttgtgcttaggaaatgaaagatgtttcagattgatgaccaccaagccctttctcctggcaaagatgtgagttatgtcacaaataaggcatggctcaactctaattcacgtggctgtatcttgctacctttgaaaaaagcagcgttcgatctgactcctcagaaggtttgaaaattcaacataaaacataaagtacagcaaggtttaaattcccaattttaaacaaactagataatgaaatgtagttcattcttgcaaatacaggctataagtgattaatcaaaatcgtcaacactactcgccaaaccaatctataccaacatattcaataactttttaaacctgtcaaatagttccaattctggtccttatgaaatattttagagaaggtcaaaattttccaatggaatgaaatttttagaaattccctgatatttattattttttcgctcgaattaaacctgtgaataaaaccctaattgctactttctgtagaaatgaaagctgcatgcagagcttatgttcccatgaattataaaatggcattttgagtaattctattaatcacagaagatattgagtgtgcttgtaaagagcatgatgactgatttcctcccattgttgatttattaaattagtcttatcacattgatttgaaagcatgcacttgctgttttcttttttcaaatagttaattgttttgcatttagagcatgatttggtatagtaagataaatgtggctatgcaagccttggaaggagaagcatttatctcacataattttttattagttatgttcaccaatatacgaacagtggtgacacttctacacatacagcttggaacagtttataagacaactaaaatggctttatatttctaatcataaaatattaatggcctatgaaactcttatgtaggcatttctaaaaacatgaatgtatattggttgagtacataaagttttgttgatgagccccaaggctaaagatatacattttagaattttacctattttaagtcagatacaaactcactaggtttgtgagtttgtatctagttaagtcaattgtattcgtatattaaactcttgcacataaactacacaacagttagctcattaagagtcaattgaatgtgacaaaatttttaagcaagtttgaacatgctaagagaaaatactttaagtgtgttattcaggtttcttagcttcctatacatgggtcccgcctcatgcataggcaatttaattatgtctttgtatattttgcatttaaatatgattttaacctaagttgtacaaaaagatgagggacgcaaattattttgataaataactgcagccagaagtgcactatacatatatattgatattttaataatgtctgcaccatgaacaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggtaatgttgttttagaatgtcaataccagattttattatacagtttaattaacctgtgaagatcatatttaaaatgttgatgttcttgtttctattaacgttctctttgatttgatgcatttccttgtattgtgtgttgttttcagtaaatgtattgtattaagtgttattcaattgacgtaatgttgaatgaataaaatgttttagactatgtaaagtgatttaagaaatgtgatgtgttttctggtaaaattgtaattgactttgtgtatctttgttccagatgaactaatgacttatcggtatatggacgacttcttactcatgttagcccattcatttcatcagagcatcttcacacatcagtgttcactctctatagatttatttgcatattgtctaaatatgtttttttctgttattattttacactttttattttgcttcattctctgttgagttcctcaaacctttaaaaaggaaataaataacttattcacttaccctctaaattatattctatgtggacggtccctaataaataatgagttatcactccaaattgtttcaaatcccaagacaccagaggaatttagaagaaagaaaatgttagaccaatttcaatatttacttaattagaatatctaaaaccaagcattcaaaggataactgaaataatatttgggttattgagcgaggatgacagtcatgcctttcatatttgtaaacttcaaaggatgacaataaagggacaacagcctttgaaattttgagagaagtatttgctgcttgcaagtcggttgatgtggttagctaactgccctgggccctgtattggttttgctcaataggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattgtgagttgttactggcaaacccacgtatgtgtttgcaactactactctattaacagaggcctactaataaaaaaaaaagagacaaaaaatctgggtacagttttaaacttctaatgtacattctgaaagtgagtggtttccctcactttgggcttctgtaacactagtgcttaattttgccaattaaagacacaagaaattaacagataacagggaaaaccccttatcaaaaatgaaaatacatcttaattttttttgctacatcatttttcataacattggcaatgttaatttgtcaatttatcatacattcactttacttcaatgtctaatccaaaaaatatgtattgctttcctgagatcatcccatgctgattttactttcttaatgtatacatgataaataataaatatttcatggtacatcttatgtcaacctgcataagccattatctcattgacttgaagaataatagcttaatcctcacacctggtttaactacttaatgggttacagtgcccataaaagaactggatgcctagtaagatggttgctaattgattgcagattgaacaatatcagataatgttattactgaaatgttaccagccaaaacaaaaaggagtgactgctcttctttcaaacaactgaatggaaagtgtatggttctctctttaaaaaggcgattcagaattgttagcttggtctcacttctttatttgtagtaggtataaaccatagaggttttctgacaggtacatttttgttcctattattaacacttgtaagatgaagaggaatgatcatcatctgtaattatagaagaaagtactcctcacaaaaccaggatgtcaaaatctggaaactaagtctttatagttaagttaggttgaattatatgaatcaaacagatactcaaccattttgccctatgtaaataataactgcatagggttcagcccatgtatgagacttcttgggaacttcttctgtgatagtgtcagttccatttaatttggtgtatatttttaaaatgtcaaaagcagttaccataacttaattttataagcatataagggaagtatgttgcatattattgtgacttcttttaatacttcaagaaaattaataaatacactgttttctgttaaatctaataccctaaagtttaatagcaggtgaattattctgagcaattggaagaatacgagaaatagcgaaactgtattgcatgtgaagtctaattccacctggctgaatgtttcagcctattatccttcatattagatgttatgaatgtaatgtgtcataaataaccttacactaaccagcaagcctgtgtctgcagatgcaaaatgaagcgaaagattaaggcaatcaaaaagaaaattctaataaaatagtttcacctcaatttaatagatcattcaagggggagtcctttgctttgaattatctgactactaactcatttctccattccaattttccccaggtcttgacacacccaatatgcaggtttaaaattcgttacaaactaatcaagttgctaatgctttatggctaaataggcacaggatcaaaaatctccataaaccacttacttaaaatgccattatgtccctattcatagtaggctctcaacaaatatttgtacaacgtaataatgactggtgaaataaaggaagcatgtgtgaaccagtatatatttttaaaaaattgtagtaaaattctgggatatattttcctcataaacgatttattcttaagttttatatattaaagatccaaaattcagaatgtgaagggggctatttttgtgttaactcttaattatccatgataataaagtaatcacaatctgtatgaagaataatcaatttaatattgcagttatatttggcatcgtattttaattagaactgagggataattgatagatgataagtaggtatataggttggtaggtagatagatagacaggtgggtgtagaaatattcaagatacatctttatacttgaccaattgtcaatgcattttaaaactaatttcactgtggccactgattagagttatctttcccaattcttacgccctagagtcatttgtgatagtcacagtaacagcttaatgaaaagtagtatttgatataaccttacaatggctctgatgcagcatatgccatagcttcagaatttcttacctccccctatattctccttctctaattgtttgatttttacttttcctaactgtccctttttgtttttctagatataaactgtaggcttaaagttcatctttcatgtctttacagcaacatgttgaaatagtaagcggtactcttaaaatgcttagtatgtgagagctgagtgagtttaaaatgaaaaattaattttccttatctcacagataaagactcagagaagtgctaaccactgtaaaattaaggcatttaggggactctgtccatgtcagagctatatatggtagtaataaagctcagaaaaggactgagactttgagggaacaatcatgaggcagcgcccagccacacaggaatgcagaccaaagcatagtagagggtatctgcaaattgtggtcctcagggcaaacctggagatgataaagaaagaggcatgagactgggaggacgcaggtaaaaattttaccagatattcaaaatgagagaactcctgccttaattaggaattccaatcatttctaatatatttcctgttggtttagaaactaggttcctcagttaagaccaagcacggactgtaaactgaggaaaagggatagttctataggatgtactatcacagcagtgtggtctagtaaaattaactcttggataaacagccttgaatatgaatcccagtgactttgagtgctgtatgatcagggataaactgagtctcatttacttcatctgtacaatagagataaggatgtttctgaggattaaataaggtaatatttgtcaaacacctgctgcgttatgcaggctcaatgcatgaaagttttcttcgtctcctttctgtatatatattaacattggaaaatagacataatctttaatttttaaaatattttcataagtcattaagagaattaagtacgcagcatttgtttaaaatgttaacaacagatatctcgttcagtgaaaatttcaaatttaattctataatatataagcagatacttttctctagattcacagaataaacacaggaaatatcacacaaatctgatgactgccaagaaagggcatgattttccctaaactgcccctcacatcattgtagcatttggaaaataacctcagagagcccaggcatttgcaaacacaaaattatacaatgaagataccactacaacccccaagggtcatgtgaaactgctaaggaacataagcttacaaactaaaattatgattattgtggaaaaaaattataagcaatgttatcagatgccaaacgttaaaaggagaatgtatacctgaagaaaatagagataagaggataatcaccaaaggatattaagtaatttttaatgttcaaaaataaaaattaaatggatttttttccagtaagaataggccattatataaagtgaaaacgaagatttgaaaaaacaaagtctggaaatgaaaatataattaatccctcaaacatctgcgtgaaataagtttcaagttgaaaaaaatagggattatggggaagagacaatatttcatattaatgaaatttaataaaatggaataaatgtaaattttaatgaatcctcaaattcaataaaggtcaaccaacgtggaaaaaataaaaacaagtctaccagctagctctgaatgaaactcagagcatcagtaatcaaaaaggtatcattaagggttacttaagacaaaagaacatttacaggatgacaatattgactgaagacttttcatcaacaatagatattagaagacagttgaataatatcttcaaaatgctaggcacattttcaaataccaggtaaaacatgattcaagaattaaggcaaaatattctcagacatacagctagtttcacctgaacaaaaactaagaatttcttgtctatagatttttgctaaaataattactaagcaatatatttgtgtaaaataaaatgaaactagaaggaaggagacagcgatgtaaagctgtataaaattgttttctctgtaaataagaacatttattaaaaaagcttataatcctaaaatttggtcagtgccaccaaggaaaacacagaatactaggagaatgcagtgtttgactgatcctgtgtaaagagagagaaatcaaatagaagacttattgcatatcctatgaattacatatccttaattcatatcctgcatattacatatgctatgtaaagggagataaaaacaagacttattcgagataatggcaacaaatataaggcttgtgcataatgtgttctatgtaaattattaccaattataatgtttctagatagcaaaaaagtgctaaacctctgaaatatgtatacatacatgacctttccaagaacagcagcaaaaaaatacaaaaaaaagcccacttcagtgaagaaaaagaaatgtccattttctaaatacatttccacttgagctgagcatgttatgacatcaaataccaagtatatgatcttgatgtttaacattttatatccaacagtctcttatcttggatgcctaatgagcatctcaaacatacaatagccaagtgaaaaataaatgatccaccccccatctacgttaattggcatctaccaacatctccagatgttattaaattgcactattatttacttaagtcagaaacctagacatccttcatgattcttttctcttacattaccatgtaaattatttccactcttgttggatatacctgcaaaatgcatcaaatcactcctccgtatctgttatggaagtgctaatctacaagattattatctctcatctggattacttcaacaacctctaacctcttcttccagtctttccccacttacaccatatttctcctggtgaaggcagagagctccttctaaggagttaatgagatcatatcaggcccctcctgcccattactctttaaatgaaatcctgtgatccgctatatgatgtagccccttcctatcacttctgttactcacactttgtctccctttttgctcttctgctaacatagaggcctaaaggtttcttttctatacttaaacacaaccaatttcatttccatatcagtatctttgaacatatttttctaatggaatatttttcacctagaattttgcataggtgctataacttatttagatatcctttcatttaggaacaatgaatatttagtagaactttgatgtataatctggttatgtaatgtagtagtttctgttataaatgttttatattccctatacttatgtatgcaaattcggagtttaagactgctcgttcagaacatcagtttctcttacggttacttctagaagtaggcatactaaggaaagacacagcttctggaacataaaagtgaggtggtaaaagatgaatatgaagagggttacaatattgtattgcaatggatagcttgtcctacagcagagtaattgtaatgggatattttgacaaaattaaagtacacatttccaaaatatacatgctcttggaaggctgatagaaaattaaccttgtttgtagattaaatgctgcaataaatgtgttatttaaaatagtccttggctgggcgtggtggctcacaactgtaatcccagctctttgtgaggccgaggtgggcggatcacttgaggaggagttccagatcagcctggctaacatatataacatgtcatgtatatatatgacatgctatacatatatacacatgttatacacacacagataacatgttatacacgtatgcacatgttacatataacatatataacatgtacgtatacacacgttatatataacatgttatacacacgttatatataacgttatatatacacgttatatataacgttatatatacacgttatatataacgttatatatacacgttatatataacatgttatacacatatacacgttatatataacatacacgtatacacgttatatataacatacatatatacacgttatatgtataacatgttatatataacatgttatacacatataacgttgaatataacatgttatatatgcacgttatatataacatgttatacatatatacacgtgttatatataacatgttatacatatataacgttttatatatacatgttatgcctatatacacatgttctacgtatatacatgttatatatacatgttatgtatataacatgttatatgttatatatacatattatgtatatgttatgtatataacatgttatgtatatgttatgtatataacatgtttgttttataatgttttatatataacatacacatgttatgtatataacatgttatataacatatacacgttatatataacatgttttatatataacatacacatgttatatatataacatgtatatataaatgttataaatacatgttatatatacatgtatatacatatatacatccatatataacatatatatacaagttatatatatatgttatatatatgtattatatatgttttatatataaaattagccaggcttgctggcagttgcttgtaatccaagcttctcagaggctgaggcatgagaattgcttgaaactgggagacagaggttacagtcagcagggatcacaccactgcactacagcctgggcaacagattgagaccccgcctcaagaaaaaaaagtagtccttaattgaataaatttgtaaaataaacacctatatattgtgaatatttttccactaacttttttaagttgtttgaatctgaatagtattatacattcacaaagagttttcacatgcatctagtttgatcacagtaatgaccctctcaagtatcattttctttgtcattttactgtaagaaaaattagcataaatgaggttaagagatttgtccaaggatacatctgagaaatggaagacgccaaacttgaactcactgctttccaaaacatggtgggagttattaataaaaaaggaaaaaagtttcagtgtttaaacaattttggtaaacagtagattaagcaaactttccttactctataactttctagtgcgtttgatatgctaatgggattatgactttctatgaaggggttagattctatagactttcacatctagacagttgcagtagaaaagggaaatttgatttcagattgatgaaaggtttcttatttgagtgatggtgaaataagaatattctttagaaaaaaatgggaagaacatcaccgtatcattattcttctgttgtttgggatttccttaaatttaagcagagatgtacaagaaaagtaataacagaactgtttgccaccaccttatgtaaaataatgtctgagcctagatttaatggtctgctacacattttttatattgtctcctatcttgtaataaaagcaactcattttgagaataaaattaggggaaatatattgtctttgcataattgccacatagattttcttctttgccttgaaataacaacaaagattgtcagctgccagtgcaacatccttggagaatttgggaagataaatgattttcttatttagagacagaatgttctttagcaaatggaattgtaaatacaaaagactaataatggttgttaagggaaatgttgcaccaggatgtagctgtttgtagaatttttctcctctcagctcaattttgtaattaacatattacaaggattaaaaaagaaattagctaacattttatgtttttctagattgttgatgatcatagtggttataaatatttgtacggagtttttttgttctagtgtctagttgtgtagcataatcagtttaatggttaagtagaggcatgttcagcgagtatcagcttccagaaagatgacagactgacttaattcctcaccccctcacttcaaatgcgtggaaattctgaataaaatataatttttaaaagttttaaatacacagctgggctatggtggaacctctcttccctctgtgtgccatgaatgatcaaatcatcttacgtgaaactgaacctggattgagagcctaatggctaggaagaagttttcaagaccttttaggacaaaatatgtgaccttcaacaacacataatatagaggtgaaaataaaacccctccttaaagtctgaattttcaagggcttccctcagctgtaaaggggaataaataaatcctacccacaatggagaagaggcattatctgtagtgataatagcttaggattttcaaaacttaatagaaattccaatactccgattgggaaactgagcaaatctgaagcagaaaagattattaaaaaaaagaaatataagtatagatcatcactatgagacgatgaatctgatgaatccaaaaaaagcaaagaaataattttaaatactgctgtatttccttagaaagtagtgacacttaaaatggtacctggttttagagcaatgatagaagccagaagacggtagaataatattttcaaaaacaatgaaagaacatccacgtaggaacctagaattgtgtactgatagaaactctctttcaggaataacattgaaataaagatcttttcagacacacagaaaccgtttactagcataaaattccctttagaggacgtcaagattggtctttaagcaggagaaagatacaagatggaagatttaagctgcaaaagaaaatgatgtgcaaagaaaatggtaaaaaaatggaaaagtcttaaataaacatttaccgtgtatgaaagtgtctattaaaaaacagaaaaatgctggacatcaatgaaacatgagaaggtggttaagtttttcatccagtttacctgctacctttctatgtattgtttctcagtttccataggtagtacctacttctctaatgctgaaatgcctcagtgctcagtccttgggcacttgccatttttatttattctatatatgtcttgctgttttcatccagcctcgtgacttgattaaaacaaaattattcttttcccctcaaatgcagtggaagcaccgttctttcaaattttcagagaaaaaaaaaaatctacgcatgctttctttagcctatctctacacaatacacagggacaacatttgaaaaatataaaccatatttaaatctgatcataatccttcaatgaattcccatctatttttaagtgaaatccaaaactcttcatgaatttcaagggatatctgacctggctggcccacttcttaactcaggccttatctcttaatactttcctctgctccacctatgttgacccctttgctgctgctttcacagatctgacatgcacccattgcattgtgtgctacctctgcctaaaataatcctcccccgtttctccatgtggctcttttcgtttctgccttaacttctttactcaaaagtgtttttttcaatgaatctttctcatgtgtgcacatacaccacacacacacacacacacacacacacacactttttatccatgctttcctcatttatttttctcaataaagtgcatgaccaggaaagttctcaatattttccttctttatcttcttgagtatttatttccctacctagaagtagagctccaacccaacaatgcaaaaaaaaattgtctttttttcccactgctgtgtcctcaacacccaaaacagtgactaggtacacagtatatatttgtttaattcataaaataagtaattaatcaataatgaataaagcaattttaagattctcttagtgcttagaatgaaaacttgcaaaatttcttgtgcgtgttaagaattttatactaatcattaaatcgatagaagtatacaatttttgaatagtagagggaaaaataaagacaagctattaagttaaagcaaataatccaaatagaaaactgaggtttaagaacattaattgaattcatcaagggtagtaagaaactatatgaacataggattttgtgttttccgaatatctctagtccaaagccatcactatgtataaaataagatgttaattacagtttaatattcttgtaagtttaagcaaatttaccatttatacgtgatttatacaacatattacctcttgaatattgtctcaaatgactggcttcaagtagcacgttaaataaaaatagtagaataaatgtgtcaagctacacttactattcacaattattttatagttagattatggctctgttagatatacaattttatatttgcttatcttctgaattaatgttacagtaatagactacagtcatcatgcaatgtgttgtcaaatatattaataaacataagaaaaaacatagtaatatactgtgtcaaatttttctatcaagtggaaatttagcacattcttcaggaaatattgactgcaaaatctatgattaatatatttttcagaaatattggatataaatacaaaatgaagtgatgaattattgatatgtgcagttttactatcatataatgttactgataaaattaaaaaaatataactcatttttagcatcagatgaggaaacttggttcactaaagttagtattatctttatttgaatgctacaaccttgaaaaattattacatttgatagaactatttgggaacagtttgttacttctcattgtgactatggacattaatgggatgcccatattccttccattcccttttcttagcatagtggaaatgattacagatatcagttatgtttcttgactgatgttacagtcattccgcattatgaagtatgcaagactaaatttttacaaagggtatctcttatccttatgatagcctaaaaaggtgaaaatttgtcaagcaggtttcctaagatcctataaaattaggggacagggttccagcatcaagatgtagttttacttattgaattaacacagagttttgttgatgattttctttgatgatgggggtagtgatcgtggtattgttttattacattggtttcttcctttttttgttcatttttaatgggaacctcccaataatggtgaggatgcagttaaatggtaactccatacacttagtgtgagtctagaaataaattcaagttttattttgaatacactgaattggtatttctttcattgaataaacatttatctagtgcctcctaagtgccagacaacacaaaacgtaaaataccattggcaaatccatagcaatcatacaaaagacgtgatatttgataaatataactcatacaatgaagaaaaaaaagaacaagaatttatacacagcaatttgacctccgtttgcaacacaacaatataaagtgtaattttctccaatctaaatttgctttgaaaatatggaacaccagctggaagggagctcagatggcttctgcagtggggttggaaatatccttctgagcatgtccagaacaactggttaaaaataattaaatcacttgcaccatctgtgaatcattctgattcttcaatgattacttaagactctcattgtatggaacatattctgagaacagatgaataaaatctattcaagtgtatattgttttccactttgattttcacaaaataaaaggattataatattttcaagttggtaagttatctgataattctcctgccctcctttatgatccagttgcttttgaaataattaaggtttgtttaaaatttagttttatgaataatacaaattcacatagccttgatgttataacataattttgcttaaaaacattctatcatttttaccctttatttaatcttttgagtatagtttagcacccatttagtaacagccaagagaactaaatggaagtccgaattgattgcattctcaaatttagcaccatatgctataatcatgagcagtttttaaaattcctaaatagctattttaacgcatgtaaaacagaggaaagctatatttagtggtgactaatccatggatgaaagatgcatggattaaatataatccaagtgcccatatctgtacaaacttaagatgttcagataatttggaggcattgttaactgtttttctggatatcagtgcatgggcacttctcgccagaataaattaactggggaaagttccagaaggtccataattttccataataattagtgctttcttagttaatagactatctgggtgatgaaaaataaatgaattacctaacaaatacagttatctataacatataactccatctgtgacccgtataaagctcaaaatgtgttaactggttagtatctagacaatcataaacacacatgaaacatgaataatatcggtcactatattttcatttcttgcttcgtagatacactcgagtatttcatatgtggaaaattaagagatctagtcctcttcatatattggcctccctaatgggaaagggtctctttaatctgctacaaagccctcctcttctttaaacttgccaagatgtcttctacctcaggtcattgcaattatgtttcctttgacttgggcctctatttctggatatttccttgctggtctcccgtcacattgcaggatgcagagtgaacattatctccacaggtggcctgccttcgacaacctattttatgtcgttcgccacatccattctatccttaccatcatgctctagaacatcagctagacgtttcccttctaatatttactgcaatctgcaaatgttacctttgcatgtttacttgtttataatttgtctgctatcattagaatgtaggcttgatgaagtcaggagcctattctatcttgttagtcactgtttccccaagacatagagtctatcacagagcaggtatttaatgaaagtatgtggaatgaatgattgaatgaatgaatgtataacatcttcctgtggaaatccctgcagtttcagagttggttgttctgtatttttatgtcagtggtatcctaatgccagtctgccatggtccagaagttttcaatggtccataaggaaaagaaaaaaaagagcaattttttatttagcttttcataaagcaaagttttttaatgcaagaattgtcctttctttcaaaattatgggtttcaacagttttggaggtattaaaatggcctttctttttctttcttctcattttgttacaatgtcctttactagaaaaagtaaagggcagaacttttgtgatgttccctaatagttttttttttttgtaatgttgttattgacctatgaaatacaatgtccgtaaaccaccaacttagataaatttatttacatgaaggaataccattcctgctaagtttctatattggttgcttgaagtttcagaatgaggaagagaaagcatgaaaaccatcacctcctatatgtatggcctgttcggcaagcagtactggccccataacagttatccactggaataacattcttgaatttattttgtcacatgtgaggagcaaaaacaagacaaaatacacaaaaaagagtagaattagggtatcacgacatttgtctaacattgttcaacgttaacacttacaaataataaaggtaccaaaatggtattttcttgtgtataaatattttcatcctctggatttgaatctgtttttgtttgttttggtgatataaagaactcataatagtatcatttcctgatgatatttggaatccaaaaattaattcaaaacagaagtattacattttctgtccttttcataattgtaaacaatgcatcaagatcaaaaacttaacaaaatgcgttaatgttattatgcatgcttttttcacattctttatttcccagtgatcataatgactaataattaacataattatttgtgattgacaaaagactctaacgttcatcattttagttaattattatttaagaaataattggtctggatataatataagccaattaaatttgtattctgaaaagttttgagaagtgaaaaaaaatttattttttatttggtaaaatactttatttctgttgtagctgcttttacaaggagattgtggggaggaacagtcatatccaagttctcagttaattaccttttcaaaatatatgatctaaaatggagtgaaaattgattgtgtcaatatgagtttttagagttaaaacttgtaaattttctggacagaatagaacaattttatattggaatccttgccataggataatacaatgactattatttcctggaacattgacagagaacaagctattttaggagaaactatctggattgtaaagtagagcacattaagcctaaggtgtcattaaattcacaaaacttttaaaaaagaattgagcgtaatctttggtaagagaaaaatggttttcttcagtgactattaccatattttgcaaagttataacctggcaaaatatattattttgggaaaataatattaaatataaccatttctatacacacagtggcactttatttattcagaggtcagatggatatcattttaatttacctgcaacacagccaagagtcaggaatggagtagaacaaaaggcctctcgattcccaaaattgattttttaaggttcatgaaatccaaagcttacttatatttcattatgaaatgaatttccaaatccttttttggagattttttaaaaattttgctttgattaaagaggtaattctaataaacttaattatctctttttttttttgtgcccctagtagctttgaagtcaaaatgggacagaaggaataaatgactgaaacaggagataatagctgcagcctcgagtaaggtgaaaaagaacctatatatatggactcatagtttggggaaataatttagcacagggcaacacagatgagagagggagggatggaggaagggagacagagagagagaacagataattagtgtttatttcattttatacttatggataatttaattatttcaatagtttattcatatagttaggtaaatactttttttttttttttgagacagattctcaccctgtcacccaggctggagtgcagtggcatgatctcggctcactgcaccctctgtctcccaggttcaagtgattctcctgcctcaacctccagagttgctgggattacaggcaaccgccatcacgcctggctaatttttttatttttttagtacagacagggtttcaccatgttgtccaggcttgtcttgaactcctgacctcaaatgatctgcctgcctcggcctcccaaagtgctgggattactggtgtgagccatggcgcccagcccaaggatctttaatatcttacctatgtgcaaaagtgtttaatacataatgccatatggcatattagcttcctaaatcacataccactgccaccagctaacttatatctctatatttacatctgaggctgcataggcacacataaatgtattcatatatgttacacatatgcttatttatgtagctatgctatatgttatttgctatttacatctattaagttacttagcaaaatatgtcctttggctttgaaaaaaatgcctgctgaactcatcaagattatgatttttgtaggttattctccatcttttagtcgagttcctaaagttgtgtttttttaactgcctgctttttattgcaggtatatgaaattgttgtgcatatttcaaagaagaatagaatgcagggtaactctcaaacttgttatttggaattaggtcagataattttgtaaatactgttatcagtatatcacaatgtcattagtgtcccttcaagttaagggcatggaaataaagatggtctaatgtgccaggccaaagaggaaaacttttcagcttagcaaagtgacttcaaatacatggggagaattgaagcagtcatttcaaatgcaaacaaaaagttgtatttttatggattacaatatccttagctaaatgtttactttggcttgggtatttttctcattagtgatacttatttaattagttgcttataaattgaacctgggaagtgtagtttgcagtgagccgagatcaagccactgcactccagcctgggcaacagagcgagactccgtctcaaaaaaaaaaaaaaaaaaaattgagtacttaagatcaattaaaatatatcgagtattggatgctgtcacataagagtgctattagccattggctgttaaatttcctcatctccaggaatctcaggcacctaaaaataattctctttacttcatgggcaacagcagccactagtctttgccacgactcttctgtcaattgggtatgcagtgaggggcaccaatatggttttaggtgatgatgtgaaattgtttcaaaatgctttcattctcccttctgaattttgtcttagtctatgcttccataatattgggagccaattagtagtacatgccttcctgcagcttgaatagaagtgaagtctattatgaacaataaagtcaattagagggggccatgcctactgataaatatgttatgtaaagactcaatttaccttgaaatctgtatctatttgcatctactctttagtgctagttcagagctctgtgcgattattttaaatgtattgcagtattactttaatcaattaatacaaaggtagattaaggaaactttactactcttcatttcttcattctgctgattcctccctcactgaagcaaaaaaaaagtctacaatttagtctttaaaaagtctatagtttagtcttagatatctctttgtactatattccatatactgttcattcttaccaatgaatagtatatatagatatattttacttttttaaaaaatactgctttattctgtgtattattttaaatataacagtcaattagaaacatgttcccaggtaatgtatatagatcttatacattctttgtgaaagtcttagatgatgaatcaaaatgtattctattattcttctacatttctggattattatattttgattagaaaaggtggcctatcaaatctttctttttgatgcttttaaaagtttcctctctatgtaatttttgatgtcccaagtaaataggagaatatgctttttccagtgtgcacaaaatacggattaaatttagcttgtcggttttaaaccacctctattcttgttttttatttgtattttttgtctattttaatctaacaaattacagaagagttgtatgtaaggtaccaactacagctatgattttatcatgttctccttttatttctagtaatttttaccttatgtagaatgcacccaattgtttggggcatagcaattaatgactactgtgctttgggaagaagtgtgatttttgtcattacaatggttctctgagacccatttagtgcttttcggtcttgaactatacttcatttgatgctattattttgactttcactttttaaaaaatggttttctaaatcaccattaacgcagcattgtgaccttgtatttttatgtttcttgtgactttcactttttaaaaaatggttttctaaatcaccattaacgcagcattgtgaccttgtatttttatgtttcttgtaaacagcctatagatggagtgtgcattttaaactagataattttgtctttttaacttatgcaaatatttttacatctttatagggtacatgtaatattttgctacatgcatagaatgtataatgattaagtcaggatagttagggtatccatcatctcaagtatttatcatttatatgtgttggaaatagttcaactcctctcttctaggtattttgagagatacaatatattgttgattatagtcaccctactcttctttcaaacattagcacttactctttctatgcaactgtatgtccgtacccagtaaccaatctctcttcacccattccgcccacctacactcttcccagcctctggtatctataaaaaaaaatcacatattcttaccaatacgtgcttgatcttatgaagatataaaaatgatagatagttcatctttagatgagacattttaaccaacttcatttttacaataactcttataactgtgtctgttttaattccttgtcatattgatggtcattattttatcattttatttactcttatcccttgtctataattttataattcatcatcttcttcactgcactctactgcatctcttcccgcacttataggttatttataagttatactttgtactatcattttactagtgctgtttcccattttaaacaacaattttatgcctatatttctgtagtgttgcgccaaaattaaataagaacaatgccctcatcaccaagatgatttacttagtcaactcctcattattttcaatcaaaggcaaaatcctttaaaaagaaataatttataattttatttcctggctactattgttttcacttgtagtatcacatactagttcaagatgtcatgttattacttaaattacactatcacttcataaaatttgaccacaaacgacacaaggtgtatttcctgtcactgtttttttgtaccgtttatttctcattgttttgaaatctttattacacagtcatccttcagtgtctgtggggcactggtttcagcattttgatatcaaaattcaagaatactcaaattatttatataaaatggcatagtgtttgcatgtaactatggacaccctcctgaacacttcatatcatctctagattatttatagtacccaatacaatgtaaatgctatgtaaatagttgttatgcagtattgtttagggaataatggcaataaaaatgtctgtacatgttcagtgcagacacagccatccatgtatttttgcaaatgtgttcgatcgatgactggttaaatccacaaatgtggaacccatggatacagagggccaactgtacttcagttttaatttggttggaacacatgagaaatgtcctcgtaaaaacataaaggatgtaaactttgtaaaccttgcattttcgaaatgatctttgctttgcagtcatcatgatggatttattggatagtaacattctttaatatctctcctctttttttagtagtctctgtaggttatgaacaattgtcttccagtttccattgttttcttgtttcaactatcttcaagctactattgtttccagtgtaaagtctgattctagtccaagtatcatttatttgtatttaaccttttttctttctctcaaactctaaagttgctgtctgtcccatctattgaagtacagaaatttcattaagatataattttaaatgtttctaaatgtgtccctgtttattattttattttattttattttgtttttatttttgagacagggtcttgctattgcccaagctggagtgccgcgatgcaatcatagctcactgcagccaccaactcctaggctcaggagatcctattgcctcagcctctttagtggctgggactacaggccatcagtaccatgactggctaatttttaaaacatttgtttgtagagatgatgtgtcattatgttgcccaggctggtcttgaactcctggaatcaagtaatcttctcacctcagcctcctaaagtgctgggatttcagttgtgacccaccacttatttaattcttttttgcacttgggtaacgttttaaataaccaattaatattaataacttctttagctctggaaaattttctattatgattgttttaattattacaaatcttccatctcttcttttttctcattctggtacttatcattgcttaataggtatcttagatctgttctctaagtctcttattttttcactattaatgtcagtttatttctatttgtctttaaattgtgatatacttcttctggttgactgtaaagaacccatattttatttttagccatgatcattctcttttctaagttgtctattgttatttaaaaactaggtaacaggctttctgtgctctaatgttaaccttttaatgtttctaattttatttttattaaatgtaccttccgtatcttctagtatactacttgtatggactctcagctttgtctttctctccagccccttgtgtcttctgaaaaagcctttgctttattttctctcatgcctaagtcaaagaatgtaaaatgtcttggcgcaaatgcagttaaggttttgatattttgatgcatagtgattgattgagaagcaacatggatactggaagttttgttgttgttgttgttgttttgatctgatgaataattatttaacaagctgaaacctattcacaaaatttacatatgggaaaacatctctgatctcatggacaaggggtggaagtaaggctgtcctcaaccatgtagtacagccactctccagtaatgcctgcatgaaacaaactagcaggtactgacccccttcttaagtcaaacagatctccttaaatcaatggtctccaacagatcattccacatatatacttgaaaaccatcagatccatcatttctgtctcagatcgtgccaagatacacataactttgaaatatcaccagttcatcatcattctctcttcacctgcaatttttttttccataatttgaggtcctgatacatatattcttctaaattgtagcagttagttgtgattatcttgacgttgcatggactcagttcaaagtgaaacagaaaacatatctacgatgtgatttacccattctcaacatttctattttgtgtgtctgtatttgcacagacacgtacatacatacatgtgcatatatataattaataagctttgaccatataaataatgcaaattatgtataattcacaataataggtttttaaattaattatcttcagagttgagtgagattacttacagatttaggctgtgtctacctgaaaacaaaatacagtgtattagcaattcagtaaaatcaattggatatagaataataacaaattagttgagttttcaccttgtgacattttagtttggatttagtagcctgtctaaattacctttgtgaaaaaactaggctacaagtattttctgatagatataataccagcattagaattattcatataatcttagttttcacattatttaaaatagaacacattgttatattttaataagcaatttgaaaaagaaacaaatctttctttcttgtatgattgccattataaaagaatattaattgagtgctcattaggtaactttaaccacattaagtactagacagccctttggacagagactgagtagaataaaaaacgattacagaacatactttggtattaaccttttctataaataaaatgtattgtcattctctagattagcactgtcctatagaactttctgagatgatggcaatgttctatatctacactgtccaataaagtagctattgaggctactgagaacttaaaacatggctagtaaaaacagatgtactaagtttttaattgtatttgcttttaaataatttagatttacatttctttcgtcaagtgtagctaatgactaccatacgggatagtgtaattatatgcatctttactatcactcgcatttctaatgaagagaatacttccttgaaaaacataattatgacacatgcatatttagacatagatactgagttgccgcattaatctagagatagtgtccacattttctgaggggtgtgacaaatgtaatatagaaataaaagtgtgagtttattctgaaaaatctactcaagttgacagatccacaaggcaacagaagttaaaagcgatataggagggtgaaatataactgcagtatttaaggtctttccatacttattttttcttgtgttacttttattttcacactgaattaagtataagtatgtgtgtgaggtggagggagggttcgatttgcttgtcaacatacaaaaagattgctatagcaagtattcccaagctgaaattttggaatagcttaaaataaaaaatatatactagatatgtaaacgaaaacttttatgagaagagtttgggaagagttatcaaaggttaaaatgattttttgaatacaagtcttctcatacccttcaatttgctaatagacattatgatacccatgaagaagctaaaatcagtatatcttaatatcgtctatatgtcattacctcaaataattgcttatgtttgtattcaagtataatgagtcagattagtaactaaaagacaatttaaggacctaagcacgcatgtacaatagcatgtagctaatgtgctatgaattgaagaaatgcgacatagtgaaatcagatataccttttaaatctatgacaataaagattgcattataaaatgaagaaaatattcctgtttgaattctgaatattcctaaatataaattataaatgtaaatcccagcaattgtaaccacatatctatcttataattatcctgttaagttgatacttgttttttcattaatttatccaacaaatatttttgataacatactgtatgctaggtactaggcatgagtctttgctgcatttattttttgctgccttataagttggctagggtgtataaccttatctattaatttataggttattttttggagatggttttacaaagcaggccatgattgttggtgcttatatattgctgcttatgtgttgatacttatcttggtggcaaccaaagcccttttctttctcttctctcacaggccatacttagtgactaaaattttatcaagttactaatttatgttaattctttgaaaatctgtataaaaatgcaaatgttgtcctttgaaacgaaagactttaaaccactataagccattaacacattttccagattcagtttatcagcttaatttgatagtaattgagcttggccctgaggaattaggtaaatttcatggtgtagaaagtcagaatccacatgaggcaggtcaatgagcaggtctgtccagaccttttacataggacactatttatacctggccttctagaagcagggtgtatttaaagactggcaaatccagcatcatctgcatatctttttcgctgacagcctgccctgctttaaaaattaattctaactttagaaaataaataatatgggcataaaggatgattttctttcatattttaccttgactattttgtgtatgttagtgagttttattctttttaaacaaagggggtaaattgttcattgattctgaataattattctgagatggacaggccctttttttggttacatagcttcacataagcaattttttagatgatgcaataggaagggggaaatcacataagagcaaacactctctcattgctattttttctatgcacggtcataaccaatatgcttagactcattagattgattattcaacatctttctacccagtgacttgactaaaacagacaaaacgaagtactgtcagaatgctgttattgtcatgccattatatgtatccaaaacagtgacaacgcagattaaaaccatacccgtctcacctgcatcatgttgttttgtttttatgctttattgtttggggttttttaatcaccctggaccaatacaatatttttgcctaatttgtttgtgatttgcatttttatgcttacaatgcctattataattgtccaggagaaataaataaaaaatctctcaactttgtttattactgtaatgattcctagaaggaaacttgtctttctctgaagacttgtggggctaagagacagagctacttgtctaagacttaagtctttcccattgccttttcatttatgacccatcagaacctacttaaagcctgcagtcctattttggatttacatatcattgtgttattacttttaaataatccataatatttaagaatgtccctttgaggaaagataatcagatacaaactgacatactttcatattatggctcatagattttcatattatagctcacactaaatcattaataaatcttactttgaggatttgcttattttcatcttcattaacaccaacgcagttaaaaaaaaaaaggctccatcactattttactgtttttggtcaagataatagtctatttttgttacacttttgatgcattgatatatttttcatgtgccatatttatatgagatatatagttattttgtggcatatgtcataatcatatgtcatatagcacatttttcttcttgagtttctttgacctcataactcataaatgggccagtaacctcaatgcatttaaaggagaaagaagtcttttaaatcatggaggaaaacattttgtttaaaaacctagacataatgcaccatttgtttcaaaacaggattgcttttatcctttgcagttatggcccttcaagaaacaaattttatgtaatgaaaagaatgtgataacttaagtttcagatgaatgaaaatgtattcaaaactttgtgagtgatacctgtgcctatttacacagctcagaatcttaaaactgttttgactttaagtttagatcatacaaatcataattgtgttctataatagtcattaagcattgatcgaacttttcatttttaaataaaaataggcattttatggtttctttcacatatctttttgtttctagaaaatgaggctagtatattctttggggtatatatggttaaaaatgaaaataaacacaaagaaataaaatgaattaatcagattatagcatttccttgctaatgatgcatgagtatctataatgatataaggtggtaaagaacattaacaaaagcaagttgattttcaaaaggttagacgggatttgtacacatcagaactcagaaggataaaattattcaaggcagagttaatgaaattcaaatgaaaaggattaatctgaatgagtacctggattttgcataaagaagagaaaatgaacatgatatttctaattacactgatttttaaataactgtctgaaatttttattaaaccaaactgaaagtcattcaatggatgtagttttctcattatagattcgcatgactgtgtcaataggaatgctatacttttaaggaatagatagcaaactagatctccaaatgtctggttctcttttgattcaatttctggtagtttcttgtatatgaaaattacaaaaaagtctatatattaaacattattgtatatatcagattgctataataaatgagaatattcaaacttaataacacggaattttctagaaaatgagttcacagtttcccagtggtgtcaaaaagttattttggaatatttctatttctcaagaaagttcacaggatcaacccttagttttctctagtcagctgatctgtaccacttagtgtctgttatctgtgatgactggacactacgtatcaagatagtaaatctttcaatagatccgtcttcattaaatatatttaaagtataacattaaccttttagactttataacgtatagctgaactgttgcccataggtaattgtaatgagaagcatcttagaaattacaggtattctaatttatctttataatggaaagaaaaatttttgaaagattacttaattatcagtagttgaggatagaaatgatttttctcattcagatttttctaaagtaataaactatacctttttattgattatgttcaaccataagaattttaatatttctaagtgttctagaaaatgtgttcatgccatggctgagcatgtagggattatttccatgtattgacactggttgctctatggcttatttgtgacaatcttgaaaataatcacaatatgcatattattagagcattctcaacctgcagttcaatggctaatatttcttttaagagtatttcgatcaggttaataagagcttcttcattatttaaaagtttgtaaaaaatgatttctagaaccagatacagaattacaattatttgtcacttaggtatctaaaattttcttaaaaattgaactcttgtacagagagtaaaaggatgattaccagaaaaattggcaatttaaatagatgccacataacactcttctaaaagagattttctttgaaagataggtgaaaatggtttttagtttaatgttctgaagaatatttgttaaatcggtatataataatctatggtagacacatggggtcaggtggagagaagcttaacagatgagaagccagggtatggtgtgctgcctacattctttaagccctggtttaggactatgattaacactggatcttatttgctgagacacagaattctggtctgagagcacgaattattattttctaagtgaatctaatttttattttatccagtgtcactgaatgattttttctttttttttttaattatacttaagttctgggatacatgtacagaacgtgcaggtttgttgcataggtatacatgttccgtggtggtttgctgcacccatcaacctgtcatctacattaggtatttctcctaatgctatccctccccttgccccccacccgccaacaggcccctgcggccatatgttttcattgttcaactcccattatcagtgagaacatgcagtgtttggttttctgttcctgtgttagtttgctgagaatgacggtttctagtttcatccatgttcctgcaaaggacacgaactcattcttttttatggctgcatagtgtcccatggtgtatatgtgtcaattttctttatccagtctatcactggtgggcatttgggttggttgcaattctttgctattgtgaacagtgctgcaataaacatacgtgtgcatgtgtctttatagtaggatgatttataatcctttgggtatatatccagtaatgggattgctgggtcaaatggtatttctggttctagatccttgaggaatctgcacactgtcttccacaatggtggaactaatttacactcccaccaacagtgtaaaagagttcctatttctccacatcttctccagcatcagttgtttcctgactttttaatgatcgccattctaactggtgtgagatgctatctcgttgtggttttgacttgcatttctctaatgaccagtgatgatgaggtttttttcttatgtttgttggccgcgtaaatgtcttcttttgcgaagtgtctgttcatatcctttgcccactttctgatggggtcttttttttcttgtaaatttgtttaagttccttatagattctggataatagccctttgtcagatggatagattgcaaaagttttctctcattctgtaggttgcctgttgactctcatgatagggtcttttgctgtgctcttcagtttaattagatcccatttgtcaattttggcttttgttgctgttgcttttggtgttttagtcatgaagtctttgcccatgcctgtatcctgaatggtattgcctaggttttcttctagagtttttatggtttcaggtcttaggtttaagtctttaatccatcatgagttaatttttgtataaggtgtaagaaaggggtctagtttccgttttctgcatatggccagccagttttcccgacaccatttattaaatagggaatcttttccacattgcttgtttttgtcaggtttgtcaaagatcagatggttgtagatgtgtggtgatatttctgaggcctctgttctgttccgttggtctatatatctgttttgctatcagtataatctgttttggttactgtagcattatagtatagtttgaagtcaggtagcgtgatgcctccagctttgttattcttgcttaggattttcttggctatatgggcccttttttggttccatatgaaatgtaaagtagtttgttctaattctgtgaagaaagtcaatggtagcttgatgggagtagcattgaatctataaattactttgggcgctatggccattttcatgttattgattcttcctttccataagcatggaatgtttttccatttgtttgggtcctctcttatttccttgagcagtggtttgtagttctccttgaagaggcccttcacatcccttgcaagttgtattcctaggtattttattctctttgtagcaatttttaatgggagttctctcattatttggctctctgtctgttattggtttataggaatgcttgtgatttttgcacgttgattttgtatcctgagactttgctgaagttgcttatcagcttaaagagtttttgggctgagacgatggggttttctaaatatacaatcatgtcatctgcaaacagagataatttgacttcctctcttcctatttgaatatctttctttctttctcttgcctgattgccctggccaggacttccaatactatgttgaataggagtggtgagagagggcatccttgtcttgtgccagttttcaaagggaatgcttctagcttttgcccattcagtatgatactggctgtgggtttgtcataaatagctcttaatattttgagatttgtcccatcaataactagtttattgagtgtttttaacatgaaagggtgttgaatttatccaagaccttttctgcatctattgagataatcatgtggtttttttggtcattggttctgtttatgtgatgggttacatttattgatttgcgtatgttgaaccagctttgcatcccagggatgaagcctacttgattgtgatggatatgctttttaatgtgctactggatttggtttgccagtattttattgaggattttcttttttgttgtgtctttgccaggttttggtatcaggatgctgctggcctcataaaaagagttagggaagaatttattttcttttgtattgcttggaatagttttagagggaatggtaccagctcctctttgtatctctggtagaattcagctgtgaatccgtctggtcctgggcttttttttttttttttttttttggttcgtaggctattactgcctcaatttcagaacttgttattggtctattcagggattcaacttcttcctggtttagtcttgggagggtgtatgtgtccaggaatttatccattttttctagattttctagtttatttgcgtagaggtgttgatagtattctctgatggtagtttgtatttctgtgggatcggtggtgatatcccctttatcattttttattgtgcctctttgattcttttctcttttcttctttattagtctggctagtggtctatctattttgttaatcttttcaaaagaccagctcctggattcattggcaaatctcatttttatttaacgttcctttctgcaaataccaaaatagtcaaaatttgggtttgaaatttcatttaaggaagttaaatacaagttagcagacaaaagtgagtatattttgagtgtctttttcttcattatatttgaccatacagctaagtttcttgctggctataatccacaattactatatttattaagcaccaatatgaatttaagatagctgagagcatctcaaatgaaagtaatgaagactgagaaaactacatatcaaagaagaatcagaaaatagataaaaacatcttagaattatttttcttttaagaaaaagtgatgaggacatgcatcaaaacttttctgaattcccactgcttttgttaaggccacccagatttttttctaaatattttcaagatatgtccaattctgaaacaactcccttgattaaacaacaaaacaaattaataaataaatgaaaaactacaacttgtcttctacttactctgttcctgataacaaaaacctttgttttccaaaaacttacaggtgtaaaatgtatcattaaaggcagatttaattgcaccattaaataagtattataagaaatacgcttgctttagatgatgtgaagctatctttactgcaggggttatagcaactaacgtgaataagaaagacgagcttattaacttgtaaattttattaagaacaacataatggtcaccaaccaatgtaatgcgtgcaaaacacaagcttgtgttacttgtgctattgattctactgtttaatgtgtcagtgaaaatttcacattcaaatagcctgctgagttatttttcttttaaatgtgtaaaatgcttatgatgaaatagtgaaattaagaatttcttaagaaatctgttaaattctgaattttatttatcaaactctggctcaagtttctaatatccttttaaatgtaaatgagaaatatatatacattattccattgaacatgaaggaatgtgtgccatggatttggcccagatatacacaataaaacaaatgttgtaaaaggtataattatttaatagctaatttgtgcaattctgtgaatttgctatatcacaagtagatgagatatctaaattagaattacttcattttttatatcatgtaagaattgagtatgaaaatcctaggtcagagaaattaaaaacaaaacataaagtgaccagcttgtaaattttactcctctttgtgtggggttcagtctagtatccccaaagtccaatgtattacattactgcaaaaataagtatggtgttgtcataaaaggctgtgcagtaataaatggctacgttagcatgcttatcgtttgtacttccccagagaccctaccactgaaaccctcaggtgacctcatcaacaggcaggtggcagttgatcaattctagacaaagttattgggagaataatttcaattacaagaattttgctgcctatagtgtagacagaagagagcacaggtcatccatctttctgaatttgcctgccaagtagtatttattttttgctcttataaagaatagggaaagatgtattactgggaaactccaaaaggactctggagctggaaattctcatcatgtctagcacttggatcccagtcagaaaagtgtaggtgcaagagaagaggctagtgctcccttatatatcaggacattctggagttctttttaaaatataaattccgcagtcagttctgctcatatagcagcttcattagcagcttaacttagcaagagactagcaacaaaaacaggagctaatgtctagaatttggaggagaagagggcttaatacaaagttacataccagcctaactacttcgtatctgttgtatctcagtgaactttcctatagatacaggaaagttgcctgtgttaggaataaaacagatatgagtccccctcacccaatcccatatctagatttccaggaaaattagaattttaaatgccagttgcaaattagaattagaaatttaaatgccggttgcaaaaatcgtctttttcttaggataaaactactctccttatgacctcatggtctttcgtcttatatttatggtgctaatatgtgtgtgtcacttattatgaaatgcttttaacactttctggaaaaagtaggtatataattaataaatcaccgttttactagacttaccatcgtgaggttttgaatccattttcagcccagtttgtagattcaattgtcagctgtagaatgagacctatataaacttaatggaggaggtttcactgttaggaagctaaaaaaaattgttcttttgtatatctataccagcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaaggtaaaaccaaagcactttcattcgtattttacaaggtgatcatactgatcattcatagtgccagaacaattgacttaaattgtatgcatcatgatggcattttgactttcacatggaattcttaaaaatacttgatagtgtggttggcttcagaaatctagggtagaaagacataagttagaaaatgtattttacaatatttagctttgagagacatcctaaaatgaagaaatgcacaaaaatgatcatttttacatgcagtagggacagaaaggaaccaccagtaaataaactttgatggaagaacagtttattcctagttaatggatgacttctgtttcattttccaaaaagggaaattagatttttcatttatatgtaatgtatattgtttttgttttatattttttatgtatacatattcaatttcaaattaatgtcaatacctgtgctataacatatggaataaaattgaatagaaatcaataaaatattttctttataactgccagttaaaggctaccaacaaaatccagctgttttcaaaccaccaacagcaagttactaaattctcaagtaaggcaaataatgatgatgaaataggctatgaatttcagaaggcagtgtctgaagataaatgaatgtaggatcaagaaaatgcacataataatgtgtctccagataattttcatgatcgtacattttacactcaaaatgaaatattatagtatacccagagcttggtattttcaaatgcaaacagtatgtgattataggcaaaagatgggtttgctatcagcagcacatattagctaaagtattttatactcaaatggtttcctggaagctcattctatatcacacatttgcctgtatgaatatacaaatggataaagctatttgtttgttttggaaatcggtgttgcagtatcttcagtgacttgactttaatatcttaacattatatcaaataagctataaaattacacagtaaaataagagcttcacagatctctggaactattccatccatgtcagtgtggcactgtttcttattctgtttgaagtaaaagtcaaatcacttattggtacaatgaagaaaagaaacctaatcagttaataaaataaagctgacatgccagaattcctgtcattatttctattaactaagttctcatggcagcatagtttgtaagtgcatcattgtcattcaataagtaaattattgccaatgagctaatatccattccttcccaggttcatggacatttggttcaggagagtagtgaccctgatcttattaagttgcccattgaataactctgtctccatacctcttagcctggcatactcagaatgttagacccttggctacactcacagtgaatcatttgttcatcctgatctatttaatattattatagctgatgtcaatcgtaatagtattgattactgcggtttataatatggtattattgtagatttaatttagctaaatggttgaatccccataagatacagttgtgggcatgattccttctgtctcccaacaaatctccagcaggtgaatgggcttcctaccttcattgacttttttgaagggggatagttttgagctcagtcttttcagtgaatatgtatttcctgttaaaggcattcatcattgtcattatccagtagtaaaaatggaaaagcagtgcataaattgtacagctgctggttgggaaggtttgaaattgtggttgattttattcctgacagatatgcatgaatcaaattacagaactatagtaagtattgctgtgctttaacatacatcttttttgaaagtgcagtacaacacaaataatatgtaatatgttaaaagaattactttctaaacaaaatacaactaaaatagcacgtatggtttcaatagatgtattgaattggaaagctacctaatcatgttgacagagactatgcagataaacacaaacatatatatatacgtatatatatatacatatgtggaaatctgcatttaatagcaaaaacactagctaaggcagagctagagaagaatgagaaacatacacataagtaatattttctttcttacttcagagccaatattaacagttaattgattgtgattgcttatatgtacaaagttaataatactcataacagacaagagtacataattttagaagaattgcaattttttggaagtttagagcaatattaacttgcatttcatttttaagaaaaaatcattttcatgataaaattttccaaaatataattactgtgttaaaccgtcaaatcctgccttaaagtatctcatatgaaagcatgaacacagaatttcttagcatcgtaagttttaaattaccaaaaggttttctctggagagagttaaatatttgaaagcttatcctaaaagcagaaatgatccacttaaaagacttaactgaaaggatttatcatcatgtgtccatatgcctaattttactgaaagcatcagttttattggaggatgaaacactcttgggatgtcacccatatcatttcctgactcagcatgccttgtactctgactggtagctgccagatccaagtgtctctgactgtttgccttagggctctctctagtaatcaaagctcatgagtgtcaggtagttaaagttctgcatcccccgtgttccccagcaaacctcaaccaataacaaataacttttggtggataaataccactactcactcattcttcagttagggtaactctgaagcatgatttatgctctgacccaaaattctgttccaggattaagaccccatcgcacacagtaaaaacctgcctcataggatacatttcacttgctccctgtcctaccttacacacactttactagcacctccttggatcattcccaaagacatcccttgtcttcgaatctgcttataggggaactctatctaggacatttttgaaataaataatgacatatttactgtgtagttagcatttacgtagagaaattcttagaaatagttcatgcctttggagtggaattcttcaagtgattctgctgctccctcattcagggaatccttagctgttcaattaggccttggtatcaataaatgtgaatttttaggacaaaaataagaacatagcttataataagaatgacaactatgctttaccttttgcaataatgagaatcaatttacagctaatattattctttatggtagagcagaatgtcttcacctgaagaacatgaacaagacaaggatatctgcccacatcccttcaatattccacattgcactggagtttcaaatcactgaaaggaggaggaaggaagggaggaagtaaggaagaaagagagtgagggaaggagggagggagaattgaagaaaagaaataaaataaggagagaaacaaggaggaaataaatggaaggaaagaaaaaatatcaggcacacatcatttcagttgtctcatcaaaaccaattatagtacagatgccttgtttggaatgaataaaatgtgctatactttgggtaaccaagagggtgatgaaaaacgtggccatatgaagaaagctcacgggtaggagacatggtggtcctaatgtagattttaaataggatcaagaaatagagacaacccttgttcaagttcgagaccacaagggaaagctggtagtgagcttataagccaaagatagtgtgaagccaggtcgttcaagtcctcttgagttcaggttttttgcattgctcttgagaaacaaaaaattgttaggacaagtaaacctaaggaatgtggattcgtatattccaaaaatagttattaagctcttagtatgtaccacacactattctaagtgcttataaaacagtgaaaaagactaacgaatctttgccctcattcagcttttattataacattgggagacagaatagaagcaagcaaacaaagaaaaatgataagtaaatattgcgtattactaggtgatacgtattttgggaaaaaaaaaaaaaccagaatctgttaaggggatataggaccactacaggggtagacgtaggtataattgaaagtggcggaattgccatttcaaatagggtagaaatgacctttgagcaaagattggaagaaggtaagggagtcagccatggagtctgtgtagaggaaatagagtagaggcccaaatgtgggactgagcttatcttaatcaagcaccaacaagaaggccaaagtggctgaagcaaaacaagccagtggaagggtagaaagagatgaggatatgggagttgtgagtgtccagattgtggagggcctttggggccattgtaaagaagattctaaatgagatgagagcaattgtaagtttctgagcagttgagtggcatgatctcaatcatgttttaaaaggatcacactggcttctgggttgagagtagaactgtaggggaccaataatagaatcaacaagagttgaaaaagagatgctggtggcttggacttggtcggtagtgagagaatgtcagattctggaaatattttgaaattagagatagcagatatatttctctggtcatacagaaacttaagcatgtgtctatgaaaacccattctcggccgacttggggctgagttagaactttggtctcgtaaaacctagcagaagatcccttgagagatgtatgatttcttctcatattttagtcttcgattcttcagtcttgccttgaagtagggacaaaagtactggcaacagagatttttaatacactggttaagatctttctcctctggaatctgtttcacagctcttaagcacaaatttaataatcccaattagttaaatgaaggcaaaattatgccatgagcaaagtgactgcttttctattctggtattaggagaattagataatagcaagaggcaccatatgtagaaatccaaacaaaatatctgaaggaaaataaaagaacgattgtttatatgcgtattgtaatacaggggcatattacattgtttatatgcatattgtaatacaggggtatttaataatattggaataagaggacattgcaattactctaaataatcatggatcatataaaatttcaaagcaaaatttgtttgcaaatgctttttgaattcgagttgaattttctaatagtttaatagttctaacagtttaatgcgtggaaaagatgatttttattaatacattgtgactttgtagaaactgatcttttgaactatacataaacatttgcaataatgtgatcagtggtttctcttagaaaaattgagtttttcaacacatttatttggttataaatataatttgtttcttcaacagcttatatgacttgggatttatttgattgatttgctatatataaatgtgtgtattttcaaatattaatcattaactgtagtttaaatcatgcttaaattatttccatagtacattatttttcatttgtattatatgaaaagatttgtactatagagaagagattatagatatttactgcctttcagtcatgcccagctcatatttatatgtgcttcggtacagttttcttttatattttatacaaatctctcttgtaggaaattatccattctttatccccaaccattattttatcaagcctagcagttgtcctaccttgactattatgctgcaatttactcccaactctgctaaaatgtactttaagaacgcactcctactccttccattctcccagcagcactgttttcataatccccatcgtgtaaagtgtagaaagcagaaacttccatattaaaacttacaaatcatgaggctggtagaaattttgaagttgcagttaagttgtggggaggttttccttttattcacaaacggttgaagctgtgcttcgaccagttataatgtcgttttttatgtgtgatatataattactgattcgttatttatgcaaagacaatgcatcatcctatgaagaatattttggtccaaatacgtagctgtgtttagaaagtgttttctcacatggggacaataaaccatgaagaaaaaattaaaaggtcaccttaccatagagccaccaaaaataactttttaactttttttggaagctccgtaaaacctagttaataagtactttaatgccttttgattgaacacagttcccaattcgatatgtcattaatgtagtgcctggtagctggatgggatgtgaagagtgtaagaattagatttatatagggtgttgcctttatctgtcagataaagacaaattccagagagtgaaaatgaactggagtttgagtctttggttctcttatttctctttttccattttaagatagatctactccccaacggccgctgtcacaacagttactaatgggtttttctaatccttttttcttagaaatgaaagttatgtgctcctctgttaaccaagttacaaagtgtctcaaggcatttctgatacctaaaactgcttaaagctattattttcaccttcccaaaatatgacgacaatagtgcctagagttttataagtctataaacactatacatgcatttaagtatatgtataacccatgtaactgcagtgctacatttttcaagaaggtgatacatacacacagccaccaggaagaaaaattagtatcttgtttgttgtttttttcctccaccactgtatctagaactcctagaacagcacctagcacttaaaggtactgaatgtacatctgttgaattagtgagtgatggtctgatacatgtaggtgtggactctgagatagaagaagacagggcagtgttagtaagcgctggtactaaaagagaaaaccaaatttacttctttttatattgtatcctaactcactgagttaaatcatctagacatgtgcattctacaaatctatatgcatataagcatgaagaaattgttctaggtttgtatatactgaatctaaaacaatcatttatgaaaatgtgtgacagggaacccacatataattaaaacattactaacatttttccacatcagtgagctttcattatgtggttatgataagcagtagagtagagagtttagcaaagtactgtattggaacctgaaaagcttagaaagatttaacctgattgttgatagttgtacccttgggcaagtaacataagatatttaggcctgttttttaacgttgaaattaaatcagtgataataactgcccctgcctactcaactgtactcttgtgaagatacagtgaaatcatgtacgactgtgtaggaaaattcctgttaaaatgtataattatataaatttcaagatttgtaaaatgcatattgcttcatcaaacatcccaaattctaagaaagttataaatttccacgtaaagtatcctaaaaacaaattacctttaagaatgtgttaaacattataaaattgcatatttatatcttaaaaaactgtaaataaaatgttaaccacataaaatatacgtaaagttatttccagatgtggcaaatattctaaagctaaaaaaactttaaaataagagaatacatacaagctaagccacgtttgcttttgacaaaatcttccttagaggatcttacaaacttttgatcatattcttctattgtacagaatgttccttgacttgtgatggggttatatccagataaacccattgtaagttgagaattttgtatgcggaaatgcattcaatacacttaacccaccaaatatcatggtttagcctagcttaccttaaacatgctctgaacacctatgttaacctacagttgcgcaaagtcatagaacacaagacctattttatagtaaagtgttgaatatctcattcaatttagtgaatactatactgaagtatggtttcgaatgaatgtatatcactttctcaccaccctaaagttgaaaaatcactaagtagaaacattataagacgggggccatgtgtatttccgaggctagttgttacttattcaggagtaatttttttattcttctatttatttaaggtataaaacaaataactcactttattgtatatttatcttgaggtgcagaaatgcaactctaaattattccaagattctgtgtaccataacttttaccaagaagaggatgctgttttctagcttggttttaattgttgttttattttgggctttagtttctttatgaaatgtgttgatttattttttccatttctagttcagtaacttaaaacccattgttctaattgtgagttcagaaccatgacaaaaattattgaaaaatattgaaactctaagcaaagaatgatttaatcagtagtgtttttttctcttttttgctttggagtcttgaaatttgcttttgttgtttattttttgttgtctttcctttgccatttaaaaaagttagtttgtatttattttctcctggttaaatttgtaaccatgaacatattaaaattataatgctattccattgaaccttatgaattgtcaagtctttcaaaaggtttaaatattggcaatatcttatagtttaatacaatgacttgtacccaagtctgcttatttctgaatattaatatatatcattaaacatcctgatggaaaaaaaacaagaactttctgttgtaaatcacgtatgattaacagacaccaattcccaaatttaatttgccaaaccacaggcaaaaattaaatagtgttatcagtaaggaaatctatggagcttccaaaaaggtaaacattgagtagagtgttagcttcctgctcccatatcatgccttttgtttatttcttttctttcttttttttttttttttagatgtatgcatttgggtacagaacaattgtatgaaagagcgattttgcttttctgtcccctgtgtaaaacaatatgatggaaagcacatttccccaacatcagaagtattagttatatataaaacgggcataatattaccaaatatgttttctgttttaccaaaatagtttactgtcatcaatattaatttttgcaggtttgattatattttatcatgtatggtagctacctatgaagttgcttaatcatttatactaaattttcatttatcaaaataataagatgctcatgattgcatatgtaaatagaattaaaaagtataacatgaattttaaaaaagcatattccattcattggtgatcatcagtttttgaggttttcttggattgttgtattgctttggaatttttcctccataaaacctacctggccctcctctgctgagtcacacaacactaaagcgtatcctgactctaagaaatttgggatcatagaatgccatatattttgaactaagagaaaagtacttacttctataaaaccccctttgccatgcatgtgagtcaatttttctatttggattttctgtaaaatgatttaggcgatgtgtacaacttaacacaaaatgtacgtatcataaaaggactggtaaaattgttttcaatttacttagtgctgatggactagaatcattttatctgagaaacacttggatcagtaaagtgcagggttttttttgttgttctttttgttcttgttgatgctctgtggcatctggagaaatgggcaggtgtaattctgaataaaggacttttttcttagatatctaatgtgctgtgaggaaaccataaggaaactcagccaggaaatgcatgtggacttctattccactgttcaacagctaatgtcttgtaaaagtaaagtagaataaacaaggaattacctgaatagctcacgtctgaccatacctgaatatctatctacaatggttgaacagagtaacaaatcttagaggttcaatgattgaattcaaattggattttcataagcaagttcaactcaactttttacttcaagtcaacagatatttattaatgctacaagtgctatgcttaacattctaaaagataagaaagaaatattaaggaataatccttgtactctggtagttgataacattattgaatatacatattatagttatacaaacaagttagagagtaataaagacattaaggacatcatccaagcaaaaatatataagacatgagtgtaactgaaatcatgaaaagaagaaagcagcacaaaaagcagaaactaggaggaattttatagaggaggaatccttagcttgaggtgtgaatataactggaatctggactaatcttgaatgtaatagctgacagttattatttttgtgccaggacacattctaaacacttagagtaacttgtatggtcatcataacagccctacaaggaaggctgtattattatacccatactcagatggagaaacggaggtcctgagcagttaagtgacttgctcaggtgagatcatttttaaatatcatagttgaagtcccactctggatgttcaagctccagagtttctgctcttaagcactacgctatacagtttcttgatgcagaaaatgttttcaaagttaaagatacaaagtcagtaagggtaaaaaaaaaaaaaattgtatcagaaggatgtgtctgaagaataacaaagagattaatccttcactttgttattcactttgattatcctttcaagtgtctctgctggcaaagcactaggaaatcaagttggataaaaactgtgaatccagttttttcttttttttcctggaaaaaaagatgggctaaaagatgggcttgaaagtgtccaaaaagctatatgtcatcatggatggattttggtcagggataatccttaaaatggcaggataaattggacacaaggaaaaataaagagataaaacaataagtaaggagatatttgtgttcagcatagctggaccgatttataaaccatacccttgattcagtagctgtaccaggactctcattattaaagttcactcaggagatgcccaacatcctagatcacccattttcctgtgttagtgcaaaatgtggactggatttcccgatacatatttctatctagttaaataaatactctgattggttaaggaaaggttttctggaaggtgtatataatcccaccatggcaacagaaccaagagtctctgactgtctaccaacctgtagacttgaattttttccctgtactttcttctagcttcttcgatttctgttatccccaaaacaccttgatgtagccttaagcagaatcaaccatcaaagggctaactccctcctcctgctgggtgccttctctgttgggccccagcagcagtgaatctatgctcccaacttgacatttttcttatcccctttcccacctcccctaaataaaattcctttgtgtcaaagtttgatttaagtgatagaaatggctaagattgtctacagggttgggtttggaagaaaagaggtctggaaagggaatatagcaaaacatcagtattttctgagcaagtttggaagagattaaaaattacccctagtgactctcaaatttatatctctagtcaagattcctctcctgaatcatgacatatatatatatgccttttatatattcacttagaagtataataaacatcttaaatttagcatgttaaaatcttacaccctaaccttatcctcctgcagttttctacactatagttaatggcaactccattattccacttgtctgtgccaaaattcttcatgttatccttaaggcctttctctaccaacacacatgtaattggccaccaaatcctaaggattctgcctttacaatgtatccggaattcaaccctgcctccactctgatccaaagcaccatcatctccagcatggatgattgcagttgtctattaacaagtttccccctcattgccttctcccctgtagactctactgtcaatatactagccagagatacctatttaaatggaaagtcagattatatccccctttctgcttctgttcaaaacccccaatgctccccatccccctcaaagtaaacagggaagtccttatgttcataagtaccttcatgggttacccaccccattctctgatatttctctggtagtcgctagctcatacactccagccataatcacttcctccatgttccttggccactcctccaggcacattccagtgtcagggcccttatacttgctttacctgtctggaatattattctcatgatttttctttcaatggttaatttctgcatttccttcagatctttacttaaaaactgccttcctggtaaggtcttccccgacccctcttacctaaaattctgacccccactttatccttcatttcttccttccctgctttagttttgctcctcagcacttaaccactatctaactgagtatatagtttagtcatttctctatttgtttactttattctcctgtagaaggtgagattccagagagcggggcttttgctttctggatcactagtatatacccaagatataatatatgactgtctcaggctgggcgcggtggctcacgcctgtaatcccagcactttgggaggccaaggcgggtgaccacagggtcaggagttcaataccagcctggccaacgtaatggaacccgatctctactaaaaatacaaaaaattagccgggcatggtggcgggcgcctgtaatcccagctactcgggaggctgaggcaggagaattgcttgaacctgggaggtggaggttgcagtgaacagagattgcgccactgcattccagcctgggtgacagagtgagactctgtctccaaaataaataaataaataataaataaataaataaataaataaataaataaataaaatatgactgtctcatggtaggttttttcaacaaatatttcttgagttaatgaatgaatacagcgatgtagctgtcagacacagagagagaaacctagaagatagtattactagttaaaactagtgtggctaggtctgtatgatgaaaactgtgcctaactgtactgaatcctgccaaggagggaaagatgaaatggggaagctattactaagtgagtgaataggaatttccttcaggaaataaatatggttaaaaatgtgaattataagtgcttccagctgtctgctaatgttagtccttcagagaaatgaaaactgagaaaccattagaaagcaattttatcacttcttttaaaaaataaagttcaatatatttcaaaccagaatatcatcgaaatactgaagtcattttcaggggaaaatgccctgaaacaacaatttcatattatcttatattttaacttatgcttttatacatttgaaattttatttcatttgaagacttttttctaattgaaatttttgactgagagaacactcacaacttctgatgtaaaattttattactgaggaaaaactgttaaacagaagacaaattagccaattaatgtttgtatatacatcccacagtggacatattatttaaaatcttggaaagagttgtagatttgtgaaggtatatgtgagcttatttctaggtatgaaataagggagcaaagacacttgtaaattatagacatccttatttagtaattggatgttgaagatgaagaaatggctgaattgaatgaccacagagacgggacagaggaagtgatgtttgtttgtttgtttaattgtttattgagacagagtttcactcttgttgcccaggctggagtgcggtggcacagtctcggctcactgcaacctccgcttcctggggtcaagtgattctcctaccttagcctcccaagtagctgggattacaggcgcccaccgccacacctggtgaatgtttgtatttttagtagagacagggtttcacatgttggtcaggctggtctcgaactcctgtcctaaagtgatccacctacctcggcctcccaaagtgctgggattacaggcgtgagccaccgcgcccggctgctattttaaataatagaactttggcacttttcacagtattcgggaagcaacgagctttgctataggtacaaaaatatatttaaaacttcagtaaattattttaagtttactttcatcaaaagtgattaacagtaagttcaatttgtcagatattactctcccctactctagttctcttcaggttctgcaatatctactttgacatttatacacataagtttaccatttagatggtaaaggcaggctctgcaatgaaaatctttgacagcaagggagtagttgtcactttacattaaatggaagaaaaactaaacagtagaagtctatcccttatgataaagaatggagcatagttaagggttgcttcatacctttatcttaaactgattagttggcaaataggtcccttgtttgtttcctagataaattttctgtattctctggcttctccttttatcctgttaaagacacatactccacaacacttgaataaacaaagcatttttatgttcaaattatttctgtatgtgtctcctttaaaaaccaattatcttcttaagggagagactcacattttaaagtctttattttcatatctcacatttgaggctgatattatgtctgtattatcaataaacacttatttaaacaataagcttttcaaacagataaatgaattgaagccacatggcttatagatttctgcttttccttactttaggtatctggatttcatctgccggttgtaaaagttactgtgctatctaatttttctctattcacagtgcataatcagggtcttctttaacttattggagactgtgaatcagagatgcaaatatcctattttaaaatattaaggactcgagttgtataaattcgtgtacagatgcctttcagaaattaaaattccatttgtatgtatatttagaatttccttttgcagaaagagtggccaaaaataaacatcttacagaatttcagcggaatagtgaagtggtcaattcataggggcatgtcaaaattaagaagggatttgactaaaaagttggtactttatcattttgacatcatattttcagataagataaggaactattcagggagagaaatagaaatgctatattctatagtgattctagggatgtttatatcgccatagcaactacaagggactatggcttcctttttagagggtcagaaactataaagatcacttatttctagacaaactaaaatagtaaaatactatcagagatctcatctctgactttaaactatggaaagtgctacagcattttctttggtgcacataccatttttctgtgtgcagtgccttgaggacacgaatatgtgcagggactttaaaaaggatgtatttcctggactccagccaattttgacagcattctctgagaatgcaccaaggagctattatctagatatccagggagtgtgacatcccctgccccagtttttgctttttgcttttctcctttaagatagaaagttttcccgcgttagtaacatgctgtacagcattgctaaaaccgttcataacttgatgctgagcaatgctacagcattccaaagaattggtagctccccagagactcagattaaaatcaggaagctttgcaagctcaaatcctcagagagtatacatacacacacatacgcacaaacacacgcataccatatcaaagccataactggataacttttatatgctgatggggaagatcctttatctcttcccttgaatgtttttctccatgggtgcttacagctatgcatttaaagggtttgggcctgctatgtactaacaaatgtgattggttgcccaatgtgaatttaagtaatcagcctttcattcagctggagtcttggtatcaggtggaggacttggcagagttatgtatctttgccattggactggcagccaagcaagaatgatggagacagtgacttaaaagaattcagagttgaatcaagtacttgtgaaatcaggctgcccaggtcaggcaagttaacagaagcagccaagaagatatgttggtgcacgtttctggtacctgacctaatcaggctagcggagtagccctaaacattccacccaagactccaggcttggagccatcagaagatggtagtaaaattctaccaggtaaataaaagtaaagaaataatactagagatacgcttgagttcaatggcttttagggcattaataacaggtattacatccattgtatctcttttattataatttcaagtgtattttagattcaggaatacatgtgcaggtttgttacatggatatattgtttgatgctgagatttgggatatgaatgaccccatcacccaggcagtgagcatagtatccaacagtttctgttttattatgagttttgtttttatcaatatgaaacttttcttcaataagcaagcctctgatgtcaaatacagcatactgcaatgtcgtacaaagctattttctattttatagtgaaagatgatgacagcaaaagacagtctggtctgcctacatttatgttttccacttccaacatgctgttgttgctctcgataagatcaccaatgacctcctaaattgcccgagctgacttttccctcctggtcctggctgcatctgacttgttgacaactccctccctccttctggttctcttcctgggtctgatgactattattctttagggatactcatctccttcctctgcccatgctttccacataggttcatctttatgctacctttcttctcactcttttcaccctaaacacctttcctgagcaatctgaccatccctagtcttattcaacatcacacacattccaatgactatcaattctctatgtgaaattgctaaaagacagttttaacctgcattcctccagataagtaaattctcagattgtttctgtgttggcttgttctttcttttgtatggtaatacctgacctgtcagataagtactttttccacagagttaaattgaggtgcgaaacaaaagaaataatgaaagctttccatcacaaggtgtacatagactggaagagaatgccttgaaattttattttaaaaacaccttctttctctgaaattcactcacatcacccataaccattgtatcttatcctgttgctgagctgataaataagacacgagaacacagttgctttttataaggttcccattgtaagcattgacttttaccttttacaactgacattatctgtagtctcacctgcctcttcagcttagttcttgctcaaggcaagtcctcgtggaccacaaacgtgaaatcttagaataaggcagaaaatcctctaagttttattgttaacttctttcctgtttccctctctgattgtgaagttttcttcagagcccgtcatctggaaagctgtacgatcagcagcagtcactccctatctaacacagtctccaacttacaaatgattaaaatgcttcccaattttgactgaaaataggcaagaatattccctttgttttgggaggctgaggcgggtggatcacgaggtcaggagatcgagaccatcctggctaacacggtgaaaccccgtctctactaaagatacaaaaaattagccaggcgtggtggtgggcgcctatagtcccagctactcgggaggaggctgaggcaagagaatggtgtaagtaaacccgggaggcggagcttgcagtgagcctagatcagaccactgcactccagcctgggtgacagagctagactccatctcaaaaaaaaaaaaaaaagaatattccctttgttgatatttgttaaaatttatatttatctagtcaggaaacataagatctctggatgagagaatacatcattaattactcaaaagcatctcagggcaagatgtttatctgtgagtgcaggggttgtagtacaggagagaaatcccagaattgtggatcttggagattatatagagcacctgatgtatcaggaggagagaaagtgagagagacagacatacaggaagacagagactttgctctgggctataaaccaatgatctaggtctattatttttggaatataagttgaaatgtaatcaaagggctcttggagataaaagtttttaaatctctccagagcaatgcactaaactccaaggtacgcttgccattcagtcaccctttaagacagttactacaactctttgctcagaaagcctagtccatgtatccaaatgtgaaaatatgtatggctcagcaatccctgccatcttactcctcttctcaaaatctgatttcaactgcctctggaacatctacagtttgatgcctcaaaggcttttcagaatgaccatgtccaaaattgaactgatcacttatgcacacatacacaagcatgtaaccatggaacctcttcatctgtctgaaatcctgttacccaatgacaccacaaatcatgtggatgcccaggccagatacctaagactcattcaagttcttcctcttcttcacccaacacacagtcactgaattctgctgagctgttttcctaaacttccttcccacttcagctcaaatgtgaatagcaactagatacttgattcaattaatgaacttttgttaagactgtaggtgtgttaatggtattatatatgtactttccgaaaaaagttctcatgagagaatatttcagcaagagaaaaatgctgaagtatttatggagaaaataatatatcagtttgtttcagaataatctagttgaagaggtgagtgggtggattgtccatggagtcataacagttggcactggattatagggttatgggagctatttgtattattttcctactttcaaatatatttgaaatcttacataatgataactttttaaaaatcatagttccccattagctactgaagtacaggcagaattttctgttgagattcaaagcacattattgaacatcctcagcctctgtttcatgccccatcttcccctaagcttctatgttactgaaaaggcagccaaatatgactgcgcttgttacctagctttgcgtgtgtgttacctactagctctaatgttcttcccacttctactactcagatatgtctactgcaatttgcaccttcttcgtgaattctttcctgagcctatgaccaaatatatgatacatgttttctctaacttctagaaaatgtttggtaccacttggaacactcatttcttccttcttctcatccagctaaggcttctatacttggatttttttcttcaattcttcaaaccatatcctttcttactactacaataaaacctacttaaaacttcttaaaggcaaactaaactgtgtttcacccacctttgtttctgctatattgctccttacacatgggaagaactcaataaattttgctcagtggaccttatgtataatttagatgatcaaaataacaaaattcgtactaggaagaatagccagaatgtagtttttagcaaatttattgagaataaatatgtttagatttttctttcttcccgtataacccatttgtggtttgtgatttttccgttaaatagaatataaacaaaacattatggattaaatttatgggaccatctattcatttattcaacaaaaaagcttttgccatctatcatgtgccaagcacaggtttgagctttggaagcccaacagataacaacatccctgtagtcatagatttcaaattagtggtatataccggctacttgatatatattttaatgttagtaataagtactataaagaaaagggaagagtaatgccaggaataaagagtgattgctggtgctatttaaaatagagtagtagagaaggcccctttaacgtgagaaagaagtaagggaaccactgatagaaatgtgggttaggaaaactatttttggcaggtagaacagcaagggcagaaatcttgaagcaagaatgtagttgttatactcaagtaatgcaataaacctaatgagggtgaagtgttgtggactatgaagagactgggaagagatgagcttggaatggtaggtagtatacaaccaagtcatgtagagatttataggtcatagtgaagattatgcttttttaaaaaaagtaaaagcaagtttattaagaaagtaaaggaataaagaatggccactccgtaggcagtgcagtggcatgggctgcttgactcaggatacttgtagttatttcttgattatatgctaaacaaggggtggattattcatgagttttctgggaaaaggagtcagcaattcctagaactgagggtttctcccattttagaccatattgggtaacttcttgacattgccatgcatttgtaacctgtcatggcactgctaggagtgtcttttagcctgctaatgcattataattagtgtataatgagcagtgagaaggaccagaggtcacttttttcaccagcttggttttggtgggttttgactagcttatttacagcaacctgctttatcagcaaggtctttgtgacccgtatcttgttctggcctcttatctcatcctgtgactaagaatgcccaacctcctgggaatgcagcccagtaggtctcagccttattttacccagcccctattcaagatggagttgttctagttcgaacgcctctgacatatttcccctctttcttttacaagggaacccttaatcctaagggtagtagagttacccttaggattaagtagtagaagggtaatacatcttctgtaacttcttcaggctgaatatgggtgatgatatttctgcctaactattagggtctcttgtattcagggtagagaggagctcagtcagcaagcatcagcttggtgagggccattcataactgataaatggtgatatctggaagattagtaagttttcaatctaagaaaacattgagtaagcttattctgcattcctatacaaaaagtaaaacagcaaatatattccacaacagtaaaacacaataagtaaaattatcccaagtaaactaaattagaaggctttccgtgaactgggcagctgttggaaccaaagtgatgtggggctgctagctgattccaatacatgcccagaattagaatactgatccaggtttttatattacccatccttcttgtttcttctgaggtgcagtcagagatcactggcaggttcacaggaataagcaggatcagtctatattgcaggaaaaaactcaaaaacagctgacgagactaataacaggtgtaccatagttcttaaaacataatttttttctctctccagtctcccatttttactaaagatggatcatcataggactgatttgctttattatacttggcctgattatttgtataaagtgttgcaagaataattatttttcatgtaggcttttgaaattggctgtgattgaactctgtgatgaagagccaccagaagattttgagcagaggagtgatatgatcccaattatgttttaaaagaatcttttcggctcttgtgtggagaattatccagtaggggggaaagagcggaagcaagaggaccatttagataggtagttctataacccagatgagagacaataatagcttctatcagatctgtagcaagaaaggtagtgagaagcagtcaaattctgcatatgtcctgaaagtcaagccaaaacatttgcccaataatttgaatactggagactgaaaaaattaaggatggctccaaagttgtcaatctgagtaattgttaattgaattactataattcaattgaaatcagtaattgccatttactgaaatgagggaatctatgggatgagaaggattaggaaatgcagttcagaattttgtttgcgtcatattaagtttgaaagtctcgtgagacctccaagtgttgagaaattagcatttgttagactggagttcggaggagatgtccgggcttgagatacacatttgggtgtcattgtcttatataagatatttaaaattatgagaacaaatgggatggattatggacagagaagaaaagaagtgcaaatactgagtcagagcactctaatattaagatcaggatgagaaggatccagcaaaggaaagcagaagaggtcaggatacagaagccaaatgaaggcagttttaagatgtagggagcgatccactctctcaggatgaggtctgtgatttacctattgaatttgaacatgtcaaagtcactggacttcatggttattaactttaaaaagtcaataattaagaattgcaacaccatttgctacctttgggatttgtatatatatatatatttttctctttctatagacagctaattcatttttttactgttttaaaatttttatattacagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggtaggtaacacatatatttttcttgatacttgcagaaatgatttgttttcagggaactgtagaatttatttcagtaccctccatggaaaaaagacagggaaaaagaagtatcactctcattgaaaaatggtaagtaaaatgagaacaaataatgatgaacaattcagacaaatgagctgaactgtagaaattattcagtattaaatttagcgttatgttgaagcattatatcttctaaaatttcaggtaatcgtaaatcagattggggcattgaggtgctataaacagttgttcgatataacatatttatctttagtcaaatctgtatctacaaatttataggagtttgatacttagattaacatgtttaaaatactacctatcaataaaaaaattgattttcatttatttatattttggagggtgacactttacactttgcattaccctcccccacatttttttttgccatggggaatttgttaagttgatttaaaatcatgtttctttttatcttaattgaaatatttagctgttgacttaattggggggtggcagaaattcaattacattatttagcttcacatcacaagaagtggattactctttcttttacatttttagattaaaagtaataaagttctctaacagcttaaagtgattcatttcagaagtctttatcctcaaggtaggcttcttaattattctcagaggaaatcaaatcattcgtctaataattatagggaacctccatggtatctcttacatctgtccatttctaaccatctttactcctattttagttcttggtttactacatcaggcacctaaagagagatttctagcattaatctcagttgtctcaagtgattatctccactttgttctcaacgatctttcagtggccgtcatttttctaaagtgtaagagctttggtactataatctcattcccttgagaatgaaaccctgactccttaattgtgcaaaattatctggtcagcctcactgcttatttcttcgtgcctgccctatagcaagcccctccaattatgttctagcgatattaaatcaatttgcagatgcccaagtgttttgtactccctctgacctgcctgttcttcaggtctcacttcagatgttgtctttttctagaaatcctaaaactattagtcgctcctaacatctggaaacttggatattgtttcatcatttaatgtaatttaatatcaataaatcatttatgcatttgtaaattttccagacttggtggctaccgtgtagaatatatgatctgatgtgcctgctcctaaaacctaacacatagtaatcaatttgtttacttttctgcctcccacacaagctccttatagaaaagggctatgttttatttgtgttatatgctcaggactgatatagtgctgagcacaaagtgggtgttcaatgtgtctggactcaagcctcctctccgaaacctgagaatatttcccctttggatagtctaccagatttatctcactgcaccttccagggcaggtgcggtggctcatgtctgtaatcccagcactttgggagtccaaggcgggcacatcatttgaggtcaggagtccgagaccagcctggccaacatggtgaaaccttgtctccattaaaaatacaaaaatgacctgtgcgtggtggcatgcgcttgtagtcccagctactcgggaggctgaggcaggagaatcccttgaacccaggaggcagaggctgcagtgagcccaaatccaccactgcattccagcctgggtgacagagcaaggctccgtctcaaacaaaacaaaacaaaacaaaaaaacagatttatctcaacttccttgaaaatagctggtcccacagtatccaaagccaggcttgataaaggcaaagaaactcagccactctgtgtatatgctacaaatacaaacttaaacttataaaatggtggctcatgcctgtaatccctgtgctttgggaggctgaggcaggagggtcacttgagcccaggaattcaaggctgccacgagccatgattgtgccactgtactacagcctgagtaacagactctctctaaaataaattaacaaaaatatttgaataaacttatatcgccaccatggtgtactttctcccagcatttcacattgagacattatgaggctctgcgggctactccaatgatgtcagtttcattaccatcttttgggatgttcattccactcttgggaagttcttccccctctggtttgtcttcttatagtcagtgttttctccaagcattctaggccacccacaccatcccctaaggaccgttgaggtttcttggatagccagtgattactgtgcttctatatacacctaccagttttgcactaaagtagaaataacgctttctgctttttgaggtttctcctccgctttactcatgagtaatttttggcaaatgatccaggtattcccttctcactgggtcatatggacatttccctttcagtttaccttcaccttagacttaaacagaaacactaacgccattccacagagagggtcgctgaaatctcaccccaactctgaggacttttctggttttgacaaaggatagagtttctctagccccaatagatccaccctgtccttatccagaggttgaaattgtacttccattgacattctataggaattggtcaggagctgttaaatttcctatgacttttagtacaatctcagatacaaactgttttaagtaattgcttataagcacaggctctagagttccaacccgttttggaattctggcctttctgctatctatgtgcccttgagcaagtctcttaaatcttctgctccatacatttctgatgtataaaataggataagaatagtgtctatgtcacagggttgttatgaggattatctgacacaatatatgtggggagcttagtgggttgcttaaacacgataatggctcagttaaggttggcaattttgatgatgaaaatggtgatcttatggttctgatagtcatgatatctgttaattcattcttacatgctttcaaatttccctgagaactacagagagaagaattagactcagtccctgctttgaagagcttcacagtcttggagagaaaaggcacaaccagccagtaaaataagggttgatagactggagctgtacaagagggcaagaacaagatccctggggaatggaatgaagctatcttactaagaatggggaataagtcaaggtctatagaccattcaaggttctgagttacaactaacagaaagtgactctagttactttaggtagaattatataaattactagaaggatatcagatacctcatggaatcaataggaaagcctgagagctaggtttaacaatgggcagaaactataaaggaagagcaggctaggcatccagaatatatctactatcaagctatgaggtaaatctgaattattttgctgtcatgccagagtccattgctttaccaggagcaccattgcactggacattgcttgctatcgtcactgcaaaaaaaaagtatctaaattatttattcttgctgtgtgtcgctcattctacaactagggtctctggcagaagcatctgatagtcagaggatggatatttttttctgtaaaggggcagttagtcgatatttttgtccctgcaggtcatgtagtctctgtcacaactactcaactctgctgttttagggtgaaaaaaaccatgtataatatataaatggatggacatgttgtgtttaaataaaactttatttaccaaggcagatggcaggctggaattgctgatgggccatagattgatgactgctgttacaatacaggtttaggccacagaactaggttcttattgccagagatcagggaaaataaatagctgaatttgttcttcattgtagtggcagtcaacacctcgtgtcctactaagtcccatacaatggtagattcttgaatccttggagagatttagaagctatgcattcctgaatacacaaatgttcagtacagccttcatgtggtgttctcaacaaaaatctgctgagttttttagtaagccaatttgggttaaatcaaaataaatttgagctagtaagaagggctatattggtatttttcttaaatggtacatgtatggtagtattagctatgaccgcaataatgctgtgacacaaatcaccctagaacttgctgactgaaaacaacaggcatttctggctgtttaggttacttgtaccttgactgactcagctgggcttggccgggaagctctgcttcaagatgtgggttagtagagctaggttccatgatgcatgttggattaaggtctgctatatatgtctttgctctggacctaagatgaagggtcagtgacatgttttcatgaccagtcaccaaagtataaacctaaacctcccaagaacactcatggcctctgctcctgtgaagttcactgacatttgattggccaaagcaaattacgttgccaaatctgacatcaatagaatgagaaagtagactcttcctacagtggaaggggggagagatgttaatatttgctgaaccataattcaaattattagagatagttaataatttataacaggattgttttacagctagaaaatgccttagtggttttgccctgcttcattattttataagggagaaaactatatttcaaagatgttatgtgacttgcctaagcacatactaaatagtacatctgcgtatttctcgttcagtcatctctattaaatgtcataaggtaaaacagacattacgctttagatgagaacaggaagatatttaaaaagccagactaatttatgactgctcattcattatctaacatacctgcttccatacattgtctttcagcaaatagaatttcaacatgtatctcaacaagttacacatcatcaaagtattaaaagccttattttcacggacattctgattgttcactaacagtcaacacagtcaacagtaaatccacaagcaccatgaacgtatggatagatatgcctatatgtaagattactagttaactttttgggaaattaatattactgctaaattcagttttcattgattttcgggtgggtaactaactgcttataaaatatacctataggaaacatgtaaaaacaaagaatttacataagatctatctgggattagagaaacaaagctcttttcttctttcaatgaacacttaagaagggcctactaaatgtcagatgttatactctattgtcgttagtttctttctgataccatctttactatcctgtaagccattagtgagtgtttcccacttttagaaaatgacttcccaaagactaagagggtagaacagttcaaatgctatcatcaaaatgaaggcagtttctagactacaaattgctgtacagccataagatggcattattgtgtaacaacaaggtccctgtcaaacatcaagaaagtaatgttttaaaatcagtatttccttcttggaattctacttagtcagatatgttgggttgacttacccacccatataagtagttaaattcaagatggttctgagctttagatatgatgtaaaatagacatgagactaagagtatttatttctatattattacatttctatagcaaaaaaagaaacctctaaaaaaattagagaaagaagtataagggcatttaattaatcaaatgttcttattaataatatttcataaaataaaggaaatgttgaaaaataaaatatgaacacagtgttgtataaagtaagtcagaaataagagaacacttactgtatgaatctattatatgaaactaaaaaattaggcactttggagtttagaggtcagataggagttacctttgtgagttgtgattaacaagggctgaagcaggcttctagggactgggtaatgttttgtttcttgatgtggatgctgcttgcattgatgtgtttcctttagggaagtttatggaaccatacacttgtgatgtgtacacatttctgtgtgaatgctggactgaactaaaatttatacttacattttaaaaataataaatatgtactttaagtacaggagggacataaatcataattgttttaataaagaaggtgtagctttaggaaaagcataccgcattgttctatttttggcatttcaccatggacccctgaacattttataattgcccagtacagcctgtcagataaatatgtgggcactactgctttagagaaagtattttccaaatttatcaccaccattctggaaccacagttccacaggtcattaggatgctgagggtgggacagttggaagctgcttccccagggatttctccattgttcagttctcatagcagtaagcctgcagcattaaagcactcacaggctctggctgccatttgtgctacatgaagaaaaatgagaaaatgaaagaaacgaaaggagagaaaacaggagtagaaaccaaataaatcagattcgaagagaaagtccctaatcgtctctgtattcagacagtagggaatgagcatgcaattctgcaagcccattcctaatgtgagtttctgataagaatttgctatctcagttgtaatctttctactgagacattcaataaataattttctttcatgtcaaggtaaggaaataacctcacattacccatataaggaaagaatagtatactaatcctcacgttatcactatagaattttatcttttaaagtggaagctagagggacagatgcataatctgggagcttttccagaattgtttgttcctaaatgagacattcagctatagcagcattagcagcctcttctatttgtcacaatgccatatgtagttgggaagatacatgataagcacatacaggatgctgacaactcacgaaggattatcattgcagtcttagaattaatctctaccatatttgaagatttttatgcaagactggatcttcattccacaacccaggtataggtatatgtgccaatacaaaatacttactgttggtttctgagcttggtagaattaggaagtaaggggtaaaaaacaagcaagtcctgaacttaagaaagttgttcatatcctattccatggccactgttttactgactggaagaaaggaatcccgtggattcagtcatggggacaatgcagaagaagatacagtagacagacagagaagtacaaatttctatttatgttccacttttcaaaattttttatctttaaatgttatttttaacgtttgtgggtacatagtgtgtatatatatatatatatatatactgtatatatatatatatatactgtatatataaacacacatatataaatatatactatatataaacatatactatatataaatagatttactatgtatatacacacatacatagtgtatatatgtggggtatatatatatgtggggtacatatatatatgtggggtacatatatatatatgtggggtacatatatatatgggttacacatatatatgtgtatatatgtggggtacatatatatatatggggtacatgagatgttttgatataggcatgcaagtatcatggaaaatgggatgttcatcccctcaagcaattattctttgttttacaaacagtaaaattgtatttttttaattgtttaaaaatgtacaattaaattgttttgactatagtcaccctgttgtgctagcaaatagtaggtggtgttcattctttctaactattttttgtaccaagtaaccatttcaacctccccctcaacccccccactacccttcacagcctctggtaaccatccttccaccctctatctccaagtgttcagttgttttgatttttacctgccacaaataaatgagaacgtgtgatgtttgtctttctgtgcctggcttatttcatttaacacaatgacctccagttccatccatgatgttgcaaatgaaaggatctcattctttttatggctgaatagtactctattacgtatatgtatcacattttctttgtccattcatctcttgatggacgctcaggttgcttccaaatcttggctattatgaacagtgcttcaacaaacgtgggagtacagatatctctttgatatactgatttgctttctttgggatatatacccagcagtgggattgctggatcatatggtagccctgtttttagtttctgaggaacctccaaactattctccattttggttgtactaatttacattcctgccaacagtgtacaggagtccccttttcttcacactctctccagcatttgtaattgcctgtcttttggatatgtcgttttaattggggtgagagaatatcccattgtagttttgctttgtatttctgtgatgattagtgatgctgagcatattttgatacacctgtttgccatttgtatgtcttcttttgagaaatgcctattcgaatcttttgtctattttctgatctaattattagactttttcctatagagttgttttaactccttatatattctggttattaatcccttgtgagatgggtaatttgcaaatattttctccctttctgttggttgtctcttcactttattgattgtttcactgcggaggagctttttaacttgatgtgatccatttgtctatttttgcttttgttgcctgtgcttataggatattactcaagatttgttttacccagacagatatcctggagagtttctccaatgtttccttgtagtagtttcttagtttgaggtcttagattttagtcgttaatccattttgatttgcagttctctgatggccagtgatggtgagcattttttcatgtgttttttggctgcataaatgtcttcttttgagaagtgtctgttcatgtccttcacccactttttgatggggttgtttgtttttttcttgtacgtttgtttgagttcattgtagattctggatattagccctttgtcagatgagtaggttgcgaaaattttctcccattttgtaggttgcctgttcactctgcatcaattttgcatcaatattttttgcatcaattttgcatcaatatttatcacatggtagagttcagcagtgcagccatcgggtcccaagcttttctttactgggagagtttactaaggcttcagttgtgttactcgttactggtccgttcaggttttggatttctttatggtttaatcttggtaggttgtatgtgtctaggaatttatccattacctctagatttttcaatttgttggcatatagttgctcatagtagccactaatgagcctttgaatttatctggtattaattgtaatatctcctttctcatttctgattttacttatttgggtcttctcccttttttcttcattagtctggctcaagatttgtcaattttgtttaccttttcaataaaccaacttttcgttttgttgactttttgtatgttttctttattacaaagtcatttatttctgctctgatctttattatttctttcttccactaattttgggttcgatttgctcctgcttgtctaggtctttaagttgcattgttaggtgatttatttgaagtttttttcttttttgatagaagcacctacagctgtaaatttctctcttagtactagttttgctgtatcccataggttttggtatgtggtttttctttcattttttgaagacatttttcaatttccttcttaatttcttcatagacccagtggtcatttagtagcatattgtttaacttccatgtgtttgtatagcttccaaaattcctcattgttgatttctagtctcattccattgtggtcagagaagatgcttgatattatttcattgttactgaatttttaagactgcttttgtgacctactgtgtggtctatctttgataataatctgtgtgctgagaagaagaatgtgtattctacactcattgaattaaatgtcctgtaaatattagatccatttattctatagtgcagattaagtccaatgttactactttggttgagcttctgtctgggagatctgcccaatgttgaaagtggggttgttgaaggctcctgctgttattgtattgaggtctttctctctcctgagctcgaataatatttgctttatatatctgtactccagtgttgtatatatatttgctttatatatatatactccagtgttgagtgcatatataattgttatatcctgttgctgaattgacccttttgtcattatataatgaccttctttgtctcttcttacagtttttgtcctgatatcgatttggtctgatataagtagagctagtccagctatgtttgggtttccattggcatggaatatctttttccatccctttatttccagtctgtgtgtagctttataggtgaagagtgcttcttgaggtcaacacaaaattgggtcttattttttcatccattcagacactgtatctatttttcttttcttttcttctctctcttttttttctatctttctttcttttcttttctttcttgagacagcatctcactctgttgcccaggctggagtgctgtgacaggatctcagttcgctgcaacctccgcctcctgggttcaagagattcttgtgccttagccccccaagaggctgagattacagtcacccacaatcacgcgtggctaatttttgtatttttagtagagttggggtttcatgatgttggccaggctggtctcgaactcctgacctcaagtgatccacctacttcggcctcccaaagtgctaggattacaggcgtgagccaccatgcctggtcgagacactgtatctctcttgattggagagtgttgtccaggagctgagcctagaaatgggtcctcacaacactgtccagtgccctatcctactgtgactaagctggtatccaagatgcaagacagaatcctctttacttttcactctcctctccttaagcaaaagtaaggagtcacttttgttactgtgggctgcactgcttgaggtgggggaggaatggtgcaagcactcccttagccatgccagctggtgtctccctaggtcacatgccaccctagtcctctagctcttagcccaggctatgactagaagttatctaggaattgcagttcgtgtgtcccagactgcctctcaggtttacctgggactccagagcactttggcccacaatggtgaggcttgccaagaaacttgagttctgactgctgggatgggcgattcccttctggctggggctagttcaaatattccctccgtgcacaggcactgactgaggccagcatggcttttttctctactgtgacagcacagcagttagttcaatgtaaagtcccccagtagctgtactgtcccttccaaaagtgcaaagattccctctctgcactgcacgtccagtgctgggtgattgggaaggtgtggtgttggtgattcaagactgtgtctcctgcctttcctcaatgcctcttttagcaagatgaagttaaaaccaggtaccatgattccgtacctggtttttggttctggtgacagtgcttttctgtctgctcatagttgttacaatttgatgtttcagtgagggagattagttatataggcttctattctgacatcttgcaccactccgtctcacttttttgaattgttgaaaccatggtttatggggaaatgttctgttctggtttttaccctcaagatcttctttgaaaatcatgatttactaagtaactagttggatagaattcatttttaagaaaataatgaataagtagttcccttagatatagcaagcaatgttcttataaactgacacaccaaaacacttaccagttcacctaaacactgaaagtatttaaaaatttatttttaacctttaagtttttctccatttgagtatcttgtgcactatacgctctcctacatatgtctacaatctttggtctgatttattttattggttgttgaatgtcagaaaccacctgaattttgcttgtatatataatgcccagtagagtgcacattggtaatcaatacgacttgatgataataatggtaatgaacactataatttgatagcatcaacttggcatgtatgccagaaataaaccatcataaacttcgagaaaaacaagtctcattaatctgtcatttattataatctccctccatcaagcgtagcctctatatactgtcttttttgccatatgtaagtttcttcttgtatatttcagattagagcttgcctcctcccacacactatcttctatttcacactgctctgttcaagtgtttatgtttctgctgaaggctgtataatctaagataatccctagctattgtaaatatcattcactggccagtcattgcattttgcacaccactgagagagtgattgtgagccaaatagaggagattttgtttccacccagcaacccaaaatgaattgtgtgatttgactattgatgccaattacatggaagttttactaccagaggcaaagctttaaactgcaaaagattaaccccatatagttggtgtcatgaggtatttaatgtatattggactatcaaagcgtctccttacaacaaaccaattatcaatgaataatattcttatcttattgtgacttattgaaactctttaaaaaacatgaaccattcagcacactataccgtctaaattagatatctaaactagccttcatttacatttccttgtttagttttaaatataatttcttctgaattcttagttgttaagagcaggtggtgaaagaatttaaagaagaaaatttgttgtatttattaagtgaaagagctttttgaaatgcattaaatagaagtttgtttctgcccatcagcttatcttctgcatattcctatttatagttcaaagcacttaagagttgcagagtgatttgctttttatgatcaccgcttcatccaggatcatttgccttatatcttcaacattttcagattcttataaatcttcacagttcacttagaggttagtttaaaactttcttcagataagaaattgactagatataaaattcacataatctcagagttagccatagatcaatatccccagtctttttctcaaagtaattgaacatttttgtttcccaggatagttgtatacaagcattttcatcctcaccatagatgattcttgttcttcagtatatgaggggactgtatttgcctgcttgttatctaaataaacatttttattattgtcaaaggaaaaagactctaatacagaaagaaattttgtgtccataggactagcctcattttggaggctgatattaatatttgactttattcattgtgtatttcttggttttgtcatttcacaaatttcccttctctaaatatgcattttttctctacctggaatagatgagttttaaaagacattactgtaaaataaaactgtgctaaatgtacttttcccagaaactctctttattttatcaattataatttgctttggctaagtgttacagaagctcaaggtagaaatgacttaaataaaagagaagcctatttctttctcctgaaaaaccctggaagtttgcagccaaggcagatatgttggccccgctcatttctgttttctactgagtgagttatctttacttggtggaatttcatccacatgttgcaagatggagctctcatgacatccacattccaagaaggatgtaagaaggccagaagaagggtcaaagggtgcataccaattgtcttttagggaagtttcgtgggagctgccatgttatatttccacttacgcttcattggccagatgtctgtcacatggccacatctaagctgcaagtggggctgggaaatgtgtttatttcacatgtgctctgctaaaaactgttcagtcatgaaaaaaaaaaaaagaatattggaagagaactaacagtcttcaacatgtatatttaaaaagagcgttatttttcttttacttatttatttttttttgagtgagagtgttgctggggctggtctcaaactccctggatgaagtaatcctcccacctcagccttctgagaagatgggattacagaggcacaccactgcacccggctcctgttttgttttgttttgttttgttttatttaaggagccctaagaagagtgtaaaaagggcaactttgtctttagttaacccttccctttttttttctttcctaattttatgaactctgattcagcccgcatcttactctggcttactaaattctgccaatataagagtagaagttttcatcatttccctaggtacctactcttctgtttctccatattctcaaagtaatttctcattcatcaacttttgtctgacttagatttaagctactgcttaggaaatgtgagaaatggagaatttggttgtcatagcgctcctacttagagggctaatgctttcctaaattttactaaagttggatcctaagttatataagttacctaaatttaattagcaagttttgcttactaattcactgactaaccactataaaacaaggacctaagtttaaagctgatattatgacaatgtactgaaatttcaagacattactttttctggacacgtaggatggaccttgcataagataaaagagcttatttttaggcacacctatgtgccaggcatgggttcagagccttacatatatcatttcattctcaagagaaccttaattttagagacgaataattttgagttttagaataaataattgtcttaagctcacacatgaagtatgtgccagagtctatatcgtgaccccagttatgaattcttttccactacatagcctgcctccatggcatttcacataggatttcttatgctcaaggattatgttcttccttccagatctatagacatcagtagaaacaacacaaatacgtataatgactttttaaagtctcatatacaagaccaaagtactttaaaaagatgtttaaatttttgaaggtgatatctttatgttcgagatcagtagcagaaatggattgtaattcattacaagatgcttagcaaagccaagtggtaaaggattttctgatgtgcttgaggagtcctgacttgctccttagcaaattcctacacaccattcagcattcagtgcaaataccacctcttggaatccttctctgttcttgatcaattattccattgtctggattcatagaactctctgtttacctatttatcttacaggttattatcatgagtttatatgtcttacatagctgtttgcaacatgttaccattcagtggagtactttttcctacagggaagaggctgtactatataccttttgtcacccctaagtggaatgcagtatggtttcatgttagatgttcaatacatgttaatattttattgatgagcccttaaatgtatataataagcttctcactcaaaagctgtaatattctagaatgaataagtttcttgagaaactctttggttaacagaatctccatttccatcatagtgtattcaataaattattaatgcagggtaaatttccttatatttcctttcatttcgctatactaaggtcaaatcatgacttttaggtgtggatacagcaatatataaaataatctaagacctggatatatgtttttctaattagggaattggagatacatgaacagtctctcatagagaaaaatatatccattagtcactaaagtcagtataacattctggtgaaaggtttgcttgcttgcttgtctgcttacttgcttgtttcaccttctattctaggaggatgtttgtcacaattatgaaattctaacgctttaaaaatctgtttaccctatgaaagttgcaaattcttgcctgtaaggcaattttcacaagaattattttcatattagttttagtttatccgtggatagtctcaaattcctcttgaaaatatcagtgttctcaagggaaaactgcccattacaagccacagatgtggttttttgagagatttctgcctgaaatacaagttttaaaatattctttgtagtttcctagtatggctagatacttgtaggaaatgacaatttagatgcacatttgaaaattcttagcctttgagtaatttatatgtttgaataaatttaaactatctttgttcataaaaaggcaaattttgtctgtttgtcttgaaatgcttttttagtttcttcttcagttctttcacttgtctttctgtaatattcaaaattatagcatagtacttgaaaaccaaggatggtccagtctgtgtcctttgttttgaaggaattttggaatcatcagagatataattctggaatttctttgggtaccttccataaaatagtagcatcctgataaggacgtagatgctaacttttatttttatctcattttctttcccctatctctcagtaatgtaggagtgacccaaggtagctgtttattgggccctcaccaaagtcaatcaatattagtcagctacaaccacaataatgctgtgtgacaagcataccccaaaagaacaataagcacttatcctcatattcacaggcctactttgagtaatctctgattcagaatctgactgtaggttgaccaaacatgtctgatctatgtgtctcattctggggctcaagctggaatggcagtagatatttggggcacattcctccatggctgagttctaaagatctcagaagggtaagcagaaacacatgatggttcttaagacccagatttataactagcgttctctcttccatccatagtcaattgtcaaagcaagtcacgtggcatatccaaagatcagggatagagaaatacacttggcagttagtgaacccatttcaagagtgtgggtgtataacactactacaaaacagaactgagacttgcaacttgaaataccacaccattctagtagaattttattacagtattaattaaacatttttgataaaacacagacaactctgttagaaagcccaacttacaatttgttgatcccacttggaaaggtattctgaatccattttttcacaagttttctttctaattcaatgtgttggggtacttttattttacccagaaaagtaatattataaagcataaagttaatgccccctgtaaaaatagaatactgaaacaaactttaagtcacaattttattatttactgacttgagaatctccttgtgcttcagcacacttggtagttggatttccaaatagcatcatgactttccatacccagctgtctgctgctcaaaactaccataagctgactatcacagctcacaggatacccttgaagaagaccatctggtttatgtctcttggcaaaatttgtttaaaaacaagcagctgcatgacaaagtaagaaagagtctctgtctagctgtggtaaataagtagctttgcaatactcataataaagcatttttctaatccaagccaacatcttcaaaaggaaagcattattttcttacaactgaaagaaaaatctacagaattcagtgatgagggaaggactccattaaatttgtttcagcagcttgagatagtgagaaaaacaaaacaaaataaaaacctgtttgtgattagatacagtcttgtaataactagttttaaaagtatttatttagaatctaatacttggatattattttaattctttatattaagagatttacatttcataaaagcttgtcctttgaaccctaatactcatattgtgatggtgagccggaatgagtaaggtcacttactatatagtcggtatataataattcgttgaataactctctctcctcctgttactggcagtgaatccatacgggtcttcagcaaccttaattcatgcctcctcagaagaaagaattcgaccaaggaggcataaggcagaagaagagactgaggcaagtgttagagcaggaatgaaagtttatttaaaaactttagagcagaaatgaaaggaaataaagtacatctggaagggggccaagtgggcgacttgagatattaagtgtcctgtttgaactttgatttatggttttgtattttggcatacttccatggtcttatataccttctccccaattcttcccttggggtagggggctatctgcatgcacagtggtctgctgacacttgggaggggagcatgcacggtgtatttactggagttgtattcaagaggtgttcccttaccagtcaagtgtttccagaggaaggtcgtataccagttacactatgacattttgcctcttagtgcgcacgcgggagcccatttgcccaactcctgcgatcttatcgggaagctgctgatcaccaatttcaggtgtttttatctattgggagactgcctttccctggtattggctgtgaccaattattattttaaagacacagtttaataaccacctgactgaccatcacttgatggttgcctgacattcctggttggggtggcgggggtggggggtctcctaccctgctcatatctgactagctatctactgtaacactactattaggtatgtctgtatcccattacactcactctctattacaaaaaagagtaccttattcatttttcaaaagaatgagtgaattttctgctccagttaagtgcttttccttacctctatgtagagtgtcaaactagccatgcttaaggattgattctggtattaataatataaattcttgcattatgagtgtctcagtttgggttcttacataagcaaatcctgagacaaggatgtgagttcaaatagtttctttgggcagtgattctaggaagctgtggtaggatgttggagttgtgagaaagttaagagaaagcaacctgtaaagagtatgttatcaagccaaacaccactgtgagaactagggcttaattccctggagaaagtctgggaaggcataaaacacttgtctcagagttatcttagacaaggtgcaggagctgaggtgtttatatttcaactcttgttagtcacttttaaagggccgctcagggtgtcagggtattaatttcctcttgcaactacttccaacctgtttttgcatgtggttgtagctactttttctgcgtcaaagatagactttaggctaagacatgcagtttccggctgtaggacatcaaccagagtaccctggagtgtccaggcccaagataatgggtgagctccacctggatctgtggcaatgtgagggaggggcattattaccctagcaagggccactgcacttccctatccagctggtcactcttctgcgtatttgtgttacttttctgactcctgcattcctctggatcctgattcaccatcagcttttgtattctgaggcttgtgtggctgtgtctttctatttcttccttattgacttacttgtttaatcttttgctaatgtatacctttgatattcctatgtactcacctttggttagctctgtgaattattgagtcttgctttacagctttaaaaagatcatagccatggtttgttttttaagtgtgattcataacagttagtgacaaaattagaagtggaaattaaaggtcacgtgcacaatcctacacaagccaatttcttgaacgacataaaatacttgaatttgtcttttactatcaccaatatagaaataatttgggggtatttctcaaagtattgatttaacaaaactttatttttgtgtgaagattttttcaagtctcctggaaattattcaaattattgtctttaaagtcaaaggaaaggttaatattagggttacttttctttggtcacagaattgctggaggcttctatgacttgctttgaagcagctgactttatgcacagttttggttagaaattcactaccaattccaacattttcaaagtcctaaaagaccaaaagtacaattcttgaaatatccctagagaaagcaagaataaattagttttcactagaaatgaagacaaatttttctcattagttcattttgcctcatgatcagaattctttgccacatgaaaatattttggttaataggttgtaacataaagagtaatatgaatagagatctagcccaattagatgacagaaaaagagcaaagcttttgaaatgtataaagaagaaagtttaagagagacatgaacaaggctggatgtagtttaaggttgaagaacacagaaaaatgagataagtgaagttaagtgaaaatccttcccttactgagaagaaagagaactcaaaattatgtgaaggtttttgttttactttgttttgcttcttaataaggaaacaacagtggcaaatctggggcattaggaatggtggaacttctataacagtgatgtttcaaaggtcacaaaggaaattaaattgtagattgggtttaaaagcactggaattacttccagccccattttttcaggattttgtatgtagcaggaaatagatcaccgcatagctaaaggggagaatttaggttttaactggtctcagtgcaaactgcttcatagttcctttgcatttggtggtgtatgtaaaacatgaaaggtataaacatttattatcataactttattattatacaactatttattggctgcataggaccatgtgtcttcttgcaggtataatcaaaaataaaaagacagaaatgtatcttatatgaaggctgccattatcgctcttatcaatggccataaaatcagatttcttacatgtacaacatatgaaaatatattaaatatgaaacgttttccattaaataattctgtaaatgattttcataacatttctgtccatgatgtgtaaatctgtagatcaaatactgcaagtgtacagaacttaaaatgctttggtcaaaaaaattctcttattaatatgacaatggcgttcaaaagtaaaaaggtaaaaatacagtttagcattaataagtaaactcagaaagtaaaatatattgatcatacagtctgtattagtctgttctcatgctgctctaaagaactgcccaagactgaataatttataaaggacagaggtttaattgactcacagttccacatggctggggaggcctcagggaaaacttacaaccatgccagaaggggaagcaatcacatccttcttcatatggtggcagaaaggagaagtgctgagcaaagggggaaaagccccttataaaaccattggatctcatgagaactcactatcacaagaacagcaccatggggataaccgcccctgtaattcaattacctccaactgggtccctcacatgacacatggggattacaggaactacaattcagaatgagatttgggtggggacatagccaaaccatatcatttcatccctggcccctcccaaatggcacgtcttcacatttcaaaacacaataatgccttcccaacagtcactcaaagtcttaactcactctagcattaacccaggagtccaagtccaaagtctcatctgagacaaggcaagtcacttctgcctaggagccataaaatcaaaagcaagttagttactttctaggtacaatggaggtaccagcattggttaaatacacccattccagatgggagaaattggcccaaacaaaggggctccaggctccatgcatgtcaaatccaatgaggcagtaattaaatcttaaagctccaagataatctcctttgactctgtgtctcacatccaggtcacgctgatgcaaggtgggctcccacagccttgggtagctccactcctttggcgttgcagggtacagcccccttcctggctgctttcacaggctagcattgagtgtctgtggctgttccatgcacacggtggatcaagccctcttctcacagctctactaggcagtgccccagtggggactctatgtgggggctccaaccccacatttctcttctgcactgacctagtagaggttctctctgagggccccatctctgcagcaaacttctgcctggatatctagacatttccatatatcctctgaaatctaggtagaagttcccaaagctcagttcttgacttctgtgtacccacaggctcaacaccacatggaagctgccaaatcttggggcttgcaccctctgtagccatgggctgagctctatcttggctccttttagccatggctggagtggctgggatgcagggcacctagtccctaggctgcacatagcaggggggctctgggcccggcccaggaaaccattttgccttcctaggcctctggtcctatgatgggaggggctgccatgaaaacttctggcatttcctggagacaattttcccattgccttggtgattaacatttggctcctcgttacatatgcaaatttctgtagtcagattgaatttctcctcagaaaatgagtttttcttttctattgcatcttcaggctgcaaattttctgaacttttatgctctgcttcccttttaaacataatttccaattccaaaccatatctttgtggatacataaaactgaatgcttttaacagcacccaagtcaaatcttgaacactttgctgtttagaaattccttccaccagatgccctaaatcatctctctcatgttcaaaattccacagatctctcggacaggggcaaaaagccaccagtctctttgctaaagcgtagcaaaagtgacctttactacagttaccaagaagtttctcatctccctctgagaccacctcagtctggactttattgtccatatcactatcagcatttgggtcaaagccattcaacaagtctctaggaagttccaaactttcccacatcttcctgtcttctgacccctccaattctctaggaagttccagagtttcccatactttcctgtcttcttctgagtcctcccaactgtttcaacctctgcctgttacccagttccaaagttgcttccacatttttgggtttctttatagcagtatcccactctctgtggtaccaatttactgtattagtctgttctcatgctgctataaagaactacctgagactgggtaatttataaaggaacgaggtttaattgactcactggtttgcatggctggggaggcctcaggaaacttacaatcactgtggaagcagaagcaaacacatcctttgtcacatgatggcaagaaggagaagtgccgagcaaaggaggaaaagccccttatgaaaccatcagctctcatgagagctcactatcataagaacagcagcacgggagtgaccaccccccatgattcagttacctcccactggatccctcccatgacatctggggattatgggaactgcaattcaagacgggatttgggtggggacacagccaaaccctatcactgcctttaagatctatgaattgtttttctacattgaagaaatttgtagacatttgttttttattctctttttggtttgctgagagcagtagtctcttggaagtgagtttcatttacattttttcctttgggtgtcaaatatataaaatattttttaaaatcaatggctgagggataaatgagggttggtagaaagggaaaggataagggttgtagttaacggaccatgttttaatgtgtctataattagatggaagttgtctcttaccattcaacatcctggatggccttcctatagaggacattttcatcttcttttgtcgtccagagctagcatatgtgtttcatgtctttagatagtgaaaatcaattcagattttcatggaaaatgctctctcttcatcctaaagacagaattgtcacggctatttcgtttattgaaaagtgaaacctgctacagttagcatatagttaattccatatatgttacctgtatcatttaatacattcacaaagtaaaaaaccaaattttgccaagttcttgatagtaacaatagtaaaatggaatttctgttggcatattttcatgttattctgaaatgctgaatggatttattaagattgataacaatatgttgtacctttatgttctaaaatttaataacagttattcttccaaacatgccagcgtcctcaatagttgacagtctgcaaaatattctattatgcaatcagccatatctccttcttgagctttctttaagtacttgtatcctgtatttttccctgaaatctagcagtaagttgaagaaatgataaacaaaattgtatcattgtatataatggctatttataaatactgatgtacattttcataatgttatttaaatgattacttcagatatgtatttctgttttctacattttaacttctcaacatattaggttgttatcttagattggattttctaagacatagactctaagacagagatttccatgcagatggtttcttagtgagtgcttttaagaaaaatgcctgggagggagtaaaggcagcaggattgaggagagagaggagttgaatgatgatgcagtgaaatggaagatcttatctggtcccatgtggggttgggatgaccatttagagtattaccgtatgaagcaaggaaggtggaccattgtatccctaatccattagtcattagatgtgagcctcccaactaccagcttccgggcaatatcatcttggtcaaagaagtgcctgtctgctgagagaaatttcttggaagagcttaggtatgatctgttagtagataacaatcccagcaactgggagaatgaatgcttcatttgtaattggtgaatctcggtggcacaccacagtgttcgctacggtaatctttatacttattgagacatatattgtttttaagtaaaacttgtatacctagtaatgcatttaggtagtgtattggccaagctagtcctttttggaaacaatttcattgtggtataaatgatatacaataagctacacatttaaatagtacaatttgataagttttgacatatgcaaataccagtgaaactattagcacagtcaagataataaacatatccaatatcctcacaagtctgttttcggtaatcactctctcctgcccctcccttgattcccaggttaccactgatgctgactggcattatagataagtttgcgttttatagaattttataaaagtagaatcatgaagtatgtaccttatttctggtctgccttctttcactcacaaactactaactttcattttgtgaataatatgatctccgtgtgattacacacattaagaaagtcaataaaaacattgtaatttgattccgatactagtttatgggtctacattatgtatttaaagatactatcatgtttggattagcccttaggtatcaagtaaccctggagttgaggcagttactgttttatttgctatcaatctttttataagctcaccttccactaattacccaaaaatatttgatttaatacctgagtacagaaaaagaacatattcacaatgtttaaattttataatttaatattataatttacaacagtttaaaataactagtcctgaaattgagtatttctcacctaatattctgctctatttattacccactccacgaaaaaatttcccagaaaaatcacaaacatgtctcttgagtgtattattacccaacccacagaagaatttccaaaaacagtcgcaaacattctctcttgagtgcaaccattttctcgggccagccattcattgaaacaaaatagcctgtataacttctgtgggtagacatttgtaggttgttcttttgaggcattagtgctattgcatttaagataaagaaataacgaattcacaaattttataaagttctcttaaatttaccaagtcaatagcaccaccactttgattcctataacctgtgacttagttaggcttctcaattccaagaacataccaccattatttcttataatgtcctcagattaaaacatgtgttgtcctttctttatacctccctgcactttaattgaatattttgccatttactggattctgtacactttttatgttttcatgccctcccttttcattctcctggacatcaatcgcaagtcagtagataccttgtaagagatctctctccacccaaatcactgtttcttttgaaagagttaacctttctgaagcagcactcctgcttcacatttcccagcacaggaaccttcagtgtttctctgttgatagctttgatttcaaacgggtagccccaggagaaaagagagctgaaggatatgttttgcttggctgctttgtttgacctgcaaggaacattaaaaggcaatgaaaccgggcagagactggactgatcaacaccatcagtttagcacttattgctatactttctaaggctttacaattttatgtgtcccacgtgtcccctgaaggcatttgattttctaacctcctaggccagaggctaacatccagaattcatagtctggcacttataaaccctaacttagcttctgtcacttgtatctctatgcaactctacagcaaaatgtacttattttctctaaaatacccttattccatacttctttggagtgtaattttatatataaaagtcctcaccacctgtaaacattaggaagctttgattcgaagaagcagaagccatctccatttaactgaagtgaaatgaaacttactggagggataatgtatagttcttggaaatgaaggaaaagaaggcaactgtggcagagggagggcagcactgagagtcaggaactccagggaagttactttttggatgctgtcattaaaatgcttcagcttcaaattgtactgactctacctttctcaattctagattcaaatttctaaatgtaattggcataaattaggaacttgtcccaccagtttatagagtttacagagcactatgattataggtccccctaagatcatgcagaatgagggaagagtaatttcatccaaggaaaagcagggtaccattcaccaaagagtggagatacttattcagaacaattaatgttagatgccacaaaaaaactaaccctgaaatcaaagtggcctaatgaatgcttatttattgctcatataaagtctgatataaatcaggtagcattccttcacagtgactcagggacctaaattgctttcatcttgtggctctgccatgtcaacattgaaacttcagaggtattgacaaaggagagctgagaaattgacactaactatcaagtacctcaggcaagaagtgatgcatcacttcctacactttcccactttccaggattcaatcacaattgcactcacgaaacctcaagggaacatgagaaacataatgaaatcaataccaagatatccaaagagtactaattttcttcaccacagaagggatattggacagacaaaaaattttgggacagaggaatatccactaaatgatccttccatgccctgctcagatgctacattttccattaaggctctcttgaccaacccataaggagatgatctccaactcctctgaacatctggaacattgcattctacttatttttactgtctcctattgtaataattgttggctattccttattagacaaattataagcttttatgggacggtgatcaaaagtcctaatttatcttgtcttcctacagcattcaaagcattgtagaccttcaatacatagcagtcttcgaagccagagtattagtattttttctaaaactgtattcatcgcaacgaactcgatggatgttcaataaaaatgtattgaatagtcattcatgcagatagcaaatttcttaaaacatttcttactcaatgtttacttatattcatcatgaatataaatttaatataataatatcaaatcccattacatttagtacaaagtaaatataccaataattttatatatgtttaagtgaatttttatatttcatattatttgtgaatgatacacatcgtcgtggaaaatttacaacgttgaagtaaattatacaatatagggtatttgtattaaaatacatttcatagaaggtgctttaaatttaaaaagttagcatgaatacatattaaatgtaaaagagtctttaaaatgaaaaatatttcacacttgtgggtttgatctaaaaatatcagtcgctatatgatatggctagacagatttgagtaggtataattttaatgaataatattgtgtgatattttagggtccaaaattgaatgtttctattaagtaacagatatttaaatgccaagcagaagctacactggcaaaacaagatttagtatgttatcttaagtgtatcctaaatcctctttcatcttatggagaagaaatacatgcttttagtttccagccactcctgtctatattcatttaaaataaactattatttatatcagatatgatgccatgtgagtccacaatttgtagtatagagaaataatttcattgaattattttggctgtttgtacctgagacctgattctgaatcatttatttttctatttaagttgtgctattttatgatcctacctatggctatgttcaaaacaatgacaaaatatattttaccctgatctttttttcattattatactttaagttctgggacacacgtgcagaacgggcaggtttgttgcataggtgtacacgttccatggtggtttgctgcacacatcaacccatcatctacattaggtatttctcctaatgctatccctcccctaaccccccatcccctgagaggccccggtgtgtgatgttccccgccctgtgtctatgtgttctcatcgttcaactcccacttatgggtgagaatatgtggtgtttggttttctgttcctgtgttagtttgctgagaatgatggtttccagcttcatccatgtccgtgcaaaggacatgaactcattcttttttatggctgcatagtattccatggtgtatatgtgccaattttctttatccagtctatcattgatgggcatttgggttggttccaagtctttgctattgtaaatagtgctgcaataaacatacgtgtgcatgtgtctttataggagaatgatttataatactttgggtatatatgcagtaatgggattgctgggtcaaatggtatttctggttctgtatccttgaggaatcgccacactgtcttccacaatggttgaactagtttacagtcccaccaacagtgtaaaagcgttcctttttctccacatcctctccagcatctgttgttgcctgacttttgaatgttcgccattctaactggtgtgagatggtatctcattgtggttttgatttgcattcctctaatgaccagtgataatgagctttttttgatatgtttgctggctgcataaatgtcttgttttgagaagtgtctgttcatatccttagcccactttctgatgggtttttttttttcttgtaaatttgtttaagttccttatagattccgggtattagccctttgtcagatgtatagattgcaaaaattttctcccaatctgtagtttgcctgttcactctcatgatagtttcttttgcagtgtagaagctctttagtttcattagatcccatttgtcaattttggcttttgttgctgttgcttttggtgttttagtcatgcagtctttccccgtacttgtgtcctgaatggtattgcctaggttttcttctagggttttgatggttttcggttttaggtttaagtctttaatgcatcttgagttgatttttgtataaggggtaaggaaggggtccagtttccgttttctgcatatgactagccagttttcccaacaccatttattaaatagggaatcctttccccgttgcttgtttttgtcaggtttgtcaaagatcagatggttgtagatgtgtggcattatttttctggcctctgttctgttccattggtctatatatctgttttgctaccagtaccagtctgttttgcttactgtagccttgtagtatagtttgaagtcaggtagcatgatgcctccagctttgttcattttacttaggattgtcttggctatacaagctcttttttggttccatctgaaatgtaaagtaatttttcctaattctgtaaagaaagtcagtggtagcctgttggggatagcattgaatctgtaaattaatttggacagtatggccattttcactccactgattcttcctaaccacgagcatgaaatgttttttccatttgtttgcgtcctttcgtattttcttgaacagtggtttgtagttctccttgaagaggtccttcacatcccttgtaagttgtattcctaggcactttattctctttgtagcaattgtgaataggagttcacccacgatttggctctctgtttgtctattcttggtgtataggaatgcttgtgatcttttcactttgattttgtattctgagacttggctgaagttgctcgtaatgttaggggcagccagagagaaaggctgggttacccacaaagggaagcccatcagactaacagtggatcactctgcagaaaccctacaagctagaagagagtgggtgccaatattcaacactcttcaataagggaattttcaacccagaatttcatatccagccaaactaagtttcataagcaaaggagaaataaaatcctttacagacaagcaaatgctgagtgattttgtcaccaccaggcctggcttacaagagctcctgaaggaatcactaaacatggaaaggaaaaaccggtaccagccactgagagaaacataccaaattgtaaagaccatcgaccctatgaagaaactgcctcaactaacaggcaaaataactaaccaacatcataattacaggatcacattcacacatgacaatattaactttaaatgtaaatgggctaaatgccccaattaaaagacacagactggcaaattggataaagagtcaggaccatcagtgtggtgtattcaggagacccatctcacatgcaaacacacacataggctcaaagcaaagggatggcggaatattttccaagcaaatggaaagcaaaaaaataaaaaattaaaaaaaataaaaaaaaaaacaggggttacaatcctagtctctgataaaacagactttaaaccaacaaagatcaagaaagacaaagaagggtattacattacataatggtaaagggagcaacgcaacaagaagaactaactattctaaatatatatgcacccaatacaggagcacccagattcgtaaagcaagttcctagagacctacaaagagacttacactcctacacagtaatagtgagagacttttatactccactgtcaatattagattaacgagacagaaaattaccctgatctttaacattccaggcaagtatgttttcagtcatacatagtacgtgaatctgttatattttaaatccaagcttttggaggacaaatgatttcacagttatacaactcagcctctcccagactcaagtctctcacttgatgcagtattcccaccccatcttcaataaaagaagaaagcatgaaacatcgcattgatatagggaaagtatatctgagttttctatatagcatataaagaagtaaaataactctgtgatttgtgatgagatagatttagctgcaacaatgaggtctggatattaatattggattaacttcctttgagattgcaacttccatgtggcattcagcactttccttgttttctcatatgtaggccgagaataaaattatcctgtttctatttcccaacatgaaaggtcttttaactgtttgaagacatatgtttcatgtgaaaccaaggaattgctactgcaattttgtaagacagaagttagcaaacttattctgtaaggaacaagatagtaaatattataggctttgcgggccatatggtctatctcacaactattaaactctgccatttttttttttttttgcaaaagcaaccatagacaatatgtaaatgaatgagtgtgattatattccaataaaactttatttttaaactacaagactagttcttaaaataaaatttaacaaagaactattatatgatccaataattccacttctgggtatatacccaaaataattgaaaacaggtattcacacagatatttgtacacccaagttcatagcagcatattttactgtagagaaaaggtagaaacaaatgtacactgtgtacactgaccaagaatggagaaacaaaacgtggtgtatccatacagcagaacagtattctgctttaaaaaggaatgaaattctgtcacatcctaaaatagggatgaactttggagatattccacctagagtagttaaattcttagacaaatagttgcatggttgccagggaccagggaggggtaggggaaatgagcagttcttgtgtcattggtatagagtttcagtttagaaagatgaagagttttggagatagatggtggtgatgtttacatatccatgtgaatgtatctaatgccactgaactgtatacacttacaatggttgaaatattttgtatattttcccacagttaaaaaagacaagcccatgtgcccaaattgctgatataaatctgtattcctattagtgagcagtaatgagccatgtttagtgcagctgatatggttaagatggaacaattgcatgtaatgcaatggtgggtaacatctaataaaaattggtactcaccaatttccatttccattgtggatataaacacccttcacattatgaatcatgttatttgttatttgtgtacttacttattaaatcacttttctccatctctctcacctctatgactctgtacatgtacaaacaacatacacactgtgaacttctttagaatgacagttacattttcgttacttgattcattgtttggccaagtagatacccagtaagcataactagcaagtgaataatgtatatgtgatcattttccttttcaaaaaccacttcttatctctaccacaccaccacacattattatatgctacacttcttatataaaacaaaaaagaataggccaggtgtggtggctctcgcctgtaatcccagcaatttgagaggccgaggtgggcagatcacttgaggccaggagttagagtccagcccagccaacatggtgaaaccccatctctgctaaaaatacaaaaattggccaggcgtgttggcgcatgcttgtaatcccagctacttgggaggctgaggcaggagaatcactggaacccaggaggcggaggttgcagtgagctaagatcatgccactgccctccagcctgggcaacagagcaagactctgtctcaaaaacaaacaaagaataaataagctttaataaactcttttgcagaagagttttcatttttaaacatagaggaaaaagaagatgaggatgaacgatagtgatgcccagaagagaaaattgtgtaagacaaaatcaattgaccaggcgtggtggctcacgcctgtaatcgcagcactttgggaggctgagacgggcagattatgaggtcaggagttcgaaaacagcctagccaatatggtgaaaccctgtctctactaaaaatacaaaaattagccgggcttggtggtgcacgcctatagtcccagctacttgggaggctgaggcagaagaatctcctgaacccagcaggcggaggttgcagtgagccaagatcacgccactgcactccagcctgggtgacagagcgagactacatctcaaaaaaaaaaaaaaaagattaaatcaattttagattgatatagagataaataattccctaagtacaattaaagcaaggatcagaccctgatgagtaaggatgatctaacaaagggctgacaatataaagtgaatgcgattgtcaccaaataaacatctcccaagagctttgggacaatcttcagctaagcatattctgcactttacatcgttctgccatatgccctatgtagcttttcatcctccagaaatttgaatagcacacagtattttttggcaccgagtaattgtggaacttaaacttcctacaaagagagaagctgtttcagtcagctaagtgaccagttagtaagcaacttctattctcttagtgtcgatagggttaaagacagtcataagctccccaaacccttggccgcctcaattttttcatttaaatacttatcttcttatcttcatctattttttagagtcacacataaactctgtctatgaggttcttaaagacctggacaatatatttaatctctgtatccttaaatctcaccatgatatctcaaagatggtagataaaactgttttccctcacttctctgactccataccaatacttaatcgatcgggaaagttttataaaccatttaccgttgaatataaatatatatacacacacaaacatatatatatttatatatatttatgtatatatatatttatatatctatatatatttatgtatatatttatatatatttatatatatttttatatatttatatatttatatatatttatatatttatatatatttatatatatttatatacttatatatatttatatatatatttatatatatttatatatatttatatatatttatatatttatatatatttatatatatatttatatatttatatatatttatatatttatatatatttatatatatatttatatatttatatatatatatttatatatttgtatttatatatatttatatatacacatatttatatatttatttatatatgtttatatatatatatatatggcactatatatcagtgagcaaaggcatcataatctttatttttatttctgtattcatttattcaacatatagtaattctgatcctgtctcaaaaactctacagaaattaacaaagaacacattgtttctgcctttttggagctgaatgtttagtgggggaaaatgtattttaaggcaataatcatatacatgagtgtatatttacaagccgcagtaggtgctatgaatgaaaagtataaggagctatgagatattctaacaaaaagaaatgctgcagtctagagactgagagtaattatctgtgaggaaaagtattgaagcagagacctgcaactcagtaaagagtgtagggagtcacatgaacaaagtcttgagatgttggtagagatcttggaatgttcgaaattctaaaagaaagcccttgtgtatggggtatggtgagagagggagagcgtggcaagttttacgttgtacaagtcattgtaggccacaaaaataagtatagattttatctaagtgcaacggaaaaccattacaagtttattttttgattcttaaattttgttttacttatttatttatttcaagacacaatctcactctgttgcccaggctggagtgcagtgacatgatcacggctcactgcagccttgaactccttgggctcaagcaatcctcccatatcaccctcctacctcagcttcctgggtagctgggactactacaggcatttgccactatgcctggctaactttaaacaattattttgaagagacagggtcttgttacgtttctaagtttctaaggctgatcttggattactgggcccaagcaatcctcccgcctcatcctcttaaaatggtgggattacagatatgagccacctcacccagcaaggtagtgacataatcattgtttttgctgaaaacaatgtactttagggaacctccctgaaaacagaatggccacttagaataccaaagcatagaccaagccttgagatggcaatggaagtggaaataaacatgtctttgatacttatgttaatggagctattagtagcaacttttgacagatttgaaagtggagttgaaagacagtgaagtgtcagggatgatccctgagcatattagataatattgagctggagaacagaaaagaaggggcagatttggaggtggagacctttctagatttatattcaatttgagatacatctgaaacatctacatgaaacgtggatgaaatatctgtgaccaagatacatacgtgggatacctaggcatgtaaataatatttaaagttatgtgagtgggtgcaataacctaaagagagactgtaggtagaagattgatcaggacaaatctttgaggaacttttttttttaattattattatactttacgttctgggatacaggtgcagaacgtgcaggtttgttacataggtatacacgtgctatggtggtttgctgcacccatcaacccgtcatctacattaggtatttctcctaatgctatccctaccctagccccccacccccaacaggcaccagtgtgtgttgttcccctccctgtgtccatgtgttctcactgttccactcccacttacgagtgagtccatgcagtgtttcattttctgttcctgtgttagtttgctaagaatgatggtttccagcttcatccatgtccctgcaaaggacatgaagtcatcctgttttatgaggtacttttaatgcatttagtgactgggtaaggaataaccctgaaaaggagcacaaaaaccatcgaggtatgaagaaagccaggagatgtagtttcacaaagcagccagtggacagtaatggacaccagcataagcttaagacagcagtgatagtgttcatcagtgctgaaaactcattggaagtggctgaccatatgttgattgcgaatgcaatgccttctcccatctcctattgcttttcactgtttccgtcatgtccagagtgaaaacactggggaggcagaactgtgtaccaagaaaaatgttttgtgtcagaggaaacaagagctcattaatttccttttgacccgcatggataggaatacgataagcaggagaaaaataaaacctgctaaactaggcaaataaagcttaatagaaaagagagaaaatattgcttacaaagggaagaagacatttgccacaatattagctaaaaagagagtgaggaaaatccacatttaccatttttattatgtgtttccaaagtcgacattaagtgaatattatcactttgaagacagagaatagattgtaagcagaagaggaagtgggattttttaaatggcatatatttaaatgttgaaaaacccatttccaatactcccactgagatatatgcaataaaaacactccgcaatcagtaatatacatgtgaagctcctaaaaatcctccattgagaagattctataaaactataaagtattattatttctgctatcagaaaataaacacatactttctaagaacaagatgaagaccttaattcatcttcccaggaatatacttgtgtacttaatggttcaaggcgtttgtgatgcaaaaaaagtgggacattatgtacaaaatagttttaatcagaaaatgaaggaagtttggtatggtatggttctagggttgcaagttttcctgcaaaaagggagtacttatggctaggtgatgcagccaaggaagcatctctgaggacaggttatcctggctcctattccaaaatatttaggtctccttgagtgttcgatccttgaaccaaggacaagaatagaaagaaataaaagccacttgtataaaggttgccttcattttgtgtcgaatattgacaggagaaagccagatttgtagcttttccagggataagtgagtctcagacacagttaagagcttggctttggaattagattgacctgagtttgaatcgtggctccatcaatctctgattgtgtgaatttttggcaagttttagctgaacctcaattttctcataagtaaaataggcataatacagctatgattctgacccttgccattagcactctgagctacttgtcagtgtatcctggtctcttcctcaagcacttttccactttgttatttcaagattctttgaaattatgaacagtagctcttgatcaccaaacaaatgggagaccatagattcaaaggaacattttagtaggatatttgataagctttgtatttttttgtgctttgaaaattagagtagatttagatttaaggaactataaagctatatgtttacaaaactttattcagttgggcagttctgactcagtaactgaaataaaattgatgaaaacaaaacatatgttttactgttgtgttcacatttaaagattatttaatgcataaccaaaataggttcagcaaatgtttatacatacatgtacttagatatttgtaattcttatggtagagcatgggaatgaatgagaattctcctaggctggaataaaactaatgtctaactaagaattggcctttcacttcacgaatatatatcattatatataaaagattcatcctttgttaacttatttgtttagcttagtactttctaagtacttttctatcctgtcttggtccctatataagaatgatactattataaaaatgaacatcctattatttcataatgattagcatatcagcatatttaagagcaatgcctatatctttaccttcattattattttcatgtttaaaatcctgataattctagaaaaacaaggttgtaattatccattcataataaaagtcacaccaagttattcttgataattaacttggcatagtggagtgcactgagcaattaataattaattacgtggttactagctcaaattttattgagaaccaaggagttaaaattaatagtattgtgtttgcaatgagttaattactttgtttctttgtttttttttttggaatagtgccataattagtatcctaatagaaacagaatataaagtgggtttctgagtgcttgcttgtcgaggtgtgtaacaacatatattttaattataatttgagtcactaattgttgtcaaatacaattttaatttcttagttcagagattaaaagatatgtaaacagctccaaaaaagaatatgataagatggtttatacaagtaaataaataactatatgacttcagaagttttatttaacaacagttgtataagtgttttaactaatgttaacaatgccttttttgtaaatctcctctaccacaaatatgagataaatttaagaacggcattttcattaaatattgattattaaaattcatatataagtattggctgtacctgagcatttacagtgaaaccatgaaggactggcaggtttggggctgtttgataatatccttccttaatctttcttcgtagcatcattgtttaattttggctgaccacaatcacttatgaaaagaaacagctcaaataattagtataacctctttctcttcataaaaccttcaaatcaatgtggtcataattatgaaagtgtaagattataaaatcttctcatttaaatatacatcttcatattagcagacttggctaatttcttcatttatccttgacatccacacttaaactctgtcaaactggtcattcatagactcattattcattcaacaaagattagtgtgaccctactatgattctgagggctagaaatataaaactgaataacatataaaccctgatttctgtatttatatatacagaaaggaattatgaactcacagttttaatgcacagtgacgagtcctcagttcatgtctgccttgggagctaggcatataccaaagcaggactgtctaacacagtttgggggtctcagtctggaaggatccgggtgagatgatccttgaattgagttctaaaaaatgaggagaaattatccagataatggaaagtttaggagaaattaaccagataatggaaagtttaggaaagaaacactatttatatgtcaaggacaaagtttgaccaaatgtgtctctgaatctaactggctttatgtaagataaaattaaaaaataattgtcactaaggtttttcacatctgcagcaactaccatcatatctggctcaatatttaaaagaaatacttaacgatttttggcatttattgctactataatagattgtgctatttaaagagaaattctagatacatgccaaagtattttcaggtgaagtaatgtgattcgtgggttttgttttgacaaacttccaaggaaattatttttaatataaagagcaatggaggaagattaaacaagattcgcaaatgttgataattgctcaaggtggtgacaggtgcatgggggtccataatatactgttctctttacttatatatgtctttgaagattttcatgatgtaaaattttaaaatcagaattacagtaatacctctttctttgacaatcgttttcaaacttggttcaacaactgaatttaaattacctacatggctataaaaataaattagatatcctggttatttggtctggggtgggtcctggccatatctgtagggtgtgtgggtgtgtgtgcatttagcttcacatttgactctgaagtacgtggaaaaccaattctgggctctacatatgcaattccaatgcctgacattaggtggtgctggttgtgagccatgatttcaggtttgacttgtagagttaacagaagtgatatcaccaccgatcccacagaaatacaaactaccgtcagagaatactacaaacacctctacacaaataaactagaaaatctagaagaaatggatacattcctcgacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcataccgaatccagcagcacatcaaaaagcttatccaccatgatcaagtgggcttcatccttgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaaaggtattcagttaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtgatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactagctgacttcaaactatactacaaggctacagtaaccaaaacagcatggtactggtaccaaaacagagatatagatcaatggaacagaacagagccctcagaaataacgccacatacctacaactatctgatctttgacaaacctgaggaaaacaagcaatggggaaaggattccctatttaataaatggtgctgggaagactggctagccatatgtagaaagctgaaactggatcccttccttacaccttatacaaaaatcaattcaagatggattaaagatttaaacattagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacagggaacctacaacatgggagaaaattttcgcaacctactcatctgacaaagggctaatatccagaatctacaatgaactcaaacaaatttacaagaaaaaaacaaacaaccccatcaaaaagtgagcgaaggacatgaacagacacttctcaaaagaagacatttatgcagccaaaaaacacatgaaaaaatcctcaccatcactggccatcagagtaatgcaaatcaaaaccactatgagatatcatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaataacaaagacttggaaccaacccaaatgtccaacaatgatagactggattaagaaaatgtggcacatatacaccatggaatactatgcagccagaaaaaatgatgagttcatgtcctttgtagggacatggatgaaactggaaaccgtcattctcagtaaactatcgcaagaacaaaaaaccaaacactgcatattctcactcataggtggggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctacacaatgtgcacatgtaccctaaaacttaaagtataataaaaaaaaaaaagttcgttcctcttgttagaattttcatacaaatgcaagactccttattttcaaagagaaaacaaaattttatataaactaatacctgagaagaataggaaaaattaatgatgtatgggataggtactgataagaacctcttcttttgtgtacattgtgataaactaatgtttaacttgagtcgatgtgctggaaatacttgttaaattttcaagaattttgagatctgttaaacacaaccattatcaaaaattaaattatggtaacttacattaaatgaaatatattgttcacaaatgtactagatgcacaaaagtcatcactacctaattcttttattatatttcactattatctacgggtttgttacctgtataatggaatgactgtataatggtgtagtgctaacttcatgtttggtgacattataatgatagcttaaaattaaacatactgggaatattcaaatatgtccttcctctcaggggatctgattgttagacatttaccagcatagcactgtcttaattaacatcatataattgtcttttatccttaagatgttgagccagtaaatatcacaggagagtttgttccttaggttttaatacttgctttaccagtttactgtagcatcatgtgaaaccagcttctagaccagctgtctttaattggtatgtacccaagctaatccttgtcaggctatcatcaacccaagcacttttgaagttatttttattattacgctacagaaagattttatggcctttttgctcttttctttaccctagccctaggatcatataatttcatctcctatttattcctatttatttccttatctaaaatcttacttaactagcttgcttgcctgcctgtctgcctgtctgcctgcttgcttggtttttctttttttctttcttttctttacttctgctttcctttcctttcttttgtttcttccttccttccttccttcttcctttcctttccttctgttccttttccttttccttttcctttgcgttcctttgctttccttgctttcttcgcttgctttcttttcagtaccacaaaaaaactaacaataacaaaaatattgctacaaaaattgtgacctcccaattctatcctcatttcacggacccataaaatgattatatatctatgccaatgcgttctaactacatgatattattattgatgataagagaatccaaccctcaagaaatgaagtattataatgttttagaacacacagaagcatttttaaccaaaatgttccatgtgattttatagggtgcatgttttaccttttcttatttggaaaagtagcaaaagtattaacaaataaaataagttacatactctttgtatataaatctttcgtgtacataataatgccatttcccttctagtgcttccattattgaaaaaaaatagacatatagcaacgtgctagacattgaagttaactgttaaaaagtcatcagagggtaatgttaaaggtggtatttcaggtaataaagcatatgcagaatgattctattggctttatttccaacatgagtgttattagtaccaaggacactgaagtttaaaggaggggagtgatgagactgatcattactttgtcttctgtaacaggacttaggtggcccagagtgatccttgttggttgattggttagttgaacttctatttttgttactaggcctgcagatctgtggaatctccagagtgctgtgtaatgttacataggccacacaccagacactgttccctgaaggactgaaggtggaattggaacaatatgtagacagttcttgttgcagttaccaaggaaatttggttaggattcaggcctccatgtcagaaaaggaagtctattttatgtgctagaaaaataaccctaatcatcttatcttgggtctctctggggagcatgatgatctacctggtcttgtaaactgtatagaaccggctgggttgagacacatatgtctcataacagagcttccacttaaggctataaaatagtggtccctctattgggtatatgccttatggaaaaatatacgttatgctggtacctattataaaaaccaatgcaaaatgattagagatttctaatccaagtgttatcctcatctgctcccaaaatacagcaatgaaaaaatagaaaataaaaaaggatatatttacagaactgtatttacagaaatatatgttgatgacaagataatcaaatacatatcaaatcatgatgtgtatttacagaaatatatttacagaaatgtaaagcagagaatggggcggaagtccctgacagacttgacactgaaccacaaaacaacagtggaagccaggaatttggatgctgcgggatagttgggattaaaattgcttcaagcaaggtgtggaactggagacaaactcagtattcaaaaccagaggctgggctgtggtgcttgcattcgtgaaagaaaacctggggaaaaagtgcttcttcaggctgtagcctgacgctatggcttgcctaaacttatgggcctatgtaggtgtaagaataaagacatagccttgctgctgggaactgtgttgcatctgttctcttgcttgatgaatggattgaaattatccccagtaacattgcagtgcaagaactttaaaccttaaaggggtggctggagaccacgggacgcgatgcacatgcaactactaaatgctagatgaggatacctgaggagagagaacaagacacaaacgtgaacatggacctccaatagaaatgacaatcgaaaacatacatttatcttctctctctcccaaattgttcaaagattacgctaagggaataaaaacaatacagtcataaaatgacaaataaaatggaagaagagacatctgcacagacatatcaagtcaatgagatgaaaattaggacaagtaagccaatttgtttttcaggatcccagaaaaacttgtggattgaagacgctaggtgttttagaaggccatatattcccgagaggggctggaaataaaggggttgttttgaatcccttaaaaggggcaattacatttcatgtccccagctcagggtagttaattagacactactcctctctcatcccagcagacgtgagtgagtggtttgctttctggtgaggctgaaacaacttttggcatttggacaacaggattagttgatggaagagagagccaccatactgaaaatacaggattaagttaaagtcaacatatttaatggtgagaccagcagtccctcttcaccttcttggctcttaagtttctatcctctgggcagtagattataaatttattctcctgagagcctacctgcaatacgaaaactatttttagtcaagttttattgctataacaaaataccatagactggatgccttataaacaacagacctttatttctcaccgttctggaggctgggaagttcaagatcaaggcactggcaggtttggtgtctggtgaaagctcatttcctgtcttctcactgtaacctcacaaggcagcaggtccaagggaactgtcttgggcctcttttgtaagggtactattctcattctggatggctttggccttatgacctaattaccttccaaaggccccacttcctaatgtcatcaccttgagggtgaggatttcaacgtataaattttgcaagaacacactcagatcatagtaacctacaattaatgatatgtaatgatccaccagtgaaatagccagatctgtgcctaatgaccatatattgaagcccaccaagtataagccctacatacgcacaaggaatttccaaaagcatttaatgcctcagttttaagagacaatcaaggatttccagatatttgaacatgtctcaaagatggaagacagaaaccaacataaaaacaaaaagcagaaatattgggaaaaaaacaatagccacataaatgaaacagaaatctctgcagaaagagagacaaggcatagaccttaagaaaactttttaaagatagctataaaattattatctcacagtgagactagtcactgtattcataagaaagaacaagagactatagaaggtggtatttccgagaaagataagggttatttaaattaatagtatagcaggttaagtttttaaattcttaattgtataaatttatgggttaccagtgtaattttgttatatgaatatattttatagtggtgaaggcagagcttttagtatatccaccactggaataacatacatggtatgcatagcagttttagagcaatgaaactactctgtgtgatactataatggtggatacctttcattatatatttgtccaaacccatagaagatacaacatcacaagcaaactctaatgtaaactatggacttcgagtgttaatgatatatcaatgtatgtaagtcagttataacaaatgtaccactctggtgtgggatgttgatagcggggtaggctgtgtgtaatgaggaagggggccagagagtatacgggaaatctctgtactttcccctcgattttgctataaatgtaaaattgctttaaaaaatcaagtctattaaaaatgaagagcagaaataaaagttcaaaagtagaagataaatttgaagaaatatctcataaagcagtataaatagccaaaagcatggaaaatgggagagtataagaatcttagaagatcattctaggtaagtgtttcacaaatagaggtgattttgtcctgcagaggacgtttgacaatgtacggagacctttttcgttgtcacaaataaggaaaggatgtactactggcctcttgtgaagagtgacgcaagaggaatgcaccatgcagccatccacaaccaagaattactcatttcaaagtgtcaatagtgtttatgtttagaaaccttgttctatgtaatccaacattcaaataatagatgttaaaaataaaacagaagagaggcaactgtggagagaaaattatcaaagaagtgacaacatcagttttcttagaactgaagaaaatgagtgtccaggtttaaagggcttactaaatgcccagcacagcaaatgagctaaaaatctacaccaaggctcatcatcataaatttttacaaaaacaaggacaaagagaagttcacagatcagaaatcagaatggctttggacttttcagcaatagccatggaaaatagcagaaaggaacacttcctttaaacttctaggaataattaactttggctttgatttcatatcctatatgaaattatgttcacaaattctgtgatgctcttctattcaagagttacagctaaatgtccctgtcattgagtgtggactagattcagtgactcttttgtgatgatatgtcatttccaagtgtaggttgtagaaagactgtggtttatgtcttgtgttctccatccacgcctatctctctctgtgtctctctttctctctctctctctctctctctctctctcatgcattgcttcttctgtgggaacacatgtcatgagcagccctatggagatgcacgtatgctgagaaactaaggcctcctgcaaagagccacaagaatgagcttagaagtgcatcatttaacaccagacaaatctcgagaggctgcaagcatagacaacagcttaactacaacctcataaaataagctatgccagtcccaccctgctaagccactctcagattcttgaccttcagaaactgccaaataataaacatttttgtttttaagctgctaaattttggaatgacttgttattcaacaatatataaattgtacaccctgataaactataaattgtgcggagaaaataattttcagagatagccttatgtactcccctaaaccttttttccccagaaatctattttcaaaaatatactctaccaagtgaagaaagaaaccaagaaagacaaagaatgtttagttgtgattggagatcagaaggagagtgttttaggcatgattcgccttgttatgctgcaataataagcaattccaaaatattagtggctagaaacacaaaggttgattttgtatctttgcaacatatccaacacaagtcagtcaagggttctgatcattgtagtcactcaggaatctaagctgattcagtctctagtattctatcattctaccgtaacaataagaagctttagcgttcaccatgtcagtcaaaaatgcgtggaaaattttaaactgactcttacatgcctctatgtaggagtgatatatgtcattttcatttcacttcatcatccaaaggaagtcacgtggtcatgcctaactctgaggggacaggggattataatcactaatatttttaagagaggtaagagaattaggaaaatattggagcattagtattacctgcaaagcctaggatccggaaaacagagaacccaacgtgggaggaagatgcaaagtggtgccagaaagatggtggaggagatcctgtaacaacagctgtataacagttgtagagagaaacctgtacagattggagaagaaaatagtgctccaggaattttgttaccaagaaaaaaaaaatctaatgtattcgaatgtattgagaggtggtattcttattgtgtaagagtataatatatgacatgtatgacagacagaagtaccatttaaaattttattaaacataagaattagatccctatctcacactgtacataaacataaaaatggtaaattgatggattgcctaaacatgaaaggcaaagcattaaaatatataaaaatattttggggcatgtagggcaaaagaggtgtcccttaagcaacagcacaaagcaaaaattgtaaagaaaaagacatatatttgatcattttaattaaaaacctgtacaatgcaaagacttcataaacaaagaaaagacataggctcagatagtatatttgcaatactaaaacaataaaggatttatgtcataatttaagaaaaatatttacctatcaatagaacaaaataaaaataacctaacaggaaaatatttttaaagtttaaaaaataatagacagttcacagaacatctgtatgtcaaatacacttatgaatagatgctaactctcatttattattggaaaaattacttcatattagtcggttttcatgctgctgataaagacatacatgagactgggtcatttatacaggaaaaaggatttaatggacttacagttccacacagctggggaggcctcacaatcttggcagaaggcaaggaggagcaagtcacatcttacatgaatggcagaaggcaaagaaagtcccctttataaaaccatcagatctcatgagactaatttactatcacgagaacagcatgggaaggacctgcccccatgattcaattacctcccacgaggtccttcccacaacatgtaggaattcaagatgagatttgggtggggacactgccaaaccatatcgtactaagtgagataacgtactcccatcggactggaacaagtaaaaaataaaataagattgtgaaaggtcacaaactctcattcttgtagaaatttaagttggtacaaccaatttagagtgtaatttagcaataatctagttaaactgaggatggcatgtcctaccaaacagcattccagttaatcacattgaagatagcatgattgttctcaggcttccatattttctgttgaacggtaagttgtcagtctaattggcattcctttaaaatagacttgtttcctcttgatgattttcacattgtaattttgtctgattttcagcacttcaccggtctttaaatgattatgtaagattttcattgctgaggaggaaatcctatcacctcaaatactatcttattagttatattttcattttattttaccatgattttaaatgaattccttaaaaaattaggttagagaactaataaatgataaagagaaaaattattcttcatcctgatagctgttatgtgagggtggaatggtatggctggtttttttcactgtcattttgtaacttggaaattcttattttttaatacaatgacaatattttcatagttaaaaaacactaaaactaaaacaatagtctgttaatgacaaatttaagggcgatttcattaagttaaaaatccatgttaaggcattataagatgaataaatactccaaatgaaaacaaagtgaaggccacttttatttaccttttgtacatgatacttatttttcaacagttgtcatgttagaaaaagttgaaaaaataaaacaagatacacccccttttggcctctaaccttccaaaattgtaatgggtagacttcaaattaaatatctaattcgactcctttccacttctaccctcatagcattagagacatttggaaaaatgaaaaaaatatagtattttatggcagggtacctcaaccccagagccacagacccgtaccaatccgttgcctgttagggacccgattcgcaaagcagtaggtgagcagcagcgggctagggaaggaagcttcatctgtatttacagctgctcctcatcactccatttctgcctgagctccacctcctgtcagatcagcagccacattaaattcccataggagcacaaaccctattgtgaactactcatgcaagggatctaggttgcatgctccttatgagaatctaatgctgcatgatctgtcactgtctcccatcaccccccagatgggaccatctagctgcaggaaaggaagctcaaggctcccactgaatctacattatggtgagttgtataattatttcattatatattataatgtgataataatataaataatgtgtgcaataactgtaatgcacttgaatcatatggaaaccatcctccaacccggtccacggaaaaattgtcttccacaaaatcagttcctggtgccaaaagggtcagggaccactgttttatgggataagtgaaagctggatttgaatccaactctaccttttacttcccatgtgaacattaaaagatgacttaatgtctctgaatctttttttccttctaagtaataactaccttgcagagttattacttgaattggccataaggtaaagaggacaccaaatacagtaaataataacataataataaagaaaccttatgaattctattcagtgatatccatattgaggtatttaaggtgaatgatactgatgtcagcagtttacctggatatgcatcaaaaatatgattgattgatggatggatcggaggaaggaaaagatatgtgatcaaaacgagtatagtaaaatgttcatggtggaatctagatatatagatatcacttgtaatttttaaaaatgttattgcatttttgaaatttgttatgttaaaatattgggtgaaaattctgatgccctggccatgtcccaaatcagttgaatcagatctctggtgtattttttttttaagatccttggatgactccattgtacagcaagtttgcaaaccactattctaacttctcaccacccccttctttatagcttacaaaattatatttttaaatgtcaaatgtcacaatttcactttccttcttcaagaactgattagacttctagcttctcctatgctctcatcttgcataacgttcatttgcacgtggttaaaactgataggcaataaataataacccatctgtcttttcctgacccaacataactaaaaccttcctttcaaggcgaaaatgaactataatctcacagacaagagtagctatagacaactaattctttctggtctctcgtggtcatgggactattcaccactgccgtccctgctgtctatttggtggaccagccagttttactgtgacccataccatggctcttgagaagcatgaagctgccgaaatcgcagttgtagggttaatggaaaacatggtgaagtatagcttacatatatatacaattttggcacaaaatgaagcctaagaaattgtaccgggctgggtgtggtgactcatgcctgtaatcccagcactttgagagaccaaggtgggcggatcacctgaggtcgggagttcgagaccagactgagcaacatggagaaaccctctctacttaaaatacaaaattagccaggcatggtggcgcatgcctgtaaccccagctactcaggaggctaaggcaagagaatctcttccaccctggaggcataggttgtggtgagagaagatcacaccattgcactccagctggggcaacaagagcgaagctccgtctcaataaataaataaataaataaataaataaataaataaataaataaataaaagaaaaagaaattgtaccaggaagtggattgggaatgctctatatattctccccctccaagaagtttttttaatttattgtattgtgaaagatctgcagctatttattttgtgtggtactcttttgcaataaactacttctgcataaatgaactcaaaaactttgatattcatgaaccttcataatgttgatctagtacatcttgcccaactagcccttgggccattccttccatgccactggttgaaaaatatgctccccaccccagtaacatcagcatcagacctctgcaaccagaaagattccataggtaatgaaatccaaatgctggcatttggaagtcaaaccagtgtattttgaaatggaaaggcaaggggaagtgcatggagcaagtacagcatgtgctacaacttcagttcataccctccttaaaatactgtgcaactaaactgtcaattgcccattgatagagatagtatctttttcagctttacaccttccgaattcaacacactgctagcctcaggactaagcgctcaataaatgtttatcaaaagattgagtaaatgaatcagtggtgaaataaaatgtacaaacacatacgcttcatacacgtttaggaagcatttctagtgagctttgtggatattttatttcttaaaggttctttttctttccatgttcatgttattctttattttttaaaatgttgcttctgcttatttctctttctacggcagctatatttacttgcctgagagcacagcatatactgatgttaatcaaactttagatgaaacacctaaaatgatagaaaagaatctgctctaattaaataataaagcaacccctacaggtttagacatgtgccttccggtgtgggaaagaaaaaatttaatgaatgtagtagttttatgccaagaacatttccctcgtgcacctgtgttttaataagatagaatataaaatagcaaaaggggcccgacttttgtgatgatatttactcataaggtagtaagtcagatgtgatgacattttctttgacttagagctgctatacttgggtcagatttcagttcagtaaatttgcagtgaagttgtctttctaacatggtgtcatcctggaactgccctgctcccacagttacatacaggctagggagtgggtaggagtgggggtgaaatcctcttaatgtttatggtgtcagtagattcaaactaaaattagccttacagccatactcctaataaggggcccctggcatatttaattgatttaacaaatttatcaaaaatagataaactgaaatctgccttgaaattaattactgtatctctatttttataagaaaatattttggacccgttccctctgccttatgggtgcaactcccggcagaataggtcatgtctcctgaaaatagttcttattttctttactacttatgacctcttatagcctagaagtttttccttgctatttctagttgaaatgctaatctggcataatttctagttgaaatgctaatctggcataatttcagaactaattttctgttaatgccacttggaacatctaaattcctcctttttcaataatactatatttgtgtgttgcaaacacacacaaatcatactatatttgtgtgtatatatagtaaattccaacttataaaagtaaaattggaatttttttctttctttggaaaattattttataattgagaattataaatgtcacttttttaaatgctgcaacctttgagattggtttcaataaagtaaaacttagtaaacattaagaaaaatgatagcttgatatgttcactaatatggtaaatgaaaacttttatgtgtgtataggctcttgttaattataactaccttcacaggaaaaacagtcttgtggaaggtaatggtgccagtgagagaaaatagagaaagtagaatagtagtaagagagaaaatagaatttcccgtttagaataaagctaagtaaaaagtgaattgtttcagttttatttatgtatttgtaagtgtggtctcatgccatatatattcaaagatagacagagatcttaatctttaattttttatggccaaagaaaatgagtcccatgtaaaagggacattttcgtaagctgatctcaagtggtgtattttgatttgccgcagcagcctatggaagaaatatcattttggctgcctaagaagaaaaatgtcatacctttctattttttattcatactccgcatatttggaattcgtattctcaccatacttttgggaagataacacgaaattgccttacttgcctcgaaatcaaaatctgccattcgttttaaaataaaatggctttttcatctcattttcctttagcagaaaaaagtaagttaaatttttttgtagctgtgttaagtgtactgttcctccctcgttgagaacgaaacaaagacatatgattccatttactgtaattgttttggtttgcccaattacaatagcagtaaaatcatttacacatagtaaaatgtttgagccttaaagggcaagaagactaaatttagctgaagatatacaactttcatgtgccaatgaggaaatgtataaaatcagttatacatattttcctcattcatagatattgaaaatattcatatatgtgtacatgtatttgataacttaatattttctaaataacagaaattatatactgtatatatatttggatattatgattattgttattgccaccattgagcacttactatgggctcagaaaacttcactgtattatttttaattcttataacaaccctgtgaaatatatattatgcctatttcacaaatgagaactctgaaatcaggaaattaaatcacttgctgaagtttacaaagcactgttaggcaataaaacagaatttcaaactcacgtttgcttgtcttcaaattttgtatgctgtacaacctgattgttttactacttgttcttaatttcaaaaaaaatcttcatactaaaagatgatactttgggagttctaaagaacatgtttttggccgggcgcggtggctcacgcctgtaatcccagcactttgggaggccgaggcagaaggatcacgaggtcaggagatcgagaccgtcctggccaacaaggtgaaaccccgtctctactaaaaaatacaaaaaattagccgggcgtggtggcgggcgcctgtagtcccagctactcgggaagctgaggcgggagaaaggcgtgaacctgggaggcagagcttgtagtgagccgagatcgcgccgctgcactccagcctggttgacagagcgagactccgtctcaaaaataacaaaacaaaacaaaacaaaacaaaaaaaaccatgtttcttttcagaaggtatactcatttgaagtggataccaattatttgtattaaaattacttatggataaatttgaatctgcaaaaattaagtgcaacattattttttggcacctgttataggaggtaaaaatggtgattcaatatagtttctacccttagggagcatttagtgtggtttagacgtaatgacactaatgtaaattagagtagaataaattctttaaagcaggacaaaaggagtgttaaagactacaaagtttcagttatggaagataaaattctggagatctattatacagcatagtgcctatagctaataatgctgtttcggacacttaaaatttcctaagaaatcttatgttgtgttcttaccaccagtaacaacaataataaaggggacaagaggaaattttgagtgatgacagatatgtttatagccttcatggtggcgatggttttgtgggtgtatacttattcccaaactctttgattttatatatatatatatatatatatatatatatatatatatatatatgatgaaactctttgagatatatatatatatatgtaaaatatgtacagctttttgtatgtcaatcatacttcattaaggtggttacaaaaaagaatcaagaaaaataatcaccctaataaaaagagtgttattaaagaggggagggattacttctaattggtagtatcagaaaggttctcatggaggaaggtatagaaaaatttaggacaatataagcaacgatactttaagaaaaggaataatataaacaaaaataaaccaaaagatgaagaaccaccaaggatgtttctgaaaaatcaagagaaattccattttgatttgagagtatgaggtacttgtcatgatatataatgagaagtgtctagaaatatgttattttgagcaaatgctgcttagaaaggaggttaggttatttattaatccattcctttgaaatataaatttcatgatcagaaacacgtgagtgtaactatccaataacaacatgatttatttccaagaggatagtatattataggagaagtaggattttttctctttcacaagctaatacagtgtttactgattcaaatgacacttaaaaaaaacaagaaacaaaaaacatacactataagctatccttattcagctatgttattgtcttgcattcctgattagaaacatacaagttagactcccaaagtctcagttttctcatttgcaaaatgaataaaatgatagtacctaccccaaggtgctgtggagtatatttaatcatgtacttaatctgaagttttaattagagtgcatagcatatatttgtggttgcttttgctcctatttctgggtaaaagttcctacacctattatatatgttttgtgtttgaatgaagagaaaggcatcattatttcaaatatcccctctagccaacaaatgaaagctaagacttggaagctaggatgtctaacaccatatcctcttcatgtggactatatagtagaggatatgtaaattaagactcaattaaatgctcacattttataaaggagacccttgaatatatcaaatcctcagagagtatgtcagtttaaacttattaagaaatttaaattatttaacttagcctgctgagtcagtttctgtagctgatttctccaaaaggtcttggtattaaaagtagcattacagatcactaatagcaaactatttctgctactttgggtatttttacagggtgctaattgtgccaaatcaagacattgaaattgcataattttaggttaatattagcataatcctacatattttttcagaagcagtgcaggaatagtacaccctgaatatttttccatcatgatggaattttcaaatatcacaacctttacattgtcagttgtctgctggaacattatattgtgtcaaagagatttataaaagagaagggcaaagaaaatttgcggagttctagacaatagtaatatcagggacacttttgctttctttgttattactaaggagttaaataatcagataccaagcataggtaaagaaatgaatctctaactatttgagtacttatcaatttatctcaaggatatttacggtgttttcccctaagccaaaatagagtgcttaattaaggtccccttagccccctaaaaatcactcaggccaagtttctgatatgtgtgtatacttatatacatattaaagtatatgtatttttgtgtgcactttcagatcaaaaagtcctcgtttatctaaagcaatttcagcttattgatgaggcttttctgttacagcgtcctcctccacagatctgcctgtctagagatttaagcccaataagagtccagcaaagtttaaacaacactttagaaatctaaagaattttaagatttattttaatagtcttagtgataacctgaattgtttgtgagttcttacaaataatgcaatcaacatttaagtaattttattatttttttgtttgtataaatttaaggtatacaagtacatttttgttacatggatatattgcagagtggcgaagtctggttttttgtgtacccatcatgcaaatgatgtaccttttctccattaagcaatttcctatccttcgcccccatcccaccctctcgcccttctgagtctccagtgtctattattccacactctgtgcgcatgtgtacacattatttagcttccacttgtaagtgagaacatgcaatatttgactttctgtttttgagttattccacttaagatgaccaccagttccatccatgttgctgcaaaagacatgatttcattctttactatggctttgtagtatttttcattgtgtatatgaaattgtttattccatacgcaatttgtgtgtgtgtacatatatatatatatatatatatatatatatatatatatatatatatatgcttagacttagaagctaggatagacacacaatggaatactacacaatggaatacattcattcacacacatataaataaaagaatatgtggagatatatctccacatattctttatccaatcatctgtttttaaataatgctattgacttctttagggtgaattttatcaatattgttttggtttaaaacactcaccttaaaagagtcacagtccctaaatgtgcatcctcatatttaaattaggtctcagtaaatttgtgcaaagtgtattctttttaggatggtgttgaacttgctaaattatttatctttaagaatcatcattttgtgtcttttattaatgaaaacaacaattatgtgattgctgatatatttggaaaatgatttctgatgtagattgatttttttattctaaattctgtgtcggtattaaaaatttatagattactaactgtattaatatcgataatactaaattttattgctatttataacttggagtgtactttcatcctcctgaaaaagctgaatgaggtaggcagtattattctgggtttatgtgtgagataactgagactcagaggtaaaatagtgtatccaagcattcatggctcttaaatggaagatataaggggtttgtgaaattactcatggacttttttattcattcattcagttattaaaatgtattcaacatttatcatgtaccaggaacagcgcttagtaccaggaattcaaaggtgcataaaacatcttccttattctaagaggtacatagtgtactggaacaaacagccttgtaaatacataattagaacatgaagtagtatgttaatagaggttttcacaaagctgtggaagcttgtcttatgaagtaactaattccaagggagagaagccttatggaatagtgacattttagatagggtgtcattctaaaatacagcaaaaggcccacagtaaaaaaggaattttggttgttatgaaaattttcagattttctatgttttcagtacagtatacatggtgggctatgtgaatgtttgtatagggaccaaagtaggaagtgaggttgtctgttagagagcgctgagaaaccgaaaatagggagagatgagttggaatatgctgaggaaaagttattaggagttttcaagaaaggccacgacagtggggctagagagaagaggctaaattaaagagtcatttctggtttagaattgataaaatatagagacaagcatgataagaaagaagtcgagaagtaaacgatggtctcaagatttctagcttggaaatcattgactaaaattaaaactaaggactggattaggccattcttgcattgctataaagaaatacctgagactgggtgtttataaagtaaagaggtttaattggctgacgattctgcaggctctacaggaagcatagcaacatctgtttctggggaggcctcagggagcttttactcatggtggaaggcagagcaggtgtaggcatttcacatggcgaaagcagagagagagagttggtggtgggggtgggtggctacctacttttaaacaaccagatcttggagaactcactcattttcatgaggacagtaccaagaggatggtattaaaccgtgagaaaccaccctgatgatccagtcacctctcaccaggccccacctccaacattggggattacaatttaatatgagatttgggtggggacacagatccaaatcatatcaaagacttgcatgggaaaataaggaattgttgacataacatctttgaggttcacatcaaatgttctgatgaggatagtccaagtagcagttggctatatacctcagataagggctgaaatttggagctatgtcataatcagcctagattaagagtcaataatctcctgcccatgggccaattacacccaccacttgtttttgtaaagtagtattgaatcccagccatatccatttgcttatgctccatgtataccttttttttgaacttcaaggcagagttgagtagttgtaacaaaaaccatacggcccacaaagcctgaaatatttgttctcaagatctttatctataaagtttgccaatacctgctgtagatgttagttgaagctttgaaagcaaatgaggtttcataaggcagtgtccatacaagacatttaacaagtttacctataaaaactagaattcctttgaggggaacacatcctagtctccattaagcacagtagaagagtcccctataatgggaaagaggtcactttaggtgttgatgttggtggtacaggtcaaagaaaatttatctttgctgtttattcagaatgcaataagtgaagttatgagaaataagggaaaaaatgtgtagaatttcaacagcgaagagaggggataaaggcatgagaatgagttcctaagctcaagtattataaacactgtgagaaacttaaaatcaaagtatgactccaaacgtatttgaagcctgagaacaaggctcacaacctagggaggattagggatcaataaaatagagtgttacaaagtataatgtcaatccagagttgtaaaaatatcagcattgaatatattgaaagcagtaaaactgaatgaggagactatcattttatatcactgtgtttatttctttgccttgttctataaatatttaaaattataaaatttttattaacagtgagagcagaactaccagagtgagcagatcaaaattgggacagatgcttttcactgcacacacttttatttttctgctgttcatgcattatcttgtacagtgcacatgttttacctaaaaaattaaaatggagtctcctgcttaggaaaaaagtatatattctgtttcaaactatatacaaaaataaaatcccaggtgactaaaaactgacatgagaaaaaaacaaattgataaagcttttacagtaaaatagaggagaatatgttaattaatatagggtaagaaaaaattgcttacacaaatgatgaagcactaatcatgaataaaaataataaagtggactaccttgtatattaataacatctatacatcaaaagacagcactgagagagtaaaaatgaaacccacagagtaggataaattatttggaatacacacataatggatgaaatgtgtgtattcataattataaagaattcctacaaatctttcagaaaagaacagataatccaatagaaaaatgggaaaagttcttgaaaagtgaaccatggcacaaaaagggcttgtggcctgctggcaatattctgtatcttgacctggatggcatttttaaggtgatcactttatagtaaataactaatgtgttttatgcatcatagtaacgttaagatttttgtcatctttacaaaataagaaatccaaacggccaataaatatataaagaatttctaagtcccattaatggtccaggccatgcaaattaaaactaaaatgaaatatcactgcttaccaaccagaatcattgaaatttataagtctgacaattccatgtggtggtgagaatatacagcaattagaaatttcacacaatgttacttggtctgtgaattgtaaatagaagtgtaaaattacactactgcttcttggagtgaaatccatttggcactatttagtaaattcaaagatctgcataacctatagcccaccaatttcacttctatatatacactctacagaaatgcatatgttcatattccaggagacatgtttgggaatgtcatagcagcatagtaatagccccaaaccaaaactacttcagtatttattaatagtaaaatttgctatagtttgaatgtgtctctttccaaattcaggtgtcgataatgtgctagtactaagaggtagggtgtttaagtggtgattaggccatgagggctccttctttgttaataaaaataagacccttataaacaaggcttcacgcagcattcagtcagcttgctctcttgcccttctaccttctgccttgtgaagatacagcaggaaggccctcaccagacaccaaatgccagagcctttatcttggacttcccagcctccagaactgtgagtgaatacattggtattatttgtaaattacccagtctcaggcattttgttataacagcacaaacagactaagacaatcatacagtgagaaattaatcaacaactaataagcaaagaggtagattaatcttgaaactatgatatagagtgttccatttggctgctggaagttttatttcttggtctgggtgatggtcaccatgggtttatatgaatggttccctatattatgtttcacaacaaaaagcatttaaaaagtaaatatatgtaatgtactcagggataggcatggccaaccatggattctatgctgaaataatgattcagatttcatcagcaggctaatgacactgcctatttaaatactttaagtcctgaaattaaagaaggtaatttctcaagaaggaatttctaatttatgggtgggtctattccccaccagagagacactagcatggctcagattctatgttggtcattttatttgcatttaaagtcttaagccaaatagaggtacactaataatgacaacaactactactactcatacttgtggaacactgccagatgctgttttaagaaatttgcattttcatttgtaactgagcttacttgaatcttctctctttttttcttggttaatctaactactggtctatcaattttacttatcttttcaaagaatcaacattttgtttcattgatcttttatatttttgtttcaatttcatttagttctgctctgatctttgttatttcttttcttctggagctttgtgttggctttgttgttgattctctagttccttcaggtgtgatgttaggtagtcagactgtgaactttcaggctctttgatgtaggcatttggtgctagaaaatttcctcttagccttgcttttgctgtatcccagaggttttgaatagattttgttgtgaatgtgatgaaaacggaacatttgtacactgctggtgattgtaaattagtacaacctacatggaaaacagtatgaagatttcttaaagaactaaaagtagatctaacatttgatctggaaatctcactaccgattatgtacctagaggaagagaattcattatatcaaaaagacacttgcacgcatatgtttatagcagcacaattcacagttgcaaagatatggaaccatcctaagtgccagccgaccaatgagtggataaagaaaatgtggcatatattttcatataccgtgaaatactattcagccacataccatgcaatactactcagccgtagaaaataatgaaataatgtcttttgcagcaactttgatggagctggatgccattattctaagtgaagtaattcaggaatggaaaaccaaatactgtatgttctcacttataagtgggagctacgctgtaggtacacaaaggcagacagagtggtagaatggactttgaagactcagaaggggcagagtgggaaggtagtgagggataaaaaattacctttggggtgtaatgtacactacttgggtgacacgtgcactaaaatatctgattttacttctatacaattcattcatgtaaccaaaaatcacttgtattccaaagactattgaatttgaattttttaaaaacattaataaaataaaagatgtaaaaaaagaaatttatatatactcatttattgagctcccacaattaaccttaggaggtaagtacttcataattggtagtatacttatcttttactaaatatttgtattacttgggaagttgagggttggggagaagtagcaaggtactatgatttggggcagataactaacttatttattcgcacatacagtttggaccatgagacacgagctcaggtccctcctcctcacctaatcaaagatgaaatatgtgggatgggatgaaataatcagcagtccaatgctgagtttccagaccgaagtataaagcaacaatggatatgtcagaagtctactagggtgttatttatttaaatctatttcatggaatttactaccaccttaatggcccgaaagtgttaaagtatgccccagagtaccgaattactccctaaatgtaatttatgcttgagaataatctgactaacttgatttagaacatcagaaaataagttatgctgcacataaatgaagcagcagtgtaattttaaataccggttgcacggtgaatgagaattttaatatttgcaaaattctaaaatcacttgatttattatccttatgtttatactgacatttttttgccctttgttaagttccatccatatttcttcttactgccaagaaaaaaaactttttttcctagaaatattacagaaggcaaaaattatatttgtttccctgaatgctatttttgatgtctctacttgtttctcattgttaccatttgcttcattcatgggcagcccaattaatggagcgagacaaatttagggagcacagtgactaattagatattaaattggtaaatctaactttgtaaaaccagaaaaaatatatatatatttttttcatttggaattttccttggtggaaaagagtttaaaagtagtcatgataaaaaatgtaattttacgtagtaaattcaagaatagatttagactgtgctattaacagcacctattaaatactgaaaagtgtattttaaaattttatgtgaggcttgaaatggagtctaaagtattattactcacattaagtgtcatcacatgtaaagcccatgattttattctttaatattttgtttgaatagttacttatttcaacagtaatttcaataataaaattaaatcaactttacagttttcaaaggtttagcagttgcatgctgtaataaatacttcatatttatatatttataaagtgacagcataagtcatttttattaggtccttgaggatgcaaaagtttggattatacgaggagacgagagaaaaagggaagaagggcatttcagaaatatgctaccgatatgcaaattcacaagtcctaagacagtagcaggggtcgggcagaaagtccatcctgcctccctcttgtgggcctggaacaatggtgtaagtggaaggcctgttccccttctcttcctacctccagctctgtcttacagagctacggataccatgagcaagtgtatgaacccttacggttttcttctcttgggagaatgtaaaggaaagataacttgtagaaacttgtagataacttgtaaaaaggaaaagaattcagggtgagagggggatttgttgaatttgatagaggatggcaattaccaatatgatgagtgattgagaaacaagtctgtgcaacaggtttgaaatcgaaaatctttgaggtgtacaggatcctgaaatgaagaatgggcatttatagcagtatgtcagagaaacagtcacctcctagtagctaaaagtgttggcaaaagtatagttcaagtgattgggtaggaaaaacagcaaaccaagagtggagactgatggttgctacaaaggtggagtggtaagtcgtgaccaactggtacttctctgtgctctggttagctgctgactgtttctcagactgtggtagcaggaggagggttggagttagcagtcatttgcatatgagactgccatttaaaaaaaaattttaaattatttcatttttctgactctcaatatgaaaagcacattgtagacaaattgaaaaatatagaaaaattatataagaaaatatagtctcaccagtatggaacaatgctaactatgttgcatagatttttagattctcattcaaaagcaactctttgactccagtgatgcaaatgcatgtaacatatgcaatgtgcaattcatttttaaagggaataaacttacgatatattcataggtcatttattgtgtgttatataccattgaaaatatatgaatgctaaattattagtaaacatgcaaaaacattggcaagatcattttgttgtggaaggatatattgtatctgaataactctagaataccataaatcatcaaaggcaacattcttatttttcactaactacagttagagaatacctcttcggctaccttcggttgccttttttatgctaccaaaatgctgtctgttttacaagattttaaaggttaagcatataattattcattaaatacaatgagtgcaatgtacatgtagatacattattaaattttgggtagttaataaaaataaggggaaaaaacctctagaactatcacttttaattgtttaactgataaagtgaagcttcatcttggaaaaataatttcacaagagagcatgtgcactggtagaaaagtgccattgaaacaagagatatttgggttagaagcctctctctactatttaataccattttcaccttttggcaaattacttggcctctgttttctccaatggaaaatgggaataataattgttatgctgcagggttattgtaggtgtcaatgaaatgatgtgtctggcactataaaagcacagagcccggtgcctggctattagtaactgtttaataaatgttaattcctttctctgcccaggacatcagtaggcagatgtagcaatttaaaacttctagtgttactttaaattcctgaatgaaggtagaggactgaaaagatatcatggtattcaaaagtatgatccattgcttcttaagaatagagttcagaaaagcttgacagattcctgtactctgaggcagcaccatagccggtaatctgtaggatggctattggttttgtgctcacaaatgcttgcttgggcaggccccaggaaatctggtagactgtaagcccagtaagatttcaaatcttactttacggcagtgtttttcaccttgactgtacattgaaatcacctggatgctttgaaaaataacagcgtcagtgtccaacctccagaaatactgattaagttggtctggaatggagccccaggatcactgtttggttattgttgttgctgtgttttaaatgccccagttgattcttatgtgcaactgtcttaggtaaacatacagccctggttcatattatttctgcctcagtctcttttatgactggaaggtgaccaaatgcttgtttcctaatattctttccatgtgtagtattaacacatttgacttgtactaagttcctgcagtattccaatctaaaattttagtgactacaataaaataagaaggattaaagaaggcatcgcatagtttagtatatcggttatttaatgcttacatgtgagcctacaatatgaattatatctgtcatcttattttaaatattgacagaatctttaatgatagtgacgaattattgatttattggtgtgataatggtattttagttatatttttaaagttttatttgtaataactatatgtatttatggggtacagtgtgacgtttcagtgtaatgtttcattgtgtaatgatcaaatcaggtttcttggcagatccatagcctcaaacatttataatttctctgtggtgagaaaatttaaaattctctttcactattttgaaatatacagcacaatattggtaactttgttcatattactatgcaatagaacactagaacttattactcctttcagttgatgaacaggcagttttggatcaagaataatattgaaagtgatagaatttatgaagtaatttttatccaaaaatattttgaaagggaatatattgcttccaaataatttattacaatgttaagatatttgtaaatttctagaattaaaaaaatatatttttaggaaagaaaatgccaatagtccaaaatagttgctttatctttcttttaatcaataaatatattcattttaaagggaaaaattgcaaccttccatttaaaatcagcttttatattgagtatttttttaaaatgttgtgtgtacatgctaggtgtgtatattaatttttatttgttacttgaaactaaactctgcaaatgcaggaaactatcagagtgatatctttgtcagtataaccaaaaaatatacgctatatctctataatctgttttacataatccatctatttttcttgatccatatgcttttacctgcaggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggtaagtctttgatttgttttttcgaaattgtatttatcttcagcacatctggactctttaacttcttaaagatcaggttctgaagggtgatggaaattacttttgactgttgttgtcatcattatattactagaaagaaaattatcataatgataatattagagcacggtgctatggactttttgtgtcaggatgagagagtttgcctggacggagctggtttatctgataaactgcaaaatataattgaatctgtgacagagggaagcatcgtaacagcaaggtgttttgtggctttggggcagtgtgtatttcggctttatgttggaacctttccagaaggagaacttgtggcatacttagctaaaatgaagttgctagaaatatccatcatgataaaattacagttctgttttcctaaagacaattttgtagtgctgtagcaatatttctatatattctattgacaaaatgccttctgaaatagtccagaggccaaaacaatgcagagttaattgttggtacttattgacattttatggtttatgttaatagggaaacagcatatggatgataaccagtgtgtagtttaatttcaacttgtggtgtcctttgaatatgcaggtaaagatagattagattgtccaggatataatttggttgctaaattacatagtttaggcataagaaacactgtgtttattacacgaagacttaattatttttgcatcttttttagctcaaattgttcatgttgcaatagtcaatcaagtggatttgaattgtagccaatttttaatgccagaaaatactgattaagacagatgagggcaaaaaacacccagtagtttattaaatactttagatatttcaaaatgctggattcacaaaagcagtatcacatttgactttacaagtcttcattctcaaatatgtttccatagtaaatatgccctttaatattaaggagttaagcatttaaacacctatttatatgataagctatttaaacacagaaaatatttttaaaaccttgtgtaattatatgtgtatcaatcaaacttgcatgcacaccagcgttggcatttgtatagagaggaaatgtatggattcccaatctgctttaatatagaagatacattttaaaaatagcactgaagtgaattttgggctaatgtagcataatggggtttctgcctgagaggcagaaacatattagagttatataaaatgttttggggtagatatagaaaccacttgccattttcaatgatatccaacccaaggtagttatatatttcaatttatattttattatcaaattagtacttattgtgaaaaaaatcaagtaacatagaaatttgtaaaagtacctccattctactctttggaggatagttgttcagtatgaattttgctacatatttcaggctgggtttcttggaaagccattgtaaaatggagatttgtatgtagaaggttaactagggagtacttttacgatgaagcaatttgttttgatgtaacttggtgtagttttcttcatgtttcttgttcttgaagtcagttaagctcttgaatctgtgcatttaacatttcatcaaatttagaaacctttcaaccatttttttaaaaaaaatggaactccaattgtacatttattaggctccttaaagtgccccactactcactgatgttatgttcattgtctgtttggtctctcttttctctgtaatttgttttatataatctctattgtcaaattgactaatctttttcaaagtctaatctatggctaatcccatgtagtatatatttttaacatcagacattttcatctcttagaagtaaaagttgggtctttttatttcttccatgtgtctactcaacatgttcagtctttactttcttgactatatggaatacagatataataactgttagaatattcttctctactaattttatcatctgtgtctattctgggttaatttaaattgatttatttttctcctcattaagtgtgttgtttaactgcttctttggatgactggtaatttttgactatatgccagacattgtgaattttaacttagcgcgtgcttgatacttcaaataaattcaaatatattgaaataaatattctcaaacctcgttctggaacacagttaattcacttggaaacaatttgatcttttgagaatcttccttttatgctttgttatgaccagaacagtgtaagtttagggctactttttccccactactgaggcaaaacccttctgagtactctctctgatgtcctgtgaatgataaaatttttcactggggctcgtgggaacaggtggtattactagccacgtgtgagctctggtgattgtttcctttaattcttttgtgaagttctttccttagctttgagtggttttcttgcatacatgaactgatcaagactcagatgaagaataaaataaagctttctacaaatctccaaaatttcctctgtgtatatatcacctctctggtattttgccctgtgatcactagtcagccttgggctgctgaaactctcagcttcatcttttaacaaaagcctcctggcaaggatcactgtccttcaatgtctgatgttcaatgtgttgaaaaccgttgtagcatatattttgtctttttttttttttttttttttttaagtgtttcaggtgtttcaggcaggagattaagttcagcctcctttactccaacttgaaaacaagtccaaaacaaactattttgatgtaatttgatcttttaatacattaacattacacaattttgtgaatatatcataatttaaaattttcagagaatgtctaatggtcctcatttcttgacagtgtggtttagttgaaactgatgaacattttatcaaaacttttcccctcaattggatacttttttttttttgagatggaattttgcttttgtcacccaggctggagtggcatgatctcagctcactgcaacctctgcctccaggcttcaagcaattctcctgccttagcctcccgagtagctgggattacaggtgcccacccccacacctggctaatttttgtatttttagtagagacgagatttcaccatgttggtcaggctggtctagatctccgacctcaggtggtctgcctgtctcagcctcccaaagtgctgggattgcagacgtgagccaccatgcctggccaactggataattttaaaaagaccattttatttagtctattttttctcaatctatagatgagataagaaaaatcattctagatgtccaaggaaaaattctttcagaaaagagctgtgaatgatatcacaaaccccccaaacagttaaggtatttctttcctggttattttatgtccaaaatcatgcatatgaacatgtgcacacacatgagcgtgcacacacacatgaatacatatacacgcacataatgtaccttaggttatctttccattctgagtaattatcgtaaaatgggtaaaatcaaccccgtaagataccttcatcgataaggcaaatcaaagctttggtaatttctgctatcttggcctttgttgattgactaataatgaataagagaatgagtttcaatatttactatgaaattattttagaagacaggatgtagacagtggctgttagcaggcaattgtttggcatgagccagtaatggttactgtgaaaaaaatcaaccaagcagcccatatattaaacaaacacacgcagaagcacgttggagtctgaagcctcatatgtacaattttcagtaaagaaataacttttagatatgaaataaacaaatagatatatgttgtaaacttgtccctatgtattttgatcaaattgcatcatatttttttcactttaaagaagagaatttagtgctttaactgagacttagtgttatcattcaaaatatactgactgccaatagcagtagaaagataatctggttccatgcaactctattttttttcctctgtcgcaagtaaaagacaaaattaagtacatgaattagtgctttttgaagatattccagagcaatataccatgccactatggagaacctctctaaaaatatcccatttttttacctgagaaaaatattgatcatgttatatgccactcaaattggtttattaaattcgttgaatgatatcagcatctcttaatgcattcactaaacaagcagtaattgagtgcatatacaaagttttatcatccaccaaaacagtgacaatccacatgaggctctaatagaagtttagaaagggggttaagtggttaaatgctggactcagaaagattggattcaaatcccaggtcctttagcttaatagttgtagaatcttgtgaaaatatcttaattcttttcatgtctctgatttctcttctctaaaatggaaatataaatgagatgtgtataaagccacttggaatagcattttgcacaaaataattactcattaaatgtaagcccctattataactaatcactctttataagtgattagttcatatcaatacaaactaagacttatttactgaattatcgtctctaaacatccacactgcagaaaaaccaacctggaaatttcataaaaccttatttttatgtagtataatttcttctcaaagcataagggctcttggattaggaattgaggaaaattccaattcagccaaacgcatctgtttcagatagctgacacttctgcctactcatttcctagctaacaagaagaaatgttaatgggagttttcaaaggaaaagctgaacaccatgaaggaaagtgacacaaataatgttagctcatatattgacagggtgaatttgtgtgctttcaagtcccttcagtgaaaataggaaagtagaaattataaaatgccctaacatttaaagctagcatgttcttggagactaggaaaaaataagttttaaaacatgggctatgatagaatgagatggaaaatgtttgtagttgccagtagaaacaataacaattaccattagattaagtatttaaaccagctgaatatttttattaatggaaatggcatctgttttatgaaataatgctgctgaatgaaccatattaaaaatgaccagtatttcctgcagaacgttgtcgcagacatacaagcctgagaccctaaaatcttaaggtattccatttgaaatcgaccttaagacattaacagtagtggtattgtttagatgaaattttttaggctttaaatcaacaaatgttaagcagacatggggagcgaaacaccagtgtgttattctgacatgaataaactgctgtttttagggaaaaaatatagtcttgttaaggttaagctaattggttttctggtatcttttgcaatgttagtgtgttttactgctccataacctatgttatatggtaaatgtgcaatatatttatatatgttgctgtaaagaaatgtaataaaaaactgtttactttgtgatatgaaagtaaaaatttattcattgtcattgagcatacagaagtaaatatggattacatatgtcatattttaatgttcacatggtcccaccatcaaatgttgaaaaacttatagtttaacgtcatattctattgaagaaaaatacactcccttttctcaaatgtgaaatgtccagagagaatggaaaattacatataaagcatgtagttatagcatggtgaccctgctgtgatctctcagatgaggaacaaaagggagaaagaaagagcacactggtgctttggagttgagagaaggcaaaaaaagagtacaaaaatgtcaaagccaagtttagctgctcttcagctctccctttagctgctcttcagctttaccttaccatggttattagtgattgaagaaaattctaaagcactttttaaaggacccaattctgaagagtttagattcagagagcacaatggagttggagtgactcctgctcaaaagtttgagacaagcgagtccatgaaaagaccgtcctcctcttaatggaaatacccaggttttctcattcttctcgccttgctttcagcactcgcagcccagaaagcccttatctaacaggtactgccgttgaaaggtcattgacttgtacaaaaatgatgagtgctgaatagatgtgcataggtcactgacagtatctgctacagagaatgagttttcgtatttttattaggatacacctaacatggcaatctactgcctcaaagaactctataggaggtaagtgaatttatattaatacagattgaattaaaggataatctagaaaaaggcatatgatgtaaaaaaatcagacacaagtatattttctgtatagtcagtttttacattgtgatttcaccagctggctgctgagtttgacggcttcttaacagccacactgctgagattcaaatgctgatagaaactttgatggaaaaatcactggagtaaatatttctaccatctgttgcccttcactgggaccctaacgttaagaataattcataccattgcttgtcctttatatttccccagcagtaataaaatttcataagattttgttttgtggtcacaaagctatcctggtttctgtaactagaagacatacactagcataagggaatcagccggaaaatttactgctaagagaatttgtctctagtcacttactttaaggttacagcaatgtgtaagtgtgggaatacattttaaaatgagcttttcaaagttattagctggtagtggcatgagagttaagtctcttaatacagttaaacagttgggcacttcatccttgcgtaaatattgttacccttttattgctgcttggaaactcctctgcaactttttggcccctatccatcttttcagaagtagtaaataaccaatttactgggagtgtggtaccaggcagaaattccgagaggggctttcaatccttgcccatcaagtgtatctttcagaaataagtatattaaaataattggataatttcagtggcttgttattagacttccgttgtccagcatggcatgtttaagaagatgacagattttcatacattattggaaagaagcaagaacaaaaaaacataacttactgtagtaaccacggtaaagaactgcttaaaatgcaggataaacatgtcatccctaagggattcccattcttagagcatgaaattatcaagagagtaagagactacaaaaaatgagaagaatgctgattgcaaattccaaatagaaaaaatcaaaacaaaactgcgcaccatcattctggaagcaatgagaagcagaaattgtcatttaatgaaatgtaagattaaagttaatagaagtaattttcatgaaataatattttgcaaggacgatgttccagccatattgatcttcgtgttttcttttcacatcccttcttactgttccctagaatgcttgtttctacctttaaatttgcttttctctctaccagagggctctaccctatctccagtttctcaccatgtcccaatctactccctctcagaatttttgtacacttccctttatatatatttgtgctctaattttatattcacagatatgccttttgtaactcccccatcttaaagaaagcacacacgtacgcacacatgcacacacacaaaattgaactctttctgggagatctgcttaactttcttcataactctgtcacttgctgaaactgtagtatgtgttttcatgtttattatcttttccattagaatgaacatattttgggtacttggtctttctcgatcaccaatatacctcggtacgtagaaaaattgattcatatattgaaaatgtaatattcagtagaacgaataaatacataaataaatttaaaaatgatacttttattgtattacctgagacaaatgatccccaagtttgtccttgcttttcatagccaaaacattctctcttacattgagcttccttcacctcttctgtgtacagagcacttaaaattttcacattgcctgatactttaacaatatgatggccctgttctcttacccattggagcatatgttaaataccagaacccatgtaacaaacatatattgtgatcctactgtgtgcaaagcagatactgcttgctgctaggaatacagagctgactaagagctccttttctctttatgagctcacagtctcatgagttcaacgtcttaaggcacaacgtctaaagcaaagggcagtaagtaaacactccagaaagtactggatctggcctaggacaaatggtgggttgtttttccagctgttatttttcctgccccctaattgacagtcctccattacacctctgggatacctagtctgacttgggaaaacctgactttgggaatcagaggcagtctctcttgcttatatatgaggaactctaatggatacttactgtcattagagaaactctgcttctagcctggctccttttgtaaagaaggttgagtccccttggagagcctgcagaacataaccatttgcatgtaatgaacagtttgtaatactttgagattgatgtgcaatttctatttgacaagggaaaaacaattaggattaaccgtggtcgtatatcccagaataccaacgttgtttccacactctaagtgttgttgggtcattatatgagattcataattttgtcctgttgtacccacgtttgcattaccattcagtcttaatttattataccctattaaaagtttttttggtaatttgttcttattgctactcaggcattaaaatgtctgcaggctgtgaaaatgaataaatttaatgtggcagcatagttctcaaaatcctggctttacaactcatagtacaggcttgtattgtaaatcctagttaacatggatttatttgaaaatccaattttactgctaatcttaaataacacatttttcaaacattttatccttgaatttctatttttttataatttatggctgttgtatgtatttacaaaaggacaatgtgtgtacttttaaatactagtaatggattgctgaaacaactgtaactttaaaacaatgcaattgttaaaaaaataaactgtgcagcctggcttaatggaggcttatgaacatatgattaagatatatgctataataagcaaattcactcaactgatagttcataggaactttcaaatttaatctcataaccagtgctatccttcaaagaatggtcagggcaatttaacgagtacatgaccacgcaagataatttcattgaagagtggctgaactgttgaaatattttctagtctccttgggatatcattaagagcagaaattttgaaatggaattgtaatgatgttcagaaaagataagtaggtaactctcttaatacgttttgtgctgctgtaacaaagtacctaagactaggtaataatttgtaatgaacaaaaatgtattggctcacagttctggagactaggaagtctaacattaaggtgtcagcctctggcgagggcctacttgatatgtcatcacatgatggacgattagagggcaagaaagatcaaaagggggctgaactcccacttttataagggaaccaaacccactcgtgagggtggagccctcaatccttaatcacctcctaaagctcccaccccttaatactgtcacaatggcaattaaatttcaacatcagttttggagggaaaaacattgaaaccatagtagtgatactgactactaccacacagggcttgggaggctaccctagctgttgcacccaagagatgaatcttctaatgtgattacctttatcattttttttactttattaaaatacttttattttacatgtatacttttgtctacccaccatttccatgtctgaccactgctactactatgtcctagcataacattccatacatccttaaaaccaagcaaagggtggagttccatctttaaaaactaaacaggcattttggacaacacattcttggcaatggaatctggacaacatttatcaaacatggtagggaaggttctcactctgcattatcaaaacgacagccagatatcaactgttacagaaacgaaatcagatggaaaatttttaacaaattgtttaaactattttcttagagagacttcctccactgccagagatcttgaatagcctctggtcagtcatctggaagcaattcttcacataattcatgaacttggcttccactttaggaagagaaccacctttttctatacttgcttgcatttttgctttaatgtcttctacagaactaggtcctttgggtgttttaggagtttttccttgttttgaaggattcttgtccttttgatcttggtgttgacggttttgagtcttttccattccgatttgacttttgtgcatttttggctggagtatctcatatagatttcttcactggcgctttttcttcagtttcctcatcatcaaaatcatcatcatcatcaaaatcatcatcttcatcagcagcaagttttacttttttctgtggaaccttgctaccacctccaggagcagatcgctttccagatatacttatgagtttcacatcctcctcctgttcgtcttctgactctgtatcttcctccccagctactaaatgctgtccactcacatgcactggccctgaaccacacttcaaccgtaagaccactgatggtgttatttcaaagccctcaagggaaaccatgggctgtacagacattttcaaagctgccagtgttactttaattggactgcctttgtaactcattgcctctgcttcaacaatgtgcaatttatcctttgccccagcccctaaactgaccgttcttaaagataactgttgctcaatttcattattatccaccttaaagtgatcatctttgtcggcctttagttcacaaccaaaaagatagttttggggcctcagaggactcatgtccatcatcgtccatcaggtggcaggacgcacttaggtgggagagaaggcagatgatgataaaggaccactgctcaagagaacagctgtgcaggacagaatcacaccagggagattacctttatcttagaaaacctgaacatcttgtgtactttgacacttctctacatttcacctaacctttaacatcaacacatttattcagaaaacttttacttttggagctgctctgtgtcaggctctatgctaggtgctcaggatattgaaattgatacaatcctaacctattcacatataatccaaggtttgctgaaattgatggacatttaaacaattgaaacatttaagtggtataattagcaaatggacatttaagccataaaaatagcatctaatagatataatagaggtcggtacaccattgatgagtcagagcagaggcaacccaaagagtaactagccagaagaattgggaaagcttcatagagagagcgatatgaaaataagggagagaattgtaaatccatgaaaatgagaaaaagttgaaaagtgatggtgtcagaaaaacttgtggtatgataatgacaagatgagaggaactcttggtaagcgtgttggatgcatggaaagaaatggcacaaaataatgctgaggacattttttattttattgttggttttgttttggttaatttcattttttaaatctagtatgctagtgttcattgtccaaactgtgaatcataaactcagtttgtggatcaacaccggcctttgatttttagtgaaacaaaatagaaaatatcagcattcatcacaaatagatgtttcacagattttttgttttaattgcgactgtgtgtgtgtgggtgtgtgtgtgtgtgtgtgtgtgtgtgtgtgtatgtgagagagagagagagagagagagagagagatggcttggatgtttatcacctccgaatcttatattgaaatgtgatttccaatgttggaggcagggcctggtaggtgtgattggatcatgtgggtggatccttcatgaatgatccctttggtgacaagttagttcatgctatatgtggttgtttaaaagagtatgagacctcaacccccacctgtttcctgctctcccctttgccttccaccatggttggttgtaaacttcctgaggctctcaccagaagtagatgccagtgacatgcttcctgtacagcctgcagaaccgtaagtcaaaagaaaaccccttttctttttaaagcacccagtttcaggtatttctttatagcaatgcaagaagggactaacacagttgtatgtgtatgtgtgtgttgggtgatttctggttgagtgtcacaaggttgtaatatggtgagtgtaaggaagtataagttttagaaaattaagaagccagttcagaaaactaatacttttggaaaatagtacaaaatcaactttacaagaatatacacagaaagatgtaatacaagatttatttcattgcagtaatttataaagttggtttagtgccttgcttttgcatgctgttttaaaaattaccaagaatatgacttcatgtgattttgaaatactcccagcaagataggtagaaaaggtattcttataactcttagacaaaaatttcggaaagtttaaacgctttatcccaaatcataaagctaataaatgaagaatctgggattcaaacaccatattttttttactgttcatcagctagaagttagaaatgttaagccaaaaacattaagtcactgctctgcctaataaatcttgaggaaactaataaaaagaataataccactgactacaggacaaggtcttcctaagagaccttaaatatattaagtgatgaagatgaaacttcttttattcataaaaatgttatttagttatgagtagagctctaattaaacttattttatattgtcatcagtaaagttgagacataacatatttattaatataattataatttgacccatagtgtattaaaagaaggatgttaaaaggagttgttattagagatgatgttagggttgttgatgataataacagtagtcataacataacaaagcacttcataatttaagaagtgccttcaattacattgttactctcatggtaatctctgtttgatatatagatttggcggattctatatcactctaagacataggttactgaggtgacggaggaatttagcaagcggctgtcaaatggaggacatgagcattggattgtgtatggcaagggctgatggtctctaagaaagcctcttggtttccacagggcagaagccctttgaagatcatagccaaggatttagtaattgcctccctttcagaataccctcaagagaaaagcccaccataagacatggttccctacaggcaaaactgcttttccttaaaatttactgttccctgaatatcagccttctttggctcattcaacatagttttcttaagtttcaggacagtgctgcagaccaaaagtttcaacattgaggaaaacaatactacttgtgcagtgaccctacctcagtcagggaggcagatgcctgcctttatgtgagggaataaggaatcaatcatatttccagcactcaagaaagccagtctagtgcagggagagatagatacataaacctcaaagttatgatatagcataatagttttaaatttccataataactgtattttaaaagttttatagaaacagaagagatgacctcagtctggaaaagccagcttggagaatggcaaccaatattaagtggcaaaagctttgggatcccaggcctccagatggagggtgatagcatgggccagacaggtaggttaggaaaactttgcaaaggacattacacggtacacagacaagtctgtgttttagcctataaaccacagttgcagaatgtgtttgagcaaaggcttttggggatgagatttgcacttttcaagatttaagtttgtttaggatacttacggtttgctgtatacttcctgggtttttacattataattacggtttgaactttaaaggaaaactgcagtttagcatacttgaaagagtgcaacttcaagtcatgattggagacagatatttaacagattttgtgatcctgtgatgcttattttcttctcagacataccacatgacaatcatttttaaacagtttatttctactttagcatccatctgaaggtgttgtgtatgttttctgcttgaaaataaagcagtgggctgggtgcggtggctcacgcctgtaatcccagcactttgggaggccgaggcaggcagatcactaggtcaagaaatcgagaccatcctggccaacatggcgaaaccccatctctactaaaaatatgaaaattagccaggcgtggtggtgcatgcctagagtcccagctacttgggaggctgaggcaggagtatcgcttgaacccgagaggcggaggtcgcagtgagccaagatcgtgccactgcactccagcctggcgacagagtgagactctgtctcaaaagaaataaaaaagaaaataaagcagtgaatgcgattaagatggatttattatgatcataaagtactcaggagtcttattttaaaagacagcattactgtaattaaaaatatagggaagaaactaatgctgttttgcgtatcattctcagctctctcaaaatcagatattaagctcttgctgccaaaggagactatactgcacggtgctcacctgcataaactttgagagggttgaattgtgccaagcaattctctcaatacataaattaaccaaatatttgttgacctactgtgtgacaagtattattccaggaaataagagatccagcaatgaaacaagtatggcttcttatagagttcccaaaaaggaaataaaaggatatacgtatagtgatatccctgaattaaatttctcttttgaaaataaaaattctatcataagctgtaactgccaacacttcaatactcattcagcagttttcagggatttgtaccttttgacttatgagaatttggaagtctaattgtatcattgcactggagtcttaaagaaacagataagcgaatgactttgcctgtatcattgttgactgtacttacaatcagaaaggggcacaggacagatgccagggagtaagtggacagcccataaatggaatggtaagaaagaagaactatagtggatttggaaagttcccttcagcattttccctagacaatctttggctgtgtttgcatgatcagtatttcattcacaggatattgagctcttgatatagttctcaaaacccaaaatgaaataagaagtctactctttatttaaattcaaattccagagagttaagtaactttccaggaggtaatctaaatatggcctccttgttggggggggggggggtgtttgaatttgcatataaatagtctcacccttaaaggaaaaccacagatggtggtaatgatgtagtcataatgtacatctccacagtggtggaacaaaatatccacagttttgctttccccagtttcagtgacccatggtcaactgctgtctgaaaataggtgactacaatacaataagatattttaagagagagaaagaaagatcacattcacatgattttcattacaatgtattgttataattgttctatttttattcatgatttttaatctcttaactgcgccaaatttataaattaaaatttatcacaagtacatatagtttatatagggctcagtactatctgcagtttcagacatccactgggagtcttggaatgtatcccctacagataaggggtaaaccactgtatcctatttgtgtgaatgctacaggtgttgtgagctcataacaatatgacatcaacactgaactaatccaggatttggtagtgagagtgatgtatttgcaaggagtgagacgtggtgcctcatccaagcagagaaataattttgaaatttgcctgacaataaaaatcacaatgtgaggtctctctttagagctgcaaagtccaattcagtgccccctagccacataagatactgagctcttaaaatgcggctagtactaattgagatgggcactgagtataacacacatgccagggtttgaatacttagaaccaaaaaggaagtaaatgctcatttattgcatgttaaaattatggttttattatagttgattaaataaaatatataattaaattgacttcattttgcttttaaaaatgtggctatgaaaaatttcaaattatatatgtgtgtgattacatatgtgtgttttcacatatgtaactgatgttacatgtgaaattgattgttacatgtgacatgtaaaacacgttacctaacacgtgcatatgtatgcaacacatatgtaacgtgttacatatataacacgttacatatgtattgttacatgtgtgcttgcattacacacatgcataatatgaaattacatgtaatttcaaattacatgtgtatattttgaaaattacaaattacgtattttgttatttttgctttacaaagtcaaatttaccctatttaataaagcatcatgagttttttataactagtaaactttgagacttttgtaggagaataaataatgcttattataaaaactgattggaaaagtgagctggagcagggagcggaggaaaaaggactagagatcacctttcttcccagctccgctcctctcccaaccttttttctttccattctctcatcccaattcaaaagtgcagagttcacagttggtgtgctgatttagaaaacagatatataaacagccttaaattttctccaggcttttacaatgaaaagaagttcaatatcaaaagtaacaatataatctgtggaaaggtatagggggctatgtttttgaggtagaaactataggtgctcctggccaagcatggtggttcaagcctgtaatcccagcactttgggaagctggggcgagagtattgcttgagcccagaagtttgagtctagcctggcctacagggtgaaactccacctctactaaaaatacacacacacacacacacacacacacacacacacacacacacacacaaaagccttgcgtggtggcgcttgctgatagtcccagctactcaggaggctgaggcgggaagattgcttgaacctgggagacagaggttgcagtgagctgagatagcaccactgcactccgacctgggtgacagagtaagactgtctcaaaaaaaaaagaaaagaaagaaagtataggcactccttatatgcagctgctcacacccctcctccttcacacccctcccccttcacacccctcccccttccccaaaatttgcaaggggaaaaatgtgtgtaattggcagtatttagtggcgtgcaaccgtgagtcatcagactgcacatcctcacttctgctagtggctcagtacccaacagcactcagtgaaaactaactcatttcaaaggtgaaaacaagtgagtttggccaccagggagtgttcaaaactgtcagtgctgaagcaaatgtggagggtgttctgtagtttgttcaggttgatatttgtggtccaacccctagctgaactactaattattaatatctgtcttgatggtgcctcaggagaaagcttctcaaagggaatcaatgttcaaattatagtaggtatcttggccatggaagttattgaattttagccaatacttgctactctttcatttatagtgtgagaatgcagtgtaatgaacctgactctcactgtcctgacttgcctttctcatcgcattcacaataagcacgtcaatacgtatacacatttcatatttctaaagtttactttatttccttattgtacatcgctgtgctgctgatggaagagaaaaggaaaaacactattgattgcaaaactgttttatctttggtggcttagattttttttgtatgatatgtaacgtcttgcatacctaaggcaacacgaagctaaatagatttgcatatagcatgtattttttccaattaaatgtttaattttgttcagagtatactggggacattttgaataatggagaaaagtacaaagaaaattcataattctaccacctatcagcacagtgaaattttatgaagaaacataattttcatgtaaatcatagtgaactcacggtaggttttatttaatacagtaattggagagctggtaggaagacaaaactggttcaaaagagaatacaagaaacaaatgcttctataatgagtgaatttttaaaaaagtattctggaataagattagtgaataagatactaaactcgttgataccctacagcctttggggttatatcctctactgggtaaaaagtcatttacatcatatcagttttctaaaatttgcattgaacttcatagcgttgtaacatgtgtgggcccaaattaatagtaaacagtaagagttgctttactctgaaaatattgaagctcttgtgagggtgtgaggagtttgttagaaaacaacgctaccattattttgaaacacacacgatcatcttttgttttacttctaagttttggataatttttcttaaattatcttattatcttatccattttcttaatttccttaaccttttaaatgtttctcctaggcacttttattgatttttggaatatagttgatatgtgctgaatttttatcatccagttttaattctactgaaaaatctaaaagatgttcatcaactactatatttcaaatgcatacatcccctttcatgctaaagaaactgtatgggaaacacagtctgacattttcaggacctggtatcattaaaagtcttgacactgttaaaattaaacaacgccttttttaaaatcaaaggatacaaaagggctgtgttggtcagaggatacaaaatttcagttagataggagacataagttcatgagatcttttgtacgacatagtgactataattaataataatatgttttcgaaaattactaagagagtcgattttaagtgttctcaccgcaaaaaaatagtatgtgaggtaatgcatatgttaattagctcattttagctagtccacatttttcaatacaatgtgttgtataatacgtgatatatacaacttatattttccaattccaataagtaaaaataaatgtaaattatttgaaataaataaaatgtgaagaacatccacttttcatatgaaaccatgagatattttctgttaaaagattaaatgtccaataaatttttgatgttaacagaaacaaaaatgtttaatatttaaatacatatttgcatgctattgaccccctgaagttcactgctgggctaagtgaaccaactatatcttaagtcaaaaatgctgaaattcttccccaaatcccaaagctcatgaaaacataaacagaaaatttccaaataattctacagggaaaataagacacactatttgatctgatcaaacaacgggatgattatggttaataatgagttacttgtacatttaaaaataactaaaggagtgtgattggattgtttgtaacacaaaggagaaatgcttgaagggatggataccccgttctccatgatgtgattattacccattgcctgcctgtgtcaaaacatctcatgtaccctacaaatatatactcctacgatgtacccacaaaaattaaaataaaaaagagagggacccgaagataagctaatatttaagctcatcatacttattaagataagcaatacataccgaaagtaatagcatttaaaaccagatgttgggggagggttctaacttgttcattaaaattcaaagtcacctgtcttgttttttcttttgtttttgtttttttttttttttttttgagatggagtctcgctctgtcaccccaggctggagtacagtggcgcgatcttggctcactgcaagctctgcctcccgggtttacgccattctcctgcctcagcctcccgagtagctggtactacaggcgctggctaccacgccccgctaatttttttgtatttttagtagagacggggtttcaccgtgttagccaggatggtctcgatctcctgacctcgtgatctgcccaccttggcctcccaaagtgctgggattacaggcgtgagccaccgtgccaggccacctgtcttgttttatcatgatcccgagagtatatatgtatgtgtacagctcatctaaaccctttttctttcaacatgatcaatagattgaacattggagatattttataagaaataatgaagacaactcaatcagcacatatatatattaaatgtggaatctataatgattgcgaagcctgaagcaaactaaatattcagtaataggttctttttttccatggtatatccatttgaatatataacataaatgccttacatttgttttaactatttaaggtttatgttgttagtgtgatgaaatggctggcaaaagtcagaaactcaggaaagtttcaggcttatatctggagcctggttttctttcttcaaggtagaacctctgtgaagtgaaaaattttttttatatctggagcaataatgtagaagcttaaatgtattatccaagttgtcataagcctattatttctttacattactgaagtgaaagacagcattaatggctaaatgccatacttggctataatttatattgtttaggactggaaatgagcctgaaatgtacatttttttccaaaatagttcatgtaatatttgaaacctgacaagtaacctgatgatttcatggaataccatcaaatataaatgtgaagttttaaagacacagggaaatactcagaataaaccccctaaccacaggccagcagaagaactagacttgagaaaatgaatgggaagatagatagtaacaaatgacttctttggcagccttatatatgcttagtcttatagactgttttatggatgctctgcactctatttccagcaagtatggcatttggaacaggaccacacgagacaaactatgagttcacatttcccacaactgcacagatagaaagagggaacaacagaatactccctttcttcttgaaacaataacttctgttgaagctcactggcttcttttcagctgtttctgctagctcctcctccgcctcttgacctctaaggcaatgctcttcaaaatttcaagactgctttctaattgaaacaaaacttataagcacatttcttcccacaaaatgtacatttatttgtaaatcatatatgaatatgactaagcatgtaaacgtatgtgaaaatagaaatcaataaatataaatgcaaacacaaatagaagcattcacagttttcttttgtgtcccagtgagttgttccaaattcctcggaggtaggtatgtcacagtttgagactataccttcaatcctagggtttctggtttcgctctcctcctaggtgatagcatccatttctacggacttaactgccatctttagttgaataactcctctatctttccatcccatatttctcttgattccaaacctgcttgttcacctgagcatatgacacaattcattggctgccgcacatgcagctttgacattttatttaaaatctttccccttccccagccctcatctatttcacagtagtatcttcttcttatctacttgattggtaagcagagtccacatgattccatcatttatctcccattttatatctaatctataagcaagtaatgcaatgcaacttctgtctccaaaaatttattttgaatttgccttctcttcctctgcatctcccccatcttaggccaggtcacctctgccctcttgccagattaggtcacattctcttactactgttgttattctcttcctattcaatcctacaccgcagcaaaatggatcttctcaaaatgtcagctagataaaggcatttctgtgcttaaggccctcatggatttatcttattaggatgaacacccaactctttattatggcttagaatacaatgaattacaacacataatgaatatattatatttctatctttaccattttcttcttaagtcaacctttctcaatccatataggataatcatattagtgcttcctcactttctaaaacatctcagggcctttgcacgtgtttctctgttcttagacccagaatgctcttccttttctctttgtgtagctaggtgcttctttccatttacgtatcacatgaaatgcagtcattccctcctccttccctcactacctcacaaaaagttgatgcctctgttaaaccatgaatggaattttactcggcagtgaatagaggaaaaaccaatggtaaaagcaaccatatgaatgaatgaatgtcaaaaatattatgctgagccaaaagtcatagacacaaatatgggtatttacatgaagttaaagcacagcaaaactcaattacggtaatagaattaagaaagtggttacctctgggtgagggttggaattgagtggacagaggcattagtgactttttcggggtaatggaaatgttgtctattttgttcaggtggtgaatacatagatacattcaattgtcaaaacacatccatccaaacacttagacttttgcactttattatatgcaaattatgcctcaactgaaaaaagtttgttttcaaaattatatcaacagttgaaattcttttaaagatttgattcaaatgagattaattctgtatccatcattgatgtatgatagttttgtatgtagttaaggttattggagataattgaaagttatactcacaagaaggctgcataatatgaagtttatctgccttgatctttaatagctttcgcgatttcaacttcttcacagctctgtaagaaggcagtgtggcatgttgaagcaagcatgtgttttagagtaacacagagctggtatacaaccccatgtctaccaattatcaatgatgtgggtatgttgctggatctcaataatcttccactgtgaaatggaatgtaacacctgactcacaacgcaaaggtatttaccttatgtaatataattcctgcgatcctgggacctcccttaatcccatccacagatgccaggttaaagaccccatcacagactagaacaagttgggatgtcaaaatgaataaatattaatcgaagggcctattgtgattgaacaccacgcagtaggcactctctaatacctaccgtctccctcctttttgggggaaacattctaaatgtgcaaaaaataaagggttatttgctttctggcacttgggatcgatttattgaggatatgttagcagaacagcaaaggtgaaacactaaaagcaccatcaatacacaggcagaggtgaagccataaagcctttattttttaaattaatgcacaatatataagaggtatgttagaatgaacgtccaatccctgaaaggatatacgaaagacattcataaaattacatgggcatgttttcttaatgttcaaaatattgttttaattagtgtattatgagtttattcatgtgtctgtgtgttgtgttatattaatcttttcttgcattgctataaagaaatacctgagactgggtaatggatgagaaaagacacttacttggctcacagttctgcaggctgtaccggaagcatagcagcatctccttctgtggaggcttcgggaagcttccagtcgtggcagaaggcagaacgggagcaggcacttcacctggctagagcaggagcaagagagacagaatgaagtaccacacacgtgtaaacagccagatctcagagaactcactcatcatcatgaggatggcaccaagaggatggtgttaaaccattcatgagaaatccacacacatgatccagtcacctcccaccaggccccacctccaacactgggaattacatttcaagatgagatttgggcggggacacatatccaaatgatatccatgtttaatcagaaaaataaaagttaacagtaacagtgattttactttgtagacctttgctaatggctgaaatctagctccattccgagaacagcctgcggtacacattttgaaagatagttgattaatatgaaagaagccttatctgtagtccttaaggccattatggtttacatatatgagtaaatattccaaagtagccatgccagttaacatatatccagagtctaaaggccactgggcgacaaaagtaaaagatacatagcaattgttactttatatcacagtaattcttgtatattttaaatggatatttgcatttgaggatatccacttaagagttaggtacatggctcttacatttaagtaacatttacttaaatttctggctgcagcaattccacataggtagaaatgaagtctgaattgagttgggggtctttgcagtgctctctctgttcattggctattttgacaatgctgagagatgtggttagccattctttttcatttcatattggcaacctagagagcaattaagccttctccccttaactagatgtatgttttactcatttctggatctttatggctgactttgaatcctagcctgtggtagaaagcatggtgtcagaaggaactatgagttaagactatgcatacttggctttgagtcttgggtatcatacctccctcatagagtgaaggaaccagggattcttcttgaggcccagacccggcatccatgttaagaatacctgtgcaattttgcttcctgatatttaaggtgaaaatgcatgtttgggtcattgtgaggattatgtgagatgttacttttaaatataggcccccttattatatgctctcatagtttcaggcaacacttgtcgtatttgtaacctcagttttaactgtaatgtttccatcaatgtccctcttacctggtacaggggctcttcatattcttggattacaaatctgtgaatgcaaccatgcatcaaaaatattcagaaaaacaatgaatgcctacctctgtactgatgatttataggtgtttttcttgtcattattccctaaacagtacaatgtaataagtatttatatagcatttacattgtattaagtattataagtaatctagagatgttttaaagtatataggaggatgtgtgtaggttgtatggaaatagtatgtcattttatatgtcacttgaacatttgtggatttgctatccgtggggatcctggaaccaatcccccatggatactgagggacaattgtattataagcagcaagagggaaaggaatctgtctattttgcccaaaatcgtgttcccgggacctagcatagctcctggcaaagagtatacaacaaatatgcattgaggagagaacagagggaaccattatccccttattctcgctgttccttcatgtaatgaataaacagtcaaatcttacaagagattttaaaccagtcagagaaaagttggaagttagttagttgttcatacattgagaagcctcgacgctgtgtcatctaggtaatgaaagatctagggaagtttagcagggagaagaagagagatgatagttgtcttcaaatgtttgaaggactgttacggacacaaaaatttaaacttgtgctgaataattccaagaggtacacagtctctcgatagaagctaaagtggggggtgacatttgactcaacaaaaagccatctaaatatcagaactttcaaaagcaggaactggtgcctcaattaatagtgtgttttctagcacttatgatacctgatcataggcaagataatgaaaaattgggacctgggagttatacatgggaatttgtttatcagttgggtgattaggagaggtggccttaaagtcctgttgtgttctaagagtctgtgattctgagtcttatttcccaacaagagaggtacagagcagaagatgggattgggagaaataggataaagataccaggaaatcctaaaggtaagaaaaggaaggcagacctgaagctaactctatacttcaggtgcttgcctagagccagccctacctacttagagaatgttgaagagccagttaaaacatctttaacacggatgtaaaacaaaactatcaaaacctgaagatttcgaatgttctaacctactcgtcagttgggcttttttcacaaatacttcagtaaataggcataaatttattttttaatgatagaaaatatctcttaaagaacttataactgtggataaaagcaccaccataaaaatcttgtggtgaaatatatatatatatatatatatatatatatatataaaattttaaatatggttagctagaatatgacgacaatgtttatgaaacacagagactcttgacaagtcccatgtatacactataaaactttaagttatccactattcactcactaagcttatacttaatgagtgtctgctgtgtcacttattgcggaaggcacaggcggtatagcattgcacaaaacatatgtggtctctgatggagtttttcagtctagtggtgaaagcagtgaatgggtgtacagatgttaaataattgtacaattagttgcatgtgtaaacgtcaaagttcagaagatgacaattgatctacggcaatgtttctcaatctctgacgttttgagccaaatacatctttgttgtggtggactgccctgtccactataggatgtttggcatcacaactgacctctgcccattagatgccaatagtactctcttctttaatcacaaatttgtcccagacatttccaaatgtcccttggggagcaaaatcatccctagttgaaaatcactggtctagggggaggtctttatgaggaagtaacatctaagaaagctggtatgtttacatatagctacagtctattacacatgtatacatatgtaacaagcctgcatgttgtgcacatgtaccctagaacttaaagtataataaaaaaaatgtaacaaaacaatacagtatgataagtgctatgggaccaaagatgaaagggttctactgcacagttatgaactcatagttaggcttttggggtcaaaattttgctgaagatatttgccacccacgtgacctttggcaggtgacttagcttattcatgcctcagttttatccaatgtgaaatggggctggaaagtcccatgtacttcctaataactttgcggaaataatatgtggttatataggaaaaaaaaaaaaatcctagaagtatgcctgctgcgtagtaaaaggaaggagaaggataaagagaaatctgcattttttcttctgtaatggggcagatagtaaatattttaagttttgtggcccaaatagtctctgtcacatttacttgattctgcagttgtggcattggaagcagctatggacaatacttaaattagtaggtgtgcctgtgctttcaataaaattttataaatacaaagtttgcaaaacaaagttgttttttttttttttgtagtttgctgacaccctagtaaagaagcaccattgtcaacgttaaaaattatcaaatttttatttttcaaagttttcaaatttgctttgcttggtctagctcatgaaataagtcaaaagtagcaagacctccacctctaaaataataatagtaatgataacctcaaaaggaaagaagaaatatttttaaagaagaaaaattattgttaaataggattattgtgcagagaaaacctaggagactcaattttaaaatctgtgaaataattttaaaaatactttatgaatagatacataatagcttttattcatattaatgactataaatgcaaatggaaatatttcattcacactgatgacaatgtataaattaaggaggaataaaaattgtagaccctataggtgaaaagcataaaaatatacataagaaaaagcaaaaattgactacgtaggattgttttaggatttaagatttattgtcattaaacttgcaataccagccaagttaacatttgaatttaatacagttataatcagaatgcttttgatgtgtttgggggcaatataatttcaaaggaaataggcaatgatgtaatttaaagtttatatagaaggaaattgtgtgcgtgtatgtgtgtgtataaattggaaacaattttattaataagcatattatggcagcaacatacacttccagatttctactatactttgaagtaattgtgatcaaaaccacagtgtgctggcataaggctagagaaatgggttagtggtttacaagtgagagtccaggaaaacatccaaataagattggatattttagttctgtgtggatagcctatttcacttaataaatagtgtctcgtaattgactattcatgtacctataagtttaactatagaccaaaaaaacgccctactagattaaggagctaactagaaatataaattcatataaacaataaaggaaagtgtaggactttataagcttcatgggagacagatttttggtaagtcaggaagcctggaagacttaaaacataaaattggcagactgaattaactgatagtttaaagcttccatagagcaaaataaatcataaaccaagttttaaaatatataatggatttagagaaggtatttacaaaaatatatgactaatggaggttaataataacaatatgtaagaaggatatgaaatggcattttactataaaggtcaaacaaatgacctataagcataataaatcatattaatctccactagtaataactacacacatctacataatatagatgttacgcctgcatttgatttactttatctgtcttttggcagaactatttgtcaccagataaaaaattctatatcattaccagaaaggtatattattataatgtttattatgttgcagttgtaaaagaaataacagcttttcaattgtttacaaatcctatagaacatttactgaaatacatttacattttgtggcaaacttggatttaaataccgtgttcgtgctttgttttatgccgttttcccatcttttctccaggaatttgattgtgcttcattgaaagctaaaaagaaaaaaaaaataattctggttttggtttaaaaaattaggttaggggttaaaaagttgtacgttgtcttctgtaaaaataaaaaacaagttttctttgtttcttggaggctttatattaaatggatttttaattcatagacagcatattgtgatgaaatttccccatgagcttcacattttgtttcaatagcagaaactaacttggttgcagttactgcccttctgagaacagtgttctggaataattttgacatacatatgtatctctttttaaaacatgtgttaatcttttcataaagaaagttttcccagctgtgtcacctgtgactccaactttctggggggacagggatatgagatgttggaagggaatggcttgaagaaataaagtgcaaaagacgtaatgctttcctgtggtagaaatgtattcagtgaccctgaatgaccttcctactcttgtcccttcatttttcccacaagtatggtctgggcaattataaaaattgacatttgcagtgggctcttctgtaaaagatgctcaatcagaaatgatttattttagaaaaagagatgatataaacatatatatcccctgtctcggaagtgtgaaggttgaaaagcaaggagatgatcttcaaagtgtctaaaatattgatttgtaacatcgttttatgaaagtgcttcagattattttttttcttggatggccccttatgctttggtcagttgatgctaaaatctgaacttctttattttaaaaaaaacttttaattttgaaaaaggaagttcacggtgctgtctaattctttttagatagtcattaatgtaaatgtaagagtcattctgagaaccacatctgctgatatgttccgttaaattacaagttctatgtgtatttgctttgctttcatacaatgaatcttctttactctcttccccacctgccagaaattgccccactcaacgttcataaaaggtccattttcaatcgctatatttatttcagaagcagagatatcatatattcaaattttagttactttccaatatcaagctaataactcacacaaataaatcaaactacagcaaaacagcaatctagcattcaacaaaacctccccaatgcacatatttcaagctgtagatatgtatcatccaccatgctgaaataatgtacatgttcaaatcaaatggaaaactagaatcaaaattgttgattacttcttatcagggcattttattatatttaagaaaaatacaaattaaatcattttcaggaagcaatccttctggctaagatttttttagcataatgcttaaagttaattgttgatctttatctataaattcaaaggtggactaaaaatgcagaatcaatcaggtagtccattttgcatcaggtgaaatatataaagcataaaacagcgagttacatttcctaacaaaattgaattacagtgagtaaaagtgacaggacaaatgcattaagaaaagatggactgaaatggatagagtagaatatatgcatctataaaacacagtcatatataatacactcattttttttcttacgagtgtgagattaatggaagaaaacaacaataataacaaaaccagtgtgatgtgtcagatttcaccttttaattaaaaaattattcacttcagaggggaattttctttcttgggttagctcaatcatgtcagatcttgttcatttaaaaggtcagtttacttgccttctgaggtttttgtttgggaaaaagaaaagaaaatagattttcattggtatcctgggtagaattaattgtttatcattcatttttaagatctccgagaggcagaaaaaggggaactgtgcaacccttttgtccttctggatctcaaaatgaagggatacattctgctacatgaaatgtggaattaagaccatgatgcaacatgataaacaacacaaatttgggggtgtctctgtgctatacattattgaatttttccatgctatacactttttggatgtgtctgtgctatttattcagtttttttaaataaaagtttttgtagactaaattgccctctctactttgcatcgtttttgaacaaaggattttcaagactgataagctcaaatgtatcatttattgtattcaagtagcattcaatttttctttagaagtataatttgtagatattttaacacagaaaacttgcaacactgctcatgataggcacttattatatattttttgaaagactatatggataatgattctaactttgacttttcctgttttgccttcactttagaattaagcagagaatcaaatccatattcctgggggcgatgcttggacaacagtatctctttaaagatctttgtgtgagtcgaaggtgcagccagactgggagttattgtgaagaaacagattcaggaaggttgagaaacttgcctaaggctaatcagatagttactggcaatgttgtttctaaatcactgtttggctccctcattcaatgaatctacactatgtgggactgcctcttgctcctgacatcttttgctgctgaaataaatgaactcaaagcctagaaggtagaaaagagggagttcagaattatattcaggcacaaataccaataaggctattgcccccagaactgcaacttctcttggtttaacagataactatttagctgtgaggtacaactgaggaagtggacacacaagttatcaggagattctgatgtgccagtttatatttcttgtcacaggtaatgattcgaaatttcttaaaacagctgtcctcacagtggagtaacctgggagtacatgaaggcattccaaggagtaggcacagatagttttaagggaatttatttctagatcttctactttattttgtactcttcctgaaaactgaattgcctgaaaaaaaaaaaaaaaaaaaaaagacatctgtagtcaagacctcaggctgtttctcctttctaaccacttgccttttctaaccacttctcccaatttaagaaaaaaagccttatatttcatccaactctgatcttactaaggcttcaaacaaaagaagcatgaatgactttcatgacagggcaacatagctttttgcaagaagagtggttgctaactctttgctttcaactgaacccgaagagaagacctgataagttgtcagccgatagatcattaaaaatacgttttggtaagcaatcatcatgtacttttagcatatgccatagcaggagcacaaatgattaagcaatgctactataatacaattccttccgtttctttctactcacctatttgaataagatttttcatcatttacatctatacagacaaaaattagggatagaattgatgctgaagcctttccaattgtagaattaatttatattcttctgaaggtgtataaattgttaaatacccatccatcttattaagagatgtattttcaataaaattttatttttatgtttatcaaattttataatatacatatattgttttggtcaattgcacgttaataattgtaacaatacctcaattgaaaaggtttgttttttacatttaggacttacagtaacagaaaaaaaacactcattgtgtatacatactgtttaagaaaagtatactaggtgatcaataagattttttcaggcataaacatatatcttagttttaagatatcgatatttacaatgtccctcaaattatattattttcagtcatttaagaatgaaaagtacatttcgaatgcggattttaaatctgcaagggttgactcatttttcaagagtctttttaggggatacagaagcaagaatgtttggagttccctgatcagtatctttaagagaaggtatttgttggtagttcctagcaaattccaacagcctgatgctacttaaaagataatagtaattattttaaataatgcttctgataaaaaacattcatgcacactcagtttaaaaagatatttaaacatttgtagttgtagtttgggaactcatgatacaagtacagtctgtaaatgaagctcttagtttgcaaatatcagagataagctattaaaatgcagaaattgaaattgccctgatatatgcataaattagtgtcatctccatcttgtcagttagagtattttttagattctctctatgtatacatacatatatatatatatatatttatatatatatatatatttgtgtagctgtgcatgtgtgtatttggactaatgggtcaaaggacagtactaacccaattcaataattaaagaaaacataattttgagaattagctttatggtaattgtttgacttaaatgagtagatcagagaagaataagggctttcccttatttaaacaagcttcatttttttatccaaacatttacttagctgattaagcttcacttgtttattttcttcaaagcattcattcaggtgggtactgagtaaactgaaatatcacaccagggaacttcaacaccatccaagtcttaaaggcttcacttgttcacagttggcatttagtgaatgtctaggctactgataatattgtgagtaagttggcagggatcataagaaatgataaaatacagttcttgaaaatgttatggtttgaggaaaagatctatgtttggaattagactgacttggattcaaactctggctgtacctttgggacaaggtgttcagaaactctagcctatgttttttttctgcaaaatgatcctcttttccaggattcctgtagagattcaaagatatgtgaatgtttagaaaaagaatagacttttgatcattgttaattcccttactttccccaattagacttgtaagactgggaagaaagctacacaaaagattgaacaaattatagctgacagaccatagcaaaagatacagggcaaaacttaaaggggaaaactacacattaaattattttaaaccattaaatagcactaacttttgtcagatattacaaccaaacaccactcaaattaaagtaaactgaataaaatgcctgtttttttctgtttactgatgttttcatttgcttcattcatttattggaagatataaaatgtgttagacactgttaggtgctgagtgtataaaaaaatcttattaatacaatttaaacacgcacacacatatatatggttataacaattgatgccatgtatgtactgtttatatgcctatacattattccacagacctggggggagggggatgtagagtcttaccagaaccataggaatcttctcacatcaacatttccttttgaagtttgttcatgaggcaccatccagataatactaccatctgcaatgtggcttgagaagatgttagatttttttattacacataataaggctgtaaagtatttctgtatttaggtagaggtatgtaatacaatatgtatataaaattacatatccaataaaatctggtgttaaataaggactagcttctatgataatatagtctaaaggcttttcatttggtgttatagaaattatgtgaaatatgtttcctggagtagaattattcgcatttcagctctctgacagtggaagaaaagctagagggagaggtgaacaagagagggagcataatggacaaagctttgctggaagccaaaccaccacttcatatgtcaaatctgacaggcctcccattttaggtgtgctgtcattgaagctttcagctgcaccttgcctgtggctaggctattttcaaagattaaaatgcgaaactggaaattaaatgcaacttaattcccaatttaaatttccattatttttgaaaagtaaaagattaaaagaaatgtataattgcaattctggtggaagaggtaattataggaaaggtgggatgtatttcaagtgggggatatagcttactgcagcagagaggaatctaagctatcattcttttgaaattggtctggaaatatgttttcacatggaaaatatactatatttttaggaatttccttgtcatattactgtatccttttctgttagaatataaattctgaattccctattccactgtagatctgcctccgattatattagctcttctgaagttatcaaaaaataatgagatatacaatattccatatatgtcaaagcaattatttttaggttaagtaataaaccaatgacctttaacccggtaatattctgggttgttcataaaaaaactatattcaggtaataatgtctttccacttaagcaactgaaaaaatacacaatacttaacatttggttaattaaatacctactccagacaaaaggattttctgttttcaagttatcttagcaagctgagcaggaagcaatgatatatccaatcagaatatccatggaagctctgctacagtttcaaaaagttctcatcaggcagcttttaaaatgcctactctgaaaatggtccaggttaaagaacaacagcttcctcgtcagatagcagtattgcttggccatgtttcttcctagcacaaaaaagtacctgctcttctctgagtacctacattctaaggactatggcttacataaaacagcatgggttggggcaatttccagcacactgctcactctcgaaaacgtatgatgcaggtgagagtaatgtttttgtttgaatctgctttcactcgtggaagatgaaactacttgcaaagatctgtactttagctattatgagtaacaaaagactcctaaaatattgcacacattgtggggatggagaaccatcatcctgggatttgatggatcctatggtttggctttgtgtccccacccaaatctcattttgaattgtaatccccacaatccccacatgtcaagggagagagaccaggtggaggtaactgaatcatgggagcaatttctcccatgctgttctcctgatagtgagtgagttctcacaagatctgattgttttataaggggctcttcctgcttcactgggcacttcttcctgccacctgtgaagaaggtggcttgctccttctcaccttatgccacgatggtaagtttcctgaggcctccccagccatgctgaactgtgtgtcaattaaacctctttcttttataaattacccagtctcaggcagttctttatagcagtatgaaaatggactaatagagacgtgtctctcagaagtcacagtgatgcttgaacggatccagagctccttcttcaggaaggtcccaactcattctgaagggtctctccaagcccacctctctctgtaaatgggaaaggttttactttgagcactaaaacctgccagaattctcaattttcctaacagtgtgttaataaacacctactcatttagtatccaaaccaggtctgtatttctcaattagagctcaccaggctttcatcataaagtagagcttcaaattgtctgcaatcccactcctatcaaaaacctagaaggaggtaatatttcagagtaatactataaccagatgaccacatctaagaaactgctgaccctacgatgtaaccttctgtccatttttccctttggaaagtctaggatcttttcttataccagcaagttacaagcctggactacactaacttgctttccgcagaagaaaacaccatgagttctgttttcatattaagcacttagtctccatcagacatcaatcgagaaaaaatcattaaaaatcacattttatatttgatgtatatttctcaataatcctatgtattagttcattttcctactgctatgaagaaatacccaagactgggtaatttataagtaaaaagaggcttaatggactcacagtctcacatgactagggaggcctcacaatcatggtggaaggtgaaggggtagcaaaggcatggcttacatggtggcaggcaagagcgtgtgcaggaaaattgccctttataaaaccatcagatctcctgagacttattcactgccataaggacagcacaagtatttagctccctcagcacagaaccatccccgtgattcaattacctcccaccaggtcactcccatgacacatggggattatgggagctacaattcaagatgagatttggatggggacacagccaaaccatatcatcctatttggatgatcaatattatcaaggtatgctcccctgagggggcgtcctttttaccatttaactccaggacaaaagtttatttctttgtaaggacagtgtttatttcttatggtcctattttctcctaagatccagacaccaaaatggccatctatcattgacttaactcctgaattttgcttagagtaacagatttagtgaatctaaatattttctggctgtggaatgttaatttatacatgttcaagttacctttgattcatgtgacagtttgtgccaaaacacactcattatcagaactcagatcattatgttggctcttgttttcgttactaaaggaagaaaaacagtttctcaaaaagaaaattctgatacctaggaagaccattatacctcactcttttctttatctcatcaccacatccaatattataaaagaacttacaaagtaaaaagaaaggtgttctgtagatgtagcgcctggcttgtatggtagcttaaatgaacacagctaaaaatattttatggctagtgtccaaaacagtctggcaccagacaaaataagaatatttaaaattatattttagagttactttaagaggaagggagagagagatgtaggcaggaggaggaggagcaggaggagagggagagagagagagagagagagagagagagagagagagagagaatctggggtttctatggaagggctaagaatatgtagaaaacagtttacaaagaaatatggtccaagaatcgtgtgtacacacacacacacacacacacacacacacacaccccctggaatatttttcagccttaaaaagaagaagatctgtcatttgtcccaacatggatggacctggaggaccttatgctaaatgaaataagccagaccaagaaagaaaaatattgtatgatctcacttatatatggaatctttttttaaaaaaggtcaaatatatacagatagtgaattaaacagtggttaccagggtcagggtagttgtgaggaaatggggcaatgtaggtcataggatacaaatgattaaaatatattaatatattaaaagatataatatacatcatgaggactacagttaataatagtgtgtattcaagatttttgataaatgaatagattatagctgttcttgccacagagtgaaaaatgggtaactgtgaaatgatagatatgataatgttctccacaatggtaactattttacactatatatataaatatctatgcatcttacaccattatgtggtatcccttaaatatatacaataaaatttattttacaaacacatattaggaatgcatattctgatttttaacaatagttaacctcattaatatatttcacactatcatttctagtgtacatgaaaagtagtttattgacattagttgtaaaaaaaaaaaaaatggtcttgagacttttgggtcagagaatgttctggccataaggtaggtttctgcttgcctactagatatcttaacttcgatttcctgaacatcccatcacttcagaatctctcaatcctttctaacatccgcaacattgtttttctttctgcatttcttatattgactgatggatttataattcactttctctgaaaaaccctgcagttatcatatatccctatccattctggctctttattgcccaaatctctaccaaaatcctgtcagcacagcctctgaaatatttctcaaagcatttataatctggctctcatcaacattttcaacactctgttttatcattccactattttacatcatttcattttcatttttaccacaatcactcatccaacaaataagtatttagctccctcagtaattagtattattattattaattataactagatgctgagcatacagaagtgaacatgacagacataatcccagcagggatgtcagactttatgcaagtaatcaaccatgatgaatctcatgagattctgagagagagagagagagattgagagagagagagaaaggggaaccactggtgtccgagttagaaatttgaattagtatctgggtcaccaaaagcttctgtgaagaagtgatatagacttggccacacaaaactaccgtgaaggtggtggaaatttttctatgcagagtaccacatttaaagagctaagcctgagagtgtcagagataaaggaacagaaagaatgtgacagcagattatgtttggaagaaagatgttcaagagaccaagctaaagaggagatggggctagaacctggagggtccttcgggtcctgttgggagttttttctctgcccagaagggctttgtcacgtggttgtcaggaaagagtcatgattagagctttgattcagagacttctttcgctgaagtgtggagaatggttcagagagaagcaaatctgaatggacaaaagaggttattattgtaatcttggcaagaagcgatggtggtcttgactaaaatagttctagtgagaatgtgacaacaaacctgagaaaaatacaggagacgtaattgacgggggttagtgttaagttgaacgattgcagagttgaatttgaggaaagtgtcatatatcattcccagtttctgatgtcatacacctctggagataacactgccatttcttttgaaatgggaaaataataagtgatcagtaagtacgtattggataaaataatgaatggttaaatgcataaggggagaggaaaagagttgcagagaaagagagtaaacgtattttggatgtgttaattttgagatacctttgaaaaatccaagtgaggggttgggtagtcagagaaatgaatgtggatgtcaggacgaaaggtgaccgtgatgaactgtatgtcttcctctaagcacgttatacagcttcatgtcacaagtgactcacttcatgtcacaagtgactcacaaggtcacttgtgacaagcatttgcctggtgcttcatccctaacctccctttctatactcagctaaaatgtcacctacaatacttcttccttgactccaccgtccccactttactgatatgaatacattttaataaaatgatataataatgcttagtttgtaaacctaatgttcctcaagtggtataattatctgatttgtatgtgatcatcaacccaaccatattaggagcaccttgaaggtagaagatttaggttcatgcttaacaccacatctggaccactgtggatttaactttctacaatgattgtattcattaatatattgggtgcccactatattccaagtaatatcctgcacactacgtacaaggaagcataggtcccgtgtgctcatgaaactgtaattttagtaagcagggataggatacaaactgagaaaggaaaacaatttagaaagtgggaaatattatgcacagaattaataaaaaagagaaaaatcttgaaaaagtcttcaatacctcacttggaaggtgattttgaagaagaactgatggacaaactagagtcagccatgtaatgatgtaggggcaaagcattccgggcacaagggacagcttatgcaaagaccttaaaaatgaactagctttgtatgttggagaaggataaagagaactaaggtatctataaggtaattaggaagaggatgagttatttagtcccttagtctttgaagcacattatctcatacttcaattgagtttattcttagtgtcattcttctggatgcaatatttgagataaatgtcttaatgaacgttcacctccctccgtagtaatgcctgagtgtcacaaaaactttttttgtttacatacgtagccatctaatggaaacataaaataggaatcaaaagttgagtttcatgtacaaaaggtaaggactgtacatgtggtcataacaacttcaaaagcacctgaaggtaacctttaaggaagatacaaaggctaggaaatatctaggatccatgaagacagacttacttaaggtcatagtgtgtccagagttggttcccgccggtgggttcgtggtctcgctgacttcaagaacgaagccacggacctctgcggtgactgttacagctcttaaaggtggcacgaacccaaacagcgagcagcagcaagatttattgtgaagagcaaaagaacaaagcttccacaacgtggaaggggacccaagcaggttgccgctgctggcttgggtggccagcttttattcccttactgtcccctcccatgttccatttctgtcctatcagagtgcccttttttcaatcctccccacgattggctacttttagaatcctactgattggtgcattttacagagcgctgattggtgcgttttacaatcctcttgtaagacgggaaggttcctgattggtgcgttttacaatcctcttgtaagacagaaaagttccccaagtccccactcgacccagaaagtccagctggcctcacctctcaatagcattaagaatatagtttcacgagcatatatgaatcaaaacttacatttgccaattttatttgcttgtttatgtgtttccaacatgtcttgtcttagggccaaatgtttccctagagaataactattccaactatcttagttgctgtatttttatgcaaccttcaactctccatactaaaatgtctccagaatagaaaataaatcttttcaaagtttcaaaagaggctctctatatattccccttaaaagtaccaggcagacatatttctaggtttctaacattgcgtgttgccaggaagtatatccaaaccatcacaagttattcatgtaaccaagcacacttattggagtgcttctgcttctgttcttgcttgaaattggaagctccttccaggaaaaaaaaaaaatatctatagaaggggaaaaaagtaattttactttgaaaataaaatatacgtgagcaatagttttattctgtttttaatttaccatagcttccaaagacaacattgttttatagtaggggttagcaagtgttttctgtaatgtaaacgtaaagggccagagagtaaatattttaggctttgttttctatactctgttgcaactattcaactctgctgttagaatgttgaagcagtcatagacaatagagaaatgaagatgtgtcattgtgatccaataaaactttatttacaaaaatggcaatgggctagttacggcttgagggctgcagtttgcagactctcacttcagagctaacagttgttgtcaggagtcacttgtttttggaaacctacaatgaggtactataacaccaaaaagagttatcccttcctttttctctctcactttttgaattatgagaagaattagaaatgtagttaatgataatgtccaaccagtgtaattatacttgttagaaacacagctggaagcctgttgtccagtcttatttctcctctgtgatcctcattttcagaggttgaagtcataagtttgccatgtctactttctgacaggggaattataataatgtggagtcaccttttgtttgtgactttgacaatgcttcattgacttactcaccaattttctaatttttatgaagactttttgccgaaatgtagactcagtcttctctcttgtctactctttctataacaattaacaatgaacttatttacctttttaacatctttttaaaaattttctatacaccttgaaaatgtgaatacaaagtaatgctgcatcatgtatattgccttattcacacatagcctcttatggtatatcatataaaaatggaacaatacagcaacaggttgaatgaacagtaatcaggtaacaggaaaatgagatgtctttaatatttcacttaaaaactcaatttcctaaagcatacatataaatatttggaagtatagttagaagaaaaatatctttaaaatattttaattgattagtcttatttataagataatttttaggaggctggttgcggtggctcacacctgtaatcccagcactttgggaggccgaggtgggcagatcatgaggtcaggaaatcgagaccatcctggctaacacggtgaaactccgtctctactaaaaatacaaaaattagccgtgcatggcagcgcatgcctgtaatcccagctactcgggaggctgaggcaggagaatcacttgaacctgggaggcggaggttgcagtgagccgagatcgcgccactgcactccagcctggtgacagagctagactccgtctcaataataatcataatcataataataatttttaggaagcatcagaaatatataagaaaaagattattttcttaattgctttactaaaaacacctctatgatttttcagtaaaacttgattcttatgtcatgtgtgagtgtgatctgcctctcttgggatactactgtactcatgaggagtgatttttttctccaacgacctctttgtcacgtcaacaggtcacaggaatagtgtaccctaaaaagccacctgccacatgctgctgaaaatgtaaaagtacacacatacacacacacacacacacacacacacacacacacacacaccaaaatcaggtatcacaagctgaaaataaaattgagtccaatttttttttaattgagcagttaatgtccttaaaacaaaatcctatactgcaacaaatacttagccagatcattctgatacctccaaactgtggtgtattccaagatacctctatgatctttgatttgatccacagcttttcagttatcatgcaaataccttcaagttttatctcatttctcagtgcaaactcattaaaaattttcagctgaattcaattttataaacatgttgtgaatgtcctctttatataagcaaggttgtaaggaactggccacataaacagaaaattgaataacatatggtttctggccttagtgatctcatgtgtgagttaggcatatgggcaaaatcagaacactatagagtataagtctaaaatggtagtattttataatagaggatgaagagggtgctgtgggatcataggtgacagatataactcccgttgtgggacttgagaaaggcttcacagtctggaaacatttagttgctattgaacacaaaataagactcactgttgagagaagggagagggagggcatttcaatcaaattaagattctgtggcatattcggaaactgatgtttttaaaaagagtaatgtttattacattcctctacataaattatatttctatgtaatatgaatgacaaatatttaacacaaaatgccttataacatttgaatgaaatccatcatatgacctgttatctatttccatttcctttttgctcatatcattatgaacaatgacctgataaattttttataagactttgctgaattagtaaaggattattaagtttagaatgaacaaagctgaccaatcattcaggcaaatttgaccgttttgttgtcgcttttcttatttctgaaaccatacaattccctgaaatgaataagtacatatttgataacttcctaaattaaggctcaaaacactggtaatctactgggctttcatttgttccttctatttgtctaatcctatctatatttctttatatgagctatgaaaatattagatttattaagttgtcctttatcttaatagagaagaatgtttttctatgacattaagaggaatttgatttttttctttaatgatctacttttaattttggtagagtagcattgataagatcaatattacacattgttaagtatgcattacatgttgataagataaatattacacttaaaatatgtttatcaaatgtatgaatgataaaaacgaattctgaaatgtatgggaaagatcttgaataaaggtctatgtacatttcaaggatgtctacatatgcaaattatcataatataataactattgaatatgattatcttcacatactttctttatttttcatctcttagatgaaattgggtattgttttcttatagctggaacaaagcattacagagaattcttagtgtgatttcattgaaactcactgttatatgagttcaacaaagtttaaattagtccatgacttaatcatcctttataaatcctatcactagtattcggtaaggacaaagtcaattaaaaaattagcaacagaagcattaaaagaaggattaataaatacaaaataagggatgtgatatctttacgtattgctgagatgttagtgctaaggaaaaacttccctgttcataatgtgaggtgggaaaaagaagaactattattgtatatttctcctctctaaaactgcctatctgactgtgtttttctgtgtcagccgtattaacagatgtttaattttactcactttagtatataaggcatcataatgtatgaactatttcaaaggccctatgatggctaattaaataaaaatatattaaatattagctggacaaaataaaatatgtattaattttggaaaaagtagatcaaggttttgcagatcttttcatatcaatatattcatttgctgaataagcttttattgtttaccaatattactagttttatagagatgtagatatcaccacagtatgactaattttatagggacacagatagatagatgttattttattccaatcttatttttacatataacaggtataaatatgcgcttgaaaggagtatatcacttaggagtcagtcagaaaagtaaagatcttctagtctaatacagtggttctcagccaggggtgattctgctgcacgctgagggataaattggcaatttctggagacatttttggttgtgacaattgcaggagtgttactggtattcatttggtagagacagagatattggtagacactgtacaggacacaggaaagtctcttacaacaaagaattattctgtccaaaatgtcagttgtggtgaggttgggaaacactggtctggaagaaggaatttactatgaggaactagttacgaaagtatagagacatttaacaagctgaacaaaggatagtgagatggctcagagattagcaactgtggcatgaagccactactacgtttaggtaaaaataagctaccatttattcttatagtaataataataataattattattattattatttgagatggagtttcgctctgttgcccgggttggagtacaatggtacaatctcgactcacttcaacctctgcctcccagattcaagcgattctcctgcctcagcctcctgaatagctgggattacaggtgtgcaccacccctcccagttaattttttgtatttttggtagaaacggggtttcaccatgttggtcaggctggtctcgaactcctgacctcagatgatccatccacctcagcctcccaaagtgctgggattacaggcatgagccaccacacctggcccactctttcttttttaattattgagaaatataaaaatatgtcaaaagtaacaggtgtggtggagttacagcatgcacataatgggatacagcccattatctaatctcagatggaaactagaaaaaaaagagaagatctttgctaaagcacagattatgtggaaaatcatttagaaaaatagcttatcacaacattaaaattaaatcctttagctgatcatttttccttgctattttttcttttaaaattgagaagacagtgagttttttttctttattgtcattatcttgatgtcaaaaaataatatgcacattataagtgggaaaaaagataagtcgaaatgaaatgaaacaatgcgaggaaaaaaatgtcacaacactcttcaattagaaaaaatgacccccatctttcctccaaatagaaatgacgtaactgaagtagtggaactttctcttccatggcaactctagagaaggggtagatggcatgggattgtggacagatggacacagaaagaggcctcatttattgttattgttaaaacttttacttctagtaatagtgacacctccttcagcatttctttatcaattgtcaatattttttggatcaccagcatcaccttctatatgtatgtctagaaacctcctgttatgaatttacacttctcagagtcaagacagaaatgctgtgaattgggcgataaataaaataccccccttttattgccttgctttgtctcttaaagaaagatgcctgttgggggactatgagaatgctttgtgcttctggacctcaagggacaaatctataataaaaattatgcatagtgatgagaaatatatataatgcaagtttgtagagatcagttaacttatcttgtctaggcaattatttctaaacaatgatttcaaatcattaactataatatagcccattcataccctccatttttgtcaaatccctgtcaccttcaaggacttggccatcccataggctgctctgcttttaatagaggaagatgctgtaactcttggtaccattgccagttatgaatttatccattaatgaacattgcatttaaggcataggtttatctccttctccaggtatgaacctgcaggattcctacctgaagcttaagggagaataaatccacctgggacaatcaaggacagatcaaccaatcagctcaaagcaggtgtgaattacacagtttatttgagtgacaaggtagctaaagcagggataataaaagaagggagtgggttgatgtggacagacgaactatggctttaggaaatttggtagggactgaaacatattttgtgtaatttatgtgggtctaatagcttttgaaacttgtttacaagacctgtgtaagtggtactggcatattcatgcatgagaaaacatcaagggaaaacttaatagttcaaggaggtgacaaagaagagaggaaccaattattttcactagccgtcaaaagcaagaaaataatcagcttgagcccttcggggaaaagataggttaaatattaagtaacagtttgttattattccaagtgttttcttaaagttgctcccatactttcctgttttctctgagggaatttagtttttttgttggtttttttttttttttttttataactgtcattggtcagagcttgatttgatgccagtcaaatttttttaaagagattatgaaaactgcttaaactcttccaaagggaagatgggtcattcttaacatgtgtttcaagaggaagagcataagagcattatatggtaaggctgaaagcagatatcagcgtttaggggccatgaagaggtagagctcacattggtaggatcattgactagaattccagagatcaaaattgtatgttagtctagcattggggaggacttgtagctagtatcttcattctagcttgggagcctaggaatcaggttaggcatcttgcacaggaatgggccgatgggctaaaatctccttgagagagatgattaatccaggacaaaccaagcagtcatgccaatgaattactttaacagggtacttcatatcctcatcctttgggcagcacggtcttcagagatggggcaggccccaggctgcagttgagattctataaactaaggtcaaaaagatgcagcagtgaagaagtcatgcttatcttgtataaatcatgttttcttttctttttaatgaaaatgtacatttaacacattttaaaactaaatattgaccctaaaattccaaccaaaaaatgctacataagtggtatttatttttgaatttccctcatgctcctcccactgtggggacaaggagtggtggtggaagagagatcttttagcaaacctgtgagtagagaattagaaggtaatgggaggaaggtaaaaggaaaacatcatagatggataggctcacaaacattaaaggccttcgtgcctgtccttcatgcctattcatccctctccagtatgtgaatcaatgtacttgttaaatattcattcacctcacatatttagcattaaccgtgtatcagggacgttgttagaccgttggtttacgatgatgtgtaaaatatcatttgtaactcagactaactggaagtgctcaatataataagatgtaatgttatggaacactaagtctgtgctgaagacttatctcctttaatcctaaaacaatcctggtgggtagtctcaatgatcatctccaagtcacagttgaggaaattaaggcttcaagaagttaagaaactggaccaacatcacaaaggtagcatcagagtgacagtttgatttcaaagtgtacttgacttcaaggcccacatttccttgcacgtttaatattgcctttctcaggtaaatataccattaaatgtgatacaactctaagcatttgaattacttacaacgtgcagagttaaaaccagcattatttacactatacttcagctcgtttataagtgaactattattttgtggactaacctatgaaatgtaaccacattgaattcctctgttaggtacaggtttggtgattccagggaatagagtatgactgaatgcacaggtaggggtgaagtgaacccggtcagaaaatttagagagcatcgagcagatcattaagcagctgtctttcaaatgtgcagaacacaactcatttgtaatctagggactatctgtattgattcttcccagggaagttacttatttttatacatatgtggtgtgttctgtccataataccattctacatggtaatgctcaactttattatttaaaaaaactgctaataatgaggtttttctttgtatcacagaagcagcaggagcaagttttctttttccttcccagtttttttaagtactgccaaggaatgtgattttgtcagacttgtatttcctattaagccaatctgcatgactgttccttctactagctttacctgttcactcatttattaattcatcaaatatttgtagagtgactattgtgtgccacatactaatataggcacaaggataaccaaaaacagacaaacgctgtcctttcaaggagctcatatagtaatgggaagttaggaaaggagaaaataaatatgtggtatttcaaatggaagtattaaagtgttaagaagaaaagagaaactaacaagatagggaaaaagtgacaggaacatgatgttttattttttatttatatatattttttgagacagggtctcattctgttgcctaagctggtgtgcagtgacgtgatcatggctcactgcagccttgacctccctgggctcagatgatcctcccacatcagcctcccaagtagccaggtctacaggcatgtaccacgatacccagctaacacgttttcttttcttatagagacagagtctcactgtgttgcccaggctgttcttgaactccggggctcaagcagtccacccacatctacctcctaaggtgctggaattacaggcatgaaccaccatgcccagccgaaattgatgttttatatatggcagtctgggcagacctctttgatgtgatatttgaacagaaatctcaagagagggagtgtattagcccgttttcataccgctagaaagaactgcccgagattgggtaatttataaaggaaagaggtttaattgactcacagttcaatatggctggggaggcctcaggaaacttaaaatcatggcagaaaatgaaggggaagcgaggcaccttcttcacaaggtggcaggaaggagaagtactgaggaaagggggaagagacccttataaaaccatcagattttgggagaattcactcactatcatgagaacagcatgggggaagccaaccccatgattcaattacctccacatagcctctcctttgacacctggggattatggggattataaggattacaattcaagatgagatttgggtggggacacaaagcccaaacatatcattttgctcctggcccctcccaaatctcatgtccctttcacatttcaaaaccaatcatgccttgacaacagtactccaaagtattaattcatttcagcattaacccaaaagtccaagtccaaagtctcatctgagacaaggcaagtctgttctgcctgtgagcctgtaaaatcaaaagcaagttagttacttcctagataaaatggaagcacaggcactgggtaaatatacccattacaaatgggagaaattagccaaaatgaaggggctacaggccccaagccagtccaaaatctatcagggcagtcaaatcttacagctctgaagttgtctcctttgactccatttctcacatccaggtaacactgatgcaagaggtgggttcccatggtcttggtaagctccacccctgtgggtttgcagggtagagcccctctcctggctgcttttacaggctggcattgagtgtctgcagcttttccaggcacgtggtgcaagctgttgatcgctctaccattgtggggtctggtggacagtggccctcttctcatagctccgctaggcagtgccccagtggggactctgtgttggggctccaaccccacatttcccttccacactgtcctagccgaggttctccatgaggtcttcattcctgcagcagacttctgcctggacatccaggagtttccatacatcctctgaaatctaggcagaggttcccaaacttcaattcttgaattctgtgtatccacagactcaacaccacgtggcagttgccaaagcttgggacttgctccctctgaagcaatggtccgaactgtaccttggccccttttatccatggctggagtggctgggacacaaggcaccaagtcctgatgccgcacacagtggtggggttgggggggggacctggtccacgaaaccatttttgcctcctagacctctgggtctgtgatgggaggagccgcaatgaaggtctctgacttgccctggagacattttccccattgtcttgcctattaacattgggctccttgttaaatatgcaaatttctacagccagcctctccagaaaatgggtttttcttttctactgcattgtcaggttgcaaatttttcaaacttttatgctctgtgacctcttgaatgctttgctgcttagaaatttcttctgtcagataccttaaatcatctctcaagttcaaagttccacagatctctaggtcagggtcaaaatgatgccagtctctttgttagtcatagcaagaatgacctttactccagttaccaataagttcttcatctccatctgagaccacctctgcctggacttcagtgttcgtatcactatcagcattttggtcaaaaccattcaacaagtctctaggaagttccaaacttttccacattttcctgtcttcttctgagcctcctaactgttccaacccctgcctattacccagttctaaagttgcttccacattttcaagtatctttatagcagtacctcactacctcagtaccactggtcttaactcctgcgctcaagcgatctgcttgcctccacccctaaagtgctgaaattacagacatggtccattgtgccgagccaaaattgatattttatgtatgacactctgggcagacctctatgaggtgacatttgaacagaaatctcaaggaaggggagaaattatccatttacatatttggggaaagagcattccaggtagaagaaacagaaaatccgtagtcttgaggaatgccgtgtatatgcagtatttttcaaacttgttattttgaaatacatatacacttacaggaagttgcaaaagtattaagaaagatcatgagtacccttcactcatcttcagctaatggttacatcttacataattatatgtaatatcaaagccaggaaaccaggaaattgatgttgatacaatctatgctttattcagatctcacatcttacatagctatgcacaatataaaaaccaggaaattgatattaacacaatctatgccttattcagatctcaccagcttttacatgcacttatctgtgtctgtcattctatgcaattttataccatgtttagagtcatataacaactacccctattttgatacatggtactgaatagttccagcgtcacaaaggaactatctcaagccaccctttaattgtcacacccatccaatctcccattctacttcctgaatcactagcaacccctaatctgttctccatctctatgattttgtcttttcaagggagttttctaagtaaactcatttggggaaagaaaggagatgaattgttctagccacggagtggagaacagagagtaagagtacctattgaagcagagggagtcattgcaataattcaaatgagaaataatggtgattctaaaccaggaagctttcagtgaaaacaatgagaggtacatggattctgggtatttttggaaggtagcactaccaggtttgctgatgaatggggtatggggtgggaaagaaagagaagagcccaggatgagtccaaggtggataaggtgaatagaattgagaaaatggtagaaggatcaagttagatggtagaggggtaaaggtggaagcaataattttgttttggaattgttaggtttgaaatcttgttagacatcccagtaaagtcacaaagagtgcagttggatgaaagtatgggattcagggaagaagtatgtgctagagatgcagatttgagagtcatctgtgtggaggtattattcaaattcaagtccccttggaatgaatggctattcaggcagggtcttcataaaaatgcttgttgcatgcctgtaatcccagcactttgggagtctgaggtgggtggaacacttgaggtcaggagtttgagaccagcctgatcaacttggtgaacccccatctctactaaaaatacaaaaaaaaaaaaagttagctgggcgttgtggcacatgcctgtaatcccaggtacttgggaggctgaggcaggagaattgagccaagattgtgccattgcattccagcctgggcaacaagagcaaaactccgcctcaaaaaaaaaaaaaaaaaaaaaaaaaagcttgttgcttcaaattcatgtcagtctgtaaaattatctgggaaggcagtacaaaaactgtcactttgactacgatgtttctggtgacccatcttcattgatcagtatggaaaaggcatgtctctgaaaatctctgagagtctttgatacagcaagaacataaggataaatcattcttctatgttcatggttgtagaggatcttgaatgtttaatggcagaatagccagatcacactctggcacttctgtatgagaggctgagggatgttactgattcaccccgagaaatatttactactaaggggacagaggcaaaggggatacaagacttcaccctgagctgtagcgctccctccttccctatcctgctttcattcttcacattgttttccttctttcttttttattattatactttaagttctgggatacacgtgcagaatgtacaggtttgttacataggtatacatttgccacggtggtttgctgcacccatcaacccgtcatctaggttttaagccccacatgcattaggtatttgtcctaatgctctccctcaccttttccctgtgtccacattgttttctttctttttgaagcctctcattcactaggtttcaatcctgccttgctagtgttctaactctaaggcctaggcaagttatttcaccgaacttagcctcagtgtcctcatctgcaaaatggatagttttatgatatcttcagcccttaaagtcaatggttctgacagctagggtgtactatcttcttggatatcagtcatctcaagcaagccctccttttttggaccttcttttcacacacttcacataccttagagaacataatacacatcctctttactcagggcttattctttataacaggcttcctaattcaattaactcaacttttcaaaaatattagtgactactgtgatgtaaataaatttgcattttataggggtcttagtaacccagaagggagtggggaaaattaatatatattgagagtttattaagtgctaggtactgtaaatattttcttgtatttaatcctccgagtaattctacaacaaagatattatcattgctattatgtaaataaaagaacaaagtagaaagaaacccacggtcttgtataagctcccctagttggtgggtattgaagggagtatttcaatctttggtagcttctgagtttttgttctctcagggaatctgccagatgtccagggcacctgccaaaccctatgaggctataagaaaaccattaagggtcttagattacccagctttttgggagttagaattctgaatgaaatttagtgttcctgcagctacaaaggaattgagttagggaagtgatgactttatctttagctacattggttattttccttataataatcctggcttggtagattagaggcagcccgagtaacccagaatcgctaaaatagaagtgcgagctcattgcccgctgtccttcactatgtttgcatataggaagcaagaataaaacaagcataaaataggctaactagcttgtcagagctcttcacaccaagtctttgtgagttccaataagacactgactattattaaaaagacagagactccacataagtaggaatttattgttttccttttcagtcaccaaaggacaatcctctgcataggttagcaaaaaatggtactgatcctataatctctaatattaaagtttagatttggcaagctgtacatcttatgttgttcattaacaaaaaacaatattgattggtatcttgtactataacttgtactgtgggtcaaattccaatacagcaaataccattgcaataacaattctacaaaactacatcaaaaaaacctttcatgtttgagccaacagcctgatagtgctaaggactttgagtacagtatgctagaagattcttaacagttatttgtcctggacaacaaaggttgactccattaaaaacatagccatcagtgtgggattatttccaaatcaagcttttggaaaagtcaaatgaaagtttgcaagcaggtggggcatggtggttcatgcctgtaatctcagcactttgggatgctgaggcaggcggatcacctgaggtcaggagttcgagaccagcctggccaacgtggtaaaacccccatctctactaaaaatacaaaaattagctggcttttgtggtgcatgcttgtaatcccagctactcaggagcctgaggcacgagaatcacttgaactcgggaggcagaggttgcagtgagccgggatcatgccactgcactccagcccacatgacagagtgagaccctgtcttcaaaaaagcaaaaaacaaacacgcaaacaaaaaaaaaaaaaaccaaagttggaatgcaataaatgttcattgaatgaatactgaatagggagtttcagctaatccactcaaaatagtgctgaatttccagctctaaggtcaatgcttggcatatatatcctgaaggaatgaatggacacagagtaattttttttctaaaatgcaaattcaattatgtcacttcccttcttaaaatccttcagtagcttcccgtagcctccagcatattattttgaatagtgcttctcaaactttgatgtgcatcagaatcacctggggattttcttaattaactgatgctgattcagtaggtctggggtattgtctgagattctgcatttctagcaagtgctcagggttatagcaatgattttggcctgcagaccatactttgggtagcaaagacataagccacttaacttgacataaaagactgtttagacccttagtttctctctcgctctttccccattttgagcttttgctccggttcatgtttttccctgaaaataccgtgatcttacattgtctgtctggatgctgaattttccctaattctgggcctccatgtagttttaggtttgacatcacaaccaccaaaagatttccccttctcccttaatcttggttaatgtcactctcatgtattatactgttaatgaagcattgaggacataaaacttatcaaatattttatcacaatcaatgatggcaccagtgataacatccaaatgcctgggtgagtaaataagaggagaataggggacttgttgttaaactaagtttgcagagaaaaaatgtactgattataattaaattggatgtttatttgttatgacaaaaaaggagctagagtcttttaatccaccccttggcaccactgcttatctccttgtaacatacgtttgattcccatgtctatttcttccatatgggaaatttcagctccctaaacatcaccaatacaacctgttgataagacaaagttaaatttattgcttactatggtaagaaagaccacagcctggacaaagctttggtagtatttcataaggagaaaggtgaggttggatttcattgggagtatgaagcttggtttaagattggtctttcactgtgggggcacaattaggattgggtaaggatcatggtattacaacttagtttggtggaaacagcacagtgaagatttctagccaagaggctcagagactattaaggtgtgaactctattgatgttttttgttgaagagttgatgggagtttggggaagttactttagtgaacagtcaaattatttgcctggccaagagttatctgtaataggaaagttatgctaatgaagacaatggaaaggtaaaccatgttaatgtcgacagccagctatgtgagcataaggggtaggtagctttggtcctccatgtccaaactgtttgtagtggtaagtgatcttcattctcacatagattgaaagcttcctgaggacagggcaatgtctttgtaaactttaaaatatctatgtcctgcacatcacctgccgtagacaagcatctagtaattgacggttgggtagatactgagggaaaacatgcaccaaataaaaatggcaataggacacaaattcactatcatttggaagaataacagtgttttccactgatatttgctacacacagtggggtccacagagcagcagtaccacttgggagcttattggaaatggagactctcaggcaccaccgcaggtccaatgaattaaactctgctttttttaaggtcatttgtattcaattattatttttttcttttttctttactttcgatgcatttttctttatttgtttttgagatggggtcttgctattttgccgagtctggtcacaaactcctgagctcaaatgatcctcccacctcagcctcctaagtagctgggatcacagatgtgagccaccacacctggcttgtatcacattaaattttgaggagcagtgctttaatatctattccattctcatcacttgatgaggtattattaattccacttatggatgtggaagttgaagccagaaagtttaaatgacttgtacaaggtcaaacagcttacaggtagttgagccaagaggctctcaagtcttctgcctccacaaacccctgttcagctgctgccctacaatggaataaaatatactaatcccagagggacaaatatgctaaaaatctcaatattatacactttggaaggtgcaggtgcattatctttcaattctaatttctctttcaagttttctgatgcataaaaatatgaacagcaggtctgagcaatgtttagatgccgtgctttgatccttttgccattcaagatgtttgatttgcattctgccaaggaatgtctggtaacctccatgatgcagaccacaccattagtcaagagagagctgacgtaccttcatctgagagctggctggctgtgagctgctcagagggaaaggatttctatttacaaattgtatcgattatttataaataaaagttccccttgctttcttcagttgtaaaatctgcagttagagagtcgggaagaagatcaaaactgcatacatttgcatctgccaagcctgataactagttccagaattacagaaatggtgctgaaatagcacctcaagtaccaggctctatcaaatttaatctatccataaggcaactgccaattatattttagagaaaaaatgtagactgaaaagatagacaatccaagtagcaactcctgtaaaattatatgcccataggagcaatcttgaagatataaatattggtatgtttctccttcatttatcatttatctgatcatttgacaagtatttattgaatgcctgttaagggtgtagatatatgtggtgaggctgcaggtgtaagtaggtctttctgaggatatgcatgaagttgatgttcataacttggagatgtgtgtatacagactgaggattccttcagtggatattaagaagtggagtaataggcagtaaagaatacactagtcagttgtggtacataaacacgtcagcaccacttaggtattaacttcctgttttgttttgtgtgtgcttaattacgctgtttattaaacaagcacatcataatctgcagatattgtcataaacagcacaataaagcctgccacatcagaatgtcatctatcaaattaggtgtgttcctcagctgtcccgataggcacacacctgtgcctgtaaataggcgcttggcggagattgcttccaggtgtggatctgttgggcgaccttgggatgtagggcactttggaaccttttcctctagcttcaggaattaacctctgggcttggttccatgccagcttgcattttgctttgggacagtaacatgtaaagaatatgcctgtgaatttagggttactgagaagtcctcatagaagaagtaaaatttccttgaggaatgggagtcttttattcaatccaggtttaatgcaaggcttggtgaacagctccagaaggttaataattgcgtgcgtgtgtgtgtgtgtgtgtgtgtgtgtgtgtgtgtgtatccttttgtcattcaaaagtatacgtatacacacacacctgtacagctgatgataaatatacattgtatcaatgagttcaaatgaagtgtgctattcattcactgaggaatgggctattataatgaactattatgatattagaaattgtcagggcaataagcaaataatacatacggttttcaacaaactttctaagtattgttatcagtgggtttgcttaaatctttttttacaaatttatttatttttttgagacgaagtctcgctctgtcgccaggctggagtgcagtggtgcaatctcggctcactgcaaccactgcctcccgggttcaaaagattctcctacctcagcctcccgagtagctgagattacaggtgtgcgtcaccatgcccatctaatttttgtatttttagtagagacgggttttcaccatgttggccaggacagtctcgatctcttgaccttgtgatccatctgcctcagcctcccaaagtgctgggtttacaggcgtgagccaccgtgcccaggcaatagccccattgctcagtgaatgaatagcacactttattttaactcattgatataatgtatatttatcatcagctatacaggtgtgtgtgtgtgtgtgtgtgtgtgtgtgtgtgtgtgtgtgtgttgaatgacaaaaggatacacacacacactcttattaaccctctggagctgttcagcaaaccttgcattttttactttcattacagtgtgtaaataatttagcaaattctaatttgaacctgatatcaattgagcatttaatatttagccaaatatttatcaagtgctgactgtgttctagatgctggggctgcaatttcgaaacagaccattgaggccctcatggagctcacaataaatgatcttccttaaagtatcaggtctctggtttgttaccgtattttttaaattgttaaggaaagaaaaaggccctatctttttgtagacaaacatgccctaagtgcttccagaaataatctccatcaggtaatgcagactgtgtgtggagtgaaattgagtccaatccatgatccagcagagtttcagcccaggatttctttagagcctttgctacacacaaagttggctgatgtgccattcagcatcccagcagctctttctcttcacactagcaatggcaaagctttgtgcggaggcattgctggctgctctgaactaaaagcatccgtggggaccgaaagaggtttttgcacaccttattaaggtaggcaagtgtgtctgagtgtgtgtgtgcctaaaagctggaagacatctgttgagaggaaagtgctcttctgtgggtctggcagcttttctgtaagtcttctattctgatgcaggagcgtgtgagcagtgggtgggaggagatgctttggtacttggaatgctgaggtccggattaagtggtattgtaatagctagttagaggcagaataaaaagctgggaatcaaagcatttaaaaatgcatccttccattatttgctctcaagttaaaccatattcattctaggggaaattaaaaaaaaaaaaaaaacacagcaagggcaagtagcccaaatctgtaaggtctttgagcttctctgttcgtccagcttttgaagtcttcctacagccaatttgtttggctcctctggagggggcaattcatatccacttccctctcctggagcatttctttcttctatactccatcagggaacaatagagtttaacagtaacaggcaattttttttttttttcaaagcttgtgccctcttctgcgtttaaaggtgttttttaagagactcctgctaggggaatcttggcgcctgtgtgttaagacggcaattaacttttagtatcagtgcttacattaaattttctctctttctgctttactaaagcagtcattaaaattcagtgtgagtaccatgaaactttatcataaaaccctgctttgcttagagaaccttgattgttttctgaaagcagccttctcagtttatatatacatagctgccttccttggaatatcaaattgctttgtgtcacattaagaaacactaggttgaacctctatactgtgttttatctgagaaaaatactactgcaaaaagtttgatttgttcaagttttaggatgaaaatttctttgtaacaagttatttgagttgcatactatgtcatcgtatatctctttagttcaagtaattttgcaattaacatacggttatgtaaagaagataatgatttattttttatttatatttttaaaagttattaagtgaggttttcctttcagtaagagtttagaaaaaatagccagaacaagtaactggacttggaagataaagatacctttgcacttctaaattttacctttgtacacttcggttgtgatttaatcattgaaatgcctctgctttgaagtaaatgcatcacttatggtgtatgctgtgttttaataaagggaaaacagttatgggttctctgttgcacatttgaatgttgttattttttgctgtatttaataacctcttttttctcttgtgaggtttactttggaaatgaggcatgttcaaaaataggctgacattcagcttctatgttttaaatttaaatgctgtctgtgttttatcacatctggaatgtgtggggagaaaagataccaagttttattatttagatttaattgtagaattgcagattgatatttttcaatgcattttcattatagtttctgccatggaggcagcgtgagggctttcaggaagatggagtggtgtaattaccaggtgcgcacgttcattaatccttcctggctagagaaagcttcaagttcttctccagtggcccattcgtaaagctataaatatctaaattgtgtcagccaagaagtcacacagaatggtggctctttttgagttcaatttcatgcactgttgctttggtcttgtgaggaaagctctgaattccttaggatagtcttggttgtgaagttccaaaaacaaaatatcaaatcattaaggatttaatttaaaatacatactcttctttcacaaactagatgattgcagtaatgtggattataaatttttttttttgctttatttctttagagctcctctttttattttgtatgatcaagattatagctgagattttggtgatttttttaaaaagatttatggcttatggtccatcagtctctccactacttcaaacctgtgtacccctgtatattatctgcagtactggaatgtttgcattgtatgtggaagctatatacgatttggtaaaaaataacacttaaaggtcttcgctaagagtgcttatttaatcattaaatatcccttaataaaaataattccagagatattgtctgtgtacaaacttaaaaaaagagaaatataaaatactgtgatgtgaataaaatgtatagcaatacactccaataataccattcttatgttttcccttgttctcaactgaaataactaagctaatagagacgtcagtaaggaatgtgttgtttcttcataatacaactacaaactcatctgataagaacaacctgagagtgaacgttaactttcctcattagaaagattcaatttaacacatatatacaaatacatttttaagataatgatatttgcagagtttttgtattctatggagtaaaggagaattatcacatattcaaagtaaaggtataaaatacatcttaatgttttacttaaattttaaagggtccaaaatatactaaaattgtttttctaattctttcctatgtttaaacgtgccagagtcattggaaataggacattctttttcttaagaagattttgcccaaaatatttaaaactattttcttttcccttgattttacaatttcaatattcatggatttttctactttaaaaataacagtagtttttatgatcttaaaacaaatgtttaagggcactttcgctctctggagactataccatccacatatttattatcagcaaaagaaagggcagggcatacttttatttgaagttgagtataaaaatgtgtctgtgtgtgagtgttattaaaaagataagtgaagagacaaatatagaatccaggaacattttcagcctggcttttactctctctaaaaatctaatgaaacccttgagcatctcttatctcaaggtacattaggaactgtccaacactatgatccgatgggagatcagtatattcatataaagaagaaaatttgttgttagtgaaagtcaagtcttttaaaaaaataatagttacagcatttgcaatatacaagcataatagatttactcaacgcccaccccccatctttaaaaaatcaatttccgacagttgtctactttaaaattgaacatatttgctacctggagggaacattgtaatgtagcccatatgtggtatgcatcctgaagaaaacctgaaattatagaggaagttatcctgccttctttcttctgttgaatgagttaaaatatattaacaatttgcctttcactttgtatttatcattttgtatctttgcatatttacatatacattcatgtgtacaagggcatatatactcacaggtcagggctatttaaacagctatttatttgaatatgccagggaaaatctccaagatataaagaagcagttattagatactatgtcagtatagaattaacagccatcttttttaagatggaagagaaaattaattaattacatacaatttctaacctcaagacattttctttctggagacaaggaatactgaggtgctcacgatagtgaagactcaacaagaccctaataaaatagatgaggataagtaaaactacaatagccaataaaaaacaaaaaacaataaaccatgtttcgctggcatgttggtgagtatctctgtaatatctgtcaataagggtctctgtagatttggagtaatgttcaggaactacctgtactagagaagacagtggagaggactccagtggctaaattctgctgcctttgcttccagaaatgtaaataataaggaggtattgtggcatttcctggaagcagtagtcttgtttcatggtctgactgtataagaatgcctagagaaacataacctcagctgactaaactcccttgatgattgtcactttgtcactgaactctgaccataccttttgcctccagaggcaaaagacgggtgaggaagtgatctcctcatctggtttttaaacaagtatataactagagaactggattatctcctaaacccactcttgtccctggaaaaaggggagtcatcctatccgtttcttagccaatttatgtatactcttagtttgagagcatgagaaggaaaactattttcttttcttaccttggctgggtttttaagaatttatttttagtttaatcaaaataatattttaaaaggtagtaagcctctcataagcagtttgatctgttctaaaataacttcaatttttctttttttaaactttcttttatcttacacacaaagtataatagtaatatgtactcactagaacaaatgaaacaggatggagtcacatagagaaatatatcatattctccctatcccctcccttaatattaacatttaggtgtcatgtgcttctccattaattttcattgcaaaggcctaaattttcttccaagagtgaggagtagcagcacggtagtttggacctgatatagctctctttccctagccttttgcttaagtgctttcctaggggctgactttacttacctaaagatgtttcaagcaagggctcacatttttggtagcagaagacacttactgattgctctcactaataattttgaaaggaatgtcaaaatctgggaggatcatgaaagaaatatcagaaatttcctttcagctgccattctccttaatactgttatcaataaattcagcatctcatatgtgatagcaaaaaaggtgctgccttttgttcttgcatcctgaggttcttacctaataccatggtagcaataaagatggtgagaaaattgcttcttctatggtgttcaggtcctgaacgagcaccctcacctccacagacggtggcaggtattcaagcattttacagactttggagttaaatatagcagtgttattctaatttaggtatgccaccaccagcggcaccggcaactgcaataggaaaaatgattggcaatgccagctatctgatgttttcatgtgccaggtgctgtcagttcttcacagtattacattccatcctcacaacaagagagtgccagtgagtgttgctgtgtgccagtgcccaggctaagggctttgaacacattaccctgttttatcctcataactttccacgttatttttattcctgaatgaagaaacaagttctctgtagagatgctgtcattgatccactcatatcctttcacatccgtttaacattttccctgctgtgcttttactcccaacaactagctccctaatcgctctgttggagggtggccttgaggctgccagagcctatttggtctgtgtaaagagagagatggatctatcctggaatttatgtccctgtgtgtgggaagcccttaatcaatgactgctggttgcagacacataaatacgtgagctttcttgttcccaactgagaaattcagaagtgtgaatggcactgccaccctgggcttttatgccatatatgtgtttggtctgtttcccttcccaatctcacttcattttcccttaccagtgtttcttgaaaacacatcccattagatcatttttgcatgaagcttcatctcagaacctccatttagggaacccaaactaagatattctctaaaatagaaactttattgataaagtttccaaactgtcttagtagatggccaatataagaccaagccaaatctttctgggtccaaattccctgtctttaattaatagactccattacaacacattcttcaatctttagtcagcaaacacttaccacgtgcctattttatggcatattatatttataccatagttaggatattatggttcatgaatattttatatctgtacacctgaaattctattgacctctctgggccacagttttgcatctgtaaaatcagcacaataatgctacttatctcatagagtagacttaaaaacgaatgaaatgatatatgccaagtgttgagaatcacaattggcaattactcatgctcattaaatattagctgtttttatgagtattgtttcattttcggtgcataatatcctatgcaaagaacaaaaggtattggtataggcattgaaacttgaagcatagaagaaaaagttaattaaccggtgccccactagatgcctctaactgctggctccgtgtatccctttagccttggctcgtcacgagaaaaccttggagacatttctgctggactcagcagatcaatttaagaaagatgaatgacatttttcttgaaatgtattcagtcatagctgcctttttctactttcatattttggagttcttagaaaaaattaaggactcctttttttaaagaaaatggtataaaagaaaatgcatatcactttgtcactttattattgtaacctcatcaaagtattcagtgtaaagacagtagccaagtgaactcttcttgtaatgctcggaaaccattttagcaatggtaaaattgctgcaatttatattcgtcaaattgcatgatttgacttattttagaaaagttattaacttctgaagagaatgcttcagaagcatttaaatgagtacaagttatcaccagtgatatacataaatttcatttcaaaatatacttctagaaactgtacttagttagctatagtatttgtacaaggattaattcctatttcattttgtaggaatttatttatgaatgtctatggcctgccagtgtaaagcagacttagagcatcatcttttacaataatctttttttttttaatcaaaggggagatattctggtaaaacaaaacaaaacaaaaacaatagtttattctgcatttttattaagtccctctgtaagtcatccctgaaatgggatatgtagagtcttatatttatttatttctcagaagcttattggaggtgatatgaaggattttaagaccctactaactaacaaaacaacaatttaaaattaattttcaaaataccttaacaaatcttattctccttattttcaaattctttaacaatgtttttcttattactaacataatatcttctgatgtagtcataataatatctaaaatgacaggtctaagtaacttacatggattaattgagtcttctaaatagtaaggtagatggcactattacttctatatgagaaatgaggaagtagaggtataaataagaaattttttggccgggtgcggtggctcacgcctgtaatcccagcactttgggaggccgaggcgggctgatcacgaggtcaggagatcgagaccatcctggcgaacacggtgaaaccccgtctctactaaaaatataaaaaattagcctggcgtggtagtgggtgcctgtagtcccagctactcgggaggctgaggcaggagaatggcgtgaacccgggaggtggaggttgcagtgagccgagatcgcgccactgcactccagcctgggtgacagagcgagactccatctcaaaaaaaaaaaaaaaaaagaagaaatttttttgagtgtatacagttagaaaatggcaaaatgggaattcagacccaaacagtaagactcaaggatacctttcttatcagtatgctaatatgaaaacctaagcatactagaaaatctaagtgccagttggaaaccagaattaacattttggtgtgtaactttctggctgctttttctatgctaacaaacatatatgacatacaaaaatacacacatacacaaattcctgttcactacttcttttatgttaacatcacaatgtaccgtacacagctgtattattttatatttgatttcatattttttctaaagtcagtgtatttgtcaaatatcaacttatctatttaataggaatatgggatgatctttgcttatacatacatacatatgtatataaaaacaaaatcaagtattttaagcgttcaccagaagtcatatgtcaatcagtaaagtatataattttttgctgccaatgacatatatcataaaaacgctacctatcatagaatgaaaatgaaacacagcaatattgggacacctattctcaagcaacagctttgtgatttattagctatctcacatgaaataactcattaacttggtattccaagcagcaaaagaaggatcacttaggtcacttgcaaaataatacaaagctaggtttaggggtgggttgcgcttggtgggatgtagatgaaaccatatgggcccttgagtttataattgctgggatctgcatggtgggtatatggatgtttattacagtatgctagtgagttaagaaagaagaggaattattattgacttacatcatagagtttatgcaaaaattaaacgataatttatttttaaactctagaggtataggtaccatcatgaagggacccacagaactgatgtagccagtaattattggagctggaacagatactctgctgtcagttgttctggttttgtggtcattgttcttgcctttgcaagttaccaactctaagaccttgggcaatactttaagtcttggttgtctcatctgtaaaatggggagagcagtaagtgtcttaaaggtttattctcatgttatatgacttacggtatgtaaaacatctgcgtttagacacatagagggtgcttaatggatgattgctctcattattaggctacatctaatctatgaatttaaaaactgtatagaaatatgtgacagattctttaagagccaaataccaactacagtgaaaaatacttaacacttgctgagctcttagtatgtgtcaggcttaactaccttaatgctcatagcaatcctataagataggtactcttgttatcctattttatatcttctaaaattgaagcaagggaagttaaataataggacaaagatcatacgctatctatccatatatacccatctggctgtctacctgtctccttccatccatccatccacttattcatctacccatccatccactcagttacttctctctctcccaccatccctttccctttccctctccctctccctgtctctgtcactctcctttacttatctatctatcgatggatcggtttatctatcatctatctatctctatcatctatgtatagttgttaataacactaacattttataaattacaagactgaaaaatgttttcattaacttatggtaacaaaagaccacattgtgaataaaaaaagcagtaaacacaggtctctgcacatatgaaagagatgtcctaaacaggaagagatgtcctaaacagtagggatacatagtatcatacaatcaaaacatggcagccctataaaacttacaaagcaatttcatgtaagttatttcatttgactcttaccacaatctatgaggttactatttttatttttctcattttacaggttaaatttaatatggcttccaataaaaaattagtatggttaataaatatcttgacgtcttgctcctataatcctaccgatagtttacagtaattagtaaaataaaataataggaaaaatacctttgatactagtattaaattataatcatatcattaggtaatttcaatttgtgattttcaagaatctgtaatatggtagcttcttcctactgacatgtttgaattcattttaaggcttataattcacaagtaatctatatattatctaaaatgtaaatgcacattcacatggagataataaattagcgtgaaatggctgtattttgctctctataatttttaacatacaggaaatcactgttgtctcaaaaatcaaggaaatatagtatttgaggtgaacttattctttctactattaacacattttaatatagttctctcacagtgcaacagagcaagaagctttcagacacatttgctgctgcaaggagcatgctgtgctgaacttaaaacaccttccctttcaaactccttgggactgtttttttccaagagacttcaaatgcactaaatttagcatccgttggaggcacacccaggcatattatagtgaaagccccaataactgaatgtgttaccactattcacaatgtttatgtgtgtatatgccttatctatgatgtattgcaaattacaaaaattgtgttattattcacagtaacaaaaacacttccagcaaatttctaacagtgatctcttttgaaataacttacatacatgtgtcatgggtcttaaactttgtcacttttatgtttccatcatgttgttttagccagtgagggttttgtttggttttcatttatgattatatactttcaaaaaatagatttcaaagtgtgaatttgattgattgattgactgattcattgagacggtgtttcactcttgttgcccaggctggggtgcaatggtgcgatctcggctcaccacaacctctaccacccaggttcaagcgattctcctgcctcagcctccctagtagctgggattacagatgtgcaccaccacgcctggctaattttttgtatttttagtagagacaggggttcaccatgttggccaggctggtctcgaactcctgacctcaggtgatccaccctcctcagcttcccaaagcactggaattccagacgtgagccaccgcgcccagcccgtgaattttatttttgaaagacaagaatgtccttgcctaattgcataatagtttaacatcatgaagactaaatatgctttttagccatgacaattttatttattattgttttcatttttaattttctcaaagatcctcatcagtgtactctttttggtcttccttataagcgtattttaacaggacataataataagataaatcccaactttttaaagttgtatccgtatgtattactttaaagtgctattaatataaacgaattagaggcaacttttattcaatcagattttaagtaattttaccaaaaatatggccttgataatgtctctgtaacaggttctctgtaatatacatgctgaggattggtttgtctttgcttttgatactattttaattagaaaagtaatggggaatccagacccttctcatttaataatccagagaaaaatcagtccatgttctaatagtttaaatttttctactaaaacccatgtgagaatccatatgagtggaatggagaggagttcagcttcaaagttggcagatttgagatgattctatggcaacagaaatgtgcttgagggaaatcagttgcggcatcttctataattgtgtcacctagattttgccttaggaatttctagatttccatagaacattgtgacctcaaatgctttatcttaataaagaaataaaagcagattagaagaattatttgcctacagtttgtgggagatgggcaagtcttaagagtttattaggtacccagaacgaaacatattttcttgggcctcataatcacattgaaatacaaggatttagttatacacagtgaccagttagtgaatgacagtcttcagtatctagtagacagtaaacatataaagatgtatttgtggccgggcacggtggctcacgcctgtaatcccagcactttgggaggccgaggcgggcggatcacgaggtcaggagaccgagaccatcctggctaacacggtgaaacctcgtctctactaaaaaatacaaaaaaaaaaaaattagccatgcgtggtggcgggcgcctgtggtcccagctactcgggaggttaaggcaggagaatggcgtgaacccgggaggcggagcttgcagtgagcagaggtcaggccactgcactccagcctgggcgacagagggagactccatctcaaaaagaaaaaaaaaaaaaatgtatttttacttttaactacagcgagagaccctggcagcctacagcatacaattagtgttcattatttagattgcatggatttaatgtgaggggtcaattacttgtctaaccagtgagcctagcctcttgctcaatactgcctgcttcatgagggtgaactgtgctggagaaatatattacaggattatctgcagattttttttaaatgagtggttaagtcaaaagttcttgtgaaaattcagagtaataaattattatgaagttgtgtaactaggtaaaggatagtttcttttacacgggtaaagattaacatgaggaggaaaactttagcaatggcatttaattccattcaatatatttatattgagctcctttaaaaatacagggccttgtggtgggtgctgaggacagaacaaaaaccaagtaatacatgaacataacccttgatttcatgatctagtagacctataaaagttgtcgatatctgatgaaaagaaaatggtaaagatattccaaacagtgtatgcaaatccagagataggatggaggggctctacctgaaggatgatgataagaaaaccgtgttgagtgaagggtgatttgtggaattcagataaaatatcagtcttgaatgctgagtgaatactcaatgattgactagatcccatggacagtaatttcttcaattatgacgatgctagtgtttatgactataactatcattctccatgccaggcactttgccatttggtaaatgtatagtgtgctattctaacaagcatgcacagagcttttactttaatgtatccatgagtttattggggttcagaatttaggtaagctttgcaaggtcgtagcatggagtaaaatatctgaaattcagacccatatctaactaagttcaaagactgtacagatatttctcctcctttgtgcagagaaggataggaatggttccatattatcatggacttagtcagatgttttaaaattataatgtcctgtgttaatgaagaagggatgatattcagtgcatattcttaaccgttactttgcttaatgctctcgacttttctgtgagatggatagtgtagataaaatccccaaggggactcagcaagtgcaagtaaaacaatgaaactttaaagccctttgtcaaaacctctctttttctcagaggatggaagggccgtaaaggttggtgaggaaggatggaccatttcctatgtagtcttctgacaatattcaaacaaaaggagagtcagcaaatcccccttgatgtgggaagttttaatacaatttgcagagtgtctctctggagtagacatcctcctctgcaatcgtgtcttctatatagcctcagggctttgggtaggtaatcctctccaaggagagtcctggagagggctgtctaccccccttgcaccatcctctaacattattctatagctcagctccttgtttctgtttcctgccttgtttttgtctgagtctgcaattatgatgtaagcaccatgaaggaaggtatgttgccagtgtttgcatcagcatatcccccgtgtgtagcagcgcaagggatatagtgagccctcaatgtctatttgtagaaaaaagaatgaacgtatcaacgaaatctgatacatattcattgtgtctgttatctccatctctcttgtcctgccttgttatcttgccattttcacaaaaggccccaaggcccatcatttcttgtgtaacttccagagtgttaatttttaaattaaaattaaggctttctacatgagtgtctattatttgagaaaccatgcaagatcgtgtgtgtgtgtgtgtgtgtgtgtgtgtgtgtgtgtgtgtgtgtgttgcactctatattatattgaattctggattttttcttataaataaaattttaaaaatagttctttaaaaataggaataagatgttttaggaggcacagagagcaaaggagaataaaaattgcaggtttggggttgtgcatactaattgccattgagtaaagagagcacactgaggccatttagaagagaattaacgtgttttgtttttgtttttgtttttgtttttgtttttgtttttgttttgagacggagtctcgctctgtcacccaggctgaagtgcagtggtatgatctcggctcactgcaacctccacctcccgggttcaagtgattcttgtgcctcggcctcccaagcagctgggattagaggcgcccacaaccacgccaggctatttgttttttttttttgtatttttagtagagacggggtttcaccatgttggccaggctggtctcgaactcctagcctcaagtcatccacccgactcagcctcccaaagtgttgggattataggtgtgatccactgcacctgaccttatttttattcatttaaaaatattaaatgttactgcatagggagtaatgggcttaacaatgaggtgaccaaaactcctatgtaccatgcagagcaatgtatcaaatgtttttaactataaacttctcaaaaacataaacctaattgttctgcagctgcaggttatatctgccttgtttgagcaaaatttggtggtgaaaatgccttgcttccatttttccttcaataactgatatggtttggctgtgtccccacccaaatctcatcttgaattctactcccataattcctacttgttgtgggagggatccagtgggaggtcatttgaatcatgggggcggtttcccccatactgttctcatggtactgaataagtctcacgagatctgttggttttatcaggggtttctgctcttgcgtctccacattttctcttctgcttccatgtaagaagtgcctttcacctcccaccatgattctgaggcctccccagtcatgtggaactataagttcaattaaactactttttcttcccagtctcaagtatgtctttatcacagcatgaaaacggactaatacaataacctatataattttgaaaagtacttgtctaatagactttcacaatagaaactatatccttatcaactttgaaaagtcattgcttaatgcctttggataactgaattttctaagattattttaattttgaaagttaaattttatcccagtgttgacgatttttgtatgctacttttaaaatattttgtcagtgatttatatctatggtgcaatcttgtaaaaaattaacaatgcaaatgtggctagaccatttaaaaatcaatatgttataattcagcccatttaatcactttagttaaacatcttaggaacaactcagttccatttgagagaagacacagttttctagatgtgtgttgtggcatcatattgctttacaatatcttacataaggtgaattcaaatcatatcattgaatctgttttaaattctgtcatagcttaagattagtgactaaatattggcaggtttatggaagtaggatgtaaacaagacaaaaacaagggtggaacaagtaattttagtatattattcacttgcacagagaaaagtcattcacaccttcttcagctttgtgaagaaaatagactaaaatcctgttgatatagcaactatgttttccgtttcttgtataaaaataaagaaaacttcctattaggaattagccagacattttaattttctctcttctttctctattttcccttacagtctctttgaaggcaggcaaaatttctataaagttttaagaatgttttaagatttttttattgtgaaatattcatagactcacaaggagttgcaaaaacagtacagagatttcctgtgtatacataacccaactttccccagttacatattaaccaaatacagtatattaccaaacccaataaactgacattggcacagtgcaatcaactagactgtagaccttacttggatttcacctgtttttgcacatgctcttttactgtgagtcattatctgttattctatgacattaaccatgtctatagatttatatagttactaccactatcaagataaagaagtgtttcatcaccacaaagtaacttaaaggattatttttataaagtaatgacaaatgtgtcaaaagccattcctgtgttatatagcaagtatgttttgagttattaaaactcactgatcatgtctttcagtgtcataactttgggtttccctccctaactataataatcctgatgaattacagttgatgaatatgagaatatccaactcttcctgactctataaatatattgactgagattgtaatatttatggtgtcttaaggggcgcttgttttattatgatgatgtgaacatgttgagaatagtaagaacagcccagtttagcaaacaggatatgagtcttctatatccagctcaatcgttgccccaacaggggacatctgcctttgctacttaattttccattctggaaaatgtgaagtgtatgagaatgaataatcgtctccgattttccagcacataataatctgaggagagcaggtacagcaatttaggagctgttttcttttggtttccaaaaaaagttccgtccagtggtctaagttagtcgtttactaagtgatagagcaattggctatgctttttgaacggactgataattatgtggatgcagcaaataggatatagacaatgcatctactccattacagtaaaaaagactctgatagcagttaatccacataccaggcacttagcttaggcacagttggaggaaatggaatggtaatagactgtagtatggcatgacaggagctgtagcttgagattcagaattccaactctgcctctcaatatttgagtcctcatggccaagatatgtaaagtgctctgtgcaggtcttggcaaccatccaccacacacttagtatgcaatatctatctttattagtcaaggatctggaaagctagttgatgagacaaatgatagaaacaagagttcattagatgaaataaagtaataaatgatgcaagaatttaaaaaagatttagagaaggaaagggaacagaactcacatgcaagtagagcaactgtgtatcagataatgtgctagctgagttagaaaccatgtctcatattaccctgaaaataattctgcaaagctgtaggtgttatttttttcatttgacaggtgaattcatgaaggcttgaatatagggttaagtgagttgtttcaatgtagttattgattcaaatcaagatctgaatgactctaaatatggtgctatagagatttgaagtaggataaataggatttgaaaaaaagaaaaaatatatagggaaaggaattggtacactgtagcagtgtcataaatgaagcttcagttgtgtgattccagatgatgtatgtgaggcctaatcaaacagctttgtggaatcaaaatttctgctcttgtctccaactggggacgagttggctcgggattaaggtgggcgaccttgggaagactagagtctaagcaggactttagtccctcataagaattatatgaggatgtatatttgcatacaaattcctgggcccaccgagatctgccaaattggaatgtgtggtgatatcacccagggaaacatagagagctgttataattagtcatgaaatatttagtactgaaattatagattatgttaaataatcacttataggggacatagcagggttggcaggttaaccatacagcaaacagggttgtaagtcagggcctagagaattttcaagaggcaggaattctgcagaatgaaggcctggtctcatgcagcaccatggacagctccgaggcactcttgtttctccaaaaacctgaaatcaaaaactttgcttttcatcatgcaacatacccatgtaacaatcctgcataggtactccctagtccaaaattaaagttgaaaaaaaaaactatactttcatttgaatacagttctcttcggctttaccagctctactctggaaggaatatcttttactcaatgaaaggccatcccctgttaatgcctggccaggttctccttatcagtcattcactatctttgtgtgtgagtgactaaacatataatgctatgtttagtggatggagtaagattacctttgcagaggttgtactggcttacccctttggttcttgtagttttcttctattagagttttttccatccctaggtttctatactgttcaaatgggtttaagattcttgaaggtattcctctgaccttgtaatttatgcttgtctcctagcacaacttttttttgtaaaggaggcaccaactatgtggtttgctggcgatggcatacacaaatcaggtgggaggaattaatgagagcagcaattccaatatctggttcttcaagattaacttgtatagtttaattcagcattctaaataagcctcatagatttaaaaatctagaataaacccacatttttaaaaaaagttttatgttatctgtgctgataatgcacgctgtacataataaaatattattttcttttttttaaatttattattatactttaagttttagggcacatgtgcacaatgtgcaggttagttacatatgtatacatgtgccatgctggtgcgctgcacccactaactcgtcatctagcttaaggtaaatctcccaatgctatccctcccccttccccccaccccacagcagtccccagagtgtgatattccccttcctgtgtccatgtgttctcattgttcaattcccaatattattttctaagtggcagtggaagaaacatggaaagttctacttcatccatcggtggattagaatttgtataccatgagatgattaattttcaaaaccagtttgaatctcacaaaataatgaccctgttttttgaaggacaaggcagaacaaggaactaggctgtgccacgttcaagtcacaatctctaacatttgttttgttttgttttgttttgttttgttttgttttgttttgtttaatctctgttgcttgttcactttctcttgtaatctgcattgatttgctacctggctatttgtagattgacttcggctgccaggaatggaatgtttttcataaaggaacatatgccttaatgaaagtaccataagaagggagtagagtgtgaccaattgcctaggtaataagtagtgacaacaatgatattattctagtataaatggaatcagtttttctttgcccagggggcatgataaagaaggcctggctggtatatactaggtgggacacaccaacagtgcctagaatgtcaatggatcaaacctgagggaaccagaagttgaaaagacatatcccaaaagaaagcatttgatgtttaagggttggcttacttagaacacaatgaaaaatattactaaaattaaaactatgattttagctatttttaaatatgacaaattaaatagcagaacattttaataaaacattacttaaggtccacaattttctgtaagtctaatacatgggtcattaaaataaaaaattccccatgatttatggaatcagatttttttaatacaacgaattctaaatggttttataatgccaattccaattaatatcctaattataacatgtcatccagaagggttaatgactaaattttattaatatttgttttctatttattttgatttgtgcagtttatgtgtatagtaacgatagctgcaaattagataccattagcattaaataaggtatatattttaatagaaaattaaagttaagtatttgagctagcctaaaatattcaacaacttaaatttgttttttgtggatcacatttttttgagacaaagtcttgctctgctgcccaggcttgagtgcagtggtgcattcatggctcactgcctcaaccatccaggctcaggtgatcctcccacctcagcctcccgggtagctgaggctactggcgcacgccaccatgcccagctaattttttgtatttttttttagagatggtgtttcaccatctggtctcaaactcctgagctcaagcaatctgcccaccttggcctcccaaaatgccgagattacaggcgtgatccagtgcactcacccctgtgaaccaccattaaatagctaataaaagatgcatgtcaataaaaataaacaacttactagaatgattatgtgaaaatcatttattcttccaaagcatgaattttcaaacacaccttttgttactgttttaagaagggaatcatttccatatatttgcatgtaaatcacttttagtctcagagaactttccataaaagtttttttattactgctgtaaccgatagagctagtggactattaatttaaaaagctgtacataaaaacacatctatagctcaaataatctaggataccttttagtttggggaaatgtagatgaaaatgaagtaattacagaatccttgttaattttcagatttagacagtctaggcaatatctttcaggaatgaagagatatgtgttttttggcatcttggtagagtatattcccattgtaattcttttgtgaagtctagaccagatgtggccataaaaatagacccctactacaataatatatttcatagataatccaataaagtcaaatcttattgcagtaggcttagaactctgtttgcacccatggaatttatatcagtttttggcaaatcctttcatctctgaggatactttttcatctcacatataccctattttctgaacattttgccttcaaagtatacctcatttatcaagaatttctctttattcatctgacttatacaagtggcaataacaacgtctggttcccatgaagtaaccagtgaccctttgaaataatatagcgctggaagaaagaaaaggaaagggagactgatcattcagcaactctttaaaaccatgtcaccgttaaacacatagtttattttatcttttttttagaattgtgaaaacctatattagcatcttcacggatgtctcctttgtttacatccccgcttctgtgccttgcctgcagtagaaaaaaaaaggacatgtgtatccctattccccattgtcttctcattctacatgagaatgagaattcttttaatttcttctctatctacatgaacccacttccattatctgtttgttcagttctttaaatgccctgaagctagctctgtgactgggcagttgaaagttctggacttagcatcaggttaatttgaaaaatacttattgagccaccaccatatgtcagccactactgtagatgttttgaatgtgtcagtgaacaaagcagaaaagatgtatgccctctggattcttgggggtctcaaatagtgaaagacagatacgataagtatattgtatagtatgttcaaaagtgataagtgctgtgaaaaaaaagaagaagggtaaaataagagatggctcatgctggagtacattccaattttaaatagggtatcatggtattcttcattgagaaggtgacatttgagcaaagatctcaaagaatgaggcatggggttgaatcatgtagatatcagcagtaaactcattttgggttcagtaaacagtcaatgcagaattcctaagccatcggtttatctgctgtttggggctggttatctgcagtgtggctagagtgaagtaagtgagagaggtttaggagagaatgttagtgaggtgagggtggacctttgaagccattgtaaggacgtttttctctttctaagtgtgagaagatgatgctgactgagaccagggtgataagaaatagtcatattctgaacgtgtttggaagtggggccaacaaggatttctggatgaattggataaggggcatgggagaaaaatggagtcatgaatggctccaacgtttttgctctgattaactggaagggataaagttgccctaaactgaaataataaagactatagatagaatggggcgattagggaggcattaaatttggatatctgttagacatatcaccagatatattgaataggcaattgaataaatacctttagagttcagcaaaaaaggtccaggttggacgtttaaatttcggaggtgtttgtataagataacatttaaagctgtgatatcagattgtatcactaaggaagaatatagatagaaatgacaacgtgactaaggactctaacattaagaggtggattgacaaaggagaaaacagcacaggataatgaaaaggaatgatcagccaggcatggtggctcacacctgtaatcctagtactttgggaggccgaggcgggcagatcacgaggtcaggagttggagaccagcctggccaacatggtgaaaccccatctctactaaaaatacaaaattagctgggtgtggtggcacacacctgtagtcccagctgctctggaggctgaggcagaagaattgcttgtacctaggagacagaggttgcagtgagccaaaagattgtgccactgcgctccaacctgggcgatggagcgagacttcatctaaaaaaaaaaaaaaaaaaaaaaaaaaaaaaaagaaaagaaaaggagtgatcaatgagatgggaagaaaaacaaaagtgtgtggtgtcctcaaaaactgacgttctattttcaaaacctacattttgggtctccttttactatatcctgactttctagctatataaccaaaaggagaaagcagtaatttttttagatataacatgttaataactctaagggtattcaatgaatctgaataattcagtggtataatgtgaaaaaatatagtattcataggaaaaggaacagaagttagctcaggaaatgacttgaatgaacaccgaagccaaatctccagcgcaggtccacgtattatttgtctcagtggttgaattagcagcaagattccttagtaggatgaaaaaagatgttgtgagcatctgtatctacatgactgaattaaattcctccaacaatgaaatgtagttaacgtagtatctcgaaaagaaccctaagtggaattcagggaacctaaattccaaccatggttttgctgctgactgattgcattcacttcaaatctatcattaacctccttgtgcctcattatcctcatttcaccaaataagaaaaatgaaatattcctccttccctacctcactaggatgttgtggatttaaatgtgtgagaagtgcttgagatgcataaaatttgatggagtgttttattcatgaattcaaggcatctgaagtaatttgaccatgatggacagttgcttccttgcacattttttagagtgacatttccgttactgacccacccatttatgcaacatgttgcctaatctaaatttaggtcaaaacaaattgaccttataggtaagcattatatctattaatattgtatttttgtattattttataatattcatcattcacctattttctcatgcaatatatgttactgaacacatatagattaaaaagccttcatccctaaataacaatgatgggaccttccatttttatatccctctggcatttaaaatgtgcttttatagccatcatctccattgatctctcagtcccttgaggttgatatgacagatatgctttttccattttaaaattacggaactgacagtctcagatgactttaccctccaactactgtgtgaagaagcagggtctggcactgaggtcttctgacatccagtgtagagcactatacttcacaatatggccattggcttactttattacaagcactaaatattttccactgaatacgtaatacctagaggagaatgtcgtgtaaaacagcagcagtagaacagaggattaaatgacccattttcttgaagttatcttagttttaaagggttttttcttcatcactaatgaccatccctgactaagaaattattctcataatacatgataatatctgcgttttccaatgcgacaagaatgttaggatgtctatacatgatcttgacaatccctagctccatcacaatgtgtccaaattcattttatttggctagacaggcatgtagtcttactttcaatggttggctctgctggatgctatgtgatctagaacctgtcacttaccccttctaaacttcaggaattttttatccttaagataacaagaaaactcgtacctgtttcaaagagctgtttgttcaatcacctatccattgattatcttctatatgccaaatgtttttctaggtgctgaattacaggaatgaatcagaagcaaaaagttcttactctcaaggatcttatatgctaatgaaatagatgttaaaaaataacaatttttgtttcattttattttattttattttgttgagacagagtctcactctgtcacccaggctggagtgcagtggcacagtctctgctcactgcaacctctgcctcccgggttcaaatgattctcctgcctcagcctaccgagtagctgggattacaggcatgcgccaccatgcctggctaatttttgtatttttagtagagatggggtttcaccatattggccaggctgttctcgagctcctgacctcaggtgatctgccctccacggcctcccaaagtgctgggattacgggcatgagccagcgcacctggcattaaaaagtaataacaatttttaaatatcaatatgtcttatacagaaaagtgagcagtgtggtagagtgtaactggaatgtgagttgagacataacaccagacagagaagccagagaaggacttttgtttgaggaaatgacatttgaaaaggaacctgaatagtgacagaggcagatacctaaagaatatgttccagacaaaggaaacaaaaagcgtgcaattgcatagtcaacttagcctacttgaggaaaagtgtgagtggattttggtgatggagaggtaagtgccaggagatgaagggagagatctggcatgcatcagatgatgtgcagtcttccgggacgttgtaaagagttgggctttttttgtttataaattaaatgttaagccattggggtttttaaccagaggagttatgtgatatgatctatagttaaattatgtttgttcttggatggagtgtgcattatgggaatttatacagaaacaagatttcacatatatatatatataaaactcagtgtcaatagaaaataataaaaacaaattttatccattgataattctggcattgatagtagtgggtatggtggtaataattgtgtgtaacactcaaactttctgaaaacctacacttgatctgtaaatccaaaagtatatgtagcaaaagccataatctgctcttatttctgcaccacttgcaccagtgtggagtgataaggcaaattattcaggcacctgtgtaagccttcagtgtcctcacccccttgttataactctccactaatattacattggtaaagacgtccctgacctatatgtcactgagacctcaaagaaaagagcaaagctaaagcgtaagggggaaaaaagccagcttaaaaagacttaaaggtttctgggaccaaaaaaaaaaaaaaaaagtctttgaaaaatgagaaaggaaggatagaagaaaagattctcctttggtcaatctggccaacctttggaaataaaaagtattgtgttgcagctaataactatttgtcactgcaggcacttgctgatgtctgccctttaaaatgacccaaactcgttggcctcgaaatcagaagccaaggaaaaaatcttggacataatgttttctgtagaattaccaattttctctctctctctctctctctctctctccctccctctctctctctctctccatatctatatatatatagatgtatatatattttttctgtaggaactaccaattcctatctatagggactgattgagaagtcccttatagcagtttttctttggcttttaggatgcaatgattattggtgagaataactctttcatttcacatttgtcattggcttatttgaatgtaatcctgattcaatcgttatgatctcctttaagtaggaagagaagctggtattacattgtaggattttaattttgtactcatgaaacttttgaaaaacattactcatactcttctgactgtcaaattggcctctaagaggtccacatctcaagaggtatcaagcattggtaactattttttggtgttgttttctcatcataaaatgtacttttattaggtgactttggaaattttattgaatcaatgcatgacactgcctcattctagtaatctgatgaagcaaagctgaaaaacaaaatttgaggattgtcagtatatatacttttatttgcagtcaagagttatgctgcaaaaatggtttattgaagtaacaaaattttagctgatatattaatctgaaagatacagtatacatttttagtatggaaaagatgaggaaaaggaggttctctttcctctaggtatctagagcaaactgtaactgtccttggtatttaatttttggctaaggtactgagattagaggtggggccttagatatgattaattgtcagactgataagctagatatttcattgagtttctgttgtgctctttctttcagatcctctgttcgatgctttgttataaagatttgggcatttcaaaatcttctccatatctggtgtctttccaaacagcaggtcatagactttacacaaagaggaacgacacaggttataagtagaagtgttttaaaccctgagttcctatttcagttttgctttcttaaacatattttccttatgtgataaatgcgagtgttgaatggtgataaataccacccataggctttaaagcctaaatgttgaatttgacactgagagtttaaaggcatcatgaaaatttctccagaactaatgttcaagcaatttaggttttacaggcaactcaatagttttgaatgatgtagttattttgaaaaagtcaccataaaacgctatgtttagggaattggtactttgcatttatcagaagattgtaaatgtcaatcgattggcttgctatttggaatataattttttaaattatagttcaaatcattaggatttaattcatgattttgtactacaaactaaatctatgaaaaatatcagatatttattttaaattagaggcatgtaaaggaaaatataaattttgaaatgccattttactggatttttctcttcagcccaccctaggcatttgttacataaaatatttctgaggaagtcttccactgattttgtaaacaaacatgttttattgaacagttctttgttgactagattaacattgaccattgtatgcaatgcattctcaaaatcttagaagctggttttctttttaatcatataattttacttgttttacagtgaaattaatgcatgtaaaaagtatacctatatagaaagttaaaagaatattgctaactagttactatacttccaaattgcctattttctgtgtcttgcattggacagtagtgattacctctaaaagaaaatggatggtctttgtttcattgaagggatggataatggacataactggcattcttgagcaatgcaattgcaaatacatgtctttgcatttatggtccaatcatcttcttactatgatagcatataattgaaggttcaaataaatgcctcgtcccttcctgtggcatattaaagagaaagaaaaattagaaatactttcaaagctacctcacatactaatggtagagttgtttgagtatttaggtgatttaacaaagctgatgtattttattatgcttgatcattgaggaaaatttatttatcggaatgcttttgagagcatatatattgtcagagataaacacagctggatattaaagaggtaaaaacagattttattcaatacctcgtgaaattaggggagagctgagatccattctaatttgtgcagaggcgacttggttgttttaaggcaagaaggagggagaaggagtgggggttcattcgagttagagaagtaaaaaagtacaaagggctggacagtgtaaatgtgattaggccagctgtgttagctggaagttattgaagttaggattctatcttcccacagagaacaggagacagaggacttatccttcttgatgatgtcatttgaaaagaatggctttcaggtccttgagtgagagacacttctgatttccaagagctacatgttcacaattgtaagcccttttgagtaaatgttctaagaaacggaggtaagagtcctatcaacagatgtgtgttggctagaacaaacattaaattttcctggcagcactgagctttctcaagcaggcacttaagggaaggctagggtcatcctagggacatggccttctggggctagaaaccatactagagtttagtcaagtcttagtgcaagggtttggacagagttgttaagtgctgagagttctgtatttctcactgtcacaaaggaagatcagaagctcctgatacttttttcatcagtacaattgaatatataaatcctatacacaaaaataaactaagcttatacaagcatattggtcaaggaatgttgctggccttattaattagatagcccagttaaaagaagaattttttaatataattaatgttaaagtaggatgatagtatataaaacgtgtctactgtcctgaatacaaactaaactgtttggtttagcatttacctcaagatctcttaatatcccccaaagggtccctaaaaccacaacttatctttgtgctcatgaagtagagaagagacagttaatagacatttctagctgatagactgttgtagagcagagaacgctctgtgtttttgaaaattaaacatatgaatttgcccctcttcccctattaaggaagaagagtttcttaattgtgcgaacacatcaagtgaactattcaattagatttttgtgacccagggtataaacatctggttaaggttacatatttcaaaggaacaaaacactagaaactcttggttttaaatctcatggctggaggataatttgcagcagagatttatctggcaagcatacagaattgctgagactgttctaaagatgtaagtgtgggtgtttgtgtcgtgaaaatagctgtttacatctattaagtggataccgatggttgaaagtgccgtctatgtcaagtttttaccaaatcaacttttgcctcactgtgtcagaccattttacctaatcaacttggactgctaatgtcctttcccctggcaccactatctgtctcttttgcaaagcacagaaacggcatgcatgattgtagtttataaaacacatgtaccaatgtggtctacagcttctgttgagttcgagagggtcagtttctgtaatctcttctggcacagagtcaagaacagcttcactttcctcctgctacctctctacccgtaagtgtgaacccatcactttgctaacactcaggaaggggattacacaaaatagagcaggagccctctgacctgaatatgcatctgagccctagccatagagcttctgattcagtagatctgggatggggcctaaatatttgcatttttaagtgtataagtgatgctgatgctgctggttccaggaccacattttaagaaatatcgataaaggtggagaattaaactgcagctcagaagacctgagttcttgccccagcttgacttttacaatctagcaaatggataaaactcgcaggacttcagttctcttcatctacacagtgagtggttagattggctttgtaatttaaaattaaacagggtttgattctgattcactacacaaggttccaaagaaggaatgatatctcctttcatttcttcactttgtcttctgtccctaggtaatcttatctatgttcctgatttaacctaactaatgtttctgcaaagcttctaatatttacatctccagccctgaaactctcatttgaatgctagtcttatatacatacccccctgcctaattgacatctccacttaaatgtatcagaggcaactcagactcaacaaggaccaaactgaatgttcgaccttgtccttcaaacccgatacacatccaggttcctccatcccagtgaatgacactatccagttaagcaagccaaaagtctggattttttttcctcactcttcctcactgtccgtcaactaccattattaaatctgtcacctggtcctactgatttaaccttctcaatatctctacagtttttctttatgcccattagtatcctagtgcaagctaccatcgtctctcattggaattaacacagtaacccccctacccaccagactgttctgcctacagatagtgtgatatttaataaatataaatctagccttggctagatttctccttcaaaaggttcacattaattttagccttaaaatggtgtgcaaagctttgcatagtctgtcctttgctatgttggcagtattttttactatccctctcatctgctcattctctgtactccaactacactaactttgtttttttttttttttagatttctctaactacagtgctgtaatctctttttcctttgcacgtactattccgtttgtcagggaatctgctcactgtctccacccactccacacactcacgttttcctgcccgtcttaccggtcttgatcggttgtcacttgctcaggaaggtttccctggtcaccccctccacaaattgaattaagtcctcttgctgcatgctgtcctagtgctctttattttcctctcctcatccttaattcagtttgtaattacatgttatttgtgtgaggatttgattattatctgtgtcacccactagatattgggcattctttacttactcaccactgaattcatagaaccacagtaattgtacacaacaaatattcaagagaaatttattgaattgatgaatgaaaagttgtaccttaacatgttcctgacatgtatccaaaaaagagctcccctttggggtctattaggactttggacctaggtaaacgtaaccctagtttcgctcaggtttaaacagtagaaagtaattgggtctcttttgcatgtggctttcctaagggctaaccctgtcttcggaatgagtcaatacagcagagctgttgaaagcagactctagcttcggacaacgttggtccgaatcatggttccgtcatttcttagctgtgtgatttagaataaattaatgttttaaagctttgatttcctcttccttaatctggagatgctaataaagccaacttcgtagaggtattgcgatgagtaaataagcataatttgctgtaaacaccttgcagattgcctgttgtatgctaactaatcaataaattgaagctcttaacatcattatattagatatttccagcattgagtatactatcaggcatgtggtagaagctcaatataaagttttgttaaattgaatagattccatatatggtatttctacagcattatgctccttatttaagtgtctctaagtattttttaagtatcacctcacaaaagacagatgtttaattcattacacatgtgaattgttttagatagaaaataaaataaaaaattcaaacattgaaatcaatagtgtaccttaccttaggattacaccataaaatttctaccaatcgagaataaagtgtacagtctatttcctttctaatacttttaacgcaacaaatgtttattgaacacttactacttctaatctatgacagacataaagatgaataaagcatgccacaatgtttaaaggagctcactatatcataagaaagcggattcacacagacaactctataagataaagtggtaaatttaggctggcctgtgaaacaaaggattataggtatagttaagaggtggaatttattttacttcgaggatttcagttacctttatattctttgtctaacctttcatgtttctctttcttcagaaacagagcacctttttcctgacacattcatttccccctatggagtagagcagttgttttcaaagtgtgggtcccagatcagcatcacggggatggttagaaatgcccattcttgagcctcacaacagacctactgaaacagaaattcttggagagtggagcccgcagatctgtgatcaagccctgtaggcaattctaacgcacactcaagttaaagaaccacgggaagaaaggtccatcctgtaacaagacagatttttttcattagcatcaattttgatcatttatatatatatatatatatatatatatatatatatatatatgcatgctcacaaaaccattcaccttactaggttttagtattccccttcctgtattcatgtggtatgtatgtatacaagatgaacacacatttacctgagacaaggtaagactacacatgtctcatttggggaccagaggctgtaatcttactcaaggtcaaagcgtcttcactgctttctttcactgcttttcaaaagtaaaatttccatgtaggtgtcatttgttttctttttgtgttttagaaaaccgattaaggggtgaagtctggctaaacttagtgtcaggacatttacttagataaaattattttaatttatcttgtaatgttcaatgtgagaagaaaagtccttatgagtagtgtattccttaaataacaacaatttaaaaactaccactgaagtctgtcagagtagttttgcctcatttgtctagataagagaaaaaaggttcacattagggattgcaatttgtctgccaaagtgcagtttatttattcagaaacatttagagaggaatgtgtcagttctgttgcaggcactgtgctgtgacggggagctcaagatgatctcaaaaaatttcacagatggggtgggcagggggcacagagagatgtatttagtggttcagatactatttagactgtggccagcatttctctaaatgcaatccagataacaccttacagaatcatctgggcagcttgataaaagctgtagactcctacccttcatcccaaacctattgaatcagtgtctgtgtgtgaagacctagattgtgactggtaattataccaaagtcttagaagcaactctaggccagtaatactcacatcagaatcagctggagggtttgctataccacagattgctaggttagccttcagagttgctggtccagtaactttggtgcaggtccagattttgcatttccagcaagttaccaggtgatactgatgctgctggccttgatcgtgctttgaaaaccactgctttagctacgctataggaaaaaccatataaggcttttatactggccaatgacttcacaggcctgaattttagaaagcccccttctgcagcttggcctatagattcgaaggaaacagaactaacacaagaaagctagttaggagctagttaaaaatcatcctgacttgccaaggaaaggtgctgaagacctgggtcacagagcaaatgcaaaacactaggactttgtccctagttcaccattaaatcaacttattttctcttaccccctcatattcacgtttactccttactttgtagtggttggacaaaaatcaaataaatctgagaattctaaaatgcacacccttgtttattttctaactcaaatatgccactgttgtctgtgctctgtcaagatttcaacacatctttttctcctgtttgcttttccttttggcatatagtgagtgtgtgtatacacacacacacacacacattttttttgactccttccaatgcccttctgctctccgcagatacacttctgcattctgaataaaaccgaatacatatatatatatatatatatatatatatatatatatatatatatgcacacatattttgaaaaccttatttgaaaagaaagctttcggaggaaacgttatttagccacttaatcgagtcttttactgagggactttttgtcgtcccctaacttcctgtcagcagtccacaggcagcaggaataatgtgggagaagatcaacaggcttatttcaggaggtcaggggccagtgccaccacctgcaggtggagacatcagaagcaggaagcagcccaccagctgcagggagaactccccacagagcctaaccaagatgaagggacttgtaaatttcaaccctcccttttggcttttgtgctaaaaatgtgaatattgaggtctgccctgattaagaactagatacattcctctttgtgactgccacacttccttagcgtattcattttttgtctttcgatctcaagttattattttcaaatgcattgcacgtatctaccatggataccattgcaattggaaggagcaaacgttttgtatgtttacttgacaaagagaagtgactgcccaagccacacagagttctgcacaaatcagtaacttctaacgaacgtttgcacttccgggcttgttctctacctatttcagtcgatgcatttgtattatttacttcaaactccaatactaataatgcctcaatcaggttgcaattgggatttgagcagccagaatttcagaaatttggtttggtccatatctgtgacaggtcagtaaatcagagaagcaagggtttggttgctattataatacattgcttacctatcaatttagttatcagccaaggtggttgttatcatccaaagtggctcattaaccaccttggagactcagtatacaattgcaagtaaccctggaagttgtaaataatcccaactgaatttgtatgagtttggtaaggttaagtggaaaccagctgcttagggccttgattataaatgaagttaggagtggaagaagtaacaaaaccccaggcaaattcattaaacattttttcccttcaactttatgctcacgaatgtgttgagactcttctgaatccataaaacacctttcagcatcatctgggcagcttgataaaggctgtagactgcctgcccttcatcccaaacctactgaatcagtgtctgtgtgtgaagacctagattctgactggtagttataccaaagtcttagaagcaactctaggccagtagtactcacgtcagaatcagctggagggtttgctataccacagattgctaggctagccttcaaagttgctggtccagtaactttggtgcaggtccagaatttgcatttctagcaagttaccaggtgatgctgatgctgctggccttgatcatgctgtgaaaaccactgctttagctaggctataagaaaccatataacatggacaaggcaaatgaaaaggttggaattcttctgaatcccaacacatttgtgagcataaagtcgaagggaaaatgattcttctgaatccagacacatttgtttaaggataaactgttttttccttctgaaaatttaatgtctgattctcgttcattcattcatcaaaagttatcaactatcaactataggtaggaactgtgcaatatgctggtgataaagagatgaaagacacagcccctcccttcaaccagctcctagttgaggtggcaagtcagctgtataatcaagtaattgcaagactgtgcactgaaaagggtgaccacagggtgtgatggccacccagggctgtggaatcagtcccaaaatgaagaatgaaagcagggaagggtaattcagaaagaagaaacagttcgcataaagacccatagataaacatcaatcagatgtggttaagacaaaagtaagtttctggaggctgaggaccttctcagctatatgtttgcagtgcttggtatagggctttatgcatctacatggaagacagaaagggccacatcacagtggacaaggcaaatgagaaggaggcagtatcagaagatgagggtacaccggagatcctagttatatatgggcattgtgttcatctcaggagttactgagtaatgggaccttgactcaaatgaatctcaagtctgtttttgcctaatcttggttttaggactaggattagcatacaaccgcactaggagcctagttatacgaaaggctgcattgcggacctgatacagttcaatatacatactgtcaccttgcaaatagggttacgttagttctcaagactgccaatcctctgtgctctaatccttttggcttttttttttttttttttaactgtctcactctgtcatccaggtgaagtgccctgggatgatctaagctcactgaaacctccgcgtcccaggttcaggtgattctcatgccacagcctcccaagtagctgggattacaggtgctctggcgccaccaggccctgctaagttttgcatttttagtagagacagggtttcaccatgttgcccagactgatctcaaacgcctgacctcaagtgatctgcccgctttcctttggcttttaacactatagagcaagggtccccagccctggggccacagaccagtacaggtcagtgacctgttaggaaccggggccccacatcaggaggtgagctgcagggccgccagcattaccacttgagctccaccttctatcagctcagcagcggtattagattctcataggatcacgaaccctattgtgaactgtccacacgagggatctaggttgtgtgctccttatgagaatctaatgcctgaagatctgaggtgcaacagttttatccccaaaccatcgcctcccacgcacctctccccacaaccccacccgcccctgatccatggaaaaattgtcttcctctaaaccagtctctggtgccgaaaaggttggggattgctgctatagggcgatggttttcacatttgatcctgcatcaaaatttccaggtgactcattaaaatactgattgctgtgccccactcgtaggagttctgataaggtagctgtggggtgagacctgagaatttacttttctaataagttcccaggtcatgctgatattgctttgataaccaaagcaatatcagctttggttatcaatatataaccaaagccacatagagggggagaagttccttgggtttagcccagtgtttactgcgaccaccaaaattgctggagcttaaccatggctcagagagttatgttctgttcactctgtaggctgctattccctgtcaccttttgaactatgatggaggggaagagctgccagctcaggagatttcacttttttctctgcataattgaaaatccagaaacacagggttttgggaaagctatagaacagatcatcagtgatcagtgtttaataaagtaaagcaataaactttactgtgtaaaataggatactttattatataaattttgtccccttcccccacctcacaggccaataaaataatatacttcttgtccctgggtgtaatgttattggaaacctttgaatgtaggagaggcatgggcttgtaagttgcagaaaactgctagcctaggattgagaatttcatggataatccaaaaatagatgattttacagttataagccttacgtgaacttgaggtaagaaaacacaatgcctttatagtcttctcagttgctccacatgccctctgagattctgttctgcccagcctctctggttgtcacatctctgggcattaacagaaagttcacatactctttgtctctgatgataatccttctaggtccatatagaagatccctatccaaaccatcccccaaacaaacctattggttaaatattttctccaccgaaggcactttcttagattctaagtgccctgtaggcaggcttcctctctgatttgggagagtacaaattgcgacaaggttaaatcatagcctgggaatttgacctaaaattcactcttctcccatatgcattcatgaaccttctgctggtttttaaaagaagctacttaatgtcagctcgaagaggttggaaggggttaaaaacatgagcatggcagtaagaagatttatgaaggatctgagaagattatgacttgatcagatggtattttgtcagctagccacatttgtgaagacttgaaaactagggaggcttgtccttctaagagggggcactgctgggacctggattctgtggaaccgtattagtagaataaacaataacctttgcttgtatcaaatgaacttctattctcatgtgtcttttgacatatttttattaatcatatcactgggacctccttgctgaaagatatctccgttccccattctgatgactcccaactaggagtgagatcaaatgaagatggcatggaccatttctccatgtgacagctctctgtggttgccttttaacacttctaatgccctttctcttaagaattcccatttgtcgtctggcactggtgctgtgatcaataaaaatgtaatggagtgaggcttagaaacatgaggaaatttactcaagctatccatttattgatgtgtccatttgtgttgtcagggaagaaaaactttttcactcccctcttaggttcattacttggggggctgcaaattaaactgacgacagatagattggcaatagaaaagacaaagtttattcagagaagtatgtgggagctcacagaaaacatagctcaatgaagttagaatttggggcttatgtactattttaacaagggttttgaaaagaagagtgttagaatttcaagccacaaagttggtgggaaatatgaaagaaactaatgaaaggtaatgtttgttttagtaaagtctgtttatgtaattttcttttcccagcgacaacttctcatctctggtgacaggagtcactctttacccctggtgcaagaaactttccttaaaggaggatttaaaacagttgaattatttcagaaatctttgcttttaggcagatagggggagtacagaaaaagccccttcccgtatctgttgatcctcaaatggctttagctcaaaacaatttttacatcacgatggcataatgtagatctcttcaatgtgttcatttattccacagatatttgtgaagtacatgatatatgccaggtacttgggatacaagaatacataagtatgtccctagtctcgtagaacttacactctagtagtgagctagagaataaatgatattatttattatatgcatacacatatgatttcagatagtgatccatattggaaataaagctggttaagggaatagaaaatgatattgaaggtggacttgtttagattgggtggattggcatggcttctctagggggcagtatttgagcagatatgagagcagatattctccaatttgggcaaaaacattccaggcagaggaaacaagggcaagggcactgagttcaaaagagacttgacctagccaacaaatagcaaggattccagtgtaagagaaggtggggaaggaaggaggtgcaagtataggcaagggcaagatcacacgggatcttgcaggccgtgataaaagaatttaactctttcataattttgacaggacatcattgaagaatttagaaaaatagagtggagatacctgatctgctttcttcaaagagttcattcatcattgctgagtagaggttagactgaaatggaagcaatagtgaatacagggagatagcacaggaagccacgttactagtccacatcagaggtggttcagactagggtggagtggtggggtcagttagagagctggtatttaggatacattttaaagacaaagctgacaggatttgctgtgatgaattagatgtaaagtatgagaataattgagaattatttctaagttctttgctggggaaaagtggaggaggaaaaagttagggtacaaggtgtgatgaaatcaagagtctctcttattatcagagtctcattagatatccaagtggaaatgctggaaagaaagttgggtagatcagtctgaagctgaagacagatactgtgactggaataataacgtaagagttggccggacacagtggctcactcctataatcccagcactttgggaggccaggataggagaattacttgagcccaggagtccaagaccagcctgggtaacacagcgagacctcgcctctacacacacacacgcgcgcaaaaattaatcgggtgtggtggcacatgcctgtagtcccagatactcaggaggccgaggctgaaggatcacttgagcctgggaagtcaaggctgcagtgagccgtgatcacaccgctgcactccagcctgggcaacagagtgagaccctgtctcaaaataaataaataaataatgtggcagtcataggcccttagatggtttttaaagacatgggactggatgaagtcttctaggaggagagtttgggaaaagagcccgagaattgactgcacctttcaaaacaggaggaagaaaaaaaatactcaaaggagacaaaagcaacttctgtgatttatagagaaaaccaggcaagtgggatgaagaaagtccttcatgatagaatcaaaaacagtgtcaaatgttgaaaatacaattagacaaacacaaaagaatagaccattgggttttgcaatatggagctcatacttgaccttgataaaagacattttcactggaagcatgcatcaaaaaactatttgtggtaggttaaaatgtagtaggaggtgaggatatacagacagtggctttcactgtgcagatactgctgctcatgcactaattaaaagacatttgttgagtatctactatgttgtatccattgctaaatagtaacagctgggtttagtcaggtagaacagcatcaaaatcattatagtatcccaagataggtacagtaaaatctgtgaaggaatcagagtagtctcttctccaacagagcgtaagacccagcttcacggagaaggtggtagattagctcatctgggaggctgagtagaagcttgtcattatagagggagaacatcagaagtgtggacaacagcttgaataaccttgaaaggacaaaagaggacggtctgccctggaaatattaagaagtctcacatgattagacacaagatattaggggaaaggcataaggtgaattgagtcaatgaggtcaaagagaagctagctggaggaacaggcgatcataaaatgagtaaaagtatatattcaaagattctttttagaagggctacacaggatggataaggggagagagagagttgaggcacagagacaaattggaaaggtgcaatcataaccagagacatgaaaaacccatagaaatctgatgtagattatgtggtccccaaggttgaacaattaagtacgctttcagttgttatgcccatgatattaacatattttataactgcaataagtgctgaagctaaagataaatacaaacaatgtaattcttattctgtgagaaaatgttgtagctggaagttaaacatgtttcttagctaaagaaaaatattgtgtgatctggattacttaatgttataatttagcaacaaaatgttgacattgagccttgcataatcaaaaaagtagtctattcaataaccacattctcagaaaaaaaacaagaaaatattagaaacaatgataaattatcgtagtaatttaattcagtattctattgttttatttggatttaggaaaggcagaaatgttgaaatattaatatatatccctgtaataatataatttgtgtctgagaggtaggaatgagggcatgaggtcaaagtttgataatgaacttcaaagctataactatgatcaggaaattaaaattggacaataaattcctagaatcgtcaggagttgcttgtgaaatcgagaaaggaaaggatatacacaaaaataaagaacagccaatgctctcaaaggagtctaacttttataatagtcttctgtgttagagctgaactcttctggtttagaaggacactctgttgcctggaaatagggcatggaaaaagtcatcagagtcatgtcatctttcattcttcccatgaacgaaatcgaggccctgaaaagtcacctgtgtttgctgtattttattgcaactaagatgtgcatttttaaattgatacataataattgtacatatttgtgggatacatgtgatattttgatgcatgcataccatgtgtaattatcaaataaggatatttctgtatccgtcacctcaaacatttaccattgctttgtgttgggaacatttcacgtattttattatagctattttgaaatacaaaatagattgtcattaactatagtcaccctactggatgcaccttgtttttaatatttctgaaaacagatacgtctcataggtgatggtgtcacagctgtgcattagttattattgcctgtgcaggtgcaaacgtaactattcatattgttgtcaattaattaaatagttacatttatttatatgcgtttattatactaataaacacaatattgagatagttgagctctagttttgactctgctgttaactagctgcgttactttaatttacttaactaatttggctttcaaattcctgataagtaaaattacaacatgagtttctcctgctataatagcctgagaaatcggtgaaacacatgaattcagatgttgatgctatttaatagcgggattccagatatctacttgccattatgggagggagagaggaggtggactggaggctgtgatttccctaggaggttgttaaaattggccaggtgaggaaagctgagacagaccataaatatgaagcatgatacctagccctcagtgttgaaagaaaatcaaatctcatctttgtggtctaaatatcagtatgatacaatcctctgtgtagacatatcctctgccctattgttttctttctaaaagctaaagcccaggtgtgatcacatccctccgttatttacaaatttctgatgatgatgattcttctaatatctacattccttaccattaccatgatgtccaaaacctattataatctattcgtctccaagtgccatgttgtggtcaccctatgcaccctctaaacccaccatatgaccttcccgctgctacttgaatacagttggccctctacctcgttgtgtctttgcattgcctatttaattgcctttccattctctaaatcactctttcgctggaccagcaacatcagcaccatctgggaattcattagaaatatagatcctcaggcctcatctcagacctgcttgatcagaaacattggagagtggagatgagcagcctgtatttttatcagccctctaggtaatttgatgcacactaaagtttgagaaccactggtctagagcattcttctttaactctcttctaaaaattattagaatgaattcgagggacgggatctccttgaaagccaagaacatttctttgtcatctttctgacttcagggcgtagtacactttttggcccataattaaagctcgataaatgcattctatgccaataaatcagctaatcaaatatattattcatgcccttgaggtatctgaaatttgtttgcagaatgtaatatataactatagagtaacaagagaataatttattgccatagataataaaacaatatcctctgtataataaatcctagcctctgctcaatgggcaaaaacgggactggggtttcagattttaaaaagattattggtaattaaatcacctggagaagcacttgctgcagagatgggacttgaagcatcataataaactgttgtttattatgattcggtcagagctgatggaatcacagggattgtgtgaggtatggaaagtggttgacattgaattccaggctgcacagttgggacttgatatgataaccaaaaagaaagaatgtctggggtggtagcaagctctaaatttagacaatctaggcttatcctaaggagaatatagatacagataactgaagtttgattaaagggaacctggtgtatcacaaatagtaaaaagctgtagttagtctatgcagctatcagctagccacataatacttttgggcaaatacattataaaccaaaagaatgacatggcttatctctgtaacaaagtggctcattgttctttattctactgttatccttaagaaaaaaattttagtaaatttgttatgctatactcaacttcaagaagggatagcgcttataaaaaaattgtttaaagaaacaggcctatttctctttgggagaagccacggagaaacgaaaagaatggaacgtgtgtttctgcccagatggcaataaaatgtagggtaaatttctgtcttttaaaactgtattttttccatccctctgtatatacacatatcctaggactgttataaaatgctgcatgcgtatgtgaaaatggaaccttattgggctgtttgatggacctttaaaatatatttgttggtttggggtacatactagctatgcaatataatccgcattatttcttatgtaaacaatggataaactgtttcacagtccagacatttatttggtcactgtttgtagaatgtctattttatttacttctgaatttgtattccagagatctgccttcaatgttggatacttccactgtaatattctaggagatgctcactttctttttcagcatctgacacagtaccatctgcctcctcttttcttgccacaagtaataacaattttataaaggaggatcacattacagaattataggtggtaaactttctaccaccagatttacccaagaacctgaaacacattttttcaaaaggaaatagaatgtccttcttgtgactacatcggaattttgcttgcagcattatgctttttttttccccctagtgtagctagccatgtggaactgaagccattagccagctcctcatcctataaatgctattacctgggaaaagaggcagaaaatatactctcttctccagttagagtctaaaggaagagaacaatatgggtagttgtgtttaccacaaattgatagaactcctttattttaaatgctaaaaccaaataacttgtttatatgacttcaacattgactatcacacactgttgcatgataacagagtgaaaactacctctattggatttaagtggggaatctatgtctcattctcattctttttttactgtggaaactagttgattccaggatcagccttagctccaacttgccacactttgagttttggtttttcacttgcattgtcacaggaaacttctataggataaatcgaggaagattttactctgcaacgtgttgcagaattaaacatttaaagtggcaaaaccttcgtgtgtaggttgtctccccagagaatgtaaaaatgaattgaaggcagcacctaataggtaaacgacagccaatcaaacaagaacaaatgaaatttgactggcaaaatcaaattgaaaatgtataacgctgaatctcagaatataggaggatgcatagaaactaagctgtactattataaaagtcatagccattgaaaaataatgactggttaatttggttttctttacctcatggatgtgaatggttagattttgatgttggtgttatttgacgtgtgtttgtcaagaagttgccttagtcggctcgcatttaggataaaaaaaatattttaagaaatgtttaagagattatgttggagacattagaaacaaaataattatgcagagggcaggactatcaaaatataatagaaaaattacaccgctcttttatgatttcctcctttttggcatttaacacaaaactttatgattacacacaccacgcactccagaaatgcttaaaggaagatgagaggaaaattcaatagaagtagcaggcatttctgtgaggacagcagaatgatcacttcatctctgtattttttttttttcaaatttctgtatctgtacaatgtcttttccagctctaatattctgtgatttggtaatttccgcactcagattttctttaatgaattttgtatgatattacctatttttataccagatattacctggctctaatttctttttcaccctaggaaataaaagtatcgggtgaatttcccattttcttatgttattgatacaggtctctgttggatatccccacgattaactttcctgcagcatgttcgatggtggcttaaagaagaaaccatgtatcagagccccttgtctatatagacttttagataaagagaaatacatatcacagaattattctgggcgcatagagtctctaaatgcaaaaaaaaaattgtattgtagctgttgattcttctcagatagattgagtgtagagagagagcattccaaaaactgagcagaagaaacacagtctgaatcaaataacatgaaattttagctaacaagtaaataacacttttttcagaatatgcaaataatattggtttattatgaaaaatgtataggctgatagatgagcatagagaaaaaattataaatatcttctttaatatcactttccccagcaaaccacttttaacattttgatacattttcatgttcaaacatttcctaatagtcttttttcctgttatataaatatgaattttaaacattcgtatgtttatgaaaaggcaataagatactgctcttttataacaggctttctgaacttcacaacatgcagtgtattctaacatgctccttgtgttcttaactaataaaaaacctcacgttatttaaaaaaccatcttaaacataattatccattaagagaagaggttggggtagagagtttcagactatcaatatcaaagttatattttctgtaagtattttaatttttaagtgtagctataggtatatgattataaaaccaatagcagagaaaagataccacctttgaatatagttttccttggttccatgaaaatggcctcctttctttttgccagtccctcagtatcattaactcatttttctgtaaatgccatcattgtatcacatgtcctcaggaaaaggcacttttctcttttaagctagtgtttgttcttgttctaattttatggcaatttaacgagtaacaatcctgtttctataaatactgtttcctaattaatctattgcattctatccatgagaatttagatgactttctttgtaagagaaatctctgtagcatgagattcttctttgctcttaaatttcattctttcacatttttaaatgacctgatagtattttgttgtatttgtgctgattttttttaaccaatcttaccttgttgaacatgtaagttgtttctaatatttgcaatgatcaaaatgtggatccaacttcactaaagcgttaagaatctaaaacaaaacaaagaacaaaaagttggctgtcatcttgcttggaccaccccgtgagttactattttcttgtttccggtcacagttcatcctaaatcatttcagtacacaaaatgttttttaaagtttgggacagggggtagagaatgtcaattattcctccaaggcagtcatatgagcattgagtatcatgtggaatagttgttacttgtaaagttatggggcatcaaacccagtcaatatgtttctggaattgaaaaagtccctggacattctaatgatactgttgttcactttgcacctactgttaccactactttgatctgtcaacactgcccgtaatggttaattttgtgcatcaacttgactgggctacaaggtgcccagatatttggtcaaacattattctgggtgattctgtgcaagtgttatcagatgagattaacatttaaattggtagactgagtaaagtagattgcccttcctaatgtgagcagacttcatgtaattaattaaaggcctgaatagaagaaaaacactgaccctcccctgagcaaaagggaatcgttctgcccgactgccttcaaactgggacatgggctttttcctgccttcagactttaaccacaatattagctgttcttgtatctcaagtctgctctacttcgattggaactacactatcagctctctcgggtctccagcttgcttgttcaccctgtataccttgggagttgtcagtctccatagttgcctccataattgcatgagccaatttcttaccacatacaaacacacacagagacacacacacacacacacacacacacacacacacatataattatatatgtgtgtgtatacatattctcttattccttttgtttctctaaggaaccctaatatactccttattactctttctactgccttagagatcttcaaggccaagagcgtaatcctccatcctggctctttttcctaatcattaatgatcaactcatagccatttagctcaactaaaaataatttgttcatgaagctttacactcccacatactgaggaacgtggtacctaagatcaaacagtcactgcctcatcaaatgcattcctcttcaaccccatacaaatgtccccagatggaactcacaccataaaaatattagatcccattgacttttctgctttctcaaggatcattgcagagcttgaaaaagatggctcctccctttgcctaagcaggttaacttggtgtaaaagtacatgtaagatttggcacaaaggaaaataaatcagttttgcctgggtcctaagaaacatttccctctgcctcatggtaattgtacctgccagttgattgcattactcaagtggagaccatgaagtgaagtggtagaacaagaagaaatccctataattttattaagtatggtgaaaaatacagatatgtagagaaatgactgggattagatggagcaaaacataattcgagatcctgatacaaattgtacttcctggctcaagggagggagcagaacattccctgctacatgggaataataataaatgcctgataaaaatgcagatatatcatagactacagaagctgaagtggattcttatggtcccctactcagacagcctctccttcagatgaagaaactgaagcacagaaagctcatcctagtgtttcatattgaaaaacccattcaagtctattttaataacctgttaccaaaaatgagggaaataatttaactttaatgtttcactttgcattacccttttcctgactagacttctatccttttcttgagttgagctcattaactactatgaaattatggttatgggtagaggttaattttatacctgtccatcttctggcatcttatttacactaaaaatcatttttaaatggcttcattttaaaaaatattatttcagttgacattttaaaagacacatcatttatgtactacagaatatgcattttatactctcctttattaattttattattttccaggtagaccaatcaaatgaatcagaaattcttggttagatctattagacagcataagtatgtttttcatcattaaattaagatgaaaacacaattttactttaaagtgtttgacgtttccagcctttataaagtcaacacttaatcacatctgaaatttgcaggaaaaaattttgaaagccttcaattattaacattatttcgggagaaaaagccactttgccgcagaactttcacttttctctcgtgaattaagtctgatacaaattattcattatggtgaagtttaaacataatagagtctagctacttccacaaaaatactattcaatgagtttctacattgacatctaactgaccttgtaattaatgttgtacacgatccttttattatatgctggattatcaaatatgacttattagcagtataaagacacaaagttctgaaatgtaatttatagccatgaaaaggaactgagctttgtgtgacagttaaatttgaagagatcaggtgattattatgaagcatgaataataatgcatattaaactcacgtttttgtttaaatcattaatatgattgttttagaagaaagtctacctctatcatatgggcaataaaatgtgtataagagcaaacatttgtgtatgtgaaataactcaaattaaaaccagttttccacattaattcttacagtttttaaaatttaaatcatttaatgtatcacacatagctttattcattttaagctataaatgttacaatttctgtttaagctgttaatataagctttgtaagagcaattctgtataaatatagaattgtcattattcactaatagctaccatttatttagtgcttgttgagtgcaaaagtactgcactgagatctttgcatatgttctcttaatgttacaattcttacctgaggcatttctgtttctgctggaatatggtctctctgaattgaacaagggaggcatttttggttgttatgatgaaaggtggacactgctggcactaacgtgtgttggtaagcgactagactcttcatgatgcgtaaacagtgtttcctcatacccctgcacattcaaatagaggaaaaccttgtttatagttaatttcccctagaatgtaaatccatttaacatataaacacaaagcgtgttttgtgtggatgttttttactggagcagggagacaggagaggaaatgcagttttgatagttgctgaatttttcaagaatgcagcaattatagaacaatttctagaagtttcctaggagctcttttccatagcagaaaactaggacttaatagccttgcgactcatggtacttgagtgttccatacaactcacctatattcaggggacatttgaaaaattctacattaaaggggattcttaacataggcgcaagtgtctggcatcttcaataggtcttctggtgtggccatgaaaacattcacacgtttcaaagtattttaaaataaaataaaacatatattgttgtgttatgaattattttctttcttttttatatgatggttagatcactgtgcagacaagtttatgagatctattcatttcatttcagggtggtaaatgagggtgttactaaatgttggttctaaaaagggagacattgggtattacagaattcagaacagctctaagccctgtgcacatttagcattagaggacacaggcaaatctggcctccagtcctggcagcttcttcactatgtatatgatgttgggtgggttgctttacctctctagtttttacttttatttctaagctagggctattcatagttctttatcatgtggttactgtgaagtagcaaagcacctgacataattagagcagataaaatgctcaacaaatattgcttatcagaaggattatgtattacctcccgaaatacatcaaaaatatattttccaattcaaagaatatgtagtacaaaaatcatgcctaaattaacagagttgcagtagcccaaggagagaagataatcattattgatttcttcttcctttttgctaagcagttctctgtctctgcctcctcagttgttgtccatcccactcccccactcccaagccctgaactctgaggggtttgctgccgtggccggttctgtagtcattgctgtccaatgatgaaaacacaaaatactgcaacagaacactatgcctgtcagcttagctcccttctttctgctaaatgacactcaatcctattcttttgttctaaaggatatcctaaatgaatagccactggggggaaaaaaggttatataagattgtgcactgtgtgaaactgatgcaaccagatcaatgatgtgaatttctcttaactatttactgggatctagaaacaggtctctcaacttagcagtgtttacgaatataataggccttccttatacatacatctgaagccaatctgagtcaggaagagtcgtggtctgataaatattttgaaaacttgcatttgttctattaaagcaaactgtttattaatagtgtgccttattttttaaagcaaaacatttataaacagtagtcattacaggcacttcagtgtacggagtgatcaattgttagacctttaggaatcgattgtttcgtggagcttcggcttataattgaaatgtcatcagaaggagtgtaagacatagcttcaggagaggccatttatgcgcttttgttttcagctaagttatagagtcatcatgtgaagaaagattcttctcttagtaaaaatcctttaatggttggaataacacttgatatttaatatttctttctactttatatccacatttattcaagtgctaacgcgtgtggggcagcaatgaagcactttattccaacattatagttctcatatctgcgtatgattatttttcatttatcgttagcatatatataatgatgacttttaaagtacactgtattatattcactggaataatgattagctattaataatttgaacactatccaggaaattactgaacatgtcctacaagataaacctcgtatgatattgtctccaaataacagtgctaaccaagaagagtgctaccaagttcaaaagtaatcacagggagtaacctaaatgcagctccgttgggttaaaaatagtttctctaaattatatgttccctaagtttgagatcgatttctacaaggggataaaatgtttttataaattctcagtgataagtcatgtgattaagaacccccaactttttttccaaagacatttgcatctctgatcaaaataacaagatccagtcttagttataaattggggaattttcatcaaaataaggagctactcgttgcataagaagactagtacaacttaaagccaatttaatttcaatgaatgcatgatcagctccattgccaattgagtgtttttcttattcatcagaagatgggttcatcatcgtgtttcatatcaactgttctcaaaccatattgcccatttaaataaatatagatttgtctcgaaattctaaattcatgtcatatttcataaatagcctatggtcctatttattactttaaaatattatagatataatatttttattctaaagtaactgtgttatacaaccaaattattcatttaaatatgtgactttttaaataagtaaatgacttatttaagtaaagtcattaaaattttccagtctgtccttcatccacctgatctttgaatgagttaggaacaatacaggaaactaatacaaacttaattttgattacaaaagatgaaatcattctgttatttattcaacacactatgtgtcaataaaatcttatactgtgaaagaattcgtctaagtccatttgctgttgcttgtaacagaatacctgaaaatgggtaatttacaaagaaaaggagtttacttcttacagttacggaggctgagaagtccaaggttgaggggccacatctggtcagagccttctcccatccaagtactaaccaggtcgaacctcacttagcttccaagatcagataagagtgggcgcgtttaggctggtgtggctgtagacttgttagagcctttttgctcatggggacacagcagagccctgaggcagtgcaggacattacatggcaagaaggctgagtattctaatgtgttcatgtctctcttcctgttcttataaaatcatgaatcctactcccatgataacccattaacctattaatttatgaatggatgaatccattcataagggcagagccctcatgatgcaatcacctcttaaaggcacaatctcccggtgctgccacgttggggattaagtttccaacacatgaaatttgggggacacatttaaactatagcaaaattgtaataaaatgttatatagaagcaatgttcttactgattataattgttatattggtaaagtgttaagtcctctaaccaagggatatatttcagcttattataatagttttaaatttacaattcaatatgaataacatctggtaaaagttcttttcaagaaatgggaaaattagaaatgtttagaagaaaataattcaataaatattaagttcaaactggattcatagtttatgtgaaattctgggaaccaattgcaaggggagaaaatagttacaatagcaatggtgaggatgagaataagagcaggtatcaacgttaattgagggtgtgttatagttctaatcgtgctatgcccactacatgacttttccctgtgtgaggtttccgagcttcttcgtagtaatcctaaattgagctggagagaggctagggtaacttactcacgctcatagagccatagagtagtaaaacctgtatttgaactctggcctgtctgacatcattctgtggtcttttaaaccaccactgcttctccatattaaaactccaaatctaggtgaaaagaagaaaactcagaacatgttctgcaacaaaatataacaaaatataatgtatataaacacttatacataatatcactaatatctttactatgaaaagactctgatacgaacattttacataattcatgcagaagtgttaatcacattgtctgtgatgagctgtgtatgtatctgataaaattctggcaaccagacatcaactcgtaggcatagatctgtaacactaaatatttgcctcgagaaacttaaagaaataaagacaaatgaatgaataggaacatggaactgagtacaagataaaatcctcctaaagcaatcgatgtacttgctgctgcgttattgttctaagcaaaagaagcatggcgaagggagatgtgaagctaaaaacagaatgcttagaaggagatgatagcaggagggaagcaaagatgggaccaagctcccaaaaggcgggctttgaacaaacaaaacagaaagctaagcctttgacggatgcacgggatgcaagaaactttagtcaggaaagaggaggcgaagaaaaaccctccaaagaaaaggtgaacaatattttaataggcaaattgacagatagcaagagatatataccatgctatgttttctcattgcagctgaagacaaactggggttatttatgctttgaaaaagcgtaaatctaaaaaacaattgtggaggaagaagcgatgaaaacacgtgttaatacagaaaacatggctccaaggctttaaacttccttgtgagataaatgcatttacattttccgtagtagctaatatatatatatatacatatatatatatatatctgggaaaataatacacagtgattttctttctttttttcatctacttatgtgagaaaaaagtaggctatctgaaagcttttcagttaaatgaggaagaaagttaggtgatcttgtaaataatatatatgttcaagataatgtaaggcccttgtgtagttttcaaaacttatctttaatagcagtttcttctggggatggggtagttcaaagttgaaatgttagaaagatgttaactttttttcctttttacttctccctttcaggatggaattaacaaatttgattacaaatagatctcagagagaggcaaatgcattgaatccagaagtaacataaaattagatcatgtttagttatgcccgaggtcacatggtgataaaaatgaggataaactgaaattgtctgtgagccagattagtttattttatgccagtcctaggaaaaagacacatcatggtaggatacatcctttttttttttaattatactttaagttttagggtacatgtgcacagtgtgcaagttagttacatatgtatacctgtgccatgttggagtgctgcacccattaactcttcatttaacattaggtatatctcctaatgctgtccctcccccctccccccaccccacaacagttcccagggtgtgatgttccccttcctgtgtccatgtgttctcattgttccattcccacctaagagtgagaacatgcgctgtttggttttttgtccttgcgatagtttactgagaatgatgtattccagtttcatccatgtccctacaaaggacatgaactcatcattttttctggctgcatagtattccatggtgtatatgtgccacattttcttaatccagtctatcattgttggacatttgggttggttccaagtctttgctattgtgaatagagccgcaataaacatatgtgtgcacgtgtctttatagcagcatgatttatagtcctttgggtatatacccagtaatgggatggctgggtcaaatggtatttctagttctaggcccctgaggaatcgccacactgccttccacaatgaacagacacttctcaaaagaagacatttatgcagccaaaaaacacatgaaaaaatgctcaccatcactggccatcagagacatgcaaatcaaaaccacaatgagataccatctcacaccagttagaatggcaatcattaaaaagtcaggaaacaacaggtgctggagaggatggggagaaataggaacacttttacactgttggtgggattgtaaactagtacattcttaacatcaatttattcctaaaagcaatgttcatagggcacactgtaggccatagatttgcctcacaaatttaaaggcctaagccctcaacatgcacagcagtatactcagagactatttgtaaagatgacgattctggaactttttaatgaccccaatcattagcaatgattaaaattaatattcaacattctatatttaccaaggcaataaagtagactaatctattttaaaagggttttaaaatgaagagatgaaacaaaccaaatgattttgatttaaacttcatgaaaacataagttgcattaatcaggtgattttgttttatgagcattctgattgaagtgatcatatttagccccgggagaataagagaaggtaaagtatgggtatggcactgaatttactgagatgattatattgtttgagttaaagaacttgtattaagaaacaagtatgtgccaaacattgtgctaggagcaagcaatgctaaaattacatgggtagaaagagagaatgaaatatctagaatgagttagaaacatcagtgttttccaatgtggagccctgacttcacatgaaaattctcattttcaaacaaggtagtttatgaaaactggactattagcaagacagggtgggcatgccatcagtatagtacctggtgtaaaactagaaattttaatcatttgtgctttcattttataatcagtaaaatccaaggtaggacaaacttttactttttctgtataatggactgatatttgaattatacccaactttaattttttgccagaaattatgctttattgtttctctaaaatggtactatagatctttatttatttctatatatttatatgatttttacatatatgtgcatttacatgtatatacatccataaactatatacatatatacacataaattacaaatatgtgtacctacgtacatatatatgcatatatcacgcaaatacaggcacattttcaatacccctttttgatttttttccttgaagagcatagcatctgaatttattatggatttatttttaatttatggtcatgttctttgagtgcttttggtgtttatctggttgccccaaactcgctagcattgtaaagaagatgtgcaaagcctgaatctagactgactttcatattgactttattagtcaaaaaaagtagatgaaaatgtaacagtccgtgttaaaaatgggaataagacagatgttcaagccctagcttcagcagtttttagctgagatttactggaagaaaacattttctgaactgtaaaacatgcaaaatgcctacgtgacagacttcattaacattattaaatgctatgatatagtaaaagaatttgtaaactgtcaagtgctttgtcaacattaggaatttagttattataggtatttccatatacatgttgtatttagaattccctttaattttatacttagggttgatttgtattttaactaagtcactttatatatctggtcccattatacaagtatacttttccttaggataagaaagtgatctttatatatgtttatcaacccaaatgcccatcagtgatggactggataaagaaaaggtggcacatacacaccatggaatactatgaatccataaaaaagaacgagttcatgtcctttgaagggacatggataaagctggaagccatcatcctcagcaaactaacacaggaatggaaaaacagacaccgcattttctcactcataattgggagttgagcaatgagaacacatggacaccgggaggggaacatcacacaccgaggcctgtcgcgaggtggggggcaaggggagggagagcattaggacaaatacctaatgcatgcggggcttaaaacctaaatgacgggttcataggtgcagcaaaccactatggcacatgtgtacctatgtaacaaatctgcacgttctgcacatgtttcccagaacttaaaatttaaaaaactttaaaaaaagaactgtagatactgatccaaaaaaaatgttcattaatgggggttaaatgattatttctaagtagactactcttgaacccttgaatctttaagaattttctttgctattgaagccattcaaactctattttattaaagctgtcgttattctagtagattttaaacagtaatacctgaatacattagaaatatgcaaatctgcattacatatggcatctgcagagcagaggagtttggtcatctggactcatgctaaagtctccgaaaaatccgcttgtcttaatgatggttgactcgctaatgctatgcgtatatagtcttattttaagtgattgaatgatgtggctaataacccctctgttagatgcactcagaacctcacctacctgggtcctcagctctccagtgaaatctctactttaagtttattttctaacatggtaagagccttcagtttatgttatgctcaggcccgtcactgtgaataaaatattagaaatggactttttttttttgtatttttttaatggatcccttggaactttaaaaaaattatttatttgagctttctactgttatcacagtgtctcctaagcatggcctcccgttttttgttggtaatataattcttacgttattcaaattagtaaccattatttttctcatggctagaattctggaaactattaggaaatcactgagcataattgaatggctgtttatttgaagagctatgtcaaggcagcatagagttgtattttcttgcaggggctctggagtcaaagagcctgggttcaaaccttggctccaccactttctatctgtggggcattgggcgtgttacatttgtgaaacttttgtttctccatttgtaaagtgaggtttgggggatgattaaaccagataactcatgtgaaatatttaatggaaatgtatttggtaggggatttattatttttaaatttggattgcacatgacacatgtcagggatcatgctatgcattttggatagaaagatggctaagatatcatgcctgactcttaaaaacttacctaatggtaaatgacgagttaatgggtgcagcacaccaacatggcacatgtatacgtgtgtaactaacctgcatgttgtgcacatgaaccctaaaacttaaagtataataaaaaaaaaaacttataatcaactgtagtagaaagagatctgaatggcttgccatttagctaggcacatggtatatgtgcttaattcatactagcagccactacagttgtcatgattaataatgagcttccaactgcacagaatgcttttaatccatagaaaatcaaatcagaaacaagtttttgtaaaattaatgtgaaaggagcaacaattaaaatgcaagattgacatttattttctaaattggttctattttctttcacatttacaaaatttataagaaaattctttatttctatgtgatataaagaactagaatgtactttgatgtgaattattgttgccagtgctgttcaacttttatccataatttactaagcacctacatttagacaaaggcattatccatccctttggggaggatttcagatgattcatacacagacctggtctcgaggaatttaagattttctttggggagggaaataaggactttaaccaactcaagagtacttagagaattttctgaaaataattttatcaatgaaaacttgttatattaaaagaaactgtcattctgacttccacaaatctaggcttgaaactatggataacgagatattttctattactctcactcacgtcattttcacaaagtgaaaaggtacattttaactagtgaaagaatagaggaaatggaagtagctcgaggcagtggacgatgattcaaaaagacagggccctattatttgatcaagttatgcaacgactctgggcctgtttcttcacctctggaaggaggaataatctccaagccctttcagactcttttggtaattcacctccagcacatcttctaaatgccagcattaactgtcctctgatttgtctcatgtttttctagccccatgctctcctgttcgccatttaccctcatgcaaggtacaaattacacccatcatcacaagacacttgctcaagtcccattgcccccttgaagacctgccacacctactctctcaaaaaccatcatttcctgaaagtcctatacagctcatttggtatttacagtgtactgccacaagccactaagcatcgttttgtgaatacatgacttacagacttagcttgagtaaagatacttgaaaatgaacaccatttcttggctatcttcctattttgatgtacccttcaggcctatgaattttagtataatagataaccaataattatttcttggttctttcctgcacatctgaataaccctatgcaaagtgatagaatgtttttctataaggaggtcctacactggagattgtgtatttcttaatgctgttgaaggaagagatgtgtatctaaaataaatagactctaacaaacattaatttatatttctattatctgttttgtgtattgagatatctcacaaaaataactaaacattttggcattattgatattacatatttgccatgaatatttgtaaatgaagaaaaatatatatacatcagtaattatcttggcaaactcttcaattatgcaatattgttacatagattacatatctaagtgaacactggagttttaacaatattgtgtgttcataaatgttttatttattattgccactaattcttattgccatttcaagaactatgtataagttgttctaaaaactattaaagtataggtgaccatggtcactactgcctactttggtaaaggccaaatatgtgaagactttttaatgtgttaacaaacgttgaaggttttttaacctgttaacaatcagtaggactcttgaaattatttcctaagagagtaaattttacaacttgcaaagcatgattaacctcttgtaattataaaccatctcttgtagttatgtagcattttgttaatgagcaaagaaccattgtggttcctttttacatttcttaaaataattctccgtaacctcattgatatctccagtaaatttagataagcttttttttttaaaggagggttaaaatgacattttaaactaatttttcttgttagttatacagagttgaactatctgagggttttattgacagtcataaaaaatttgttattttctgtgaaatatagagaatttaattcattatcatattattaattctgtgggccattgtcttaattctagaggcacaagctgttttcatcccactgaaatagaggaatcaaagtatgttccttgctcaaagcacaaaagtgacatactacatagtatgcttcttgagtagtcgtaaatctcatgtgttaaattacatcccaaagatttcagtatgttttatgactttaataatttatggtaatttctaatctggcctttgttgacctgtcttgctttttaaatttttagtttttcgacaaaataattaacatattttaataatcttccaaaggtgtttaaaatggcattgtatagagatagctgaaggcttttgagcttctgtgttgtaaacactttcttaataaaacatgaattgctaccagatgatccagcaatcccactactgggcatttatccaaagaaaaggaaatcagtatctttgaagagatagctttgttcccatgtttactgcagcacttttcatactagccatgatatggaatcaacctaaacgtccatcagtggatgaattgaaaagaaaatgtggtatgaaacagaaattgctgctttaatttatattaaacacactcatattcttctcagctgttaagtattgagttatagatttaaagaattctattgtgaagactaaagtgactattaaagtaagaaattattttttccattatatttaacttatttcatactttaatgttagcgccaatgagcaagactattgaatacaaaaactaattaagtagtggtgatagtacagtatataagggagaacattcttttagaaaggaacaataacagggagcaatagaaacaatgaatgagtgtaaggtcacttagtgttaaaacagctaaaatatagtacaaataagttgcgttttaatagtgattttatataattacaccttgatgttttatttgttacaagaattgtccaggaagatttctctaaagaccaaaggcactcttcccctaaataactccaaagccagtcctgtgtttctataaaaaaaaaaaaaaaaaaaaaaaaaaaaaaaaagtgaaaataacgtgatgaacatttttgaggaagtataaaaccaaaatactccactgcatagctgtttctgcaggtattgtattgatatattacattattcagctttggagtctccacatccaatgttacatcatcactctaaattaaacatgtatagataaatgaaataaatgagatagcatatgaaaatctcatagcccagcccctgcactatttaaaatagaaataccaaagaattgtattcctcatctgaaagctatttagtggtggtgtttcaaataaaaattccatctactgctgttgcttccattgtatctttttctctgcggtactgaaagagaaagagacccagaaggggccttgtctgaagtgtccctcttttaagctgttgctgctttaagcacagggtggacaaatgtaataggagtttcataaaggtggaataaaccagcggattacggtgtgggtgaatactttcagatgttaaccaggagctctgcttgcatgctgggagttgcccatgcctcttctagattgaggcacattatcatgcacaacctaactccaagaaatcttttaaaccactggaaattgaacccagaacatgtctctaagccagccttttcatcctgacaccgaatcatagcatgagccagtctgtcagggatgctgctgctctctaggcaaattttaaatgttgaaataatgaatcatgttttcttgaaaaccatgtacaccaaagaaaagttagtcattttatagatgatgaatattaacattttcttagacaatctgataaattatcagatctcacttttggctctttttaagacagttatgcctcagaaatattaataaacccccaagcccttatactgatcagtatgttcactactagctatgagaaattcttgaagttcttgtaattattgtattatttccttactttcattttattagtatgtgaataatatttttaaaaattctagtgtatgtcttgtatatattttaacaacatgacttttaattaatgtcttgataacatttcttctagtgtatgttttcagtaacatgattattaactgtaactttaaaaacctgtggattagatgggaccattttaaaatgttttaaacctggaaaatctgatggctttaggtttagttcaagctatagatcacctgtggagaatggaactgccaaaaaaaaaaatagctgtagcagccctttgagtattctaaaatagggatgttatccagagcattggtttctaaagcttccattatttattgatgttgagctttcaggatttagctacaatatttactcaacatctaagccatgcttttttatcagtcatgttttatatcttttataatcaaactgcttatcactgaaaaaaatatataagtttctatgtatctggaagaattctctggtgtttcttagatatggattttgatgtgtggaataagaattcaattcaaggataacagagatgttgtcctgaaaaaaatcgaagaaaatcagcttttctttaacattctgtcaaagctcctgactattagtttatcagcactgttttgccaaaggtgtcttctcttctcttctttgaaaaaaatcatctgctgctgctacgccgcaagtgtgttcccgctgtgcctgagaagatgtgtggcataaaaaaatgggcatggcctgagttaaaagtgctacatttaagccagagctggcttatttattagttgtctaatcataggaaaatgacagagcatgcttttctcttgcaatatccgttgctgaaaattaaacacatgagcagagctttcagagaggttgactggcctctcagacagcacctcataggatggcctgtgttgaagcatctcctttaaccagggtctgtccctcagcattgggttggctcacctagattggattgtcccagcagaaaaaaaaaacccaaaattcagaatcatatccaaaccggaatactctttcattcacattacttgtactaccttttcagaaactggatacctgagtgtgtgagggtaacttagaaacttatctcatggttagaagttttagaattagagagcgatgatcatgaaacggacttcatgatcagaagcaatggagcaaggaatgagatgtctttgaggagtatttccctgaggctgtggataacgctgacgaataatccccaccttaaaagtgggttgaccactctagtagctgtaaggtgggagggttctttcttcagagataaatctgtgctcttcacttgcccatttcccaggttttcatgtaggtagaagaaacacctgtaatctgaagacactcttccttcagctttgttagtgacagggatttaaatatgtctttcacacattttccttagatagttaaatttcacttttcctgtttgtttttctctgaaggtattctaactcccctcctaatggacttctagagctttctaattctatgcaatttctgttgatttgttctggtaaactttgaaggtaatctctgattcaacttcttggagattctatcatgtcatctctgtttattaactttatgttactcatggtttcttgatgaggactcattaaacataatgtaagtagaaaattattaactacataatatttactacgggttgttatttctgatagtagctagctgtaagattccaattgttcttcaaatctttgtctcagtgatctctgtgtagttcttgactacttcaaataacttcctagaaggatagggatttaataatctcttaataggaacacttaacacactgctggtgggaacgtaaattagttcggtcgttgaaagcagtgtggtgatttctcaaataacttacaaaagaattaccatttgacccagcaatcccattattgggcatatacccagaggaatagaaatcattctaccataaagacatatgcacgttgtgtatgttcattgcaacactactcacaatagcaaagacatggattcaacttaaatgcctatcaatgaacagactgaataaagaaaatgtggtacatatacaccatggaatactatgtggccatgaaaaagaatgagatcatgtcctttgcagcgacatggatggagccagtggccattatccttagcaaacttatatggaaacagaaaaccaaatactgcgtgttctcacttataaatggaagctaaatgatgagaacatatggacacaaagaggggaataacacacactggggcctactggagggtggaacacaagtggagggagaagatcaggaaaaataattattgggtactatgtttagtacctgcgtgagaaaataatctttacaccaaacccccgcaaaatgcagttcacctgtatagcaaacctgcacgtgtacccctgaacctaatttaaaagttataaaataaacgtatcttattttcagtacaatacaccacagagtagaagggttaaaagagattgcttctgaggaggtgagatgggggtaaggacagcacaagagcattttggggggtgatgaagctgttctgtgtcttgcctgcgatgatggctacacgactaagcccttgtcagaactcacagaactttacttcaaaaggagcggattttactacacatcaattccaataacaaatactttgtctttaagcaaagggatacctaaatatagcgtattgaatggatctccagaaaaacacatttttcagttcatgtttcagcctaggcctcatctcatccaggaaaccttgtcttgcttgcctttacatacatgtggcaatcagtagtttcttttagggctcggactgaacactcaatgaacttcaatcttagcgcttgtcgtagcagattgacatggtttatttatatgtgtcattctctgtagtaaaaggaaaggatcaaggccattcacttttgtagtgattgtgcatggcagtatttggcacatagtagattattaattatggaacttctgttttcacacacacacacacacacacacacacacacacttcagagctattttcatttaaatatttgctttagtctccaaagcccctctgcctcaacaccaacccttctatctcattattcatcagcttttctcctattacgaaactacttaggaaagcccacttatttagcttatgatggcaaaaataaatatttgtacttttttttttttttttagtcatcgcttcatagaacagcctctgtcctctgcttatgccatgtctgaatatatgctggaggtaaaaagagttcctggttgagagcttcaatttgagaaactatctgagattactttccaggttccaccgtggaacctgtctgaccttgaacaaatgacctcgaacaagtggctgaaatctcttctatttcgtcaactgtaaaatgggggaaaaccatgtctatctcatggggttcatgtgaaggttaagaaattgcttattcagtgtttagcacagtgcctgatatgcataaagctcctaggaatattagctgttattgtatttccttaaagaagcccatagctctatatgccctttcattatatgttttagtagcccaatttaacatatggataaaatatttttaagttaaatgatttgctaatggattgttgaacgagtggcagacacccatattatagacgaaggtcaagtccataacatacagtacatttccccactttcatttcccattaccaaaattcattattctcctgagaaactcattatagaattcatgtcagattcatctgtgtgttcccagcagtgccttatatccagaaataacactgagtcattgtctagatgtagcagaggtggaatcctccaaagagaagcctcagagtggccaggtttgccaagtatagggatgccttgattactggccttactctttatgctcgtgaattcctaagttttattcctcctgtagtcatagattggcttttaagctacaagctgaagagagagaaaacctcttccacctcgttggaatatgtctcttcaatccatttgagccaatttaggacatgagactgctcttagtctagaaccagtcatcaggagaattccaggtctgattgactcggactagcgggtcaatatcagggcaaaaattccaacgcacaacacgatgtatcagtaaggagaacctcaaaattatttcttaacgtccagatcatgttcctatttttatatatctattttctcacataagtcattaaaatgatgtacctgtgcgggtcctttaatgatactcaaagatcttgaattataggctaataactaacttaataagctgcagaaattaacatttctgctacgtttatgtagcattttcccacatgtacttcagaggcttgagaaaagaccctgaaataatgactgaataacagctttactcacttaatttcaaatttgttaattcttctgggaaataccgtcaacatccattttattatttttctcaattacatgtacgtttctacatcagtggataagttaaggagaagaattccctcatgataattttttcatgctcgaaaattttgaatcaattttttattttacattatactctttcctagtcattagaaagggagtggtggttaagataggcaagaatgctttataaggatactactctcgtttcaattcttaacatcaaaaaccttaacagtgtgtagactataaaataaaatatctagggatcagagcattgtgctgaactttgcaggttttttagtcaataatatatatgacgtgttcacagaattctttgtcaacaaagtacttttggagctccaggccatttaagttggtttttgtactttttctttttcttcggaagactttttttgttctatttacctggaagtgtttcttttttggtactgtgaattaaaatgagaccaatctactaggcaggaaaaaaccttaattagattgttgacacagacaaataagaatgtcaattagcatctactgtcacatgcctctccagactgcttctaggatgagtggcctcaagcagctacatcatctttatactcctaaagcatcaaggaaacttggagtgacaattcatatcatgaacacatccacagtgatgatgattgtgcttcttcccccccacccaacaacaaaggatgaatgccaattaatgtattcagttttttgcgtcaaaggctggatcacttgtgcaatgagggtaatcatcctgaccagacaggccatacaatccatattgtgtgaattaaagataatatgcgtgaaacaccttactctggatgtggttcatagcagtagcaaaaagatgaaaactatggtatgctaacattttagagatctgtactctattttaaataattttataaaagtgcatatacaataaaaagtgcacgtatcacaagtatatgcctcaaaatctaaagccagtcatgtaatcagcatccacttcaagaaagaaaacaaaacagtacccctggttcctctttgcaatcattagtctcccaagagtaatcaccgatctgatctgtgacagcatagattggttttgccctactatatttttgctgaattatacaatatatgctctttaatgtctggcttcttagtgcattgtatttgtgtatcagctattctcttgtgtgtagttattaaacaatcattttatgggctgcataatattccatagggtaaatataacagttttattgataacttagctattacaaatagtgctgttgcagacatatattctattacatgtcttttggtataagaatttacacatttcacatgggtgtatacccagaactgagattgctaaatattggggcacattgtatacattttgatttagtagataagatattgccagatatcgtaaatgcacagtttgataaatatagagatttatactttttctagagaaaagccatcaatatcagtgtatgtgtatatatatacgcgtgtgtatatatacgtatatatatacgcgtgtgtatatatacgtatatatacacacatatatatacgtatatatgtgtatatatatacgtatatatatacacatatatacatatatgtgtgtgtgtatatatatatatgaaacaactcagaagcagaaagataccccatgttctcacttataagtgaaagacaaataatgtataaacatgtacacatggacatagagtgtgtagtgataagcattggagactgaagtgtgggggtgtgcaagggaatcagtgataaattaatggctacaatgtacataatttgggtgatggatacactaaaaatccaaagttcaccactatccaacatactcacataataaaattgcacttgtaccccttacattcatacaaataaaaaattatttaaataaaaataaatatgtgtatatgtatgcatacatacatatgcatatacatatgtgtttgtgtgtgtgtatataacttacacttaaaataagcatggatgctgcaatgaatgctcaatttacaagggttgtccatccaaacttgtggcaagtatctcacctctcaagttgttttcttttttcttcatatatttcttgcttttgtctaggaaggaataatttggcttgcctttcaagagtgtacagtcagcatgataacccaaacacttaagacacgtgctaacccatgtggatcccttgagagaaggaaaacagtggtccttttactgggcagatagagcccggggccaggtttcgtggcttgaagatttcagcttctctgcgcctctcagctcagtgcctctggaagcaatttacaacttgtgaggccatactcaaaggccctgttattaattccccgccttccgagaccccatttcagaggatctcaattgctctcagagtgaatttactgtttcctgaattccgtaatcccaatagcaggtctgttgtcctcattagatagcttaagttagagtcggcagtgtaattggcaactgagctactaagtatccaatgcttatgtggaaaatatgttccctattgcaaacaactgatattcatattcaatttggcaccatcatctatctataaagcagatactacttgtgtttattaagttttatcccaaataattattttagtaataatgcttgaaaataggccttggtcatttgcatgtctgtatatggcatatcctgagtctttgtatgtattagaaagatcactcgttttgacttgatggtttaataaaagatgtccctcactttgggcagagacatttgaaaaaggcactccaaccagggacctaagaggtgaatgagatgcagctctgaatcaggtcacacggcctcaggaaggaaacatcttggttttcacatccctcacttctcgatgtcatgtgcaatacacaaatgacccctcaacacacacacaggcacatacacaaacacacactcactcactcactgtattgtctctttccttgactaagtccttcttactaactcaagctctaaagcttttttacttacctaaggtgagtgtgtgaggatttgaggtttcaatattaaaattcagaaacatttaaagttcattttaaatattagtaaaaaaaaatcttgacaaaatacaattatagacaaaaagaaaattcagaatatttggaatttaaggttgaggttacagccctatttatgaaatattagaagaaaaatgctggagagaataaagcaggtttatgagtctgatagaaagcataaccagatgattatgcatatatttgcatatgcaaagctttctaggcaatctgaacatttaaacctacaaatgtggctgcgatgaacagccacagaagagcaggctagaacagaagaggaggctagaacagaagagcaggcagaagttgtaaatgaaatgttaattttcaatggttgatctcccaagtactggaacagatttgtgctgttttcaaggttttggttcaaagaatccagtagtgtattgaattgttttgtggcacttccctgttattttgctttgtaagctacctcaatccatgaagtggctatgagccccttatacaacactgttgatttttttttccttatctacgcaaaagatttttgattcagggccaggcatggtggctcacgcctgtaatcccagcactttgggaggccgaggcaggcggatcatgaggtcaggagatagagaccatcctggctaacacggtgaaaacccacctctactacaaatacaaaaaatcagccgggcgtagtggcatgtgccggtagtcccagctactcgggaggctgaggcaggagaatcacttgaacccggtagccgagatcctgccactccactccagcctgggcgacagagccagactccatctcaaaaaaagaaaaaaaaaaaagattttttattcaggtggctatcagactcattaaatagaagccttaggttaagttcacgggttgctagttggaagcctccatggactatgttcataaaataatagaaaggagttatgcaggacttcttgaaatgttatttaaaaagtcagaataggctttctattacttgtctgaggtcaaatacatgtagtgctttctgaccatttcatccagggtgttagctaggacaataagaggtgcttaaaaattattagattgagtaaatgagaaagcccttagaaacataggaacagaatgacccttgctttggatctaatattgactcccacgcctaaatccctttggagaactcctttattttctcttccatcaagagcaggtataaattaaaaacaccattaaaggggccatctagctcagctgaagctttcatcacacatgtaggggaggtatggttgggagggatctttttatcctttaggtcttcaatttacataggacttttgaataatcaaatagccccaaagagctgatcttaggactagttgtaattgagactatttctccatggggtagaaaaatctagttgtaggaaaactgagaagtagatgtatgttaacctcaaaggctgttttttacaaaggatgttaaagcatcatctttgctcagaaagggagcaataaaacaaatgagtggaaataacaaaaggaaataatggccaggtgcagtgcctcacactagtaatcccaacactggggggctgtggtgtaaggatcgcttgaggctagcagttcaagaccagcctgagtaaaataggcctcatctctacaaaatagatagatagatagatagatagatagatagatagatagatagatagccgggcgaggtagtgtgcccctgtagccccagctactcaggaggctgagatgggagaatcgtttgagcccatgaggtcaagtctatggtgagctgtgctccctcctgccactgcactccagcctgggtgacagagtgagatcctgtctcgaaaacaaaaggcatactttttagatgtaatggaatagagtacttccaaacctggctgcctgctggagttgtattggaagaggttgcacgacttcagtggagatggcctagatgcctgctcagcagtcatctagttaaagcaactaagaacatgtaatatgaaactgcaaaaagagatcgtgtacgtaaaatcactctgggctcctcagatagagtaataaacacaactcctgacagccaaataaaaagagaaataatacagcccttgacttccttggttgctttgacatactaagtaggtgttacaggttgggttctctgggaaacagactctaaaacatttttatttttactttatttgttgttattattattattattattattttagacagaattttgctctcgttgtccatgttggagtgtaatggcacaatctcgtctcactgtaatttccgccttatgggttcaagtgattcttctgcctcaaactcccaagtatctgggattacaggcaagtactaccacgcctggctaattttgtatttttagtagagacggggtttcatcatgttggtcaggctggtctcaaacacccgacctcaggtgatccacccacttctgcctcccaaagtgctgggattacaggcgtgagccactacgcccggccagactctaaaataaagtttaatatgcagaatacttatcagggaatgcccactggaccaatacatattcaagagagggcttagaagcaggattggacagaaagagaagttgagctgtaatgcaggcccaataacagccttagtgttaagcaggctgagagattcagcagttaatgagacagtcaacccaaacagttttataggcatcaaaagtatgatcagcatggtgtcagtttcctgtgtcacttgtcccacagtatgataccaaaattaaagagaccagatgacatgcaacacaagcagtgtgcactctgttgttgagaagccaatttcgtcatgcaattaagcagttttatactctgcagctgtactttaaggggagctgagatggaacatcatatgtctcaccataaccagaaaggcagatgagaaatgttctatcgccacctcccacaaggtaagggacttccctaaagatacagaggtgggtggaatattgccttggtagacttcctctcaagactgcctatcttcccatgttggaaggatcacagagcatttgtcaagacgtgggtcaatctgcagttgaactttgtgtatgtggcctatgtggatacttataatatcattgggcacctccatagagctgtttcccaattgaccaaacatatgggaagcttcagagcttcgaatgacccttcagagtagtcctgagaacagtgagccttactactcctgcattaatcagtcattggatgatagccttctcagaaataagtcatgaccttgtgcaagggggctcttcatggctgggaccacccctaaaactgagagctgaaggctgtctgccaccagcccttccacctgctgggacaagttctttattgaagggaaatctgagtagttcatcagcgtccatcacagtagtcaagccgttcattcttccttcttatgacaacattgtgcttattgttatgtaatccctttccagaacattttaggttaagttttaaaaataatgcatataaatagacaattcaaatactggggaaaaaaagcttgcacttatattgttatagaaatgtgcacacttaaagagctgatttcttctgggtatttacataactttatttaaaaatccatccatttttaattagctgtttttaatatgcagttagctaagatattataagccatatattaggctaatggacatttaacagcttagttaagttcttttaatggaaatgctgacaaacctttgtctgtaattatagcaacactgtgattacagaaggaggtgcctctccttgttgtttgcagccctaaaattccatgtggctataagtaacaaagtccattattagataaacacaagtcatacttggcattacttgcattactcgtctccttgctttatttgaatcattttttaaagttgtaaaatgtttttcaaaactcagaatagtggccagttaataatatgattcctcttatattatgagattttaaaaaatagttcaccagtttctggtggcctctatacccattggcaagtcctagccattgtgaattaagtaaacaattctttatggaaattttttaatccttaaaccctataagtttttattcatcatgtcaggtcacttgtcaaagggtttaacattcagaattcaacaaaagtttatcaaacacctattacaggacgtgcaattttgggcgcactgggatttcagcaattaacaatcaagatatgatttgtatcgacatggatattacattctctcacaggagacagaaaacaaaataactagaaaatatacataaagagactttaaaatggggtaaaattacagattgtgacaggatgaccactttggttcagaatatctaggacatttttttctttttttttcccctccctccctctttcttttttttctttttctttttctttcttttctttctttttctttctgcctttcggagtcttgctctgttgcccaggctggagcgcagtggtgcaatctcagctcactgcaacctctgcctcccatgttcaagcttttcgtgtgcctccgcctcccaaataactgggactagaggcatgcaccaccaggcccagctgatttttgtatttttagtagagatggggtttgaccatgttgcccaggctggtctcaaacttctgacctcaagcgatccacccgcctcagcctcccaaagtgctgggatttacaggcgtgacccaccaggcccaagcaaggacatttttttctgagccatgttatttaaacagagatctgaatgacaagaaggggccagctctgtgatgtaggggaagaaaaatatgttccttctacccttctaggctgcccagctggagtcctacaaagttagagtgacaaaagacagattaacaagaggaaaagcctagaagtttattaaaatattcagtgcacatacacctggtagaaactcagtgatgagtaactcaaaggggtggttagaatgttgggtttatatagcatctgaacaaagaacagtaaacttgtagagaaatgacaaaacaaagaaaaaaggggtttaggtatttagggttgccaaactgtaggaaggtaaatatatgggagaaacatggagtatagtttgtttatgccaagtctatcttgagatcaacttttcgtattcttcatggccataacaatttcccaggagagagggcttatagcagttatcatttctcagaagtttctgcttttatttagacaagggaagcactgggaaggcttctttttgcttatattgattcttacttgcctctaactaaaagtaatctttatgtcaaagtgccatattttggagtggtatatattgatctcctataataacaatcaaaaggaacagtattctaggcaggagtaccactaatgcatagtgtttggtgtaaagacaagttaacatattcatggggcaacaacaacaataagccaatatggctaagacattgaggatgagtgagttggagaagtaggcaatggccagctcatataaagacttgttcgtttttataaattgtttagattttattgtaattatggtggcaagtgattggagagtattagcttcactttgactggcttatcgaaaacggaatgtagggggtgaaagtggaataaaaagaccagtcattaattgagtagtccgtgtgagagatgatagtggcttggacaaggacgattgtactggagagattgaagcgactgatttcagatttgtagtcaacaaggcttaattggtaggagaaaaaaataaatcagtgttaactctttaatgtttaacttgaataattatgatgagggtattaccatttattgagatgtagaatattataaagtaagagcagatttgttcaaaaagtatcaagaatctttatttggacatgctagtttggggatgcttattagagaccctaggaaactgaatataaatgtggattttagagaagagcttagggctggcagatgcacattaaggatctgtctagagccatggcgctagagacctccaggagaacataaatagtctcaagatcaagccctgagacactcagatgtttagaagtggaacagaagagggacatccaatatagaataccaagaattaggaggggaatcaagagagtgtggcaatatgaaagatacaaaaagagtgttgaagggagggagtaattaataaccagcatgttatgaggggctcagtataatgaaaagataagtgactattggatttggcaacatataattttttggtgatctggacaagagcaatttgaacagaatgatggatatggaaggtccagaggagtaggctgagtaaataatataaggtgggaaaatagatacaaagattatagacaactttttcaagaagttttactgtgaaggggcacagcaagctgagacagtgaggataaataatagactcaaggatggtaactttagaataagaaatttcaatctgatgggatttaagtgttagcaaggaagctttaagaagttattttccccattagaatgatctgaaaaatgttttagaacattcctcttatattctattttatcacatttatataactttcagagaattgaaagaggtattaagttattatgaaattttctgagattaataagataacaattataggatgttttcttttagttgaaatacacctactcagcctaatttttataacttcttactgaagtataatatacttcagtagaaaagcatgcctaatataaaggtgcagctagatgaatttgcacaaactgaacacatccctttaaccagcacttagattaaaaacagaaccttgatgatacctcagaggcccccttctgccccttttcagtctctccgtgctacccccatggataagcattatcgtgatttctaataccatagattaattttgccagtttttgaattttatgcaaatggatctatttcacctaattgtaaatatataacattgtcatagcaaggcactcattgccttacactgaaaattacattgactctttgccacaagcttagacttgctttctcattttattatcatcaagcctatagctttcacactataccttgttcctgctcttccctactctatttcttggtagatattctatatcagtcttagagtgcagtttgcagaacccctccatcagaatctcctagggagcttgttaataatgcagattcctaggcccctcccatggtttatgaatctgagagtgaggcagacaagactataccctctcatgcctctataatgtaataatgtcttcctagaatgttctttgctgcatctcttattaaagaaatcttatgggccgggcagggtggctcacgcctgtaatcccagcactttgggagcctgaggcgggcggatcacatggtcaagagatcgagaccatcctggctaacacggtgaaaccccatctctactaaaaatataaaaaattagccgggcgtgctggcaggcgcctgtagtcccagctactcgggaggctgaggcaggaaaatggtgtgaacccgggaggtggagcttgcagtgagctgagatcacgacactccactccagcctgggtgacagagcgagactctgtctcaaaaaaaaaaaaaagaaagaaagaaaaaaagaagtcttatgtttcctttatggccagagcacaacattgtcatgaagtcatctaaaatttcccactagaggtaacatctccttcccctgtctagctcttttaaagcattacctccatttgccttgtatcatagctgcttgtacacctgtctgtctttccgctgaggttataatcctctggagggtcatgactttgcattcctttgtgtctcccattagcagccagcacagtgccttgcatactgttagttctaaataacttctctctctctctctctctctttttttttttttttttttttttttttttttttttgagacagagtctcgttctgtcacccaggctggagtgcagtgcaatggcatggtcacagctcactgcaacctccccatcgtgggctcaaatgattctcctgcctctgtcttccagtagctgggattataagtgtctgccaccacgcctggctaatttttgtatctttagtggagacggggtttcaccatgttgcccaggctggtctcgaactcctggtctcaagcagtctgccctactcggcctcccaaagtgctgagattacaggcgtcagctgctgcgcgcatccctaaataaacttttttttttttggcatgaaatctgtaacactggaaagatgttattgccttagaataattaagagattaaatgtagaatctcaaaaacattcatttttttccatgaaaactttaccaggcctcaagggataggaaaattatgggtacagaattgagaatctgtaggaacttgcaagataaacaacggtttcacaagaaagaccttgttggagagttaaattttcagacagttgtaataacttcacattaaagttttgtcaaaaaataagtatctgcatgttttgtttgccttccaatgccctcattttatttgattttttcccataagtaactatagtgaaagcacgaaaatgtgtttctgtgtttgtgtgcctgtatgttaattgtgactgtttctattgcattgttattgcagaacctaggcacgcactctgtaggcttgggtgctttctccaactgaaaaaaatcctacatatggataaattatttttacagccagtgtttaattttacaagtggtccccctccttctgtttttaggatggcagagagaatacatatttacttaccattatcacttactcatgctttgagcttgaaggaaatgagacagaaaaatgaagtaacattaacttctctctggaactatgtttctcatattagagctttatctgaggagttcacttcctctctcttcaatgctttgttcctctccagtcgattcaaatgtcctcttaaagcagaagttccgaacctctttctgtgacttcaggagagcatgagaatgtaaatataagttttaggactaaattttcaaagactttttccactcagctctcttttcctcttcggtttgttgttgtcgttgttgttgttgtcgttgttgttgttgctgctgctgctgctgtttttccccttccacttccgtaactgagctcttagggtccatctggaatctgattgcaattaaaaaaaaaaaagtttatttttacctccttgtacgtgctttctcctaaagcaggagtcagaagccttttttctttgaagggctagttagtaaatattttaggcttgtcgtctttgtcgcaattactcaactacgctgttgtagtatgaaagcagacaatacatacctgaatgagcatggttttgttcctagcaaactttacgcacagagaaatttggatatcgtataatttttatgtgttgcaaagttgtattattcttttgatttctccccaaccatttaatatgtaaatcccattcttagcttgtgtgccatacgcacacaggcagcaaatgcgagttgtcacacaggctatagtttctgactttatgtcttaaagtaaacagtaataatcattctctttttccaaacagtccactaatctccctttgtattcagcccttgcatagtaaacgccgtttcttcatcatcctgatttttattctgagaaaatactgtatattgttcccatgcactagggttcggggaaatttaaaaggatgtaggatctccttttcattggtcctaaaattgcactggggaggcaggtcatgtttatgaacagataaatagtatcataatataatcatgcatttctatggctagcatttagaactatagcttttgatgtcatgtggtttttatatggttgattatttttttcttatttataaaatgaaaaagtttgagaatttttcatctccttaatgtattcccttatttgagggaaaagtatttacctactacataggaatttatcttaaaattttctttgtctatctatttttatggaatataatcgagcaactattttactaattaatactttaatatcattatgaaaatgttctcatatttttaaccttataagatcagataattgctatgccaatctatggttgaaatgggttcttatacttaacgctatgctctttcttctgagatgtaaaaatatgtttaaatcagaatttatataggtgtcaattcaaaatgacagtagttcattattttgattagtataaatgttcacaactaattctattctcttatctattaagtcaccaaataaagtatatttgttttaaatatttaacagtttaaattattctttgaaaacttatgagtctaaagtaagaacaattaacccattcattttgcaagtgggatagttgaattttacttgcaatccagggatttttgacagtttgaaatatacatacataccatgtatgtttaggaaaacatttaaaaagagggggttgtaaaataataatagttcttccatgattttttagccataatgtttataatataaaatatgtatactcttgttattgaatgtagtatgtttctaatttaccagaaggcaagagaataatcctggagaatttctcaaggcatcttcgaactctttgatttattgctcacatatagtaatttgccaaatgacgccctagtgaactgaaagaattaatgccccgtcctaagtcactttcaccgagggactgaaaacctgcagcattttgccaattagaggaggaaacaatctaccttgcagagtcaggagtactggataaaggagctaagagtgttgctttttttccccttcttactttaaaaatcccaattcatcccatgtctttcttaaaggctaagtgaagtagtaagtacgtttttgcaacatacgaatttagcagactggccttgtgtttatttttggccggaaccattacacttatttccaaccctctcctttatttgttggttgataatgggctaattttgaatctttactgtcaaaagaacattaagagaagcagccctgcctgcatcgcaggctatgtctgtcctttgccgagtattaaacactaaaaaaaaattaagaaaatactaacaaaatgacaaagcattaagaaaataaaactagatgttaaaggaaatgagaaaataggaaaggatgctgtacctggagtgattttttttccccaggctacctaagatgatcaaaaaagagctaatttctcttaggtttctattaaggaattactagaatatcgggcacaccaggaaactttatcagtggacctgtcctgaaccaaattttcttaatgtatatatgataatttgttaccacatcccagattattttacaggaattaaaatatatttgaaacactgacagggaaaattgggtaagacattgatagatactacaatctgtacttgaaactgcactcaaggaattcgttagtcaagaaagaacacaatgactgtgggcccctctgggttttggaacctcttttgtaaagcatttttttttttcccaaatagaagatattatttttgaaaaggttaaataaaaaatctttgttcactatatagtttcctcctaaggagtaaattaatttatataaaatattgcaatataaataacaattttaaaatctcaaaagagcagtgttttaaaaataatgtagaaacattaagaaatgacttcaaatgataagaatgtcattggagagcaaagggtttttaatattacatatcgtggcacgtatatcagcacccaaccgctcaagatacagagttctttacaaaaatcaaacagaaggaaatgtgccaccttgttcataaactatatttaataataagccaggcagataaagtcactttcacaaataatgagcaagcccatggtaatataattcatttacaataagatttatctcatggaattcttagactgtgctttgaaatttaaataattctgataaatgccaacagaatagagaaatcaattccagagcaattactaacacgttgcattacctttctaacattaatatttctcttcatacatatcattgaagagaaaatgaggatggaaaataaaaagatcaggtaatatatttgctttctcatctagggttgttatgatcttcaagatgaagttttattttttactcctagcaaatgatattcttttttattttagtttttattattttatttttctgtaaattattggggtacaggtggtatttggttacatgagtaagttcttttttttgatatttctgagattttttttttattctactttaagttttagggtacatgtgcacaacgtgcaggtttgttacgtatgtatacatgtgccatgttggtgtgctgcacccattaactcgtcatttagcattaggtatatctcctaatgctatccctcccccctccccccaccccacaacaggccccggtgtgtgatgttccccttcctgtgtccatgtgttctcattgttcaattcccacctatgagcgagaacatgcggtgtttggttttttgtccttgcgatagtttgctgagaaaaccacgaggtaccatctcacgccagttagaatggcgatcattaaaaatcaggaaacaacaggtgctggtgaggatgtggagaaacaggaacacttttacactgttggtgggactgtaaactagttcaaccattgtggaagtcagtgtggcgattcctcaggcatctagaactagaattaccatttgacccagccatcccattactgggtatatacccaaaggattataaatcatgctgctgtaaagacacatgcacatgtatgtttattgcggcactattcacaatagcaaagacttggaaccaacccaaatgtccgacaatgatagactggattaagaaaatgtggcacatatacaccatggaatactgtgcagccataaaaaaggatgagttcacgtcctttgtagggacatggatgaagctggaaaccatcattctcagcaaactattgcaatgagtaagttctttagtggtaatttgtgagatcctggtgcacccatcacacgagtagtatacactgcaccatatatgttatcttttgtccctcggcaccccttttctaccccccaagtctccaaagcccattgtatcattcttatgcctttgcatcctcatagcttagctcccacgtatcagtgagaacatatgctgtttggttttccattcctgagttacttcacttacaatgatagtctccaatcgcatccaggtcattgcaaatgctgttaattcattcctttttatggctgagtagtattcatatatatatatatagacacacgtacatacatatgtatatataccgcagtttctttatctacttgtcgattgatgggcatttgggttgatacttgcacacacatgtttatagcagcataattcacaattgcaagtgatattctcaggaagcatgatgtaagtgacagagacttactttgtagactgcactcattcacttgttctctgaatgtgctctaggcagcctgagtttctactatgtcagtgttacatagatgagaaaccccatgggtggtttccacagaggctgcaatactatttttgataccaaaaatctgtttggttttgtgagccccagatgcccatatggaaaactgaagtgttgatacctctttgtagccctctgatgaactgcatggttcaccttcctcagcagtttgagcggggtggggagagcgcctgcttcctagccatccgattggcctgaatcatcaaaaatgctatcatgaaacaggttctgtttatctgctccagattacacccatcatgttctagagtgctggtttcatgcttgaatctagatcaagcctgctttcctcccctgcctgtactccctgtggctacctacagtcctgctgctgacagataatctaaaccaatagcacctaattagcctatttgctcatgtgttttttccatcgtggtataatgtcctccttgtcaatttagggtgaaaatgtagcaacacgttgctgatggtttaatttctggaatgcaggtaatgaatgtgtttttgcttatccaagtcttcccatcagatgtcaaatatagaagaacagtgttcagaggtcctaaatttaaattggagtgagaaattcacagcgcccctgaactcaggcaaaatgcactctgacaagtcaaccagatattcacagatggtctggaggatttgaagcctaatttggtgaaataaaattaaatgagtgaaattgtatgcagtcattaatctatcaccatacttaaaatgcttcattgaaatttcttttactgcttcaaatgaaaaaagatcaaactatgttatagaaaagcattcaaaacccttacataacatagataaaacttggttggagacttacagaactttctctgctgcttcgagaaagttacagtgcccacaaatctattgctattagaatattttattgtattcaacactcaattctaccataattatgtatatgagaaaaatatttttacctataaaataattattattaccttttaaaaatctgacattcttccttttttctaaagaaacatatttagatttagcttttattttatttttgtgttgatacatagagattgtacatatttctaagattctagtgatattttgatacaagcgtataatgtgtaatgatcaaatcagggtaattgggatatccaccatctgaaacacttatcatttcttcttttcaatgccatcataccaaaaggaagtaaatagaatttcaaatataaggacagccatgattttacatacatgcctacgattccaccacaaaccataattacgtcccccaaacttttaacatttcagatactttgtcccaggtatttcatgataaggattgggctatgactctgttacagaagggccaaatgactaaaatgtctctgaacaatattgattgcaaatattctacccagttgtcaggtcaatatgttccaattcggaatttataacattgtatctctactcccaaaccatccaatctcacctacctcacttccatattatggtgggtgatctcagattatatttaagctcatggttacttgtcaagtagatatggagtttagcctaacttttgaaatttatgctgagattacccttctcattatagaattaagtaggcagtttccaagtttagatttagcaggcagtttttttcaaatcacttaaaagttatatttttttagggcattgaacaggtttgaaatcctaccaagatgtcatgtacacatagaccaatagaacagaatagagaacacataaataaaactgcacagctacagccaactgttcgtcgacaaagtcaacaaaaaaataagcattgggaaatggattaaagatttaaatgtaagacttcaagctataagaatcctagaataaaatctgggaaataccattctggacattggcttgggaaagaatttttgactaagtccttaaaagcaattgcaaaaaaaaaaaaaaaaaaaaaatgacaagcaaggacttactaaaataaagagcttctgcatggcaaaataaatgatcaacagagtaaacagacaaacaccaaatgggagaaaacttttgcaagttatgcatctgacggtggtgtaatatccagaatctatgaggaacctaaacaattgaacaaacaaaaatcataaaacatcatttaaaaaatgggcaaaagacatgaacagacatttctcaaaagaagatatacacgcagccaataaacatgaaaaatgcgtcacatcactcatcatcagagaaatgcaaatcaaaaccgcaaggagataccatctcacacccgtcagactggctttgttaaaaagtcaaaagacacccaatgctggcaaggccgcagagacaaggggatgcttatacactgttgttgggaatgttaattagttcagccactgtagaaagcagtttggacatttctcaaagaacttaaaatagaactatcatttgacccatcaatcccattactgagtagatatccaaaagaaaacaaatggttctaccaaaaagacacatgcactcacatgtttgtcacagcactatgcacaatagcaaagtaatgggatcaacataggtgtccgtcaacgttggattggataaagtaaatgttgtacacatacaccataaaatactatacagccacgaaaagaagaaaatcatatcctttgcagcaacatagatgcagctagaggccattatcctaagcaaattaacataagaacagaaaaccaaatactatatgtactcagttatgagttggagctaaatgttaggtacttatagaattgaagatggcaacagtagaaactagggactaatagaaggggaaaggaaagggggagacaagggttgaaaagctgcctattgtgtactatgcttactacctggttaatgggatcatttgtatcccaaacctcagcatcacgccatatatccaggtaacaaacctgaacatgtaccctctggatcttaaaagttgaaaaaaaaagatgtcatataaatattcgtggtcactaaaagtatctaatgtattatacataaaaataaaaattgggtgaattggaagtgtattctttgtatcaagtcatgtcggagatcctattctgctttgatcacagtgtgaattcttttgcatttttgttaccagtcacttctttatttattgaactaataattacatattctgataatctgtcagaaagataaaaacattctttgtccatgtgtctgaaaatttttaacctatttttctaatgttttaagtgagaagagcatgttaatactgaaattgtaagcagtagactgaaaaatcatcccaatccatgggttatatattgaattgcttttaactgtattactaaatattaagcttaatttattttatttctacatatccccatttccactataggtgatttgtatgaatttaggaacttccttctctcatccatttttatattaaaactcagactttctaaaacaatatttctatccatccatcgttggtaactatgtactgacatgttttgtgcatccgaaaaatgttagcattagtttgtgcgcacagaagtaattccagtcaccatatgatgagctgatttatttatttcgtaagtgtgttcattattattatctcttcagcacccaaatatataggggacttaatgatacctacaagtaaaaacggaagacaaaaacgccctgctctctacagaggttaaaatgtttttgcaacagggctctagatctcagctgtgaaagtagggacgagatgaggctaggcatgcagtgtcagtataatacaatataatcaacatgtcagcatctaatgcaggtgttgcaaaacaaaatgtacacatgggtagtcaggtaacagaaaagcatgaagtagtaagggctatctatgcaagaggttccaagctgactatatactgaaatatttaaacactatgtggggcaaataaaatggacattagaacagttcgatggtcagttggggacttctgctctttcttccagtctctgaacatatcttaaagccacaatcatctatttttatttattgttatacatttatttataagccagcacccctgtgatttaagttctgttgaaatgctgagttggaaaagatcgatggatgggggaaatttagtgcagaggttttgccccaggttcaaaatcctttataaaatattaatacatggaacaaatattgaacaattaaaccactgataagttaatcaatctgattcaaagtacacctgtgaagagggacatggcaagaaaaatattacagtaagaactagaaacattccttcatggctgcttgatatggatatgtcatgtttaagaaaattcttctttagactgttgagattttttttcctgacaaagaagattcactgtcgaggaaagaaagaggtactgtgaaatttgttattgaaaacatgcacatacttttgtcagaatgagttaaagagtgaacaaaatgtgcctattacttacgtgttgtgctgttttaattcaagattaaaatatttaacgtccacagacaagaccacttttatatgaatattatttttctgctttattgctcaattttattaccatttcaaaacacccgtgttgctttctatggccaaagatgtttagcacttttcatggttatacttctgtacagtccaaaatacaacacttactttacacatacacaaacatccaatgtattttgttttctgtcaagtaaagacaatgtctgtgttattaagttaaatgtcactttcaaatacaggatatgttgatattagaatgttcaactttatttcctcatttaagcaaattacagtgtgaagaatgtaactgcagcaatttataaaaatcatatcacattcaattatgagagcaaacttgttttgtagacttgaactagtttcaattaatcttggagttatcatttcaaaaattctaaacagagagaaatacggagtgtaataatggtaggtctttgggtaagctgcttccaggaaaagaaagcaattatatatgttcacatagcactgacaaggagaaacaaaactttggacggcaaagaacttgcattagtctttttgacatgttcctgtggtgtgatttattacgtagacaatcagctcaacttctcaagtttgatatccttggaatcatttgaaatttaaattttaatgaaaattcattaattccaaggccaaaagaagtgattctaattgcttttgagaatcagactatgaaagaattctttggcaaacttgcactgtcttttctcttttatcattggttgcttcgtaggtacttaattgaaggtcctctgattatcagcacgggctgacatcagttcactccatgcattttaaacagtaggccagatgtttaaaggatcagctgaagcatcgatagcatgctagggtgaataataaaattttcattatctacaagaagcaaataaaaagcataagcattttcccccattatcctgaaggagaagatgaatgcctaagcaacattttaagaatgggttgagtgtggcctgtgggaaaatttgggtagaaaacttgtagttagctaatgtatatactgtttgcctctttagctcaccatatacccacacacatgggcatgcatgcatacagacagacacatacaatacacacaacaaacaggaaattcagatatactgaagaaatgtatttaagggattactaagtttttgtaaataaaatcctttaagatgctgagaaacaatggaagagaagtaggacatgatggctcatactttcgtaatttacttgtttaacgtttgccaaggtttaaattaatgtagatgtttttgtggctaggattaatgatctaacagtttggaataattaggcacttttatcacctagaaagcccagaaacccagcatgcaaaaattctggtatgtctgcattttacacttagatataacagagaaatgacaagtagtcaagtggatagagaaacgaatgattcttcacacatgcacacacacatagaaattgtctttttaatagtattttaatgtaacacatttatgcataatttctccatagtgtttatcttatagtgaatatgtgatgaatagtctctaacattagtggttttatagattaaacataattaaggctttatatattaaagagtcaattggtgacattctaatataaacatgtttatctcatatacattgaaatattagataattcattcgttgagaataaatcgaatgagtcaaaacttttaacctccactttgagctttgtaatagtatccactgaaaatattcatgaaaatttttaagtcatttctatttatatattcagtccaaacatctcacaagtttaaaatgtaaactcaagaatataatttctgtattctacaattggaagcatccatcatatcagatgaacttatatagtttgtgaaattttgcaaactttctgtttagtaaatcttaatgtcaaacattttaacttccaggttgtctttcttttcagttttaatatccgcgatctttgtatactcgttgaatggattctcaataagtaacccacaaatatatatacatactatgtacctacaaaaaataataaaaagtaaagaaatcgacacttatccatacctgtcccatagtaataaactattcataagtatatttgaaagatatgagaatcataaaagttcgtgtttgcacccttttgtgcgtggaatcctaggtttgcattttgtggatctagactttttggagtgtggaaataaatgaaacaaataatcgagacccagtcttatattcaggttatcattttactacataaagcataaataacatttgcagtttgtttctatggctagctctaaagtcttagcaacgagaacattatagaaagacttcaactgtagcttccagcagaacttctgaggttccgtttatggactaagcagcagttgagggggacaaaactcataggcaattgatcactccaaaggatagattgtcttttctaacctaatcaaaagatttatagtgaaggcatattcagattttgttgaaggatatggatatataatcatgtgtgtgtgtgtgtgtgtgtgtgtgttagacatacttaaaacattatttgagtagaaaattctgcacaaatggaaaagtataacatgtgttatatccacacatgttgagcatttacctggctgaaacatcaaaagctgaattgacttaattgaatgttgaatacttaatagttactttgtagtgactcactattaaaacattatctcaagctttgtcagaattaatttttttaaaaaactcagattagtgtcaggtttactgaaacagcagatctgaaattactgtgtttttttttcctttcaataatcagtttctaatccaaaattgaatatcagttccaactctacattcagtttctgttttacttgtttggactggcttttggttctgttttccacatagatcctctctgtgtaagacaaagccatttgtgcagattaaattttactgagcgtgttaacctatttaaaacattcatccaaaaagactagtatgaattcttcatatggcaagctgcttgttttaaaacttccatttattctaaaatcctttttacttatactttttaagaaacgtattcccgatatacaaaagtaacacatgctcattaaaacaaattaaaaatagtattgtataaagagctgatacatttctgccttgccccatttaactttcttaagtgttcatgtgaatcatccattcacatcaagacatttatctgtattcatatgaacgtgttttaatatatataacatatatagaattttatataaactttccttttaaaatagaaatgaaattatatgatatatttattctgtgtctagctcttgtcacgtaattattcaagaacatatttctaggttaatatctgtattcttaggtagcattcactaactcctcatctacttgttttcttccattctaattgtgtttaacatttcttcatacaattggttgtcatttggtcttctttcatggagggtgcataatgttcattctcaccaattctttacactttacataactgcttgatacgaagccagaccttataaatatcaacaaagcaggaacactgtaatcagctatcagtttcagttgagctgaatgaccctgaatatgtgtacacatattttccaggagattttaaaactgacacctcagatttctaagacctggagaaatcagcatgagaaacattgatctatattattccgtgaaatgatttcactaaatagtgaagcatctcccacatgtggactctgtaatttattagaataaagagttcatgtgcttctgaagaacttgaactactcttctggcctccgtacattggtttcttagctataggaaggctgagcatgtttttcctatgcgtttcctttctagctcatcattttagtgacaaaacaatctttcgtggtgttgctctagctatagaattgtttcagattcatttgaccaaaggtggcaaatacaacagtcccaacaaaaacaaaagacctattacagaatgatggaaatgaccccagggaacaatggcacctccacatttcttaattccaaggttataagcagtggtgtggacaattctcaattccaatgctgaatcgccttctaatttcaaatacctgtgctaaaaattatttacgtctactgaaataatgaactggaccccaccaggaatggccgatatgcttgtagtcagagcacaactgtagaaagaaaataacattttaatttatagaggtatgatgatagctgtttcatactgttttcagaacgatgaatggcctgctcagtagtttcttgtcatcgtactgagacactttaatttcttaccagctgagatgaggaatacgagcccagtgtgcaggtgaaattggttaacaggagccattaaaatttggaagagtcagaatagcatcaatcaaaatgctttcagtgtaggaagtaaacatgtactagcctgacccacctgtcttttcttttaggtatgttggtaatattacaatcattttgaggtatccataaacaactgcttagatctgaagaattgtatatctttctttactctgccctggcctggggttatggttctcattgagctctaacctttcagaaaaaaaatgtagagaagtggttcaagaagaatgctttatcttgcttcataaaaatgatagtgatagttttattgaaggcttactatgtgccaggccaaagtgcgttttattatcgttcccattttccaggcaaagaagctggagcacagagaggctaagtgagttgtccaggatggctcagctaacatgctgcagttgggatttgcacccagaccaacttcttttcaaccactgtcccatcctgtgtcttctctactcaaaaagtgtttcagctccaaacctgaaactttaaagaaaaggaaatccttagtggaaagactaggttttagtcacaaattatctccttccttacattatttgtctctttttcaaatactccaagctttgattaaaactgtctatcactaggaacattgtagaattgctaaggtggaattgttaaaagaactcaattccaattaactttgccattgattactgtgtgttctggaggggtgttctttctttcaggttaatgatgctttattgtatatctcaaagattaaaaataacaatgaaggaagtagcaaaccggaacttctctcacaatgcatctttcaatctcgtgctttaaatgaagataaaatcatggctgtggtaaggttgcaggaaggatgatatagattaagtttcttgcaaactgccctctgaattttcaatagctgtagaaggtattggttttccaaaaaattgacaaattgaggattcattcagcagtttttttctaggtctcttaccagaaagtgatcactaaaaagtgtagggaaaccactcaaagttggatagatcattattttcacttaagcattttaatttcttgaaggagctttataatgcaacaaagaatttacagtcctgtgtcaccgcttaaattttctagggtcatcagtaaactcagtggaaataaattagttcatgaatataattgacccttaaattctgtcactgtgcaagtaatcggtgggtctgctggatatggctttcgagcagacaggtcaacttcttcaaacagagaagaagcatagcataaattgaagacaaataacaaactacttgtttcctccttctttggcatcaccctatggatggagtatgcatttataatttaacacaatcaagagatctttattatcctacttttgggtacaactgcttcgtttctcttttgaatctctacagctatttaaaaatctgttttgtaaaattctttaaaaaactaaaacatcagattcatatttcaggtatcttactatcttataccaacttaagcatccagtattatcacccacccttcccctgagtgaatccttagcactgggctcttcctgttttatccctgtgcatgctgagctctttctggccttcaagtctacttccgttgcaactgttgtctgaatggtctctctatgtccttcttactctctaaatatttcggaatttaaagcctggaataatctaccttagtccaaaagatatgctacactattctagttcacaatgatctcacactgccgttgatacacaacatttaatatcaacttaatatctatttcagttcattacgaggtcacttatgctacatcttatattgttgccttggacttttattatctcttcatatatgtgtttatggtgctcccaccctcacgagaagttgcaaataccatgttagctgtctgatggctttctatgttgtcaggtataccatttcccaaccagttggcattcaatgattaagttcattaacaaagaattgtatgtgttgaaaaagatgtttttttcttaatgaagcacttgtttttatttttttaatgaaatccaccctcttaataaattttaagtgcacaatacagtattgttaaatataagcaaaatgttgcatagcagatctttataatttttttaaccctacatgcctgatagtctatacccattgcacagcatctcaccatttcttccctcctccagcccttagcaaccaccattgtactttctgtttctataattttgactactttagatacctcatgtaagtggatgcgtgcagtatttgtccttttacgacttgcttattttatttagcaaaatggctacaagattcatccacattgtagcatatggtaagatttcctttttgtggcagaatgatattccattgtatgtatataacatagctttatacattcccctgtcaatagacatttagtttgttcacacctcttggctactgtaaaaatgctacaataaacatgggaatgcagatatctcttcaagatcctaaattgaattcgtttagataaatatccagatgcgggattgctagatcttatggtagttatattttttatttttttgaggaaactccatattgttttccacaaaagctgcacaattttatatttccaccagcagtctacatctccaattttcctacaccttcaccaacacatgtaatgatcttgggctttttttttttttttttttaataatggttatcctaatccgtgaggtagtatatcattgtggatttgatttgcatttccctggtagttagtgatgttgaacatcttttcatataactgttggtcattttaatgtcttctttggagaaatatctattcaattcctttgttcactttaaaaattgggttgttcgaatttttgttgttgttgttattacgttcctcatgtattttagatattgacaccttatcagatatatggtttgcaaaccttttctctcattctataggttgcttttaattctgttgattgtttcccttgctttgtagaagctttttagtttgatatatttctgcttatctagttttgtttttgttggctgtccttttagcgtcatatccaaaaaaaattattgtgaagaccaatgtcaggaaatttttcccttatgttttcttctatgagtttcatagtttcagatcttatttttaagtctttactccatttcattttgagttgatttttatgtatagtttaagttaaaggtccaattccattctttgcaatgtgtatatccagttttcccagcaccattggttgaagaggatatcctttcccagttgtgtattcttggcacccctattgaaggtgatgctaggtttatttctgggatctctattctgttccattggtctatatgtctgcctttatgacactatcgtgcgctcttgactgaggtagctttggtaattcattttgaaactagcaagtgtgatgcctccagtttattcttcttcctcaagactgttttggctatttggagtcgtttgtggtttcatatgaattttaggaaatttaccttatttctgtaaaaaatgcgattgggattatgataggaattacactgtatctgtagatggtttggatatatagacttttaaatgacacatcagatgtatttccatttatttttgtcatcttcaatttctttcaacaatatttcatagctttcagcacacacatcttttaccttcttggttgggtatttactaagttatttattctttttattgctattgtaaatgagattgttttctaaatttcctgtttttatgttgctagcgtatagaaacgcaactgttgaatgatgactttgtatcctgcaactttgctgaatttgtttattggttctaaccatgtctctgtgtggcgtcactcttaagattttctacgtatcagatcatctaatttgcaaacagatataattttacatcttcctttccaaatttgatgtattttatttctctttcttatctaattgttctggctagtacttctggtacgattttgaaaagaagtggcaaaagtgtgcattcttgtcttgtttctgatcttaagggaaaagattttcagtcttttgccattaaatgtgatattcactgtgggtttttcatatacggtttttattatgttgcggtaatttcgttctattcctagtttgttgtgtgtttttatcatgaaagtgttgaaacttgttaagcgctttttctgcagctattgagatgaccatagatttttagcctttgttctgttaatgttgtgtatcacactgattagttttcataaattgaaccatttttgcattccaagaataaatcctatatggctctcgtgtataatcctttcaatatactgttgagttcagtttgctagtattttaatgagttattttgcttctatatttatcagcggtattgttctgtacttttctcctagtgtcttttattgactttgatatcaggatactgatgccccttgtagaatgagcttggaagtgttctcttctctttaatttttctgaagaatttgagaaggattggtgttaattcttctttaactgttcattagatttcaccagtgatgacatttggtcctgggcttttctttgttggaaggttttggactactgattcaatctccttactagtttcggcctactcagattttctatttcttcaagattcaatattggtagattgcatgtttcaaggaatttgttcatttttttctaggttaacatacagttgtttacagcagtgtcttataatcatttgcattctttttggataccagttgtaatgtctcctctttcatttctgattttacttatttgaattttcctttttttttttttttttttacttaatctacctaaagatttgtcaattttattgatttgtttttaaaaaaactcttagctttgttgatttttctattgttttctatttcaattttggcttttttctgatctaatcttaatatttccttccctctgctaactttgggcttagtttgtccttctttttctaagtctttgaggaagaaaatggcaaggacatgactttctttagcagttggaaggacaatgctgtaaatactcaaaaattaattatttttatagtgacaaaaacaaaataaaaaacacttcaaagcaaatgaaagtttatcatttaatttatcaaatcactaagcagactgcttgatcagagagaagatactcatatgatcacataaaactgaaagattaagaggtaaggacattcatgttatcattacatctaactttcttatttccaagatggagaaactgagggttggagaaaaagaaagatttctttgttagatacaaacagacaggactaaactcagtatagcagcctcctaaattccaaagtatcatgatactgtgattttatgcattcttcagaaaaatagtagagccactggattctggcaaagaagttatataaaatgtcaagttcttcctttgcctcagaaatgaagttttatgttccaaaattgattgggaagttctccttatacctcacatcacgtctactattttacattgtttacttttgaagaatttttttaattgacaaataataattgtacatattcatggagaacctagtgatgtttttatatatgtaatgtatagtgatcagatcagggtaattagcatatccattatctcaaacattggtcatttatttgtgttgggaacattcaacgttctccttctagccatttgaaacttctatattattgctaactatagtcaccattcagtcgtatagagcactagaacttatttctcctatctagctataatttatttttaaatatgctttttgaatctgttactataaattgaatgtcacatcgttttgaaaatattcttaatttatgctcaacaggcaagattacacacctgtgataatatctttaatttaaaacattactctgtttaatttaccagaatatggaaccctagtcattttagaggtggagcaaatttcagtgataatctagtgcaaatttctcatcttatgaatgaggagattgagtctgatataagggacgagattttcgtcaatgagcagcttgttaacattagctctgtgatagaacacaggcacttgtcctcccaggccggtgtttcttctactctatgatgggctgttttgttgtagtttttaaacagcagcattttcaccatgcatagttttcttccaaagttcgttcttaacgtttttgcacagaataactagattttggaagtagaaaaaggaaattctctttgcatccttgtatctctggttattttctttgtcctttgatctctctctcctcccctcccctcccctcccctccccttcccttccctcccctctccttcccttcccttcccttccctcccctctctcacacattagagaaagagttaaggtattaaagaatacataatactattaaatttccttcacatagagaaaggaatgaaaaaaagtgaaaaatggtcctcaccaaatgtccaaacttctgtaggtcatttccatagtatcagcaatgtcctgtatggtgcctcggggatatgtaagcaaatgagcaagtggttagctaattctagctttggcaaacacttgttatggcttacttgaggagaagtcacttctccaaagtgaaaataatgtgcacaggtcaattagaatttttttgtagaaaaggaaaatactttgtagggacatggatgaatctggaaaccatcgttctcagcaaactattgcaaggacaaaaaaccaaacaccgcatgttctcactcataggtgggaattgaacaatgagaacacatggacacaggaaggggaacatcacacaccggggcctgttgtggggtggggggagggtggagggatagcattaggagatatacttaatgctaaatgaccagttaatgggtgcaggacaccaacatggcacatgtatacatatgtaacaaacctgcacgttgtgcacatgtaccctaaaacttaaagtataataaaaaaaaaaaagaagaaaatacctccttatgctcctgacttattttctttttggttcctcagtcctcttctctctctctctctctctctctctctctctctctctctctctctctcacacacacacacacacataccccacatatacaatatgattaaggatatatgtgaataatgaaagcttcttgtgtatagatttagaagtctaatggacaaaatcaatattttcctatgtgcatttaattcccccctttgatttaggtatatagtctttttttaaaaaagagaaaaaaaattaggtgaccttaaggtatagatcctactttcaaaaggtttacagaactagggagaggaacatggacaagatttaaagaactattttaagcagaataaaatgtgatttatgaacaaagcatatattatttgtgcgtatgtgtgtgtgccaacaaagatgcaattaggagattgcacagggagatgtcattagaaccaaccttaacgggtgagaagtctttgaagacatttagaacatggaagatctctgacagagggaacaaaggcatagtgacaaaagtcaagggcatatttaggactggagagtggtatgtgtggcttgagagtgggcgagaaaaaacaacaatgcctctgtaataggaaagtagacagaggcatgacattaagagctttgccagctgtgctaaaagtagtgaacaagagctaacaaagtgaagaaatgtaccttttctgatgtgtatcattcccttattcatatacttcttgagggggaaattcattctgtgttgatctagtaaactactacaggaccaaatgataaaaagaagtataggaaagaatgtttcagcatactttacgagataacttccttgtagctattctccatagtattttgagcatcacaaagcaatgagctgaaactgtctaagccaaaattgacttgtcatctgttagggatgcttagatgagaattctacatttgagagcttcttagattcattgaccactatgtcccattctaagatccatgaatgcgtgacctaactattacaccttcttttagtctgattgtcaattttgtattttcaattgtgcaagtttctaaaactattttaggaagataaatctagcagtggtgtgggaatagacaagagagaaggggaaagactcttcaggaaactaaactcacaatttatgagtattctttattgcccaagtcttcccaaagtctttcatcaagaaagaggcattgcaactctccttttatagtttgtttttattctggagcagtgatgttttggtggagttgttcctcagtgcgtaattaaagggcctatgacaattacagttcatctcctgctgctcaaggtactgcagatatttggatctactactctcattcatttccaattaatgtcagctttagatttccttcagtatgctatgttataaaatttgattatcgttgtgcccaccttcccacttaatttcaagcaggtttctcgattacctgactaaactaatgaaatctgactaacccaatatctgtggacagtagtgtgatgttactgatttttgtatgattagtcaagtcatattcatgccacgttttcatatagtaccataaaggatattcttctcgtggtccttttcttttattctgaacatacaatgagaagaccggtaaagtgggctaggaaattaaagaaaaatacaaatggcaaaaaatatgggtcactcgaagtctagaatagagagcacaatcaattttgaattaaggggtgataaggtgatttggtcaggtgactggtgaaacaggaaagaaactatactttttgaagtgtttcatccatgtgttaagattcatttggggtcaagaatctaaatttcatatccctgggagtggaaactaagtaaaaaaaaaaattatggaccttggtttaatagctagaggagcaagagtgtatctttatgtgacttaacttctatgtgaaaagtgaaccttaagattaattattgggggaatttacttactcaggttctatgcctagatggtctgcccaactaagaaaacttattttcctgttactccatcctatttttcatacttttatactgcacttgcagaaaagcatatatttctacccaatacgaaaattcctgggaacatatttttctacatttcccaaattacttcaaaaagtaaacttaggttatttcatgatctccattacaatggacaggtggccttattgaatgttgtcctgtgaatacaaagatccagagtttaaagaacaaggtgtacttgcatctcccacttagggtttgcttgtggtggagagagaatctagtttgcttaaaaggatgacagtgcagtgccccaaaatatctgatatcattaaaagtctcatatttgtctttcgtaacttctctagggctgtcgatgacaggagacccttaactcctatgccttgattatgtgaataagcacatgaaaatattttagttatcttagttcacttttaaactaagtttcaattatcactagattctaaatatcatcattgagccgttcttaaggaactgattttctacatattcattcacttcacctatatctagtgtgtctactatttgccaagaaaaatttactctcttaattcagcattccatatacttaacatcataaaaagtaggccatttttagttttctaaattatttatttaaacatttctttaaaattacattctatcattacactatatttcaacactacagtaagcagcctattttgtgatttttccttatataaaatacataattgaaattaaaaatgaagttaccaagagccattttcactctggggaatgcacatttataaattatggggttattttttcttcatcagctttcatattattaaactttgtctcttcataattacagagatgactagacacagaagggaatttaacatttggtgtgcatttgtctaacctatactttatgttagaaaatacatttccatttgaaaaaaaatcagtaattgtgggtgtgatcaagagggcagcctgaaagtcgggtgatgtgactcacacctgtaatcccagcatttttggaggccaaggtgggattatcgattgagcccaggagttcaaaaccagcctgggcaacacagtgagagcctgtctctattagggggaaaaaaaaaaaaagaggaagttagcctgaggcaatgtaaatgaaatacatatttcaaggatatttatacatgattcacgttattcatataaagatgtgccagagaagactataggtacgttattttacactattttgctaggattttaagaaattcaatgtgtttttatttcagttaacttagaaaacttacctaacttatacttctcatggacacaaaagtttttaaagataggatcaaaaagcccacatggtgaagcattttgaactggatgaaaaacatctattatctttaaaattttatgatattactgattgtaatagactccctttttaagaaatcattccttatagaacataaggtttacatttacaatcaacaatttctatccttactacaataaaggcacatataaaaagtacagttgcatatttagcaggtttaattgtacattttaatgtagaaatcaattcaattctttcatttatcagcattattacagtgatttcaaattaagcataggtaactttgatatagataaatgatgtacacagcagttaaattttattttcaattatgtagtaattgtataacctaggcagtataatttgtaaactttgtattttattattatgcttctcccacttggcataagcacaacacttcctaaaagcataattttctatagacttaataactccctaaaaacctgttttggacccctatactatttgatataggcagaaaaaaaacataatccatgctcaaatttgaaaaatgactggtcacatttggtataatactaaaggtaaataaaatcaagagtctatgaacatttccggacctgcacatttgttttattaaaatgcataattgtctttagtgtgtttctatttgtttatactctactgattttaattaaaaataccaaaatacgtttattaaaaaactgtcagaatctaagttgttaaatatacttaactaggaaagtaactgtttaaacgagataatttatagagaaatgtggtgtattgccaattagatgtcaagatacaatacaactgataatgaaaaagtagcattttcttagggatggaatacagtgtaaggaacaccccagtaagaatacaaaaattactgaaaaaaaatcttccttcctgaaaaaccaagtgcccttcaagtgcagaacctcatccaactaattgttaggtatcactaaagcctgataccttcaattttctggatcattcaagctgtatttttgagtccttatactagaggaggtaaagagctataaaaacacttaatggtatctgatgtgaactgtggatcactttgacccatcacttctacgtctacatcttggataaattcccattgttgtcatagattgtacaggtttaatggtgcgtttgtggagggggctcgcttatagaaaatggagactctgaagggataaggaataaatgtatcacttcaggtcttttatttgaaattggggtccagagagcctttttgtatcagacttgtcaaaccatttccatttagtaattatatatgcactagcacttattcctacttacctcacctctttatgcccatttccttgtagttgcggttatgcatgaataatttattgcaccccttaccaacaatggaataaaacttccattctgaaagctttccatactcatttccaatagcaatagggtttttttaacggacgtattacaaatgtacgagtcagttgaacatagtattcctctttgtaagaactccaagtggatgcatgctgttgtctcaaatctcaattagaccttgctttgaggtcccttcattgccagtcatctgttctccttcccctgacttgagtatttctccagatatagataatacattttcccaactctgtgttccaagaactgacagtggctttcattcattttgtttgtttgtttgtttcttctcgttctcaagtatcccgcagtctactgtttcttccctccattcgtttgtcctttcagagtttcaaaatccagcataggtacttcttctaaaatgtcttacccttcacatacacacaccacttgagaccccatcagcctctgtccacacagtttggttacattcatagactatttttatacatcaaaatatttgaaaattttagggtaaatctcagtagtcattcatttttgctcttattcaaccaatactagtcaatcagcctgtgccaggttttgttgcaggtaccaggtatccatccataaagaaaacaacgtccctttgttgtggaatttacattttagcaggggaggcaaagaacccaataaatatgataaaatatcagattaaaagtacgatgaaaaaaatcatcagggtaaaggaaaaagggaagcagtattttagcaagagtggtgaagagaggaggctgagagtgtgacatctgagcagagacctaaatcaagtcaaggaatgaaacatgctactatctaaagaaatgagtcaggataaggaactagtaagagccgaggcccagagatgtgaatatgctgttccaggaacagcaaagagactggttgatatgatgtgaaaaatgagaagaaaccttatgatatgtgtcaagagaaaaaaaaaatttaaaagcatgcttgggaacggaggcctccagatgaaaaaaaaaaacacagttcaaatccttgttcatgcatttagtttgctttgcaatcttgggcaaaatgttaaatttctgtacgttttatcttcctcatttttaaaataggcacaaggacatctacttaataggttcattgtgaggagtaaatgagatgatatatctaggatgcctggcattatatcatacacttaataatacactgaataaataatagttatgtctatttatttccttatcgtttttattattatttcaatgcacagacctgttcataagataatgataaatattagtggcagaaactgaagatgttataaattattaggaggcgggaccactcagttcaatgtatctgttttaatatagtcagcaaaagtgtgaagataccaacaattaaatttcaatgcattcttccatttcactagttttataaactgatgaactaccagaatgtcaatgtatgaattgcatactcattcttaacaaacagatttgcaaaattatgtgtaaaattagccctcagccttccaatttgttattgtcatatttcatggaaatacataatctgtaaatttttgttttaatgatatgtgaaactgcctaaagtagagtcttggcaactacttcacatttgtcctccagagatagtggataaaagtgtcaataaatgaacactctatattcactaatcacaggcaagggacaaggaacagagtggtcacaaaataccacaaaattaaagcacattccaaattaaatatatatgtttttattacagataatgtttgctagactctttctaattatctgcaaagattttaggaatgttttaatgttttaatatttacacacctgtgtatttcaagttcagtcaaacactattgttaaaactaaatcttctcatctctaataataagatgtgaacttatcttggaaggtggttattaggatgggagagataatgtatttcattcaaagtaaaaatatttctctgtttctatctttctctttctctgtcatctatttatcatctatatccaggtatctatgcacctatgtagactagcattcaatgaaccatagatattattagtagtagaattgttactaatattaaaataagaagtatttaagaagaaacatgtcctaaagcataaggtcaattattactctcatgttttttggcatatgaagcctaaaaagtgtcaatttcaagagagtattaataaagattgtgataactgaaaggttcctgcttgaaattttgtgtggtcttacaaatatataaactctaagcatttcagtgagccaattactgactaggcactatgtcttatgactcttttgtcatagtatgtaaaaaacaaagagtagagacatcataaaaattatagtagatgggcactagggaattacgcaaaataatttgtagatttaatgtgaaaccaaaacatctgttcaagtcaatttcccacaggtcatgtggcaaagagtatgagttccagactgaggagaggaaaaggttgttcttccacagggaaataaactgagtgtaataaacataatttttcttcttaagcattatttaaaacaaaaaaaatgccattaaatctatctttcctgcctctcttatcaatgctcccttccctttcaccacttgtttcaaactccaagccttgggattttattttggctttttgccttaatgtaactaaaatgagagcatcacaaatatgaagctcatcaaataatttagcagcattttcccctgtttttaactttctctttggaaacgtagatttcgaaatttaagggcccaaaatatgaaatgcaattataataggccatttgttcattcagcttgataaacttgaataaatagtattgaacttttaatgcaaaaagaacaaaacaaaatagaactctccacgaagaaacttttcaatgtttgcatttctgtgtgaggagaagggtaatgaatgtgggaaccttaatggaatccatgttcttccagtgatgacaagggtcaaaatggagaaaaatggtcactttctacccagtacattatattagttctatgtggacaactataacatagctgatgctggttttcaggccataaatgtaggtatgtattttcctactatttataaggcaaaatttctatttgtttaatgatttctatataggtagattattctgtctttaggattaaaaacgacctgtagaccaagagactttctaatgtccaccttagagtatatggcttttactgttacagtttccatttcctttgcttgcccctttgagagaaggaaaggagacatttgggatacatacatcaatgaggagctattaatgaataaatgaatgaaattgtcagtcaatttatccacatgatcatcaattgccaataattttatcacctctgtgggattaagtagaggtaacagtttagaaatttgattttttgaaagcatttaaaatgttcaaatatatcactctggtaactaagggaaagtgtattattttcttatgcttagtcttattttggttttgcctttttaatttaaattgaacacttatatcaaagagcttgcaggattataatttgaatttttgaagcaaagatcattttcttaacatcaaacaaagagtagatacaataggaataaaatcggcagaaaaacaagagtatcaaggacagacggggagggtgggtctgtgttagcatgtattgctatgaagaaatagccgagactgggtaatgtatttttaaaaagagctttaatcgattcatgattctgcaggttgtacaggaagcaggacaccagcatctactcagcttctggggaggcctccgggagcttttactcatagtggaagatgaaacaggagtaagcatgtcacatggccagagcagaagccagggggaggttgccacacatttaaaaaaaaaaaaaacaaaacagatcgctcaagaactcagctgctatcatgaggacagcatcaagctgtgagggatccacctccgtgactcaaacatctcacaccaggccccaagtccaacacttggcattatatttcaacaagaaaaaaagtttaattggctgatggttctgcaggctgtacaggaagtgtggcacaggcatttgcttggctcctggggaggcctcagggagtttttgctcatggcagaaggtgatgcccacacactttaaaaaaaaaccagatctcatgaaaactcactcactacactgaggacaatacaaaaccatgagggatctgtccccatgacccaaaaacctcccgccaggccccaccaccaacattgggaattatatttccacttgagatttgagtggcggcaaatatccaaactatatcagggctcatgtccagttatatgtcaacatgcctgcattcgaaacatcctgtccaaatcactgccttgtcataatacttatatttttctttattgaatacgaacacaagaagattaaataatagcatttctactttaaaacagtgggcaccatattaacattggaataatagtagtaataacgatagtaataacaatgatataggctgggtgcggaggctcacgcctgtaatcccagcactttgggaggccaaggcgggcggatcatgatgtcaggagatcgagaccatcctggctaacacagtgaaaccccgtctctactaaaaatacaaaaaaattagctgggcatggtggcaggcacctgtagtctcagctacttgggaggctgaggcaggagaatggcgtgaacctgggatgcagagcttgcagtgagccgagatcgtgccactgcactccaacctgggcgacagagcgagacttcatctcaaaaaaaaaattaaataaataaataaataaataataacgataaaaggatatgtgtaggttttttttttaataggctgttaacattaataggcattgtgatttcagggatatcatcaaacatcctggtcctaagacatcccctattgaataggaagggcttaagttaaacttctcatgagccacaattttctgattatatgtttggtgtgtgtaatagccacctcagtgatgatttgattagcctggacccttacataatcattgaagtatacccatgttcctttatatacttctttagtgttgaaagctcaaaattaagcaaaatagtccccttgataatgtttagattcttaacatttgctttctaaagctggcaaatactctcttcccagtgtcatgaagttaaataacatgttgcttagtgaggactttaatgttgccatgccataggaagaccttattcgaaatccccttacctgggagaatgtcagattattaccccccaacttgtttaacacttttaggattttaaaggtgttcacatttgtattagaacaaaatactattgagaaacatttctagaaaaaaattatctttccaaattaaaatcagtggtatgtaatgtaggagtctgattataatgattaaaatacatgggctttgggcatactgcctaggtgaaactcctggtttattgcatcactattagtataacctatgggagttaacctacgtaagcctcagttaatttttctctcaaattgatctaataatcgtctctcataggcttgttttgatagatatttcagtgtatataatatacttaggacagtgcctgatatcagtaagtctccttatatgctatttttctttctattttaattatttatgcaagagaaactattatgctttaactcaattaaaataaaatgcctttgtatttattcatgtcaaaggaaatatgcaagtattgcattcacttcctaggtgcctttttgaattgagctttgcatggttagtttgtataaaaggttcagtgaactttctcataatgattttttattgaacatatggaatccattaagtgttagcaaaagtcactatccactgagctgtgtccaggggctgacagttatgtctatctcttgcaaaaataaacacatacataaatgcactaagacgtatattacctgtcgtcatctcttagagcatttccatttttcttttaagttttttctttcaatgggttttttatctttgtgagtacatggtaggtgtatatgtcaacggggtacatgaggaaggtgtatatattgatggggtacaagagaggttttaacacaagcattcaatatgaaatagtcacatcatggagaatgggttatctatcccttcaagcatttgtgctttgtattacaaacattctaattatactctgttagttattttaaaatgtaccattaagttattactgactatagcaaccctattgtgctatgaaacagtagatcttattcttatttttctaacatcttagaacatttccacaaacactacctgcttgttaaatatacctattctaatcttcatataatcaattacttttttcctctagaatgtactatgacacatccatggggaaaatgtagtaatctaattaagactatttcctctcattttatatttaaaagaatgtgctctatcaatttatttacttgtacagccgtaggcaacctctaaaatatttaaagttcttaaaagtcagatatttcagttaatattgtgattatatagttgattttgatgaacatgttcatctaccagaaataaattatacacacacattgatatggttaggctttctgtccccactcaaatctcattttgaattataatccccgtgtgtcaagggagagaccaggtggaggcaattggatcttgagggtggttttgcccatgctgttctcctgatagtgaatcatgagatcagatggttttataaagggctcttcccccttccctcctcactcattctccttcttgccaccttgtaaaggaggtgccttgctttctactatgccctttctactatgcccttcaccttctactatgattgtaagtttcctgaggtctccccagccatgctgaactatgagtcaattaaatccctttcctttataaattacccagtctcaggcagttctttattgcacatatatgtgtgtgtatgtgtatgtgtgtgtgtgtgtatatgtatgtatatatgtatacatatgtgtgtatatgtatgtatatatgtatgtatatatgtatacatatgtgtgtatatgtatgtatatatgtatacatatgtgtgtgtgtatatatgtgtacatatatatatatatatatatatatatatatatatatatatgaacagagagagagagagagagggaggaagggagagagggagggaagcatggagaaagagagagtaatagcctaaatagaaataaaactagctccaagtacaggttcgtcaacactctcctatcatacccccaccaaagttaatgttaaccacttggagccctgttcttccttagttgtggagtactttagcaaaattttaaatctaattatgcctaattcaacgacagtgctaatttgaaagtgttagaaactgaagacctataataataatgagagttacaaaacataaatagtgagacaatgatgaatgtagtggatgcatgtacgagggctatcatttgacagtagagatgatgctcaaggacagacaatgagtctttcaatgtgtggagaatgtgctgctgttacagtgatgtacaggaaagaaacaaaaactgaggaagtatcagtaaacaaaacactcaaacatatgagtatacagctagaataaaagcaacagtactagatgacaataagcccaatgttaactcagaaagcagaaggtttttaagaatttggggaatactgtggctgatgatacttatgtctcaagccacagatgccatatgggctctgcgcccagttgaatcggcaccacctggcagtaagtgggcaggtccacgactgccaggacatcccttccaacacttgtggagatcaccaggaaggggggagagacctgccttgacagattttcaatgtgggcgaaacaggtctattttgagaaaagatgttcaatagaacatatgtcagcaaggaagaagagatgatgcttagttctaaagctccaaagagctggcttacactccaacttggggaaaatgcatccgggaaatgcaagattaatctcatcttagccattcttttgaatggatggacatgacccctttctacttgaagacagaaaacataaccatattgatttcaggttttcttcattggtttccatttaggattgttcctccccatcttctttctgtgtaggcatcccagttcccaagtgttcatgaagcacgtatggccttcaggggatgtgtctgtatacattgttatcttatggatgcacggttttgtctgcaccttggttctgaatgtctttactcttgagcatctgcccatgggtccccttctcaaggcctcaatttcttgagtttaacactgcatggcccatgcagcttttcagttaagcatctcttgctatgaccaactcttttcctcagtcaactcccacactcttttcagggacaggaaaaatgtagccacttgctggctgcactctgaggcctcaagaaatttagtgaatctgcctttgcccttcttgctgatgaaatactgccacatcaggccccctcttcggaaacctacaagcatctaattttcttgcttcctccccaactttctttttgactcccccccatccagagagttcttatgtctactgtactaggaaaaactcattcttaaggtatggttttcaaatcattctctggtctggactttagctacggttttaaatgaagaaacaacccagagccaaaatataatgaaactatttccttcttccacagagtggaaactgctttggggttaaagggccagtgaaccaaatagaaaaggatctcagggaacacagattgaagagagagaagaaaaaatatgaaggcattgttggttctcttttgagtttaaaatctagtggggattgtaagcacacacacatatacacacacacgcttacacacacacaccagtgaagttatgaaggattttgtcactccaacgaccttgaatttgattatctaggtcagttgttaccaaagtggaatgtacatgcccaataatatgcgtgctaaacagttggggtagtgagaaaaaatactttttatttatcttgttctctagaaattaatattttgattgtatattttatagtgtatgtgatgtgtaagttgtgtctacaaaactagtgtcaatgtaatttaaaattacatatgtctgtgaatatatatttatatagggtacatgcttaaaatgtgtttacttctgaggtacatgaacatttttcccccaggcacagaaagacaaataccacatgatgtcacttaaatgtgcaatgtaagaaaagttgaattcatagagatgtagagtagaatcatggttaacagaggcttgggaggtggagtgagggaatagagagttactgttcaaagattacaaagtttcaactagacagagggaatacattttgagatctatttcaggaacattttgagaccctcactctaagtaataggaaatcattactttagttaacatatttgaatatgagttgtgatgttctatatcgtttatttggattctactaacccacacctagatttttatggcattacctttttactcactgtgaatatcctactcatagacagatgccctgggaacttggacttgaggcacccaagaactgagacagtgagatttgggggcacaaggatctatggataagttcatcttagtgatgataaaatcaatttggcatgtttcacggacagtgtgcattttagaaagggtaaagacttggaaacgggatatttttgagcccaagtgtttccaataaatagctgtataatttgaagcaaataattgattttttgttctctttgtgccctcgcctgtaaaatgggagaaatgtattcctttctcatccttctcatgaggccattgagagtatctaatgagatcagactgtgacatagcataataattctcatttcttgaaggcctattatacactttgcaagcactgtatgtgttgtttctacttctcttgttcgtttttcctggaataaatatccccccctcctttacattggattgccattattcaccctgtaaggaaggcttcatggttctcattttcatctgagaaaacttaggctcagagaagatcagtaacttatctaaaacacacacatacacacacagacatatctatgcccattattcttaacctagtttctctattcaggagttatctctgctgtctctgcttctgattataatctgtgtaagctgatccaagtgacacgattacagggaaattgtaagccctttgagagcagagactacctattgatatctacattttaaaatttgattttagccaacctgtttatatgcaatgactaacaggttagtttgacttgcaataaatattccaaatcctagactaagtaaatttattaatgtaatgatttaacttgattttttcattggcatgtttccctgaagtcgtcatgcaaaattgaaaaaaaaaaaagtatagtgtgtgattctagattgaaattcaggaatcctccagggttaccttgtttgctttccaaatagttcagattgcttagtctgaccaacaaggtccctgacacttggaactctgtctatccctctaattgactttgtccctgatgacctcgcccagagatactcttcaccccagctatactgtgttgctagagtttctctgatatcccatgctattgtttcctttgttctcttcataaggtaccatttcccacccgccaactcctgttttcctgatggacttttgtttcaccttacaagatcattgctaatgtatttattttgagaataaaaagtgtaggaaaggtcacgggacaaagctgtacaccagacctttcccagacgaacctagtgtataatctccctagtccaacatcatggcttaaggcagtcgatagatccgtcttaatgtcccttttgagttttctactattattatatgaggatttatttttgtctgaattcctccctagatttgccctagagagcaatgactatttacagtttattcctctttgtatctcttatgttaaggccagaccttggcacatattctagctgattagaagacgtttgttgaatgaccaagtgattgaacaaatgaccatgtgctctgccacagtccggtcagttctactttggtttggttatgtgtttgccacattaaagttgtagcctgggaagttcagttgtgagatgtctgcagaacatgaaaaattggaataatgaggttatttctaaaattgctataatttaaaataaatagtggtttattccatatatgaatatacactggaaacaaagaatttctagaatactggagattcaatgataacatcattgaaattaaataaataataggattatgctagttactttctaatttactagaaattgaccgtgtgcatggcacgtataatgagtatcatgggatagttacaaaaagtggtgcttagtgagtttctgtggaaaatctcggtaccaataaaacggaggatttccagaaatcgatattcctcaaagcttgacagtatttatgcacggttacactttgtgtgtctttcgtttgaatcaatggaaggaggctataactgaaaattattgttttagtgtattatatctttaataataagagttttaagaatctatcattagaaataattattcctcaatttgtaattctcaacatttgaacaaataaatgctctgtgtctatcagttaatcttgcccatgaagatttaataaagcacgctagtttttacaaatgtgattttagagatggtcattacttggtaaaatattttgtgttaacacttccatgaatatgttctgtgggaatatactgcctccacattgcttgctcatgaagacatgatttttcacatcatcctatcagtattttgagaaagagattgatcccatattctatgagcatttgaacattctctagtatttttgtttaatcattaaaacaacccttgaagtctatgtgctacactggttatttccctcttgactttcctttacagataaccctctatcataaacaacctatctatatttgttgtctccacatcatgttgccagccctgctttaacacactgcacattgacttctagcagcaaaggctcatgggaggtactctcatcaaggacactgatggtcctcatgttgctaaatttggtgggtcctctacagtctttatcctagttcaccttattatggaccactgtcaactctgttctgcttaaaacactctgttccttgcttatatgactctacactcttaactcctttgtgaattcctcatctgcccttccattaagtattgacgacatccttcatagttttgatctaggacctcttttcctcttacttgacattatgtgggtaatcttgtctttgaacgcaattaccattcttatgttgatgacccttaagctataattccagcccaaatcatttttctgaggaagctacaagaatacacaaatgtctaatagatctctatttagatgtccctcaggtgcttcaagcttaaaatactcacctgagctcatcacctcatctataaattctgcttctcctccctggctccctgatttatttaatatgaccaccatccacttagttgaataaagcagaagcctggacaccatctatacctccaattaatcactaagttttgttgttaaatacgttcttacattttctctctagaatgtcttattttccccatctttacacccaaaaccaaaagtcagatgaccctgatctcctgcttagatttcaaaacactatctcttgcctagactctggaatttcagtcttgctcctctccaatctatttctacaccctagactctggaatttcagtcttgctcctctccaatctatttctacacaaaagctagagtaattttttaaaaaacaaaaatctgaatgtgttcattttctgcctaaaagccttcagtaattcttatttgttcttccagggatagagtaacaactttcagacctagtttattagctagttctttaaccacaaaggactctctcacttgtctactccccctaacacacttcgccctaacctttgccattcctccctttcccttttccttcccagatggacttaagtcctttcagattcttaaatgtttcttcctccagtctcttacatctcttttccttgtaactctaaaaactacttagcttacgcaaggaaaaaggtctgtacaattcccggaatcagcgatcctaacgttccctgttgtttttttcgttgggacatgaattcattcacagtggctctaaacatcaccacccctgcctatctctcccattcctactttatctgagcttatccatactcttgaagacttacatattttttttctaccaggaaatcattactagccttattatcccactgtccaaaccaataagtctgattaggtatctgtatatatttaatattactatatgtgtttttctaacactctagtagaggagaaggtgtatttctttctgttttttagaagcctgtatttctgctattatagctcttaaggaactctcatgcaattgcctactagaatgtaagttacggtaggataagaactggatcagtcatatcacacatccacatataggacctagcaccatatctaacacacagcaggtactcaatacatttctttcccaaataactaaagagtttaaacaaaccaaaatgattaaatgagaagtaactgttttggtaattcttgtgtccttactagagtctaaattgagtgatttttatatcatcagtttatactcccctttcccaaccccaattctttcttttttaaattttttaaatcaaatatgccttaaaacttcaggatcagttgagtaaaatgatgcttttgtcgtcttttgcaaaataattgtatttcagaattttgatttagatattataaacacacctaaaataatagctttagtcttaagatgaagtgcttcttaaactccctaagatgggttggactatggatatgaacatggacaatatcacattaatttgtgtacacagttctaacacagggtctggcatataagaacaagtcagtaaatagttgttgaatggaattgaaaatttaagtagcaaataaagtattttgacctacaaagcaagaaatcacatttttctttttgtcacagttccttaggaagataattaattttttagtatttaaggatgttaaatatttattttatgttctatttactaggcttctttttatgaaaattaattggtgaaaatagcgtacatatcttcctttaccagaacatttacattttgggcagtaacgctggcttttgttaaaaaagcaaaatatgtgtgaaatttatgtttgagttgatttcaatgcattacatttccattttaaatcttctttgaaatactctatttttgacaccatgaaactgtattagatcttagtatgttagcaatgttttgcagttttagagccataattattttaatgaccactttcagcatatacgttttctacaggaaaaataatctcaagaacatgaaaagtgaaatctatattttgggtttcaaaatgatacattttagctaaaatatcatagttttaatttctcagtgaaaaatatagtgtggtaatttatgaagagactcagtgtttaaaaattatgactctatagtcaagtttatgtttataggacataggttattcaattacatttaaaataattaatttagaaaatgtgatcaatgtaacaaattttacctgttcttttctaaagctaaatttgttgtttgaagtgtttcttctaaaatgctaatgaactatcaatttaattgttgagcttagagttagaaacttaattatattgccagaaataaagaaacaaatggatcccaaaagattcacacattagaaatgtatgccagggaaatgcttttgaatgtgttcaagtcatggcttctaactcgtaacttataacttgtgttatgtctggcttcattcccttaagaaaaaggaataataatgccttcggagagcatcccagctgtaagagctatgcattggtgtctaaaaaagcttctcactcctcataccatcctggtctgggaatttaaaaaattgtcatcttttgataatctgtatcacatagtcttctgcatagtcatatgaggttagaactgccccataacttttgcagggcctatagtaagtgtgcaaatggttgcctgcatgccacatatttaatatttataaggtataaagtcaacagactattaaatatatcctatctgctttccttgacaattatacaatcataatgatatggacatctagattcgatttagaattctctctctctcattttctttttcttctttctttctttctctttctttctttccttcctttctttctttctttcttctttctttctttctttctttctttctttctttctttctttctttctttctgtctgtctgtctgtcttgtttttttaaatagtgcaagcagtttattccctggcaaggaatttggaaaaaactcaaatagcaaaccacttgatacaataaaataaattccttagagttttgtactggaatgaggcagcttggttagagctaaccctaagcctgttatttaggatacattggcttttcttaagcttaaaaaaaattttactgtgttaatgacatttaacatgagatctatcatcttaataaatactacatgcacaatacattattattgactctaggtagaatgttggacagcagatctctagagctaattcatcctacttaactgaaatgtaatgtctgttgattagtaacttcctatttcgccctatccccagcccctggcaaccaccagtccagtctttgattttatgagtttgactgttttagataccttatttcaagtaagtggaatcatgcagtatttgtctgtgtctgtcttgtttcacttagcgtaatcttaaggtccatccatattgtttcatattgcagaatttccttttataaaggctgaatagtattccattgtgtatatataccacatttatctattcatctgccaatgggcatttaggttgtttctgcatcttagctattgtgaatctgttgccttttttccctacctcctttactccatcctgcactgtgaggaactctgtgcacatagatctggtcgccccatttcccacccacatgttcaagtttttcccactcacctcatgcaaagatttaccccttagccatacccagtaactgactttgaaacatttgcccagggagttgagggattctgaatgccagatcatgggagcggggcttctagtgagcatgttggcttggtcctacagactcctaatcagagctttgcctttgaaagcatggggcccaagggcaaggaccctacttgttaaggtctaaattttttttctgaaataaccacatcgagcttttatgtgtagatggcctaaattgggctaacccagaggcagtgacactcaagtagtttacatctaagcgctttccatgtgcttcttttcccatttctgttacttcttacaaaataaaaaatcagcatctcaattaccctgatttgatcattgagcaatctaaaaagtatcaaaatatcacatgtagcccccatatacatacaactgttatatatcactataaataaatatatacacattatatttaaaaatcaatactttaattttacatgtttaacaaatcactagcatatacattccagattgaacttacgagggatgtggaaaagattcagtgactaaataacaataaagtactctaaaaatgaaaatgtgaaatggagacagtataaatctaaaatcatatcacttatgaagtattgtttcaaataaacaataaaatatatcttcaatcaatttaattttattttagttgtataaaatctttcggtcagcattaacctaattggaacactaaataggtacatctaaaaaatataatcccccccaaaaatatgtagctcataagagataatgcattgaacacagataatattggcgttaaaaacagaactctaccacatttgcaacgaaatgtttatctgttcttcctactagaaaataataaaatagttctgcatgagcttgaactcgaagtattaggtgtacaaagaccttttagtgaatgaatgctagctgaaaagcaaattttaaatatgaaaaattagcaagacaaacatttgaatttgtgggagatgagtaaaactcctataaaaatgaattgtttagtgttaaacagattgtgtatgaaatattaatggcatattgtcctgagctccccttccgctgtttccatgtagatgactgaatttcaaacagaaatatgccaggaatgattacgtgaatgaatattactacatgagattgcttaaagagtatttcttcttttgccttctttttactttcgttatttcatttagtagttagaaaatactgtctacaaatatgtgagaactgcttaatttatttttgagacattaattaattcaactaaactatattgactgtgtgagagagattcccttggtgaatatgtggatttttgcggtggtaagaactctcctctggagcgcaaatggtattgctctaggaataaagcatatacctcaggcccagatgaaccagtgcaatctacagtaacaggttcaaagatgacctcatgacctactgtggactaataaaaatcaaggagacctactgcaaaggtttctgggaaattctttttctcttgcgttgaactaagtaatatacatatgtgatagttagagctgcagcctttgtaataccatgacagaagataacctgaaataaggctgacagacacaagagggagacctaagagtactgagagatatggagcaggaccccctgattgaacttcacttgcagcccccttctgcagttttcaatgacgtgaaccagtagaatccctttgtttactgtttttgattaatttgagtgcagctttatgttatgagcaactaatagcatcctcactgtcacaactgccctctatacggcaggcactttgtgatactaaagaaagcagtatacagagtagagcccagtgaataacagggcagatgttgcaattaaactgcctgtttaaattctagctcttccactagctaacttgtgactatctaagtaatttaaccttcctataatcatacctatcttgaagacttgttgtaagatttaaagcacaacagtgctactataaaacaggtatacagtaaagcttagctacttttttattaggccatatgatatcatttcattaaaatcttatagccatgctataaggtattatgatcctcaatttataaataagacagctcaagttttggtcaagtgactttaccaaggtcatagagctagaaaataatgattccaagttacaagccaaacctcttcaatgccaaatttacatcatcccccattacttgaagtgtaagattcacatggacagaaatttttgactgtttgatcactgctatctccttatcatctaaaacagtctctggtccatattaggtgttcaataaatatttgtagagtacataatttccttcacagactccacaatctggtgaaggaggcagacatgtaagagaattatttcaggattccacagttgatgctgtaacagagctaaatataatgaatggaggaggaatgaataagtttgtctgggagcaatgctatggctattgaaataagtcttgctcatgctttgattgaaatggtggatatagatcacacaacaaataacaattagataacagcttgttgggagaaagcgaggatcagtgtttgccataaacatttctcatagctaatgtcaggtgtttgatttctcaacattttatatctttgactttgattttctctgtttttattttttaactccattctcaagaagtctgcacataagagtttcaacatctagcacttcataactccgtcatctcctctcaggcttagagcaaattctgagacgtggatttatcgtcgagtgatttcttcctggcattttatctctgagaccaggatctggttgctaagcatgtagacatagaaatgcatttcttcattgaaccccataggttcaaactagtggataatgagcacaatgtcaatgtgattatttgtaatgggggaaaggttaccggagaatattacacgaccatccacatagactaacattttcctcatgactaagtttacttagcaaaacaaattaaaaacagaagtttgtttagcagcacagaattgaaggaagacaaccagatggttatgaggaagattcatccaaactatgccagaactgaaagaaattaagttcattcagtacaagaattgtctagaataagagaatccattttgtgtcagcacttcccaagttcttgttaatgctaccttaagttcaattcaaaccaggcagcatttattacgtgttgtgctgggtcctaggaggaccgcgttttaagaacttactgtgatcttctagatcaagtttttatttcaatatttctacctcatttctgattcttaggtgttccttatttcccaatttatcccctgcagaaattgaggcaataagatgtctatcttattgcctatggtgttgattatttatgttatattctgttttgtgaagtttgacctctacctaattaaattacattttcaattgtatcttggattgatttattcaataagtattctttaatatttttgcatgaggtcggtcaggtttcatcagacattaggaattaattataaaaatctctagattggtacttggagcttaaaggaataaggtggtggaacgttaaatgaggaggaaagaaccagcagagctgggataaaattcatctctatcatcttcccacctgcttgatctctggcatataatttactatccgtgaacctcaggtttctcttcagaaaagctgcagggttgttgggggaaataaggcaattcctgggcttcagtatgttcaaaacagagcattaatattattatagacttttgatgatttacacaattttagctttttggcaagacatatttactagtactaagtaaaagcacgttgactttctaaaatgaaaatgtgtatgtgaggatgaagaaaaagaaagtgttttgtttgataatatagcattataacactgcacaaaaaaaaaatggtatatgcagagacttccatcacttgcttatgatgccgcattgggatctcattaataagacacttcctcagacacttcctttgtgttcaataaatttcaatttcctcctttccttcagttcacttcaagaaggacggcagcaactttcttgttgccaaacctgacaaatgttttttagtgctgattatactcgagcattctgtagcaaaatgctgtgggtgaaaatgccttccttcttaagggaatttagcttctgtagtaccagaatctccttgttgaatgaacatgtactgcctaagtcttagtaatccctcctttttgagcccattttctggcatctctccctttaatattcctcaaaaagttggatttttcctggacttttcatattacagactttcctttggtcatcctcatccattccgtgattccaactacattttccctccatcctggcatcttctttcttccagacttgtatatgcaactgcttccattcatacacttgaccaaccttttaatttctataagatcaaaaactcagctcacaagctttcccctaccatcgagcggggttcttcttttgcttctttgtttcagacaatggcaccaccatactcgagtaaggcacgttcatttatcaggtcctaccaaatctacaataaactctcttgaatttatccacttgttttcatttgaacagtcatttctttacctgggtagcctgcaccttctacctgcattgattcagcagtctcttcaccactggctctccctccctctcctgcctctcttcttgctccttcaatttattctctactcttcatagtgacttttattaatgcaaatatgaccttataactcccttgcttaaagacccactcatgtttgtctttgtatccataacttccggcctagggcttaacgcatagcaggtgctcagtaaatctgtggtagatgaaagaacaagttgtataaatactgaatggtctgatgtgctctttgttgtgtcaagaaggacattttgcagtcaggatagctacatcagtcctttagtaggcatttgacagcactcgcattattcctcaagagaagatggatgtattgattctgtatttcaaatgacataacttttgtgaaataagaggctgccacggtaatctgagggatctctcaagttcaagggactccacagtgctttgtgtaaggtaacaggctaaagggttcagtcttaaactttcttaagactgtagttcagggttcctatggtggggctataaccctgaattacatcctctttcatttcatgctgataatgagaactacaaaccaaggggtattaggaaagaatccaggtttgatgcagggaaaaataaaaacaactgataatctctagtgtccccaacttcaagaattcctttcttctttacaccaagctttttttctctgccaggacttactttgtcttctacatgtttaagggagaaaaatgagttaacagaaggggaggtacagcatttctatttacttagatgctagagaacaggatgaaaggtatgaaaaatatgaaagtctctctctctctctctccccagccttcccccgcttctctctctctctctctctctctgtgtgtgtgtgtgtgtgtgcacgtgcgtgtgtgtgtgtgtcataatactcaacctttcttttctttcaagcatatgttgtggcagagacaagtgtacatcaaaattcgtggtccctctttcatagtatagagttcttgctaggatccagctgcaagccagcaactacatttcccagccccactggcatctagttagagccatgtgactagttgtgaccaattgaatgtgagtgggagttatgttgcaggcataccttttccatcttcttacttcccatttgctaaccttatggaaaagagtcccaaagacctaggagatgaaaaagcctaaaatggaaggactcagagtccctgaattactgggtagagaaaagctgtttgcagatgggaatgcccattttgtagtattctttcttttcttaagccactaaaattgtgggatctctttgttatagctactggcattaacctcttacgtatacatacagctatgtgctacaaagaggaatagatacattttttaatcgttgaaaggggagaaagaaacatatttaggaggaaaataatttagtctctacaattgaaaagtgttttatgaataatattttgttttggcagcatattaaatctcaggcagctgaactacattaattttcaattctctatatatgtttttgtcttcagggtttagtaacactgatatataacagtttctttcttttaatttccaaatttaaatgtctaagtttgccttctaggcagaaattaagtcccattgtggaatgagattggatcaacacttcaccaagatcattttagttctttgtaatcttaaatgaaataagctaataaagcattaaattagcatgttgtaaaacttcgtgaagttttaatatgcttctaagtggcagctcttagcttattatctctaaagctaaagtcaaaataaatgtctcagttgatgaaatggagatgaggcaacattttatcaaatttaacaaaatattttatatctgaattataaagtccagattatctagtaattatcatataaatgtatttaaccagacatgcatttttctctaatcagtagccctggagtctttggaccacaaatgtgccttatctcaaatgctttaactgtgacattttgctttagactagctcgactacttctacagaaattatacacttcattcacattcatccagatgaaaaaaatacatgtagaaatgatcataataagtaacatttgtttaggatttcagagtttacgaagggtttttctattcactttctcacttgttcttcatgtaaactggtttggtggacaactgtcattatccctgttacctggagcccctgggtcttagggagacttcttgacttctcaaggtcatgaaggtgctaactctgaccgtgtttttattcctactgtgccacacttctcaggtaaaaatcatattgcagacactttaagagaagtacttaagaaaataaattcctccagagaattacatttaagttgtttcattaactgcagtgcataaagaaaggaaaagtgttcccaaacccatgtagtattttgctattgcttatggtaatattctgcacacctaatattgtcagcataattttccatgtaacaaaatgtcctaaatcagcaatgtccaatataactttgtgtgatgataaaaatgttctgtctctgtgctgtccaatacaacagccactagatacacatgactactgagcaatggtaatatggccagggacactaaggaactaaatttttatttaatattaaataacgtttaaatttcaaaagccgcatgcggctagtggttgtcatcagatactgcagttatagaaaattagaatttacctctttaaatactaaacctatttttaatagtaggatttttaaattaaaatagttctaagtgcttttaagtgatacgaagtcaaatgcaagatttctgttttaatagtactctcaacccagagacaatcttcatgcatccttatacatgttctttgttgccttattctagttttattttaacattaaatgcctctgttctacttgatattgacttgcttcagagaacaccaagtatagtggaaagaaacacacacatgaggacttgaggctaccaaccaggttcaactaaatgcactctgatttaattgtagtattgggatcccctgttgcatttattgaagaagaaaaaaactttgcaaccaaaaagatatttgaaagcaactgttcttcttggacacatgatccctcataaagtggggcttcctgcttttcagagacttaatttctgttcatattcatttcagcaatagtaataatgatgatggcgatgatgataataatcatgatgatgcctaagtgttgtagtaatgcttcttctgagccagacgttagtcaaattactttctctacattaattcaggcaatcatcacaacaatcccacaggacaggttttattattatacttatttagctagcaaatgatataactaggttaagttacttgcccaaggtcatactgccaagacagtggctctagtgtccctgcttctgaccatatgttatgctgcctatcctagagcttttctcttctaaaatagtaaaataatatattctttgtttgtttcatacttttttttttttttttttttttgagagggagtttcgctctttcgcccaggctggagtgaggtggcgcaatctcagctgactgtaacctctgcccccaccaggttcgagtgattcccctgcctcagcctccgaagtacctgggataataggtgcccaccaccatgcctggctaatttttgtgttttcagtagagacagggcttcaccatgttgaccaggctggtctcgagttcctcagctctggcagtccgcccgccttggcctcccacagtgctgggattacatgcatgagccactacacccggcccatacataaatattttaagcgaagtacacatgcatgatcatcatacttttaataatttcatttaactgtttccaaagaatgttagtatgaggttttctttttttctttttataatttcaacttttattttagattcagcgggtacatgttccctggatatagtgcatgatgatgaggtttgctatatgaatgatcccaccacccaggtagcgagcatggtaaccactagttcttcaacccttgcctgttcccttcctccctccttcctctgtagtccccagtgtctattgttcctgtctttatgtccatgtgcactcaatgtttagctcccacttttaagcgagaacatgcagtactcgttgtctgttcctgcgttaacgtgcttaggatagtggcctccaattgcatccatgttgttgcacaggccatgattttgttagtttttatggctgtgtagtattccatggtgtatacgcgccacattctttatcctgtccaccattaatgggcacctaggttgattgcatgtctttgccattgtgaatagtgctgtgatgttatatgtactttttggtatattcaaagagaaatgctattttcctcttgacatatttatgtcaatttaacatatttatgtcccttttctttttaggagcaccattctcttcctttaacattataaataaaatattttttgcttttctgtttttgtaagtgcagttttattgacagagtgagacatacacgtcgatattgtgactagctgcatgtcttctattatttagaggtctcactcaaatgtagattatcaaattctgttagtgaagagggtagaacagcagaactaatgctggtttccttctctagcattatttgatgataaactaagatgataataccccccaggtcttagatacctgcagtaggacaggcaccctacatttaatgctcctaggaatccttcaaagtgatagcatagttattatacagtaattgagaaaactgatgttcataagttagaaatttttccgaagttgcaaagaaagtgaatggaagaattataccaagttctggccgggcgcagtagctcatgcctgtaatctcagcgcttcaggaggccgaggcgggcggatcatgaggtcaagagattgagaccatcctggccaacatggtgagaccccgtctttactaaaaatagtaaaattagctgggcgtggtggcacgcacctgtaatctcagctactcgggaggctgaggtaggagaatcacttgaacccgggaggcggagtttgcagtgagccgagatcgtgccattgcactccagcctgggcgacaagagcaaaactccgtctcagaagaaaaaaaaaaaaaaaaaaagaggattataccgagttctctttgattccaagcccaaacaaatccttttttgcaatatatgacattgtttccctgtttgcattccccattctgtgtatcacacatcctgtggcctgatcaaaattcattttcagattctgaatttattttccattgaatctatataaactataaagacagaagatatatgtatgtgtgtatacccacgtttctcttccagtgtcaactgataaaaatagatttcaaagtctcaataacctttaattccctttttctcttaaaaattctttagaacttgtacatgacattctgactctagcagattttagaaaacagagaggccattagatattcataccttactattcagatgaagtattcaatgctaaattatgtaatttatctgctttgcaaattgtatggtcagattgagttccacaaaggagagataatttttaatataggcattctgtagcttccctaattattgaattagtttagagcaaaatccttaaattgtatcgttgctatgctcaaattttgtatacttgtccacgtaggctatattaagatttcattgaattttggtttctttctcagtgataattcaatatatcaactcaccactcagatttgcctttgggaaaatccaggccccttttctggatttttagagcagattttaaaaaagtgattctgtatatgtgttgaaattaaccacatctcattgcttttgaatgattgaggtaatgtatacctactactttaaaaaaaatgacttacttagaaggtgtccatagttttataagttccattgaactggtttatattgtatttagaaaggaaaactactccttttatccttaagggtgaaaacctggattttattatacaattaacacatatttattttttattatgaaatatatcacaatataaacgtttacagggagtgtttaaagtggtgttgtccaatggaaatataatgtgagtcaaatacgtagttttcaattttctactagccatattagaaaaagaaacagagaaattaatgtaataggatactttatttagcctagtatatccaaatcacaattatttaaatatgtaatcaatataaaaattactaattatgtatttaacctttttctttagtaagtctctgaaatctagtgtatattttacatttatggcacattgcaatttgcattagtcacatttgaattgttcaatagccacaggtggctaatggctaccgtgttggacagcacaggtttaaagaataatatgaacatctgtgttccaacattctgagtttcaaataagaagaacaccatcagtattttgggagaagctccctatgttaccccttgctaatcaccttccttccccccagagccaaaagtaaccattatcttgaatttctagtaaacaatgctcattttttaaaaaacgtatgttcaacacctgtatttgtatctttaaagagtagctagttttagtttgcctggatttgaactttatattaagggaaccaccccatctctaatcttctctgtgaattcttttctctcaatactatgttttacatatttacgttcatcaatgtgcaactcattgtatgtatataacacaatgtatatattttacatgcgtatggacatttgggttgtttttatgtttttgttcatcacaaaccacaacacacatgtgttcttgtatatgttttatagtgcatgtttaaaaatttctcaacagtattcgctagtagtattgtcaggtcatagggtatgcacacataaatagaaatgattgattagctgcaatttgtagtgcacacatatttgctatgtaagtgatccatgtttaagactttaactgaatttaaaaaatattttattggagccaatctaaatgagctaagggtttgtattgtttacataagcaaagattacacttactgggtcaattcggttgattaactttggatatataaaatatatagctagttgttaaatagatataattattaattggcattacttttgtttgtatataaaaatttcaaaatatccatgacttaagcaaggtaaacacccactgggtggcttaagcaacagaaatgtatttcttgcagttccggaagttgaacgtctaagattaaggtgatgacagggttggtttctggtgagtcctcccccattggcttgcagatagccgccttctccttcatgacctttcctctgtgtatgtgcatcccttgtagctgttcttccttttatgaggacattagacttattggattaaggtcctacccatatgaactcatttaaccttaattacccctttaaaggccctacctccacttgcaggggttaaaacttcaacatatgaatggggttgaggagacctacttcagtccataacagtttctatattctgaagatggtctttaattaactaaacagttaatgttactttactgggaatgtcttttggatgggggaataagctgatgatatgagaagggttggtgaatttctcataagtgtgaaatttgttgggccggcccagcatgattttcaatcaaatacgctttggggacaagtaggttgaatcactacgagaggtttaaaagaaagcaagttgtaattgcaacttttaattgaaagaaagacaggctttgttgatgtgccagcaagactgataactggctttaacgtagatagtaaggcagcagattcaatccactgatcgtgatctactagtgaatttcaaagccttatgcaatagaactacaaaccctttccttgcccaccttgcaggtggatccataggcaaaatgaacatttgcaaaaaagccgctatgtttcagaatttgtgctagggctttaatatctataatttctccaaatcctcacaatttaagaattaattcaacttagccccatgaatagggtgaaaattctgagatttaacaaactaaaataagttatctgaagacagacaaatagaaagagttgagatattctatttgaatgtaaaattttcaaaaagtagaatgacagcgtcaggaattacagtctcagtgttgaacacaagacttaggaacaaatttgctgcatgtaatttcattgagatgggacaaagtacagcatacgtaaggaagttttagaacaaataagataattattttacgagctttgaaacatgtgtaagaaagatacgaataaaagtataatcacatttgactaaaacatgaataccttaaaactgaaaagcactgagattatcattatataattttgaatattttaaaccacaatgctttgggagtgcactgtaatattttagaattggaattttaacttactggcttaaaaagtaatgtactttgttttaaattcaaagattatcttgtaaattcagttcgatctattgaaaaaattataaaattcggcaagaagccaaagaagaacaattatgtagctcaagataattaaattttcatgtttggctttagaaatatattcgtcgtgacatagtacatggtaatctagtgagcccagacaagtagttttctctttttgtcaaagggaacaatttgatgcgtgttcaagttgcttaaataaaattttgtatgtgctttctcatcacaagagaacaatatgatttttgaaattatttttactttataaaagaaaaaaaaaagccctcacagagaaaaaagaaaaaaatgatgatgtctttgaaaaacaaagttaatacagctttacatatatttgacctacatcagggttaatatttttcaaggtgaaacattagatgctggaacttgcaaaaacaggcaatcctcctttagatgaaacggacactctaagggttaattcattcactgagacctattgtgaagtaagccctacagagactgaaaaagttaaatgcaactcacaaaagttgctagaagagtcatgatgttaaaataaaataagtacacaatgtatgctgcaagtatacttagagccatgctaggtgcggttgagaagttcaatacaggtccaagataatagctgcttctcctatagaacatgtcttctcattggagggataagacctgtgtctatgaaacaggcgtaattacatagctctggaactatatatgccgaaataaatgagacagtaagtgttattgtactataaagaatgaagaaatcatgatgagaagtaacagttaatgaatgttttctagaaagagtaggatctgaattggccttaggttgtaagcagagtttatagatagagtagtggtatgtcagagtcactctgggtgcttaaacatacaaatccccaagtctcacccaaatgtgtcttcagatgaaaggaaaaaacaaatgacttgagctcccccgcaaagaacacgggtggtatattgagcagccaaggagtgaccagagtggcaggcccatgttgagggacaaaagaggacaattagaatatgattaatacaaatttacagtgggatgagttgttagcctgaggagcttgaatgtgaacctctgtgcaaaaaggagtcattaaatacttttgaaaaaggtgggatgggaagaaaatgacattctcaagacaattagatcgaacagtattaagcatgctgacttattaagttatgcaccttgagagggtggaatgagggaaaagggtctttatctggagtaagacaggaagaagctaagctgtaattcttactggactgtaaattatgtgcagatatattatctgtcatgttcgtgggcgcattctcagtacatagcacttgaaacaggtactcgataaattgtcaaatggatgcatggagtgatttccatgcaaaatctaatattgtatagtattagaagggggaaaaaagcatggcattatgctagcagaaatgtcatttggtattgaggatgaaacattttcaacagtttgcaaagccatccactcaaacattctgtcactttccaataattttgaaggatgttctttctacttctaccttattacacaatgagttgagtaagataaagaagtcatgtgcaacaaaacagagggagattttctgaaaggcactacaccaggaagttgttgtactcttgcttcatcttgccatcttggatatacttctggcgctacctccaggccagttcctcgttacatatgtcatttacttcccacatgctagactcaccgagttaatcattttgctgcagttaacacattttagcagagtgtaggtttatgggtgagaaggaaatcaatgatgtttcaatacagggttcttttcccatcccccttatttccacttagaactgtctctcaagtcttaatttgcctctaaacttttttcccagcttacattcttttctgaaaaatgcaacgacgatgccaatgtttgttgacctgaaatacattgtaaaacattcataatactttgagcagagcttccaaactcccatttgcctcttttatctcccttaccttggcccctttttgaaggcaatgtgatatttaatccgtttctattgatgcttcaaaattattgaaaaactggtaattgtatttttccctttacttatcagttgctagttgacaatgagtgtttgcccaaacaataaccaatcaaaaggtaaaaaggagattccagacatatctgagaagaaattctttggaagaagcccgtaaatggaatgggaattcaaacaaagccgtttccaaaagaaatactaaatggtctctaaatgcaaaaggattgctccccaagcattttatgggagcataaaaagctcccaacacattttatgacaatacttctactcaatgacttcttgtgttgacatatttgttgcactcgacgttagtatttacagcttcttatcccaaatatttacttaactgaagccctgatgtttttaaaaacttttcatctgtgtttaacagcccattttacagaaacttatttgtttcatcaggcagatatttactgagaacttgcaagtgccatatattctaaaaatgctgatgataaaactgtgaacacaatagattctcatggtgcttatggtcagggctagcacacacacttgtgaaatgatcactgatgatcaaaggcataaacactacatttggaagaaataccgagggatccagaagtatcttggaaacactagcaagtatagcagatggtgggattggtgcttcaaagaacttcttgtggaagatgttacgtatgtaccttctctgtgccaggcactgctaggaagtgctggagagaaaaagatgtgctagataccgcctctgtcctatgtgcttgtgctttgtggggaggtgagtaggataatcccagttctcatgcagtgtaatgagtaccatgacggaaatgcactccaagaactaggcagcatgaccagagataggacatttgagaaagacttcactcgggtggtactatcttagtctgggtgctaaaatagatgtgatagatgagtaagggtgacccggaagcaggagggaaagggaggggctttcagaacaacaagtgcgaggacattaaggtgaaatagagtataatagtattcccagatccttgggattgttctccattaggctaaaacaaaggtgttttctcttctttaagatttcatgactgcagattgcataacagaaggtcatttaatagacctctaaactgaaggaattcttgaattaaatcacaacatatcttccatggccagagaaaccattgcctccttatgtcgacattactaacagcaccagcacctgctgctcaggccagcgggagggttgggtgttgctgcctaggtaatgctcaccaactgatgtcctgccatgagtagttttgccaagttccacaaaaaaaacttagtgttctatcagcatctaatgagaattacagtcattagttaaataaaagaactattagataaggagcagaatgaacaacacacaatccatcagcttggtgaatggtatcagatggtttctgggtgctgggcagctgtgcatccaagtagacagggagaatatatatgtcctttgccttatgtacttgtttctctaatccaaaggcacagcaatccgtggaagctgctatgataaggtgtttagtggtgaaaatgtcttgaaagccagtagattattaaagtgatgtttttaaaaatgcagatggagagtaagtactttttatctagagtagtagttctcaaagggaggtcccgggatcagcagcgttagcatcacttgggaacttagacctgcatgggccccattccagatctcacttgaaaactctagggggtgtagcccggcagtctttgttgtgaccagctctccagggggttctgacactccaaatgttcaagtttcagaacgctactcacaggccatcatgctcggcatcacctgaaagcttgttagaactagaaagtcttggccccaccccaagcctactaaatcagagtttttgggagtagggccaagaaaactgtgggttaacaaggtctccaagtgattcttattcatgtcaaaatttgaaaagcgtcgatcgaactgttggttctcagctttgattgcgtatctgaatcacctggggagacagttgagctattccgggcccagatcacatctagaccaattgaatcagaatctatggaggcaggacccagacatcagtattttaaaatatttcttgaatgatcccagagtgtagctaaggttgagaaacactgttctaggattaaaggattaatgtgtttgagagtatgttaagatcttaggcaaatcacaagggtgttaagaactaccatcttcgcaaaaggagaatgtgcctcagatattctggtactgctttgattttaccttcagtagtcttacctattttgagtatgcttagtagtactaatatgaggcttattactaatatgttaaaatttgtcttttaattaagtgggtctaaacgttttaatctttaatctctgacccaactagaacttttctaaacattttcataatagtctccaccttgtcttctgaccttcacttatgttctttcagggttcttcgtgtgttactagtaatagtaatggcaagtgtttattgaacacttactatgtgaagattctaactggcttttaataatcacatcagctctgggaggtagaaggtagggatcctccttgcttatcaggtgagaaaactgtactatagagaagttagcaacttttcccaggtcataatatgtgacagctaaagggagcataatggttggaataaaataaatctactctagttgtaccgaaggctcatatttgtctcacgtacttgatttggtcgaggcccaaggggtcaatttccaatgcttggattcctggatatgtagagttgtattaaaaatgctaaaaacctattatgtatcatacaatcatacatatcacctaaagtattatggaaatgaatctgtattattaagggaaaaaggcctgtgtgaagaacaactgaaacttcattttaattgaaattaaataacatgcatcatacactaaaagtgcacgttatgaccccatgaattacttcaggtggctttgattcatgttacatacactaacaaatatagaagagtgatataatgcttcttaattaactactaatggaagtttactatttaactgcttcttatgtaagaatgtaaatgttttctgaaatatcagaacttttcattaggaagcacttttaaaaatagcaaaactgatatgcactatgatttccatatacattaaattgaacttgtaaatgatgttataaattatagaaaccaaggggatgttcaaattagatatttgtctaaataaatcatgtatggattgaacaaatactcattgagaaataaatgtattccttttctttcaattatctaggattccttgtttatctcttcagaagcaaaatgtcttctgtccgttttatttccagttaaacattcttcagattatgtaaataagttaacttccaatcctcttatttctgtttatctcaccactcttctaatttagacgtgatcaatatcttatctttttgcatttcatagacatcaggatccagaataattgagtgagctcaaaacaacaatggcaagaatgatgttttcagaaaactcagcaatcattcgtttaataaatattcattgcctaccaactataagcaaagtattggctaggccatgtggggtatacaaaaatgtattaaatatggctcattctccctaagaacttacacctattagacaaagtacatgcataaaaattataatgtataatagaaaataaatacaagccctagaatgcacagttgaagtacgatttgcatttattataaaaagaaagatgaattggctgggcacggtggctcacgcctgtaatcccagcactttgggaggccaaggtgggcagatcacgaggtcaggagttcgagaccatcctggccaacatggtgaaactctatctctactaaatatacaaaaattagccgggtttggtggtatgcacctgtaatcccagctacttagcaggctgaggcaggagaattgtttgaacctgggaggtggaggttgcagtgagccaagatctggccattgcactccagcctgggcaacagcaagattccatctcaaaaaaaaaaaaaggaaagaaaagaaaagattaatttcctgttagctaaatcaaggaaggcttcatggagaaaaaaatatttcaacacacacttgacgtagcagtgggatcaggctgatgttagggaagaatgaatgacattctacactgagaaagagatattcagtatatatatgaagagcagtagagaaactaacaagtggaaatagactcaatttacaatacttgcctgcctggagtactctatacgttgactgtaagttgcagtttactcagaacaatcccactttctacttgtttatcctatgtaatcatttattgggcctccttttgctctcaaaaatatccttgtttggataatagattatcactctgttcctaaatgaactgccctgtgtcctatcccagtaaaagggtgcattcgggcccttcgtaactgcctccactacatggttgattgaaaccagagcttggcattaagaagttagctgaacaatcagatttctattcttggaaaacccaagaatttcagaatagatacagaagctgtatagctttaataacatgacagagttgtagccttgaaagctatgtacaattcagaattatgagggagaagaaattgaagaaacagtagcagccgggtaaatgcagaaacaaatgagggagacacctagggggtgactgaggcacaataatggaagagaagtgcagtgaaattgcttgaactcttactgatgagatttctactgttgccttgaatccaggaccacctatatgttcattctttgtcatgctcagagttatgacagatgctgttattgaattccccagagactcccttatcgtctcacctcaaaccttacaataatcccttctatctttctatccatccaagctggcttaagtaaagtctatgatccatattcctagtaaacagagaagggaaagagactgaaggcaaaggccccaattagtaggctattgcaatatttcagggaaaaggcaatggccatcacattgttgtcccaggaatgagaatagaaatgaaagaagataatgaaagttgaaaggactgggggggcttgacaactgtttagacttgaggagtcagataaaataggaagccaaagataattcagaatattttgattttgattttcatcaccaaataagatagtagtactatgaagaaaaaatggttaaaaaacaataataataaagagaactcctccaaatagtaccaagggagggagtttaatagaggaaattaattccgtaggtgatgagagtcctgagaagccaaacgagaaaagatcaaaacaacccagggattggcagtcgcaggaagctgttctcacttatggctggggctttaagcacaaggtgacatgagatttcagaatttgaagtcgtctggaggcagctaggatcaggtggggcctgtcctgttcggcaggacctgcaaccacaggaggaggatgcgtcaagcagaaagttggaacacaagaggggattcagccataagccacaaaataccttccagagcagagagaaggagaaataccctgaattccgtattttccctgccatttagttccctgctattgccacacattgacgtattccatccagagaagtccattggcatatgagtctgggaaatgtagttcccagggggacatgatcttaagggaaatagacaatgactggtgcaacaactgacctgtgtgaggcaggagggaaaaaacaggaataatatagtttttctctagatcccttcatgcacaaagatgcaaaagaaatgtgttggcttaatgagccattctgggtggccctgtaggtggctgtcctacgaataagatttttagacaaaacagagatgacttcaaatgtcacaagaaaagtatcagacaggaattaatattgacttgatctgtcacaggcgtcaatgatttgcattaagccaacgatcttcattgttaatgtctgggaaattgccagcagcattacgactacttgtgtggattagtgtaacggattcccccactaacattcaggaaatcatgtcaagcacagagtgcctatgtaagagtggttgtgtctattcactacatttcttggactaataacacacttagccttcctgaattgccaacatgtacaaaaccagattggggttttttagttgttcatggaactatcatttattgggtagctcctgtagaagcaagatacagaaactctaattaggaataagacagtccctgtacttcaaagagctctcaggggaggcacacaagtaaacaagcaattattatcatacgttaggataataccgtcatggtgataaccactgagtgatagccaaacacatggaagaggtacccaagtctaacttggggtagtcagagactgctttcaaggatatccgagtaagtgttagctaagacatgatacgtatttctaggagggaaattttcaaggcaaggtggagattgtgcagtgacgcccagagcctggattattttggtgactgctagtatttcagaatgacttcagcaaaagttgtagagaagatagaagacaacaaagtataagcagaggccagataatgaggacctggaacagtggtttgctggtaaatgtttaacaagaggctcttggcggggagagagagtgtctgatttgcagcatttggcaaattttgttgcacaaatgctccagcatagccaatttcaagctaccagtgtgacgtcattgaatgcagaattggaaagaaacgggcagtagcacagcattgtatagttattttcattacccagatataatagataaaatatccagatggtatttaatagatatggatgcaaaatttaaatatatgtacattcatgtgcttcatgttactgaatgcgcacaacattcattatccattcattcacgtgttaatttaacaaacatttctgagcctctgctctgtgccaaacgcagttctagctgctggaattacagcactgaaaaaaaaaatttgtcctcactgaggtaagacaaacattattatgcccattttacagctgagaaattaagacatatgaggattaagcagtatagttaaaatcacacaattggtacatgaaggaatcaaagaggaaatcagctctcagattttaaatccagggactcgtttctgctataccatactacctacctagttgagctggattttatcatggtttccctatttttatcaccatgtggttggataagtaaaataaatatatgtgacctttcaaataaatttgggtcatttttcttggaagctcatctggtgtgaactttaaaatactgcaattaataatgattataataccctggaactctgtagcaacctcttttgaagaactccaaggagcctctaaatgtatcaaactaagttcttcaagtgaattagttatcatctgagagtaatatagacttttaaaaatgcattaattgtattaaccctttcaggcccatagacttaagtgtttctttctccaaataaaaatagtaatctctgtccattttctttagagaataatgaagtaattttcattgaatatgtagtcaacataattacttcaattcaatcgtgaaggattttaaaaattatttatgtctactaacttaaagacatgcatagatttcaagaacttaaaaatgcatattgcctctttgccctatgcctcataaaacaaaattatgataacgttgtgtgttacagaaaaacgcactgattgtaatgaagggtgcttcaaaggccatgaacttggaaagcaacttatttacagagacccccagcaatagcagctaaaagattgactgactccctttattttcagttatccttcagacacttttgacctcttcctgtgcctttctagtcatgtgcaatcttgtggatatctcttccttcctcttgttattttctatttcctctgtttctatttgtttctaaaaataatcatgtttgaatataggattagcttccttcccatctccccattaccaatctctcactataccgctatgttattaatcttcctgagaaatatatcaggttcattacattagttaccagctcaaaacgtatcagtggctttctagtcctcacaggctcaagttaatctgcatattctgactttcatattctgggttcatgcaaacttttcaactttccctcttatacctacttaggaggaccctcaggttccatcatgctcatgtttcaagccagaagttctcctgcctcttcctctatgtagactccacatagactatgatatcctgcttctcttttaatcctccatcttcagctcacagccacactcctctgtgaacagttaaatgattctcccacctcttacctcctatagcacttatttttcatgcagcatttttgagacttaattaaatctacagttttaaaaaatgtttttctaccacagtctcttattcatactaaaactttcaagtctatccattttgcttatacaaccacaccgttaggtcttttaggtccaagaatacaagagaatggcaaagcacgttgtttacatccacacatactgtgtaaattcaggtaattttttttaatcctatgatcctcaattacctcacctgtaaaataggtactactcatactgcagaactcttgttggaattaaataaatgagtgtattaaaaatgctcaacaagatttggcacaaaatcggtactcagtaaatgctaatcattattccctttctcttcaaagctccacaattctgtattcatatcaccctctttatatcatttgcaaaaatgtatcctattccaactctttccacctagcctcaacatttacaaacactcctggtgggaagggaaagcttttgaggagagcacatctatactcatttacttctcagggatgcaagctgccctgcttactgagggcatatgttcatagtcacaccggagcccactgtccccttatactctcaaatgggcagtagcaaatcatcttgatcggtagtaatgacctgtctctaaattttcacatgcatcagataatttcttttttagtaagtgttatcttacatatatgccaaaatatcaccattatatggaacactagctgaaagaaaaattattcagtagtcttaattttctagctaacataaattctctccattttcatcatccatttagattaaagactttactgttagctgaatattcagagactttattctgatttttaaaatttatgaggttcataatgttaagacttcaagggtgagctgtttgtgtcatttataatgcgtgactagacagtaactagaaaatggattgttgactttacaagatttctccccaccacgtccccccaaacctgtgctgctgtgtatttggcctgaaatctttacttctagtcaatctttggacctaaagcctaccagcttttagcatcctttaagattgacgtgtctctgggagaccaatagatgctaaaccaaatttcgtatgcacttggcaatataggataataacaaccatactccctgcaattgtttcctaacacagatgtaacaaattaccacaagctgggtggcttaatagacatttattctctcacaaatctggaagctaggtgtccaaaatcaaggtcaattatccctctgaaggctctggggaagaattcttccttgcctcttccagcttctggtagccccaggtgttccttgatttcaagcagcacaagttcaacatctgctcctgacctcacataaccctcttctttgtgtgtctttctgtgtccactcttttctttattattattattattattattattattattattatactttaagttttagggtacatgtgcacaatgtgcaggttagttacatatgtatgcatgtgccatgctggtgtgctgcacccattagctcatcatttagcattaggtatatctcctaatgctatccctccccccctccccccaccccacaacagtccccagagtgtgatgttcccattcctgtgtccatgtgttctcattgttcaattcccacctgtgagtgagagtatgcagtgtttggttttttgttcttgcgatagtttactgagaatgatgatttccaatttcatccatgtctctacaaagaacatgaactcatcatttttttatggctgcatagtattccatggtgtatatgtgccacattttcttaatccagtctatcattgttggacatttgggttggttccaagtctttgctattgtgaatagtgccgcaaaaggacaccagtctttggatttagagcccaccctaaattcatggtgatgtcattttgaaattcttaactaattacatcttcaaagaccctatttccaaatctggtgacattcaaggtttcagggacatgtgactattcaggggaaactattcatcccaccacatcccccttgaaaattctggaaaatgtagtaataaaggcttctgataaattagtgtggaaagtattcacggttataaattactaaaaagtctcactgtgagctcttaatcaaaaggccctataaaacatttatttgcttgattaaaactacacatccgatattttggttttggatttattattatttttagacttggaataactattttatgtgaaatagattccataactgaagcagcatacctctcaatttcccaacatttattttattattttttgtcttcacactacttaataactgaggaaaaatcatttagaccaaagttcaccttggttgacaccatccagacagctacaggaaataacaatggaaactaaatctctaagaaaaagagtctttcatgtgaaatattgcagagttgattctagatatatagctgttggaagaatggatactattacatagatatggcagagtggtatccagcacctttcaacaaagatctttcagagtcagtcttattatgtctggagaatttacccagggcttaggtgcttttactgacaatctaaccacctgcaccccacccaccgtctaaagctaaagtttattggaagacttaggaaatcagtcttcggaatgtttctgagactggtacacccaccacttcattaaagtgcttcacttcacttcattagacaagaagtaaaatacttgtcaggaaattatttatagtaccatgtatatgggtatcttatttaatactacttaatgatggtactacaagttatataaaatggagaaataagtcatcaagtttgacaataatgatatttgatattatcattatcttttttattcgttcccacagaagtactctgttattggtttagaaaaatgatatttgatataataaagaaggaaaaggtggtaatattctttattttttgtatctttataccccagctctttcaccaatctcccccatctctgtagttctcctctggtgtccccaggcagtgaactattcccagtggttagggaacatctcattgagtaagttacatcaacatttcttcacatttcaggacaacaggaacagtgccaaatcctagcccattgttcaactctcaagccttattatcctaataacacatccatcccaagaaagaattcatcaagatcagagaggaatacgtataattttttatagtacagtatttaaaatgaaacagcttttggcccgcgtggtctcagtgggctcaagggggaaattcaggatgctagctcatctcacaccaagtttaataaagggtgtcctataaaaagctaatttcttgctggtaaattgctttttaagtaatccttgctgttgcaagagacccattcatagcgctgacactgggagccatgttggaaaggctagatatgctctgggagataaggtaagatccaggtggaatcttctctttacagaatgacaatgtatatagctaatattgtcctttgaggctagtttgcatgcagttgctggtatggcactgctcagcagcctgctgcagataagaatgagtgatgatgccctagattttaatggaacttttagagtgcatgcagcagtggggtgcagtcttcagcaaagaaaaacgagctgacttgcaggcatgagagatcatcaagaaagataaagaaataggacatccactctaggttaggcaaggctttttagaggatattatggaaatgagcaagaaccaatttaatttttataatgccactccatttaactttaaaatacaaggtcaaggtactgtgtttttcataatgattaaagatttggagcactctttctgttgaaacatactgcatctgtttggcagaaaaaaaaagtgacaaagaataaaactgggatcagagaacaacaaaaacatattctgtcacttgcctaacacaagttaaaaagcaaaggaaaaagagacaactctgatggacatgttcatccttatcccaacagaaggatttatttacctaaggtcctattatttcaagttactttgatcccaggatggtaacataaaatgtacattttaaaataaaatggaagtataagatcaataaaaaccacatatctgtggataaaacagcagattcaatcttgtggctgaaagtttgctttaacccaacatttggtaaactattcactctgtaatttattaaaagacatactgttattataaaactatctcagtttgcatcttgttggttctgtcaaaatttcatcctgctaattctcaacttgtaatatctctgatatacatgattaatctattttaggaataaaacaaaaactacctttatcttacgcatttctaggaagtgtttttagatgtaaagtaggggtaattgtagtatagtggaaaggattttgaacttgaagccagaacatatgtctctgccaaaaactaggtgtgtgaccttaaataagttacttagcttcctgaatcttagtttgtttagcttttttctataaagtggcacacctatccacatcacagttttgttgtcaaaattaaataaaatactatattagaaagaaacttttagaaagaaatttataaactgaaatgtactatacaagtttaaatcattctcattattttcttaccctaaaattttgaccttatttttcttagcaaatggctgaatctgtaaaatttaacccccacgcagcatctggattcaagagaactacggtcatttctttatacagaatactaattatacacatatagcaaaacacaagttttttccaactactctgtgtttttaaagattcagtgtgggcagaaggaattttatcaactatgttaggggaaaaaagtctgaagaaatgaaaataatgagaaaaagcactgttgatttaagtgcaggaacataaaacttcaaggcaaatgtgaggccaactgagttcatatatatcctcacaaaatgatttagttaatttaaaaacttttctaataagcaacacaggtaatcccaaattctatcttttatagctctaagagtccccataatttattcagcaattatttaccacccacttattataagaaaagccctgggataagtcttgagaagaaactaacaaaaacaaaacttgattgtttgctctcaaaaagctgggtctaaaataggcaaggtaagattttgttttgaggagcccgtattttccagcactgtccattgtaacattaaaatagtttgccaaaatcctcactctgtgggtgtatttgcctagggtgctaaaattgcttaaaaactttgttatttggctaactaaaatcactgaatagtaaacagtagcattagagatggcagagacattaggtgtcatgcagttcaactgcttcacctagcagacaaagacattaagttccatttcttaaatttaactatctggttgaggatacacagtagcagagctaaatcaagaacctcttggggttagagtttttgtttatgcattactttgttttggaattaaaaacagtgcctgtttgctaagttaaattgaaaatatgctctgaaggagaaaaacagctataaaaatagacttaacttccaaactatggatcacaataaactaaagaaataatttctgtagcaataaactccaacactttccataggaccagaaaggcttgagaaagaggagaacaaaaaaatgctttggggcttaccatatatatggagaaagctaaatgaataaaccagttgaaagacagcgagttatactagtaacaatattactgatatcggagctctcacttataaattgtatattatgatcatagtgactaggtactttatatctgctttctcattccttcctcacattaattcacatgtaggacagattacctcttctgtttctatccagaggcctagagctcaggccctcatcgaagacagacagagctatcatccttattctaaaaaaaaactaagaccccagacatagctgtgctacttatagactagaatgtgagagaaaaagacaagctttcatcatgggcttaacaaactgaaacacttcttcaattttgagattgagaaacttagctaatgctaggtgtaaagatgatatgctaccttcataaccttggtgaggagaaattagcatttctctcagtcctagaaggaggatgaccatgaaggtcttcattctcttgagaagataatcaaatgcttcactgccctgttaacggtttactcaatattcaccaagaaaagtagatgggattatttttgcagacacttatacgggtaatttattctgataagcagagacatacctttagtgcataaattgttccctttgtgctctttgtaataaacatcaccatagagaacaaacacgaagtaatgacattgaattaaaagacaccatagaggcaacagcgactggaatttgtgaaagtaaaaggatagtgcaaacagttgtgcgttgcattctgctctgaagattaacaagctgggtcaggctttgaccatcatgatgagcaggagatttttctaatggaaatccccaatcaagttcctgctgcacccagaaaggaacggcttacagaaatcttacatttctttgcacataccaaattgcttggcatattctatcacaaggtttactttccagggaatgtgatcaagaaatcatgatcctaattcctagttaaccctcaaagtttctcagaacagtcagtgcatcactgtcaacttttgtgcaatgtggaaatcagaattggtcacacgtttttccggccactgttttagattcatataatattagtgaaatcatgtcagactggtatagccatgaatttatacttcatgaataggcactcaataaatagtggattaaatcgaccgatttgatttttacctccaataatttcaaaaatatcattgaagacaaggttgttgaagctgtcacttttcttgctgaacctttgttgtgccaggaggaacagatggtaaaatcaaaagtgattagagaatcagtggggtgggggtgagattggaggggagaggtcttcccagtgagacccgctagcgtcttccctgagcagtatgttaacccaagacaattttagaaatctgtgcccctaagttgcttgacatccaaagcacacttgatgcatcctacatttctaaatatttttattgttgtttctcggtagtaatcatctggtttagtcactctaaaagtcaaggatgaaattttaaaatgcaaataaaagtgcctactttctctctttccaattcctttttgttttattgaggtataatttacatgcacaaaaaaatcgcctttttaaagtgtacagtttgatgagttttgacaaacatatgcagtcctacaaccacgtccgtgatcagaataggaaatatttttatcacttcaaaaagtttccttgtactcccgttgcagtcagtctcctgccccaccccagcccctggaaaccactgataggtaaaagcacttttaatctgaaaggtatttaatgtatggcagtgtcagtggtaataataacaagatttattcattggttcactgtatttttgagcacttatatgtgcccgttgtatgcaacccattatgctcaacccctgccctcctcaccagggataaactagtggcagagatagacaaagaagccgtctctctatcacccctatcttatagaacattcttcaatgttagaaatgcagtataatgtggccattgagaacttgaaatgtgcttagtgggaatgaagaactgaagttttaactttatttaatttcaattaatttaaatttatatagccacatgtggctaatgactatcccactggaaagtacagcttctatacaatatgataatatgatacattataacgcaggagtttaaccaagtgctaaagctttactatcaccagggtcactggtgttatgtgaaaagaaaacttacaatagaaaaataaatcctttaaatagtcacagacctgagaaagtttccttctcaagggaacacacattggctcattcaaaggaggttaaaaactagcatttaaggtaatttcatgaagctttcctttggatttctcatgcttattgtatacataaataggcaattttcgatgggacctaataaatcactgttttttatttgaacattttaacaaaattatcaaacagcattgcatttatgttcaacctatttgttctgagaaagacaacgattaagtagaagtcatcaaagttaccagaacaatttttgttcttatgttttagaaggcattgaaggtgtttaaaatgtacacttatagagtcagagtactatgcaactgtggcccttatagtttatccgtcatgcatctaaagccattgttacatctgtttctaattgtgcatggattgtccaagatacacaattggaaattccattttatttatcaatttgaagaggtttcacccatgtggtcactatgatcactatggagtcacattaaattgagaagtctccagaagttgcagtatttatttaaaattctaactttcttcagaggaacaaattctccatttctggattctgaatcctcattagccataaggttgttgtaagaatttgcagctaataggaacacatcctggggagagaccagttgaaaagtaacttggttctgagtgaaattatacagagacagtttctacttcaggtggtgttgctaatgaagctatcatggtaattttagcccatatgatccctaaacgacttcagaaccacttttcatccactaagaacccacttcaaccactgccacgttcactaccacagtataatatggaacaccctctggaattcagtaagtaacttcttaactcattggctatagagctttgcctttgtaaattctttccttttgcagtaaaagagattgtttcaaagtaatccaattagtccctaggcatgtctagaaaggtagagtcaacaacagtaaggtaatagtccttataagatatgtaagaaattatcagtcatttactttaaaataatttgtacacttttccttttatatggttcttctatgttgaagccagtggtcatccagtgattaagattagccaaactcaaaaggctaaaactaaattcaaatggtattattttgctttaattttatgcaatgctatgtatttaaatttcatgaaagtttcgtatggcattgctatcaatttcagtcaggataaatttcccgtgaaataatccacaattttcaactgtacgttgggtacaggtaaggaaacacccttaagagcttatccagttattagctggtattataaatttcaagtaattcaatgttcaattaataaacagttactttaaatgggaaagtatgagtcaagagttagtacaaaggagaatcttaaaagatgaacatcaaagaatcttactattgatttgttggtgcctttgcttgcacttctccaaattgacttgacgttttaaatttgtactgataatcatcagagtcaaatctgcttttaggcaaaaagtatccgctagttattcccctactatgaaagtgatgagatgaattgatcatgtctccagtgtatggatggatgtctttgaggaagacctactgaccttatgtttatcttctgtcagcatggtgtgactatgtggagagacagtgctatttgctaaatactttgtttttcaaataaaaagatttcacagattatgcattgtagaatttataagtattcttttatgtctttgaatgtgccaatacaatttttatgaagttggaactattttatctattttaatgaaattgtaagccttctgtgaattcttttattaattttattctgaagaaaatctgaccaggttagggaaatcaggtcaggttacgacgtgatcccagtggaaaagctgaactgtggactgtgatttaaaatagggaagaggtactgaagtgttgtttttatttttgtttacaaatcagcctttctaactattatgtactcccatccttctatctttttctccaccagaacgtattaacaggcatgcatataattaatgcttttcttgagataatattaaaattaacttcatctgtcaggccgtctgggctaaaagtacacagtcagatctgggtaacatttgagttgatgtaaatatgcccacacatactgacaatgcttaccatttattgtgtgaatgaaaagcagtgtaaatattgtttgttctactagggaagctccacattttaatcaaactttgaccgtatttctaaaatgccagagcatctggaattgttaaaggaactgatagtttttgtgtttttaactgttaggatacttgaaatccaaagggtaaagaaactcagctgatttatacgtttcttcctctttattttaatgtgataaaatgtagtttttgtcatgggctgacaaacagtggtagactacactaactctgcgtttgctgggtttaatcttaccctctcaaggcatggaatgggagctcacttcagacccagccatgcttcactgtccactgccttctcatggatatagtgtgaacattaattagatgaattccataaagtgctttaagctctttggagaaagatactcgctgcataattattcttaactcccatacgctcttatgatataaaccattctgccaggaaatcctttttagggattatcacttaaaatgaaattttcattattaaaagcaggaagaatatacatctactgacagacgaaaatgtgcttaaggcgactgcttttaaataggcagaaatcctgaactatggagccatccatgcctgaaaatactgagtaataatgaaaactggtagcaaatttggaatattaatcatcacattaagttgcaaagaaaaaaaaatacaagccacatgccctttaaaaatacgtgcacaaatctttattctagaaatatataactttaggcctaaaaaagtacaaaaagtaaattattttatggctctgaaagtatccttaatttactcaggtgacaacaattagtgtttaaagagttagttttcaatcttagctacaagttggaattactctggaagctctaaaaaaacaaaaaacaaaaaaaaatagagatgcctagttcccacctgcagaaattctgatttgatttttctggtgcgagacctgagaataggaatttttttaaagcttccctagtgattctagtgtgccacctaggttgccttaaggtaaacctcatattatgcagaacctagcaatcacctatcctgattttatagacgaagatcataagacccaagagggcaaattgatttattcaagattgaatatacaaatgatagaagattcacataagatgcagtatacagagtggcttgtggattcttgccaatgcaggcagcagaattttctttagggttcacccagttcaggcacctctttgcagcagcacttgactaaggttcttctgattggatcattatatgggcaaaaagaaaaagcttaattgaaaagagctgaacccacattgtggaatggaagatatacagtttacacgttataaatgattaatattcatgaaagcatactgccctttcctcttcccttcccatagatgacatcattgcattggtgtagttaggttggtggtttcttgttgttgatcttggttctgacacagttcatcacttattatcctggcttattatctacttctacattcattgttcactcactcactaattaattcaacatggtttttattgttttggaccggttatatgcctgcaacgctacgtaaggctgaggatattacaatgaacaggaaacaaccctgaagtttaaggtatcaagcctttgagttactgtcttttatcatagctgatataaaattgaagccccactttttttgttttcaattactgaaaattcagtgctaaaaaaatgtggatttttattcaactagataaagtactacaattaggtttccactgaccttggctgtttttgttcccagttgccattacataaatctgtgccactcacaacttaggaagggtgtaacattctctgtaatagtttgcctttcgaatagtgtttggattcattactgtccctcgcagtttggaataatgaccactgaataatcagtgtttggagactaaattagtgctgcaaaattccctcaaattacctactgttcttttccctgtcgatgtatcctcatattcactatgattaccctgagaagaaagatattgttgagaaccactttacctactcgaagttttggtatttcaaagattcatacttatgtcatgttgattacattagcactaatactattggcagaattctaattcacgttattttctttttttccaatttctctccatgcctatgtgttgtcccttcgcagctataaagccatggccgattcatgggtgcttttgttaaggcgttcagcagtcacgtttgtagatttttgaatgggacttagagcccttttttgttctttatgtatttctctatttctcagcaaaggaaatgcagacatgcaagaaatagtgatcaaatgtcctgtgtactattgtgggtgtcattaatggtatagggagaaatagaaaatagttgcaaagatgcatttaacaaataaacgaggtcttgagattcaccatgaatgtggccccttctatgaaaagtagttaacatccaactgcaaagttgtactggatcagtttgactttaacctttagctaatatgaaaatatggaattgtgtggtggtgctcacaaaaaagaaaactcatttttcttaattatcatcaattaacatgtactgactacccatgagggaaagttaatttgctcttgagtggaaccagttatttgccctattatttctcccttgcttattcccctctccctccctcctccctttccattcaacaaagaaaaatagataaagcaatttctgattagccagtgaaagcctctaacataaaatttccaaagatgtgccataaattatccacaaaatgtaaaacttttcaattttggtttgcattttcttttttcttattataaaggtaataagtgctcattatagaatttgaaaaatataggaagttgcacggaagacgaataaaatcagccataatcctacaaacctattgacacttgtacatatgtttgttatctctaatgcattcattatgataatgcatcttttcaaccaatagagtaatcactggtgactttcaaatttgcctactcatttttcactctgtggacttactttactacctcttgccctttttcagtaaatgaataaatatttaagtaagtaaatacaaatgtaataacttatgcgctcaagcacacagatacacacagagagaatttggaacttcggaaatgccatcctctccctagggccgcaagtgagttgataagcacgtaaggaaggataatcaggggagccttctcgtattgcccagatggctcaaaattcgtcatctctaccaaacaactatttggagctttgaagaaatatccatgacccctttgaattcttcagtttctttcgcgttcactttgagaaccaagtgacaagtgaatttcctgacttggtcttttaaacctgttagcgcagttccattgagattttgtgggcacaagattgcaatgaagagatcaacagggagaaattcatttccctatatatgtgcgattaatccggagtgctaagggcagatataaagcaggtgcctactcctgtataacttggaataaaaccatttccaaaggctgatgatcctcaagtcttgttctgcaaatgactgatgtataacttcaggccaatttttctccagttagtctgtgtcactgggagtcccatttctcggggagcagccccatgctttgtcaggtgcggagcccacagaaggttaatgcgaaaagaaggcctcttgccagactgttttccagatgatacgtagggttattagtttgagctccttaagaagatttttctcacctgtcctaccaacttatgtttatttcattggtgttagagggtttcagtggcggaagtaaaatatttagcggggaagggacagcgttcatgggaattttgcctaacttaattttgtatctttagctcattcgtagtcattgtactttgtgttttgtcaactgaattttgtttgcatacaaaggcacaaaatgtttgcttcagacctgtcactcttatttttagcatggttagacaaaaactgagatgctttaattgtctaacttatcccagtttaagtgctgcaaaatctcccaggcaatgtcatgggcaactaagggataaaatcagagatttaaaggtgccaggtttcccacgcttctaacagttggcgttttgggtgtatacaatccctcagctttcttctttagtttatggagtcttgtggagggaatagcaggtttttagctaaaattatcatgctgtcgagttgggtctctagtgcatcctgaagagcttgcattatttacagaggctgggctatcattttaaatcctgatgcttcaatgcccgttatcattcttgacaaactcttccagcccgtggtctgttttcctctgtttgcttccatttactttcctgagcaaccagctgagcaaagatttacataacttttgtttaaacaaaccctgtacagttcactctttcagccagtatgtaaacacttttgagacacagttacatttttctattttagtcccagattctgtttatttgctacattttttgtgcccacatttttgtctttgttaagtctcttacagattcacatgaaaaaccagaaaccgtggctgctcaaaagtcattaataatgagatttttagctactgtttctgcttgtaaattcttcatttcacataatacagtctcaaaaggccacagagaattcagcctcgcttatctctgtgttgcagatgatggcttctagccttacccaatcccagtgcagcttgcttgccatccaggagtcgaatttgtttccatctgacattagcgtattaaaaagattggagatcaacaagcaacaatgttcttgtagaaaggtaatcaaggtttagagcctgtgtgtcatgagactcctagcatttgaaaccgctaaggggttgaccaccattgtcccaagcacctgtttaagattctttcctatgataagggacctaaagtgattagcatactgataagattttcctagaataacctatttatttcagtattattctttcaaatcttaattaccatcttttcctttacccagggtcttctttctacctctacgacacatttaattacctatattccccaacctgtaccatattaaattttgaatggaagttttatagggtaatttattggaaggatggccttgagtgtcattatgttcaatgaatgccctattttgacaaagagatgactaaatgttattgaaatctttttaatccaccacgcttctgcttagatgtaaatgcaaatctgttctttacatttgtgattgaattgaacttgaaaagtaccgccatattgattccttctgcaaataaaatataattacatttccctaaactttctacactctcccaagagattggctggctttgtattgtagatttttggtgatcacagaggacaatgcattatcataagaccaataagatttatttttaccttggtaaagaattttaatttatttctagtttcattttcatttatatccatctcttctcaccctctgctctacaaaagtatatatgactatataaattgaaaaaaatatcaagtgcaaaattacagaaataaataattaggttattttagtggaggaaggtttgttgtgggtggaggaggagaggagtgagccaagaaaaacgagggaccatacgtgatcatatttttgcagctattttaaattgtttgtgtatatactttaaaatattataaaataaaattttaagtgcaatgcatatttggagccaatgatgagggataacttcagaaacgtagcatcatcatctagtgctttcatagtcctttcaacatttccagatagttttaatggcctgctcatggaggcaatgccctaattttaacatatctcttcacaactctgatttcttgcttcctaacattaaatgtcttcaaagcttctttcaccactaattccttatcaagaggataagccagtttattctttaagaaaaactagctacacaaaaccgtaagtcattccaacataaatccttcactatcctctctctatagatttggttttgattcctcctgctgaaattcaaccttctttcttcagctatccacacgtcttaccctctaacttccctcaggagtgtctattagctcccattacagtgaccacagtaatatagtaatcccctgctgttctcactctccacttccttacactgcgttttaagtctcttcatattctttatcaccttgtatcatgcatcggttttcttagttgtttattttatgttgccttcataaattccatgagagctcactgccgtatctttagaacatggaacagtgcttggaacataatgggcattccttaaatagctgtagaataaactttcaaaatcaacaataatgtatttgccaaatccattggcttctctgccattttatcttgttcaataccactgcgatattccccttcctttttttttttttttaaagtctgtaaccctttagcttctgtaatattcctagttttttattcctctcatgtgtcaaaatcatcagttgaggcttattgttttctctttctcactctgacctcacctttgtttacatctcatcttctggctttggctatcctgttttttatctctgttccaacctgtatttctagccctactacctggacatgacatgtggatatctccgtatgaccgcagtttccatatgactttgcaaattcatccctgctctcccctccaaagtcatccccacaattgacttcctgttccttccaacctattaaggttcaaacccacttttgctcctcctttgcaggctacacttttccttctcagtacctcttttttttccaagttcttagataaaagtcatagtaccttacgttgtaattgccactggtctggtctttctgcctgctttcctttccatttgtaatcacattatccattccaatccatttataatactgtgatcagccataaaaataacatttatcatatcgtttgtctccttaaaacctgtagtagatcccctctatttacaagatctggtataaaatcacccttcctgatattcaatgcctgttttaatataatctcaatattatgcgtcataaatccccctgtgttcttgcactttttatttcttatacatctcatcaaccatgtcttatcaactctcaaaacctgtattggttttcaggaaaactcataaattattcttttgtagaccttttgtttgtcatctttgaagatctctctctgaactacaatattttgtctgtataatcaatttggaaattcatcaggtattgaaatatgacatgtcttctattgtcttgaacattaattaaaactttatttgactttttatatgcttacatcttgtttcctcacggagtgttaacctactagaaagtaatagtttaatcttatatttattttaattcagatttagtagcatactttacacgtggtaggatgtgtaactgccttacaccttgcttacgtgagttattaatgttttcgtatatttaatctgaggatgtactagcaatgttaaaactgtaccgcatgaaattgagtaattgaactatttgttttaaatgtgttgcttaacttattgtaccattttctcataatcacagctcaagttaactttgtggttgtacgtattatttcttgtgaaatgccaacaaacttagagcaaggaaaataacaggtataatcatactataaaggcaaccttaacactagcatagtctcttagctcatatggtaactacaataatgtacagtgacaaagagaatattgtactttcttagcacacactttcctactactctactgttgtggataaaaacagacatactttaggagaaactatgttatttccaaataatgccttaaaggttactccaggaaaaggcatttacataaactatctaggaaaagaaccttttaaataatataaagagctcacccaaaaggactgaagtgtttagttgaaaaaaagtaaaaatgtcgaagactttgaaaaatagtttcttgcagtatattttcatcgcttccacttacgttatgaagacattaagcgctagtttatcaaaaactatttttgtacatgtcttctaatgacagaacaatgtcaacatgattttcatcattgagaatgcgtaaagaaaccctttgtacagttttttctatgaatgttcccctaagattaaagcaaatttccaacacgaattaggcactccgaaaggaggaggggagggaggggagcaagtgctgcaaaacttcctgttgggtactatgttcactatctgggtgatggaatcaacagaagcccaaacctcagcatcacgcagtatacccttgtaacaaaccaacacatgtacccctgagtctacattaaaaatagagattaaaaaaaggaaatcagtatataatctaataaatacctctcaagctttctcatttttaaaataaaattttagattattattttaggaataaaataggctcttcattgtatataagttcatttctgagttgcaaaaatcctctctttatgtttttttccccgtattagcatgtttttctcctgtttttccccactcaacttggctgccacaatcagaaagcacaaagacaattttttcttgcgcttgtaaatcaaaaccttagcatcagacaaaataactgctccaggtctgtcaaatagattcatttgagctttcttcatgcattgaatacggcagaatttctgacctgaagaaatctagccttttccaaatttgctttaagaacattttgcaataaatttaatataataaaaggaaaaaacacatcaggctagaatttggaaccgattgttattaaaaatctcaagtctatcaatttaacttcaacaaattacttaatttctgtgatggttaatttcatgtgtcaacttggctgggccgcagggtaccgagacatttggtcaaacattattctgggtgtgtttatgaggctgtttctggagagattcacatttgaatcagtagagggagcaaagccgattgttctcccttgtgtgggtgggtctgatccaatcaattgaggacctaagtccaatcgattgaagacctaatcaaaaagcctgattaaaaggaactcctgcctgatagctaaagctggaacacccatcttttcctgcctttgagcttgaattgaaaccttgggtcttcttgagtcttaagcctccagttctggggctggaacttaacgtcattggctttcttggttctcatgcctttggactcagacaggaactacatcattggctttcctgggtctccagcttgctgactgtaaatcttgggacttctccagattcgtaatgagccaatttattacaataagtctctccctctctggtttcgagagagagagagagagagacagagagagaaatgagagcacaagaacgtgagtgtgagagtgccctaatataatttctctaaatatcactggttactcttcaaagttataaaattggtataaaaggtgacctcaatttttcatggagttaatgtatgaaagtcacaattaaaaaggaagaattagttctggtgtcctgaaagttatttgaataaattaatatgctatggaggctttaaaatactatgaaaatttaatattgtattattcttagtgttgctatttttaaatagcactttttcttttcctttttttttttttttttttttttttttgagatggagtctcactctgttgcccaggctggagtgcagtggcatgatctcggctcactgcaagctccactgcccgggttcacgccattctcctgcctcagcctcccaagtagctgggactacaggcggccgccaccacgtccgggtaattttttgtatttttttagtagagacggagtttcaccgtgttagccaggttgttctcgatctcctgacctcatgatccacccaccttggcctcccaaagtgctgggattacaggcatgagccaccatgcccggcttaaatagcactttttcttgtgagtcactttttaaatatttgtgcaaaccttgttgccattctactcaagctaatatcctaaaccgaggacattataacatttcaggagtcaaaacttcagacacttaacatagtatcctcaggttcatccatgttgtcataaatgacaggattttattcttttatatgactcaataatatcccattgcatatatatgcaatattttctttattcatccattattaaacacttaagttgattctatatcttggctattgtgaataatgctgcaataaacatgggaatgcagatatctctatgacatactgattttatttgctttgtctctgtccccagtagtggaattgctgtatcgtatggtagttctatttttaagttttcgaggaacctccataccgtcctccataatggatgtactcatttacattcccaccaacagtgcataagggttcccttttctccatattcttgccaacactttttatcttttgtattttgataatagccattctaactggaatgagatgatatctcattgtggttttgatttgcattttcctgatagtgatgttgaacattttttcatatgttgtattaactaagccaaacacagaaagacaaatgcagcttgttctcattcatatgcacaatctaaaaacatcgatctcatagaagcagtaaatggacggtggtcaccaaagaatgggggaagtaggggaaaagcgagaatggggagaggattgtcaatgggtacaaagtcacgattagaaaggaagaattagttctggtgtcctgttgcatagtatggagactattgtcaacagtaaggtattgcgtatctcaaaacggctagaagagagggttttgaaggtttctaccccaaataaatggtaaatgtttgaggtgatatgctaattttcttgatttgatcaagtaaaggtcttaattgtttggcaattaagactcatgaatacaaataaaggtcttaattatttggcaaagcatgctgagttttgtaaacaattcagtagtgatttttgagaataggtcaatagcaaatattaattaaaatgtcttctatttatgacctacagctagatggtaaacagatagatgatagatagataactgatagataactaatagatgacagataaatgataaatagataaatatagataatcgagagagaatacctttcccttcacacacgtgcatataggcacactccatttctatcatagttaccaggattcagacattttgtctcactatttttctcaatgtgaacatgcatataggaatattatagtttttgttctgtgcccattttagttcgttttttaatatttcaggacaaaggcaatatggcggtttcactttgtttttcatttttgcttatactttttaaagctcagtgtagaaaagtttgaaaatacacaaaagtattaaattaagacagctgggcacagtggctcacgcctgtaatcccagcacttcgggaggccaaggtgggtggatcacgaggtcaagagatcgacaccatcctggccaacatggtgaatcccgtctctactaaaaatacaaaaattagctgagcatggtggtgtgtgcctgtagtcccagctactcgggaggctgaggcaggagaatcgcttgaacccgggaggcagaggttgcagtgagccgggatcacaccactgtattccagcctggtgacagagcgagactctgtctcagaaaaaaaacaaaacaaacaaacaaaaaagcacctatagtctttctcccataggttgccttcttaatgggttttacaccttttgatgttttcttgagttctgtcccattagcaagtagtattgtacaaaaaaaattttatcatcttttatttaatattttattgatgtttaataattagaattattttaaattttatatgtcattttaaaatgcaatacaatatagtaaactcccagatgtgattgtaaataattaattattctcccattattgggcattgggactgcttccacattttggtcactgcagtgaacatccttgtacatgaatctgtatgttgaagttgatttcattccacactccccttcattcaaggggctccaaccattctcgttttctttcagcttctttatatccaggcatataaagttccttcctgactcgggagcgtcatacatgctgttttctccatctggataagtagttaattctgttcttctttgtgcatctcccgtttcagtaacttcatctccaaagcctttccaggtcactttatctaaagttacaccataatcttgcaaatcctcaactattgagcattattagtctccgttatcattattctccattattctctgtgaaagcatcccgtgattttcttttgtccctattaccacaatatgtgtttattccgtgtatgtacatctttgtttgtttattgtttgtctatacctgcaatgaaatgcctaaggtcaggaactgtctgatgcaggatgcaatgcgctcaataaatatttactgaacaaattaattcatttgctcagtcttgcaggcaaatggtacttctgtatatttaaatatctaaaatgaaagcgttactcgttactgttggttgtcaatcaaaatttaaatgtcgatgtttaagcgtgaaagacctctgtcaagttaatctgtacttacccaaaggctattatgtagaagcgacataaatattttcctaaatgttgattttcatattttaagaagacaatgaatgtttcaaagcattttcttctacacagctatttattctggagagtggggcatatgtttcttaatattgttaaaattggcaaggggatactgttgctatatacaaagaacacctaatcatcatgcagacgttttgtttctggctctcagttatgaaaagcagagattttaaaaagttacctttatatgctaaattaggaatggcagaaggtaatattctaatgtttataagtggttcttctctgagtccttggtttctatgtttatgaattctctttttgaaagaaattatagttattattaccaggtctattcttttacattgtttctaattctatggtgatcttcaaaatagagtatcaattttaaatacttgggaatgaaattattcttcccatatcatttctttgtatggcatacattgtgatttgttgtcccatcattgtttcagtatgacctgttactgcaaaaacatattgagataaatcatcccacatactctcggccaggacagacatcacactgttgcagcaacacttcagatgagccccattcaaccttgtgtttttatagagaaggatgccacatgtttatattcatttctgaagattggctcatattatttattgaaacatactagtttaaaaatctgtccatttatataacacctggtctatctacataacttgaattacataaatataaaactaaacttcccctcttctccagtgtatagcttgcaagcaagtgcatgtgaaataaattaaagccttgtttgtgtttttttcatcatgtgagtacaagacttttcaataaaaatgaattacttttgaacatatttgtttggacaacaaacaagagaaaagatctatttgattgatagtggacagaattttcattaagttcaacagcagaaataccacaattgcatcattcaccttcgtgtatcaaaagaaaacagaaaattagatgtgatgaactctacacaaatgttcactatgcatactttacccattaaatacattatcaagaatcatgtcagcatgacattctaatatagcagctttacaaaaacatgtaatctaatctagggatgctgttgtcctctttaaatcagcttcaaacatattctgggttgatatttctcattcttttttgatccacattgtttattcacataatgattatatttaactgaagataacagcattatcaaagtgaaagacaaaatagatgtttaataggaaagtgagtatcgaatcatcttttttctaccaaaaacatctataattatgaagtatttggttaattattttcacaataatttaaaagtgtacaacttgccgatttttttgtactttctacttttcatgtctcgcatatatctctttaatatctaagtatttgagtcagaaaagagccagtaccgaataatgggaatctcactgaaatgtgataacaatctggggcctggtcctgggacctttatctgcaggacaacttggacaaatatttagacccccaattcctcgtctttaccctaggaataataacacatttttctgacctcatacttcacgtggatctcaaatggaacaatcatctgatagcactttatgaagtatatgaaagcaataaattatcacaataagataattgcaattattctttggcatagtattagtgatgtctttatctgtctgacaaaatcaacatttctgtatggtaactgcctttccttgttttaacagaagatcatgccagaaaagatgagtaggtagatacttaacttgttgttcctgaatctggaatgtattgcagatgtcccagactgatctttgttcttttttttccttacaaatttcttttcacattgacagtgtgatatttctttaaatgtgcaatacatagctaaccttatttgtttgtgtttactaattaaaatatctaaactgcttaaaggagaaaattcagttttaagttttattgatttatacccttcttcaatccacataggattagggtagtatgtaacaaaatttcaaactataaatgaaatattgagttttgtattaaggccaaggatgaggaaaaaaaaagtaagtatatatggaaaaagaatggtattgaatgggagttttgatggagcatgttgacatcatgataatacctattatctttatattctgaatgtcagaacaaaattagagcaattttcccttatttccctacaatacgtctgtcttaataattctaagctttcctgatttcagtagtaatctgtattttgcaaaaggcagcatgtttataagatatcaagtaaactaagtttatggaacttgtaacagcatttttaacaacatttctccctagatagttcatggtagacatgaatttattcaaaactagtatgtagaaaaataccattaacaaaagctctgaaattatattagaggagctgaataatgttacttgagaaagaataaaatgttatttatgatttttggtatcttttacccactatatatggccatatctctgaaaaactttagtaatatgtactaatgcaaatatggtagtaaattatgtctacaggtgctgataccatagtagataaagtatgataactttattttaaaatatcatatttaaataattaatatacagtactgggaaagactattttatctattctctcactcttgaataaaaaaatccagaaaaaaataccttgttttggtaagattatatcaatttatttcccaaatgggtagagggttatttttttctgatcataaacgtatgtctcttcattataaaaatccactaaaagtgatagaagaaaaccaaaagaataaatgtaaacaatgatgccattttccaaaaatcaccttcgacatttttctggatattgatacagtctaaatctcttttcggaagactccctcctgtgtaggttccccaactactctgcaatcttatttcctcttgttctgttcttgtagaaaggagacccattgtcaccatgtcaaataacacaaaatggtgcacgtataagatcattgtctctgtccattatttgccagaggacctcaaactttttcaggtggtgggcaactggatgtcatgctgctccttgtacaacagaacacaattcattatttatatggttatttcattttaagaaaatttaactttcattagctggaaaaaaaaagaagtggtttttaagttgtttagaaatgtgaaattcaattttcatactgcaaaagagattcaactgcaaacacaggcacacatgtctggtgtaagaacgagttgtcatacaaacccaaattagctgcctccacgttgtctttgttaacaagtgtttgtttgctccttgttccatcattcagaaatgctctttagcaggaattgatggaacacagtcgcagtgacctcttcctgtctttaaaaatcgagatgacatttgcccatctgcagtgttaacatagttcctcaaagaccactgacagtggggtaggactgtattgcgcaagttctctcatttccctagaatataattggtccagggccagagattttagctcatttagagcagcaaggtgctcttttaaaattccctcacctattttgggcttcatttcccttatacggttatgccttttccagtctgatgaacattctccttgacagagcagacaagcaaaaggagctgcacactgctgctttctgtgtcgtctctatccctaaccttctcccttctgccccaatcagtgaaccttcgtctttctggttcttcttcctccaaatggaagtaaaaaggccctgaatgttgtctttaccattatcacgagcctcaattcattccaagctcagcttttcctcactgtttatacagttctatattgttcttctaatatttgccctcagttctctgtccctcgtttcttcccatgttcatactctattagaatctgagcacctttgaggttgtccatacagtggcacacatctttgttttatactcactgggatgatttgccattatattgtcaaaattttattctaaagagcttttacaggctttcttgagccattttctcttgaaattcaagatcgttgaatctctacgctttttccttcttaatctaataaacatacacccccacatacacacgtgtgttcctgaaagacagatgccacttgactcgtcttatagattgtctaaattgatcattgtgtgtggggataaaagggtgaattgtataatatccctgatggttcacgaagtctgttcctgtataacctgattagtcttctgaactcttttaaattctgtctgcaaatgactgaggtttggcaatcagcctatttcagttagttgttttcttgcataagaagggtccatatgtactgtgtgaagtaagagagagaaagtacttagatttgctggatgccctgattgttagcatggctaaggtattgtgtaagtaaggagagcagttaaaaatgatattgtttttatttcttaattgaggtaaaattttatataagatgaaacagacttatttgggagaggaggaagagtttgttcttacataacatttcaacctgtcatatttagttgagaacttcaatctgtcaagatactttgtataatattcagattctgccatctaatatattttccacgctttcttactgggtgtgacagtaacttatactgtggcaggtgtataagttagtaaagatattaaatgctcaatctgttaacttttgtgaagtggtcccactgataaagtgacacctcaataaaataaaaatttccattacctcagaaagctttttcatgctaccttccagtcaattcccagccccaataggcacctattcttctgatttatatcaccatagattagttttgtctttttaaaaatttgtataaatgaaatcatacaaaatgtactattttgatcagcatactacttttgagattcatccatgtaagtgtatcagctgttcattcctttattgatgattaatattctattgtatagatataccacaatttatttatctattctccttttgatggacattcaggtggttttcagtttttggctgttatgaataagatgctgtggacatttgtgtacaagccatttgtgagcatatgttttcatttagtttgagtaactctgtagaagtggaatggctgggtgaaatgtttaaatttatgagatattgtcaaacagcacctaaacagttttctaaagtggttgtgccattttgcaatgccaccagtgatgatggagagttccagttactctacatctttgtcaatatttggtcttgtcagtcattttaatttttgctatcttacagaatatgtaggtatattgttgtggttttaacttatattcctctgattactagcactattaagcatcttttcatggatttattggacattcatatagattatgtgtgttgaagattattacctttatgattattgggtgaaaatagtatcattttgaggtcattcatataacttgaagactgggaatgacagacattttcctgttttgtttcttttctttttactttatctgaagagtctactagaatgcagtgttgctgcctgagcagcagggcattagctttgtaaaagctctgttccttggcaaccccaccactaatatgaagtgcagaacatttgaattgtctttgaccagcttcagcatcagcactattttttttttttgctagacccctagtaggtatttaaaagtacagaaatagaatttaatcatgctttttaccaaatgtgctatgctcttagagattctttcaacgtgcataaaaattctgcagtttcaccacataccagtaaaagaaactcagtcactcatttagccatttagtaaaaagaacaaattaactgatgagcatagtggagacctcaaaggtaaagaagacaatgtccctgaaataaagacaatcataaattttcaatcaaaataatgaaatttaggctgggcatggtggctcatgcctatgatcctagcactttggaaggctaaggtgggaggattgtttgaggccaggagttcaagaccagcctcagcaaaaaagtgagaccctgtctccacaaaaaaattttaaaaattatctgggtgtggtggtatgcaccggtggtctcagctactcaagaggctgaggtggaggatcaccagagctcaggggttggagactacagtgagctatgattgtaccactgcactcaaacttgcatgacagaatgagtccttgtctctaataataacaaaatttaatttttatagactgtgaaaaaccattatgtagatacagttcaagtacagtatgattttataggatagataacttttgcttgaaaatgtattcccaatttataggatagataacttttgcttgaaaatgtattcacaatagagttagtatttggggcacacctttatccatttaacaaacatgttttgagcactgccaggtagcaacacgttactaggcactagagtgagaaaagattacagttcctgctctcatggatctcatggtctagtcaactggaatgaaaggattacataagtagaggtaaagacacacatgatggaggatggagaatagtcaaaggtctggagaatgaccaggacgtcactgtgagttgtctaattgcactgaagcatggatgaagaattggaaagtcattgtaagaagcctaaaaaggtatctctcagggatgctatgaggttctgaatgttatgtacgctatttgggcttcaacaggcaggcactgagtattcagtataaatttttgagcagggaatccaccagaagaactatgcatctggaggattaatctggaaagattgtgtagaatgttatgcagtgaaagagtctgagatgaaacagttaggagggtgtattaataacataggtgaagtgtaatgaataaccaggctggaggaaaagcaataacgatggaatcaaccgggcaagaagtataacaattaggatcagtaaaatagaatttggattggaggaatgaaaaaaaaagggacaaaacaaagttgaactgctggtatccatactggaaaatacagatgtcattcaaataaataatgtaatgaatataagaaaccagttttaggagtgaagtggatgttggcttgaaaatatttcctttgaggtttcagtcaaatgaaaaggtcctgaaatgctacgtggtagcctaagaaggaagcgttcctagagagaaaaaaattagaaaagatttacatttgataatttaatcttttccttcatacaagctaaattgataagaaagtaaaacctatagttttcaccactcttttacaaatatccctaaccttttagatattcacatgaataattgagaaaaatctaacagatgacttgcttatgtcatttgtctgctttatccttaggttcctctggcttatatattgttcaataaaatacagatcattgatattgtacaatgtactgataatggggagtgaatccatgcttgtgcattcttttttttttttttttttgatttgcagagggcgtgcccagtcaacaagagaggcacaattgtttttatcatcacctcttctcatctaattccatgaaggagagtagtattaccatacaacagataatgagttggaaaacaagaaacctaacctcagaacttaaggcttggggaaaaataaaagagtaatttgtgtttaatgcctgtataacttggcaagagggacatataaggcttagtgatgcccaacatgtgcttagatgtggattgttagttgatgtcttgggggttctgtaatctaagctaaatgctcaaaatcaattaattgatgttagacacagagatctgctttgatccctctttatcgtatttctaggccttcccattctcaagagcctgagaaacgacagctttccttaataacttgttatttgtggtaggagatgaaactttgataaaaacacaattatttttaaatgtctctttttcactctaggctgttgtatgtatttcaaaaagttacttttgaccctttccagaatgagaaagcaatcaagaagattataatatcttgcttagttttctgctcaatttatcaacaaatatttcttaagcaattattaagctgagcagtgctcagcgctgtacttggtgatataggaaatggggaaaagactgtctttaaggcctttataatagtaattacctcaacttgtctgtttcttttccttaccatttcgccaaattcattgatctatcttgttctcaaagcaatcgccatagttatattgtaacacagcattttctagggtgtccccattaagttgagagtgttgacaagaaaatacaagcttatttatcattgtaaaacttgagacacctagtagttaccctaaattaaatatttgttggagtcagtcacactaaagagaacacttactgcattgaacaatttacctacattagacagcatttaaagactatgccacagcaaaggcccatggaattcttgtgaacacagaatagaagtgtattaaggaacaagcttaattctgttctcttaaagcacaacactttctcaaaacatattttgaaatcacctttgaccattttttttaactaataggtgggtgggagttagggtaggaaaacacaagcagcttcatcaaaacgatattctattttcttcaaatttgtggggaatcatacggcctctcaattttctacattatgctaattatgatattaatctctctgccagcaaatgaaaataatacatattagatgtagcaaatgtcaataatgacaaaattagtcatcatgcagatactcagggattcccaaaatatgtttggattatgattgctagctttgagtttgcccagaatcgtttcaataaaaataagggactcaaacacatttggagcaaaactcacatcataaattttagacatagctctgccaataatgctctcagttatattttcagtcctaatatttcctctgagttccagaccagtatcttcaactgtctgattgatactctctccttcatttctgtctccaatgcattaagtcctgtgtatttactttccaaatgccacttggttccatgcacttctctccatttctgccactgactcctcctcaatccaagcgaccatctttcctcactttaactaccatgatatctcctgcttggtctccttacttctattcccgggctcctccaatccattcatcctccagcagagaatgatgactagcaccttccacagtgtctggctaataggaggtatccaatcaataattgacttacagagtgaaaatataggcatggcaaataccagtagagaactacagggttttagaaccaatgacattagatacttccatcaaatatttacagtgtataatcaagttgacttgcacattgtcttatttttgaaaaacaattttgttggctttttctatatgcacacatacatattgtatcaccctctacccgccaaatggcttttgaagaagtatttatgtggctccaaattgataatacctctagagagaagagaaattagaaattttaaaatgacctatgcttcctttcgaatatcacgtcctgagacagtgttttttgagttacgtgcaatatgttccacgatgaaacatttaatgtgttcagaggcatgctagtaatcatgtagaaagaattttatgcctgaagtcacatgttctataaccaggatcacttaataagaaaacaagtacagctgtggacaagatgcctttttatcagggaaaggccaatttgttttctttgcaaatctaagtaaatggagagaaaaacacagcccttaaatgttttctatttgtcctgaagttctcatgaatgagttagaaggcgagaaggattaaataaatccttgaacgtagagagagctaacatttattttagcaaactaaaacctattcgctttgcaaagttctgttctgtactttgtaacaacagttttctttaaaacaagagccaccaattcaaatgcctttacagaatgattgaatgctttcatgccccacctaaaggcattcaaatcattaatcaaacaaagttctaacgccaaaacatgtctgggaccagatttaaaatgtagccctcagtttcagagggcaaaaacttaacatatttatattttcctcactttaggtaacactgtattgaatctctgcttgaaattgaggagcacgtgattttttctttttggcccagggcagcatttcttggaagagaaagaaaaacaacccaagatacccttacaaaacatgtagtacttaaagctctttatgatgaattaattttggtatacacattaatagcagtgataataacaaatctatatatatatatataattgatatgaataagataaatacatcaaaaggaaatttcattacaatttgatattaggtaaatgtcccattaaaataaattgctactgtacataattttccttcagttcattggcaggatgtttgctttggaaaataaacagtctatttctagttttagaaggaattctcattattcttttatagcaaccattatcaggagcagatgggaaattgtaccaagagcatatctactattatacctcacaggaaaaagagagtattaaatgaaatctaacaaggcctgctcctgactctagttcctgtaacaaatgaacacacacatttgtatggtttcagcatttgtattagtaaggtacaataaatgtttactgaaattgaaaaaaaaaaagataacaggagaaagaagaggctaaaaaggtgcattttatttctgatcgttcattgtaaagactgctcctttttaaaataatcaaattttattttatatacagagggtacatgtacaggcttgtcacaggggaatagcgcatgatgctgaggtttggggtacagatctcatcacccaaacagtgagcatagtacctacctgatgagtagtttttcaaccaatgcgcaccctccctccttcccacatctactagtccgcggtatctgttgttcgcatatttacgtccatatatgctctatgtttagctcccacttataagtgagaacatatagtgtttgtttttcctgttcctgcgttaatttgcttatgattatggcctccaactgcatccgtgcttccgcaaaggacatgatttcattctttttatgactatgtagtatttcatggtgtatatgtaccacattttctttatccaatctaccattgtttcacaactagatggattccatgtctttgctattgtgaatagcacaagacaggacctttttatttgactgagttccttgcaaattactaataaaagatctggaggtccttagttaaaagttgaatctgtagtgccgttcaaatttagagatgtattttctgttcaagagaagaaagccctcattcggtcatgcttaatattcagctgtaaagtccaaaacatatgagaatgacacaaatggaaacattttataaatacctatacaaaggaggggcacttagttcccctaggcctcttaaaagtcctctagaaagagggtacttttatgctaactattaaagatgagtaacgaatttgtcctatacaacttaacagtatcgtcaaggaagtagaaagttactcagttttactgggcattggagctaagcttgaaagtgaggaggagaagcggcaggagacggagccgagaaggcagtggggagaagaggaggatggtcctttccatgctccctgttgtactaacatgtttggatattatcttatacttcatatatggactggattcttgtccttctcattctgagctctccttgaccttgattcttacctcctataactttcattctttctttactcaaaaaaaggccatttatttcagccatttttcactgttttcttatccttcctagttgcttttctatactatttttccactcttttttttttctatactattttgcccttctctccattttcctaactgctagatttccccaattttagccatctttcaattgttctgactatcctcaggtgctcccacaaggttatcagaccttccaccaagacggaatccctcagtctatggacaggctaagttgaatgggtcctggtgctgtgcttagcatatgccttgagtatttgtgcatttattttgcttctttacaaaaatccatcatccgatagaagttgaaagaaacttgctgaagcacattaaaatctctgaaaacagtattggctatattttctaataattagcatgactggttaacttgctttatttatcattgaaaaaagtatcagaaactgtatatcaaactcctgaattcttggcactgacgaagagacacaatgagaatgaccttaggataaaaaaacaagataaagcaccatatttgtaggaaattgcaccataaaagtctgtttcacaactctcccaaatttcattttattacatcttttctcttgaccaatcagtaaactcggttaatgatttacctgtctcaaaataattcatgaacaaaattacaagtaaatctcagtattggattcttgaaacatctccttgttcaatgaagtttcctttttcttccctctatttccctgtatttatcttttcttccagttgcattttatctcttctgtttttttatcttgctccctagtttgtgattttttgccaattttttatttcctacataattcatccaatctgtcattgtacaatttcttataactgcttcttagcttattccttttcttcatttgtcacattctatttttcatctattgtgttttcatgcagttttggaaagttttacaaatagacttttaaaaaaatgtacgtaatgttttcatagaaaaggtagtggtttctttttcttatatccttccctgtataaaaataaaaatgtagcagttctttctttgcctatgtttcctctttccttcccccaatttgaccagacttgaaggacttagatatgtaacagtgttattttctataatttaggaacagcttttgacttaaaaagcagaagagaagttgaaaataatatagtaattctacatgtccttcctgcttcccaactctctgcacatgtttgtaacctcccctttcttttttagtgtatctctttcatatacctttgtccccagaaattctgattcagtagacttagaatggaattctgggcttttatattttgaaaagctccccacgggagttagatatgcacttcttattaagaatgaatgcttaatattggaatcaaaacacaataagctttctaactatgatgaataatccaacagatttaattatgattttctttttgtccagaaccaagactagatgttaattgccagagaaatagataagaatgcctatgacagcagtacattaatatgatatcaaagcttggaaattttattggtaatgaataattcagtacttaaaatatttagaagctatagaattaaaattaattaatgttgttcactgtgtgaataaagttgattgagattttacatttaattttgtaaacccagtgttatcttttccagctcagaaaacaccacatacaagctactactttctgttttgatcccttatttttctttcttatgctttatcactgaaaactctccttgagcaggccatgcactgtaaatatttctcctggttgcaaaaccttctcatacaaatgcagtagactgtgtaatgagctcttctttcacaaaattaaaaaaacctgaaagccctgatttgcgattctatacaaatgagatttagatctaacaattttaaattattgcttcactcttagctgttcaattctatctcttatttgggaaaccgaaataataaaaccattgctgattccacaattaggttgtaaaagtcaccgtagccatcagccatgaagcaaaagtgccaagatcaaaactacaaagcaaagaggctgagataaaaatgctgcagcattagtttatagcattataagcagcaataagaattccttgattgcttaacaaagactcaaaaggcatttactccattaccttacaactcaaagaggtattcctggaccagcagtattggcatttttttgaagtttgtaggaaatgcagaattttggtgcctccacggacctaatgcagcagaacttgcagtttagtaagatctccaggagatttgtatgcgcattaaagtctaggaagcaccgctatggtatacatctgatgtgtgcccatgcattttttaaaagtatgaagtaatagttgtaagtattggacactcttgaaggaacaaataagagccatggtctttactctctaaatacctccctgacatctatgttttaggcaaaatttttttcccatttcagtagtcactgatgcttgcacgatgcagtttattccaaaacaatggtgattctcatgtaatagttcatgttgccttaataatttacgttgcctcaagttctctgcccaggccccaatatacaccgagggctgtactcctcccctaacgcctgctctcatacagtggcatagagcccagttttatgctcttggtcacatcatggagattgcacaccacaggctttaacttctgccgtactctcactgcctctaaccctccatatgcctaagttctacgattctttaaattccaaattgacccagaagtctcctccgctcatccttttcactgagatcatccctcttctggcctaccatttgttgatcaccttgctttttttttatcctactgtatgtagtataacaaattatcacttgcaactgtgtcttattttttcaactagattatgtactgcctaagacctagaaaattgtgcttatttatttgaatctctaggaggatcagtaatgggtattaatactaatgactccatggtgatgatgagcctgaacttcctcccttcctttctttctacctctctcctttcctcccttcttttcttcctccattccttcctctcttcctccctccgcttcttccccacttcccttattcatagattcatgcgttcactcagcaaatgcttactgaaaccttccatgcatcagacattgtactaaacaataggaaactatcatgaataagacacaatatctgacctcaaagaatttatgatataaaagtaatggcataaaccgtgattacttttgcaccaacctaatatatagacacagtttgttatgactggtgtctctattactaagcaatgactgtcacatgcaacgctgatctgaacaggtggtaaagagtgagatgtaagcaatggagcaaagccaactagttacaaggaaatatcacatgtttactagagcacatctcatgggcattcaagagagtatggccaggacagcttgtgaatagttcagtaactgtgcatagttttatattcattgtgaggcaccgtgtcaccggtttgctgatttacagagtattttaattgctaactgtatgctaccaaaatttccagtattcgaaaataattttgcttgaatgtagaaaaagaaaaaagccaagaaatgtatgtgaaacgagagtctaagggagctttacctcagtctcagaaaacatgcattccttccttcatttaggaagcatgtactggggtctactgtcagcttgctattgtgtcaaggagtaggagaatacaaaaatattagagaatatgaatcacatctattaggagagttttctacatacgcacattattctgtcagtgacataaggatttgagtcattcagatttaaatacggtaggtacctcaagttctcagatattatttcattttctaaggttcgtatttagttaatatgttattttaatggccttacaaattctagattatcttttttaaaaagttaaatagaacgtaattgccatttttatttaatggtaaaaagcatttttgtttttgtgtgtacttggttgtaatattctccttttcaattgagctatttttctgatactttactcttaaaatttcattcaggaaaaaagtaaacaatatttaagcttgacaatcataaaaatgctctggtgactatagattattttaaaatttattactgtagcttagggatatcttgatgggatgctcctgaaagcaattaattctcagttttttgtggcttctaatgcaaaatacattgacgcagacagaatttgaaatgaattttcttctaatatagcaattaattttatttaaatatctctagagtttttttttaatactgtgactaacctatgtttgttctttttcacctctcgtatccacgatcactaagaaacccaaatactttgttcatgtttaaattttacaacatttcatagactattaaacatggaacatccttgtggggacaagaaatcgaatttgctcttgaaaaggtttccaactaattgatttgtaggacattataacatcctctagctgacaagcttacaaaaataaaaactggagctaaccgagagggtgcttttttccctgacacataaaaggtgtctttctgtcttgtatcctttggatatgggcatgtcagtttcatagggaaattttcacatggagcttttgtatttctttctttgccagtacaactgcatgtggtagcacactgtttaatcttttctcaaataaaaagacatggggcttcatttttgttttgcctttttggtatcttacaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggtagggcgacagatctaataggaatgaaaacattttagcagactttttaagctttctttagaagaatatttcatgagagattataagcagggtgaaaggcactaacattaaagaacctatcaaccattaatcaacagcagtaaagaaattttttatttctttttttcatatactaaaatatatacttgtggctagttagtggttttctgctattttaaacttgaagtttgctttaaaaatcacccatgattgcttaaaggtgaatatcttcaatatattttaacttcaacaagctgaatctcagttgtttttcaagaagattttagaaagcaattataaatgattgttttgtaggaaagacagatctttgcttagttttaaaaatagctatgaatatgactatgaagctaaaaaaagtgatagtgtcacttacctctagtttcaccacatttgtgaatacattcttgaaggggaacttgagccaaagaggtacaagtttaatggggaaaacaaaacctcaaaaaggttactgtcaaattcaatcatcatttaaatttcccttggaatgtattgaaggcacagaaagccaaatgcgtgctgctgcagttggaaagcctagagagtttataaatgggattttgtattatgcttccagttgttgatgttaatgtgtcttgtttcgtaaaggaagacttggcctttatttaccaaatgagactattgttatgaacaatgaaaacttcgttcttttgccaagctcttgcatcccacccatcatccacataataggtggattttaatattcaggaagctagaacaactcattgatgaatatctttcgttaagatgtattaaaaagaagattttggaattatgtcagttgtctttgcccacctcctctttccctctttattcatgttacattattcagaaagtagatacaattcatattttgtacaaaataaacacattagttgacctaaacacacacacacacacacacacacacacacacacacacacacacacacacacacacaccccttgccaaagttaaagaattatagcctcatcaaaagatattttgaataattaagtcttggttttgaaaatcttcttgattatagatagataaaataaagaactaaactttgtagttaaactacttccttaggtaagtcatatacttttttcccagattgaaattcttctcttaatcatacaagtattttattatttagataactgatgtgcttatactatgaacaggtataaacctgtataatgtcatttctgaactaggctcaatctaatccaaattaagatggtaagaaatgagaaaattaaaaaaattgaataccatactataaatatatatatacggagagaattcataaagtggattaaatcgactggaagattatttttctataatatataaagtattgtttcctattttaaatgtcttactcatatagtatttgaatagagtgtattaacattccctctgataactctaattcacctgaattttcaaaatcttgttatctgttattgggctctaaaggcacattataatttataaacaaagatgtagcaatatgcctgtttcaccaaataagctctaaaattttagatctttctaattttataagaaagtggtatatgctgactctgttgtgaaatagtatacaaattttaagttaattacagctagggatttggctgtaattaggaaaaaaattttcccatttaaacatgttgacctacattaaatattgcacttcagtgctttaaaaagtcaagttcagcttccttgagttttttttttaagctgagcttttaaagttgtctatttcacgctacattttaaaaataaatgttaacatatttaaatttccactgagaccacttttgtggcatacttcctcaggatttttatatcacttaaattttatgaaatgtaaaaatgtaataaaatataagtactggttctaccaatatactcatagctatttctaagcatccagtagcaaatcaagtaaaaattaataaaataatattttatgaataatatgttaacctaacaattaattatagaagggctgtaatcacgaacctattgctaatcaatagtgtactctcagtgcaacgcaagcagatgttagaagggaatagaagttatttattgcaccggtgaaaaatatataagatgcctattcaacttaacaacagtagtcttcgtttgtaatggactttaagtacagcggttagaaatatttaacattttttagtccagggacatcaatgaaagaaagtgtataaattcaagctagatgtctatatggagccctgtagttgcaaaactttaagtcttctgaaattttaagatattagaaataggaaaaaaaatctcaaaagttcaaataatagtggacatccaagaaggttagtctatgttggaagcaaatgaagtgtgaaatgtagtcagttagcgatgcagtttaagatagacaattcactacagcttcaattatgtaacagaagaactggatacatctataggcttaagcatgataataatgagtttaatgatggcgtagccaccaaaactgtctttgtacacgaaggaggtgcaaataaaaacctatcatcggctgtaaggggaagtcataggttgatacaaagcaagcctgtgtacaagtctttaagcaagcgtccatgaatagcaaggggcgccatgctcttcactggagaagaaaattacctatttgtctttactaacctctaactgaaattaagcattccttttcattttgaaagtaggcaaaaaaatcacagtagtacaatcagtacctatgaagtcacagatatgtacacatctcattacagttataataaatatatcaaaatatcatttatgcttatcactacttcaaaactgcagtacttattatatgtgctacagggtcttattgttgggctttaaaacattattctgaggaatgtcaggcttcaacagattgccaaagaagtccaaggcataaaaaaatgatcctagccagctgtctgtttatctgcccagaatctcatcctaatttactatggtttcagtcattttaatgtgcagtcactatcttcatacactccttttcttctggagtattctaggagaagacataccagtcgaggggttctggggagccaggccttcaagcaatggattgctgacaacataatgaagaggattttacttagaataatgtcagttgataaaagtttgaatgggagacggaagcaaggcagtgggaagtggaattcctaaattgaggaacctctgaatcataatccttagcaataataattaagatttcaaaacattataattctttcttcttttagacaagtctgatattgcttatcccatatcacagataaggcaattattctactaatatgcattaaggaatagtggttttaatttaagtgttaccttaatgaaaataattttgaattttttccttccccaagtctttttgtgaaaaatttcaaacatatagaaaaattgaaacaattgcaaaacatatgcccatttacactgttttcctccccctaaattcttagagtcaacaattgttaacattttgccatatatgctttttttctctcgctttctctaccctctttctgtatctctcatatatagggcatcacacacacacacacacacacacacacacactttttaacatttttgcaaataagttataaataccattatattttacccctaaataattcagcatgtgtcgctttgaaatacagacatgccatatataaccatgcctgtttattatgctctcctccaaattaaatataatactgcattattgttaatatccattccatattcatatttccttaatagttcaaaaatgtcttttatattttgcaggggagttagtaccaatatcttatcatggctcatgcattacatttggttattattatttttcatccttcttagtctaaaatagcccttccacatttttttcaccgatattgaaatttgaaaatgtccaggacgctagcctcaaaaaatgtctcatctttcaggatttgttttattttttttcccctgatgggatgatttaacttgttctgtagtctctgaatttctagtaaactggaagttaggtctaaataagacttcaagagatgcatgtcaaacatgtttggcgagaatacttcatatgagatgctgtgtattttgtattacgtcacatcaggaggtgcatcatatgaagtagtctcactaaatgctgcaaagttttattacttgcttcaggtggtgactgacagatcttgcattataatgtcacattttttcttcgcaattaataaatcatctaatggctttagtatccattgatgatccttccctaactcagttattacactggggcttgcaaaatggaggttttcctaatctgacatgatcttaacatttaccagctggctttcttctgtttgaaaaaaaaaaaaaaaaaaggtttttcctctatatttatgtcaaaatggactcataaatttttatttattcaatatattattatgaattacagttattattcttgcccagagcttcctgctcaattgtcccaggctcaccttggactttgcctatcccagatttagaattacccatttttttcaaggaactctggttacttttagaggtgaatagtacgtagaaacgtacatctgggtagtagccccttctcaatggaatgtgtgcacctttctggcaagcagtcccaaaggagataatattttcagattaccttggaaatgattcttgacaaatctctttcagaatacatggaagttaaaagtaagtctagacatgttaaaaagcccttcttgtgtgagacttcatgtacggtcattaagttactactcctttaaacctctctacttctgaattcttaaaccaaaatgtactagtatataatctatgctggtttgccatgcaaattaatggtgtaaataagataatgggaggcattcgtaaatgtacttaaaggaagaaattattgtttaaagaccttagctcattgtttgcatgcaaatacacgctgttgattagaaatgagccttatctaattcattaaagtaggcctggttggtcctcttcttgaaagtctccattagcaattcatattgctctatgcgcttccttgtaagacaactgttgtctcttaagttttctttaactttggcttcttacaaattcagaccccacccccaaccaaatagctttcaaccaaatagcttttcagcatcttatttcctacaaattaaaagcgaatattttaatgactcaaatggctctttacagtgtgtgcaatatgttaaatgtacccagtatatccgtgtgaaccagtgctacaagcctgctcacacattcacattttgcccccaggatctgtcccgtccgcttgctctgtactcaaacttcctttttttctcattgccagtttagaccttgactctccatccagcccagagtttggaaactgagtacccacaggctgaatcctgaatgcatgcagtatttttgcatagccactgtttttaaataattgacaacttttaaaaattgagagacctcattttttaaaaaaatatggatttctgtcttcttttgaaaatttagatctggctactaggcactcattactatattttctcttggcaccatcacctacaactgagtaacagatgtttcattttcttgctactcaaagtgtggtctctggtccagagcacagacatcacctgggagttgctaagaaatgcagaatctaataaataacagtcagcatttttaataagatttccaagtttccaagtgattcatgggcacattaaagtttgagaagcattgcctggggtaagcaagctttgtcctcagtttgcagcacctgtcccactttgctcatttatattaattgcttttccatagatatttgattttatagtacctcatgcagacctttgtatgatgatgacggttagggtggtgatggaagtgatggtgataacacttaatattgccatgcactgttccaagtgttttacgtagctcaatacttataacaactctatgaaatagttgctattctccttttaattttacaggagggcaacgaaggcacagactgataaaactctttgcccaagattgcacagccagcaagtatttgaaccaggatgcagtcccgcagtctgcctccggagtccttactctagatcagattttgcattatttatcccagttttgtccatcaggattctctggtatacacttgcaatttcttcctaccaaccttctccttacctttgatggccacacgtagtagcaaaagaattgaacatagaatctgttctgacctatctttccaaccctgtttttcataatttccactatttctgtttatgtctgaagctttgaatgacctgaagttttctgttcttcagcttttgcaaaaaaaaaaaaacaaagaacaaaaaacaagacaaaaaaaaaaaaaaaccgcttcctttggttgaattctctttccccttattttttttcccaaaatcttacacatcccttaagactcatcttaactgctattacctcaatgaattgtgacctgctcttctcaaacataagcagtttattctcttaaggttttcttgcccctttttataacactcatgtaatattgtatgtatatatcatgtatcatacctatttacatatgcttttcccccagcaagattaaaagcttcatgagggcagaggactctcttattgttatctctataacccacagtacttaccagaaagcctgatatattgtagatggccagtaagtactttcttaatttaaatcgtaagaattttattcacattcagattaaactgaagatttaaatctttacacttgacattattatatagattaaaaatagatctaaagagccagaccaatttttctgtttttatcatgttatcacatttccatggatacgtttgcaattctagaaattgaccttgatcccttctagtcttaaaaaaatggaaggagtttggttaataatattttaggtattcttcagaatttagtacatttaagagacaagtaacttcaatttatttagctagttatggcaaaaagcagctctttgattcaaacattttgtacatttgtttatcctactctcactgtatctcaactaataccttttaagtgaattaagcaggaattagccctgaaactgaatgttttagcctcatcctacatatagccacaagatgttttagatgcaatccatatcaccaaagagctatttttagattgatcagagagaatcatacagatattattattcacaggtgtcaatggaaaagctggtctcttcccatctgttctctgatgactcttgaaaagctttcaagggcattcataattcttcatcaaaagactatgaaaaatcagcttcatagttaattgttttatgtcatattttattttttcaacttggctagttctagtgaaacagactagctggcaccaaatatgttgttgcattggctggtaatgatgataccactgtgtggagatatacaagtgaatgtactttatttgtggccttccatgaactttatgtgcctgggaaagtaggagttagggagagtttgttagggaacgtgatctctgggatgggtcttaaaggatgagaagaggcaaatgaagagtaaatggacatgccagagagaaaaagtgacaggagcaaaatcactgaagcaagaaaaaatggcctacattgaaggactatacacagttcagtataaaaaggctctgttaagcaagcaccattgacttaccctaaactcttcattttctacatataaactgcccaattcccactccaaacctattgatggatattagtaacctattgatgtttttgaaaggtgttcaagtatcctttctggtaccatgtaccttggctcccaccatttgagagtatgttctccaagaggcaacagtctgtggttcctgacctggctatgcaagttattcttattattaaaattgtcctatttaattaaatatcatgaaaactaatgaaatagaaatgaaaagataagagaattgtggtttctatgaatactaaattgaatgctttggaagacttgataaaggtgattagaaaaaaaaaaaaggccagatgcggtggctcacacctataatcccagcactttgggaggccgagatgggtggatcacctgaggtcaggatttcgagaccagcctggccaacatggcgaaaccacatcgctactaagaaaatacaaaacttagccagacgtgggcctgtagtcccagctacatgggagtctgaggtgggagagttgctcgaacccgggaggcggaggttgcagtgagacaagatcatgccattgcactccagcctgggtgacagagtgaggaaaaaaaaaaaaaaaaaaaaaaccacggtgctgttgaattagatgtaggtaagacaactgtttaagattgggtatgagggatagaatccccaaaaaatggaggtattttgcattgagattattttcagcatctccaaatctgactgtaattcaaagaaaccaaactaaaagtcacagattatgaaatgtagaagtgttttatgcaaaaagtaatatgcttaacttcaacctgtgggcttttactccaggaaaagtctcggaccccataccaaatgagaagtaaatgagtgaccacttgtatattctaagaaaaataaaatgtttgaagatgtgtaaacacatttatataatccctccaattttacaatatttttccaaaaaccgcctatccacttaccctaatcaagtttgataaggggacttccttttatatgtaggaaggctgaaaaatgacgccatgacaaatgaaattgtcaagatggaccaggtcatggaagatttgaaatctcaaagaattttttccagggtagaatataaggatgttgggacgtttttatatgctttagatttgcatcctcatatgtccctttgacagttgagctcagagtgaaaaaaagagagtgaaactagtggcagggtgactcaagttagagacaatgagtaagcagaatagaactttaaaaacctgacagattcaagaaatacttgatgaaagtggaacaatttagtcgttaagtagatgggatgatgaggggaatgaagggacaattctaggatgatcccttttccaggttttttgcttgggggaactggctgcatggaaggctgttagtcaggataggaaatacaaaggagagtaactgaatggaaagaggaaagcaaatcagacatacagagctcaacttgggatataatagtcttaaggagctcttggaacattgaaaataaggtgatcagaaaacacgcatttgaataggtaagtctgaacatcaggaggaagacaagggctgaagacactgagccattttgctgtcaatgtagagatggtggcaatctccattgaactaactgcttctcaataaggtacctttctcaagtcattaatttgctaaccagtaaacaaaccagaattcccagagtacacattaaccattaagcactgctgtggaaaaggagttcaggtgtcaggaagccaacgtggcagatgagcactagtggtgacaaatgaaccaaagtgatatgggtgatctttatggggccacagagtaccactgtaaactatcacaaatcagaagggttgacaaacaaaatattggggataaatcagggaaaacctaccacaacatacaggaaaataagttcaaagatttcatcctacagattgcagataagaaatgagccctttttatttggggcaccctagggaaagagtagatgcccatatgtatatttaaagtatgaatacagcatttatttgaatatactgcaaatggtcaatacaagggtagctacagagcccataacatgaaaaggaaacacaaagaaatacatgccccagtcagactccttacttgggttgctgtaaattctctctccctttaaggttattgcatttaaagtctatctgttgattggacccaacagcagctgcaccaagactgtaccatttttaaaaaaaaaaaaaaaaaaaaaaaacaggccaaatggcattctgcatttattttccttgttgctgaagaaacttgaattgtctaccctcaaagcctgtcctttgagacacattttataattagaaacacttatttacaaagttctttttatgttagaatcacaaatcataacactccaaaaaaggaatacactatcctcaggtgagtgtcctacctttgtttacaaaagaaaacccaaagtcctaagagaaaaatgtgttgatcattttattgattccttaccttggtttaatatagttaatggatgtcttagatatgtataataagtctattatcatgttccctttaaaattctcttttgttttactaattatatgttgtcatagtttgaccattaatataagtctaaatttattataatgtgattttttctacaaaggttaatttgaattaaaatattttattttatctctctctactatgataaatgtttttaaaaatcgtttgtaaaatgaaagtactatatttgtgtaagctgccaatctaacaatttatcatttaccattatgatggtgaatgtataacaatccttatattcagcagaaagccttatctctcatttcagaggaatcttgccccggttaattattctgtctcttgaatgcacacaaacacaagcatatctttaccctttttctgctgcctcactatccctgatcaggtgaatgtttttagctcctagattacaatataaatatattcagacattcctttccaaatgcattcattccactgtacttgtcagagttcatagctgtgaataacagaacccagtttttgttgatagaagcggaaacggactttaggagaaagatacagacctgttcccattcctaaacaaagggatagaaaaccagctcaaaatgggcagaactcaaaaaagaggctcagctccaagaactatagtccaaatcataccctagattggatctcgaactcttggactcaagcgatccactcatcttagcctcccacagtgctgggattacaggcatgtgccacgacgtctggcccccatacactagatgtaaacgttgccatgcaccactctaccactgcagacactgggtgaagaatgtcattgctactggaaagaattctagatagtgccttataattctgtcactcattccagattcaaaaactgaacttcccccatcagattccatttgtatttggggattttgttcgacataatcagggcattcagattctgggcaaccaaagttaacaaatgtctcttacttcccctttcttgttattattcccatttgaatcttcttcatagttagtcactgttacttaaacacacattctctattatcacatttccctctcctctcttttgctgtttgcttttgatccaaaccactgctcagaaaccattattgccaataacaacaatgatttcttgtagttaaatccactggacatatcttagtcctattatccgtaggccatgtgccattaactgaacactttccgtattagcacttggtcctatcttatcttccaagtcactaatcttatctgaatttattcttacctctctatgtaattccttactatattgatgacactccttgctttacctgccccttacatcctgatgtttctctaggacatgttctgaaccctcccttcttctcattctatacggtttccctgattgttatccatagcaacaaatgtagctttcactgtatcaattagaataatatctagggagattaaaaaagaattatagtaactgaaacaaagtagaaatatattcatcttcttgtagaaggaatctgccagtaggtagtccgaggttggtatcattgctctatgatgttgaagatccagatcccttctgtctcacagatctgccatcctttggtgaggtccttacactcatggatcaagatgactatcagctctctatctatcacaactgcttttcaaaggctgcaaggtgtaggaagtggacaaaaaagggatacctctacccttttaaagggacttcatggaagatctacacaacactttagcttgtatgtcattggccagaatttattctcatgacaatgccaaactgcaatgggcattcaaaatgtagtggaatggatcatgggctaagcagctaagcagtctctaccaaagtcaccgatttcattttatggcctaagtctaatatttggcccaatatatagtttcagattagacctacatatgtagcttcaaatggaccatttcctcttctatgtctcaaagccatctcaaagtcagtatatccaaaactcaacatgttatattcctctcccaaaatctactgtgggtgatatcactatctattcatgtacccaaactataaatttggaagttacaagagctagtattaatgacactaagttttgtgcatttactctatgaacaggactttgataagagttttacaaatgtttcccacttaattgtcgcaatatctcagttatagagattttatacgtccatcatctcacctgactcttcgagatcataagcaaagcatggcagcattcttatgtccattttacaaattaccacattaagcacaagaaaaaacaagatatatgtccaaggctaaccaaagttatagaaggatcgagaactaaaagtcagtgatttagacccagatctgtgccttttcccttattgttacatatgaccatatctagctatgtgaacaaagcagctaatagtgacgacagggtagaacaaataagaaagtgaatattccccactacatttatgattatttgccagtttaacagcttcaagcctgtgtcttctcagatatgtgcttcctcttatgtctaaggaaaagtactatatttgatatgcttttatgaactttcttttttgagatggggttctggctctgtcactcaggctggaatgcagtggcatgatcacagttcactgcagccttgatctcccaggttcaagcgatcctccaacctcagcctcctgagtagctgggaccacagacacgggctactacacccagctatttcttttttttttttttttttttggtagaggcaggatttcactgtgttgcccacctggtctcaaactcctgaggtcaagtgatccacccacctcagcctcccaaagtgcggggattacaggcatgagccaatgtgattggcctgaattttttaaatttaattttattgaggtaaaatatacctctatataaataaaagtaaatatacctttaccatttttaagtatacagttcagtggtaataagtaaatttatgttatttttcccctttgtcccctctccctactcctatttctgatctctggtaaccaccaaggtagtgtctactttcatgagatccatgtttttagctcccacatgtgagtgacaacacataatatttgtctttctgtgcctggtttaccttacttaaaataattacctccagttctatccacgttgctgcaaatgacaggatttcaccctttgtatggctgaataatatcccatggtgcatatatatatatcacattttctttatccattcatcctataaattttaaatggtgtggaatttggagaatacttaaggaaaaatgacgattgtgtaaaaggaaagtatctacaaaagcaaggtttatctaccccataaagataacaagagaatctgtgaatgtggatacggtttctggagtgtttcagaggttgaaagattgtgaagaactggatgggtataaaaaaaagtgaggaggagaagaaatgaaagttctggaatgttctgtaaattgtagatgagttccctatattaattttaaaatgtaaattgagattataattattttttgatgatctatttttgctgggctgattctctgttggtgtaactctttaacgaatatgggtcacgtgggaccctggattttattagaattacatgtgcgaatcaaattctaactttatgagccaatataatgattgtttttttaatgattagagtctatccatgacaaaaacagcttgtttctcctactgacttatttggtgttttcttgctaattagcctttatactaggcagtagtaaatcagagtacttggacttcaggttggccattacataaacctggcaactaaatgctgggtaataatcacctatcttcccacctgtgtttattacctttggaagtatgtaacatggtatctttgcgtttatatttttaatttgttcttttttctcttgcaccagctacttaaattatctgagcttccttttactaatccaaaaataaagataatagtacatatttatagagatgttgtaagagtaagaggtaatgtaaataaattggctagctctatgcccagcacatgagtaggtgcttagaagttagtgtctgggtacatgacttctggggatgataaagtgagtagctcgataaatctccccaagaatcagtaaaatgggacacactggagaaaacatcttatgaccctggatatcaaccaacggcatatgctaaattaaaaagtgattatttataaaaagtactaaactttgtatatgaacaatatgaatttgtggtgtatttgcctgtattgcccccagtccccactcccagcttggtcaagcataatagttctatcaaggtagaacaagccatggaaataagcagcttcatcaccacagggactgattttatttgaagcagaagtttaaaactccatgtccagaagcattgtcagtaacggtggagacctaggcggcaaacaaaaaggcagaatagcaactcagctggcctaaagttgcagtcttgattggaacaagtaactgactggcagactggccagaaatttaatttaaccagcatatctgcaaaatgaggcagccgtaataggcctcagtaaggactccttgtgtctccttcatgaaaacttaaaatgtgcctgcatgttgaatataccctttaacacatataaagaacctttagcaaaacttggaagtcttactggcttgaggtatttaagatcaactgctggccaactattgactaatgcaaattaagctatgcttacctctaggaaactaggcatacagtttgtttctgttgtttgacagagaaagaatatcaacagccacacactgtggggaaacagattccacagatttcatctaggcaagttattaaaacttcaatttaaaaaacgctgggcataagaaggaacatcagaatttggggctcctttaatatgttatttaaaatgtcaaattttcaagaaaaatttacgatacgttcaactgtgacccattctcatggggaaaagcagtcaacaaaagttgtctctgaattggcccaggtattggcagatagagacttaaaggctcctactataaataccttcaaacaactgaagaaaagcatgtttaaataattaaatgaaagtatggtaacaataactacaaatagagaatctcaactaaaagatacacactatataaaagaaccaaatgaaaattctagaattggaaagtagaataaccaaaatttaaaaaaatcactaatggggctcaagagcagatagtaagacagaaaaaaaaaaaaatcagtaaatttgaaaatagataaataaaaattatccaatctgaatgtcagaggtaaaacagtataaaaaacgaacatgagtcatagctttgtgtcaaaacattgagcatatcaatgtagatgttacaagagttccagaaaaaaagagaatgttgttaaagaggcagaaaaattatttgaagaaataatggccaaacacttcacaaatacggttaagctcaacaaaccccaaatagaataaacacgaagagatcaataccctaaaacataagagtcaaactattgaaatagtttcatttgaaattattgaaagacaaatgggaaagtctttaaaacaaccagaaaaaaatgactcctcatgtacagggatcacatgattgatagttaatttctcatcataaacaatagaggccagaggtattgaaatgacatattcagagttctcagagaacacaaaattgccaaccaagaattccgcataaaacaaaactatccttcaaaaatataggtaaaataaatatattaccaagttgagaatgagaatatttcttgctagctgacctgacttacaagaaaaaactaaataaagtcattcaggctgaaaagaagtgatattcagtaactcgaacccaaatgaagagataaagaatcacagaactgataaatatgtagatacatataaaagactgtacaaatatagatatatgtttttcttcttttaacttctttaaaagacctaagattgcataaaaattataacattgtgttattgtgtttataagcaggaggagcaaaaatggagcttagcagagaaaaatatctaaattttactgtgttaaattagtttgaacttaagtaaattatgatcaattaagatgcatatgtaatctttagagcaagcactaagaaaataaatagttaaaaacaaaatttaaaattacacactaaaaataactaacaagacagtgcagtaaaggagaaacaggaacaaaaaagacatgaataagatgtgaaaaaatacaatatggcacatgtaattgcaactaaaagttgagaattcccattaaaaaaatctgaaatttgaaatgctctaaaatgtgaaactttctgaaggttgatataataccacaagtggaaaatttcacacctgacctgtaatgagtcacagtcaaaacacagccaaaactttgtttcatgcaaaaaattatttaagatactttataaaattacctccaggttatatgtataagatatctattaagatatatatatatacatatatatatatatacatatatatatatatacacatatatatatatatatatgtatatatatagtatgtgtgtttaaacttaggtcctatctccaagatattaggtatatgcaaatattacaaaatctaaagaaatccaaaatccaaaacacttccaatcccaagcattttggatatgggatactcaacctacatatcaatagttatagtaaatgggagtgaactaagcattccaattataggcagagatttcagacaggattatttaaaatatccaaccatagtttgtttaaaagagaaatgtattagagccaaaaccatataatttcaaagaaaaaagaggtactatgcaaattgtttacatataaaaaatgaagtgacaatactaatgtcagacaaaatagactttatgacaaaatatgtaacaagagaaaaagacatttttaattatataaggggtcaattaagcagaaaatataacaattataaacgtatataattaataggaaagtcccaaattctatgatgcagaaattgacagaattcaaaggagaactagacaattcaacaattattattggagacttcaaaccctactctcaatagctggcaggccaattagacagaaaaatagcaacaatatagaagaattcaccaacactatcaaccagcttgacctaactaacatttataggagacgccaccaaatgaaagcagaatacatattattttaaagtgcacatgaaattttctctgggatagattctatgctaggtcaaaaaacaaatctcaatacactcaacaggcttgaattcataaaaattatgttctcttaatatgtcagaattaaattggaattcaacagaaggaaatttggaagatatcaaaatattttgaaattcaacaacttctaaatccattggttaaaaactaaatcacataggaaattataaaatattttgaactgaataaaaataaaagcacaacatgtcaagatttataggatgtaactaaagcagtgcttacagggaaacttctagttttaaatacctattttagaaaagaataaaattcttaaatcattaactcaagctttcgccataagaaactagaaaaagaagaacacagtaagctcgaaggaagcataaggaaggaaataacgggggttagagcagaagtcaataaaatagaagaagaagaaagaaaaatcaatgaaaccatacattaatctttgaaaatattttttacatggagaagctttagctagactgaccaaaaaaaaaagaattaccaaaatcataaaggaaaaaggggtaattactaccaaccctacagaaattagaaagactagaatgtaataacatgaacaacattgtcaacaatttctgcaaaacatattaaatgaaaaaattcttagaaagacataaattaacaaaactgattcaagaaaaaaatagacatatgaatagacctaacacaaacacagaaactgaattagtaatttaaaattttccaacaaaaaaacccaggtccaggagaaagataggaatccgaggcatccacagtatagaagaagaaatgaaactctctttattcacagacaatacaatcctgtatgtagaaaaatctgatatccacaaaataactgctagatctgataagttcatgaagcttgcaagataatcaatatacaagaataaattacattcctgtgtactagcaataaaaaattgaaaatgatactaagaaaataatttcattctttgtagcataaaatagattaaatggtcataaatttgaaaatataagtactaaacctgtactctgaaaactgtaatacattgctgagagaaattaaaaatctaaataaatgggaccatattccatgttcatgaattggaagactcaatactgataaggtagtgattctccccaacttgttctatagatttaatgcaatctccatcgacatcttagcagatgttggcacaaattgaaaaattgcacaatcttggcacaaattgaaaaattgatcccacaatttatatatagcaattcaaatgtaccaaatagccaaaacaattgtgaaaaagaagaaaaaagttagaggactttgaaatcaggacattacctgatttcaaatcttgatgtaaatctgcaatgatgaagacagtgtggtactgtcataaggacaggcttatagatcacctgtaggtttaggaaacaaacctattcatatttttttcttaaatctactaactgcactcctaatgttgacaatggaagagactcgatagtccagcaataaactcttatatttatggtcaatcaatatatgacaaaggtgacaagataatccaatagaagaaaagcttattattgggtagcttattgttagtgtacagaaacagagctgattgttaatacaactcaacaggaaaaaggcaaataacttgatttttaaaatatttaaatatatatttctccaaagaagacatagaaatggccaacaggtatgtgaaaaggtgctcagcatcactagtcatcagggaaatgcaaatcaaaacctctgtgagatgaacactatcatctcacccctgttaggatggctactataaaaacaaaccaaaaacaagagataagaaatgttgttgaggatgtgaggaaatcggaacgctagtacaccataggtggtaatggaaaaatgatgcagctgctatagaacacagtagaaaggttcttgaaaaagttaaaaatagaactaccatatgatccagcaacctcactcctgggtatatatcccaaagaattaaaaccagaatctcaaaaagatatctgcactctcatcttctctgaagcattattcacagtagccaagatatcaatacagcatagctgtgcatggaagaatgcatggataaagaaaatgtggtgtattcatacagggaatattatttggccttaaaagggaaggacgtcctgccatatttgacaatatgtatgaacctggaaggcattatgctaagtgaaataagccagtcaccaaagggcaaatactgaatgattccatttatatgaggtgtctgagacagtcaaactcgtagaaccagagagtagaatgatagtaaccaggggctgggcgaagggggaactgggagttgctgttcaatgagtataaagtttcagttatataatgtaaataagttctaaagatctgctgtacaacatagtgcctgtactgtgcacttaaattattattaagaggatatgtcttaagtgttcctaccataagaagaagaagaagaaggagaaggagaaagtgaagaagaagaaagaaaaaatgaagggggcatgagcaaacttttggagttgatgcatatacttggttaccttgattatggggatggtttcatggttgtatgcttatatcccaattcatcacattgtatacagatgctcctcaccttaggatgggattgtgtcctgataaacccatcataaattgaaaatgttatgagtcaaaagtacattttcaattaatgatattttcaacttacagtgagtatatccagatataaccccatcctcagtccaggattatactaaatgtgtatcgcttttgcaccatggtgaacttcaaaattgtaagtcaaaccatcgtagtcagtcggggaagatctgtttgttaattatggacccatcgtgtacaccttaaatacttaataaagctgttaaatgaaaattaaaagttgactgggcacatggctcatgcctgtcatctcagtgctttgggaggccaaggcaagaggattgcttgaggccaggagttcaagaccagcttgggcacatagcaacattccatctctacataaaattaaaaatgtagccgactgtggtgatgcaagcctgtagtcctagatgctcgggaggctgagttgggagaatttcttgagcccaggagttggaggttacagtgagctataatcatgctaccacaccccaggagaccctgtctcaaaataaataaatagaagctttaaaaaatattggtatctcagtgttcctcattatccactgtatttaaggtttagctacttgtgcttgatgcttgacaaggtaatcttacttttctccctgatattggtatgatgcaaatttactatatatatgacacaaatttatatatgcaatattttctcgttaatggccttttattttactctcattttcattatgctttgccttttaagtcatatagcaaataaattatgtggcattttcttagcaactattaattcaggagaatgggaacagaattctctcatagattcagctggaaggtaatgatggtcagctcccagtggagaaaaaaaaaaaaactcccttcagttttcgtaaacatacagagaaattttctcctaagtgctatgtcagtctgctgtatgtcctattgatctgagaaccagaaaacacatattttagtttacactgccttgactctattgtacatggctaggtctgtttaaaaaagaaatccttgaagataccctttggattctagtattttaaaacggatgcttagctaagtgaagtggtctacttcaaggatcaaaaccaatcttgagtaatctgttaggtagactccctaagttcatctgtaccttgtaccaaatttttaatgaatttagtaattgacatggatgtaaaataaataatacactaataaagttcatgcagaatcaaattttaatgcccagaggtaatgtagaagatattacctgtccatttctctggacttagctcctgcaactctccatttttctctctaaactttagccacactgaattcctagtttcaattcctctgactcgctaagtatttcttctaccttgataaaagctaattcctttgtcttgtaccatctgtattccggctgatattgacatagttttcagggctcaatttcaatgttacttactcagagggactcactgttacaaccaccacagccttttcaatctaagtaagatccactgctcttcttagaaacaggttatattccaaatgactgtaagtgcttttgttcttagaacatatgtctccattcaaaagaccgatagatattcagttaagccctttgagaaaattataaatgttgaggaccttgattattattgttattattgcttcttttctatgttttcccaggactctcaacaaatttgctttgcttttgtactcatggcacataatgagattaataatgtttagaaaacatttcaaaaatacacacagaggagacacatcttagtctaaagttagacatgataccaaaaactataataactatagctgaccagtgaccccatttattcatggaaagtaaaatttgatgcatatttgcctttaggagcaacatacctatgaaagttctgaaagtgaaagtttgtaaaaaaggagtactctcctaacaatcttaatttttttctatatatatgtatggtttgcattaaactcttttgtatgattagtggtttaatgttgatgtcacccatgacaccataagctacgtgtatggactggctctgttttgttcactcctgaatatccagcaaaaatagtatagtgcctggcccttggtagatgtgtaataaatgtttggtgaatgcatagctacacttcaatgcttatcgcattttaatcccagctactcggaggctgaggcaggagaatcgtttgaacccaggaggtggaggttgctgtgagccaagatcgcgccactgcaccccagcctgggtgacagagcgagactccatctcaaaaaataaaaacaataaaaaaaaggagacccattcatgtatctgtatcactgactagcctgtcaacattttgttaactacctcatcaagtagcaaaatcagtacctggtatgtggtagatgctcaaatatttgttgataaaatacagtaagttaatgacaggcgagcttgcctcagtgaaatataatctgtaagtgagcagtgtgtatatcatttgaaggtgccctacttagcctagcatatcacagagattcccagtaaatatttaggcagttcattaactctaaaagttgaccctcatagtcattggcctacattattcacctccctctgtctctaataaattcattggcaaatttctgaactccaactggaatgtttgtggtggatttcttcatacctaatggattatttcaattttcattttacattgtattatttacttgtctgaggtctttataatgacaaactcggcatgcatgataagctgtcattacttatgccagttgacaaggacatattatttttctacaaaaaaaattatcttggccaggcgcggtgcctcacgcctgtaatcccagcactctgggaggccgaggcgggcggatcacgaggtcaagagatcgagaccatcctggtgaacatggtgaaaccctgtctctgttaaaaatacaaaaaaaaaaaaaaaaaagcagaacaaaacaaaacaaacaaacaggagtggtggcgggcgcctgtagtcccagctactcgggaggctgaagcagaagaattgctcgaacccgggaggcagaggttgcagtgagccgagatcgcaccactgcactccagccgggcgacagagtgagactccgtctcaaaaaaaaaaaaaaaagtggtaattgttcaaaatatttacttattaattcattttaaaattgcatgttgaaataaaaaataaatgtttagtttttaaactatctcttctacaacagaaacaatatagtgagaagagtgatcttgttttacatttttgcaaatctctttaaaagttagcttaagagaaggcagctggttcttatatctgtttctgcattgaatgtgctgtcatatctcgcatcatgtagcctctgaaaaactcataatagaatgagagaggaaaaagtcaaataacatcttagtattattacgaaaataatttggacctcacagaaccactgcatgggtctcagggactcccaggggtccccagaccacatttaaggaaatactgtttcagggaatataactatttttgtacctcctgtggctatattcttttaaagaatagtaacctctgtttctgaggaacttagctgcaattatgtgcagagtttaaataagtgaaacggaaataccctttgcctttctgctcgagtatgaaagtgatgatcaaaatgttcccttttctctctctctctctctctctctctctctctctctctctctctctctctcactctctggggaacttcgggtttccgtctctatataatgtattcatattccactggaaacatacatagtttgagaaaacagatgacattttttctgggggtggaaagaattactaccacgaggaattcaaaatacagacacagtaataaaaatcaccataaagcccagaggggaaaaaaattgagtaacaaaataggaggtgaaattataaaactgagtaacaaaaaagaggtgaaattataaaataaatgataaagttggttgtgggttaggaagaaagagaaatataaagaaactggcataatgtaaaagccaagacaagaaaagtgaggcagaggcataggtcttttgactattttccatgtttgattctaaggtaagtagatatagtttctcatagttggaaatgttcgtgaatttaaacagaattaatgtttataatcagatgcaatgtctagtttttctatttgtcctgtgaaataataattgtgtaaagtgctcatgattgtttcaaggggtgaggagtagttctaattatcatagatattttcatgacttcgcataccactggtttatagagattatacagattttcttatatcagaactctcgtatctttaattccctagtagatgtctaagaaggagatttatcacatagcagatggtggtaaacttgagtaaagtgccagatactaaatgcctttggctttgtgggccattcaatctttgctgcaactactcaactctgctattgtagcatgaaagtaaccatagacaatatgtaaatgaatgagtgtagctctgttccagtaaaactttatttacaaaaacaggtggtgagcacaacttggttcatgagccatagtttacaaacacttgctgtatagctttccctggttgaatttcgttaattttatacagaacctgcctcccatacacacacactttgttcttcatggaaaatctccccagactactatgaaataatgttattacttggagatatacaattaagatgatgtcattaggagattattaatataggaactaagcaaatactatatgctaagtactgaggatagggtgcgatcacaatagatagaaaatctgcaatagtttgatgaacatgggaaattacagtatttcctgtgatggaaacattatgaggggctgtgggactacataacaggacctgtgacctatacctgggttggggatgtctaattaatcaaggaaagctttgtagaggaagtgatgtctaacctgagattggaaaggtcaacctggagctacctagatgaagatgtatggaaggacatcccaggcagagggaacattgtatgatgaatcctgatatggatatagtgctggattttaaggaagagtaagttgttccatgaactatacagtgcaaagaaagatgaagaaatagaagtagagaccagatcacaaagggctttttgaccatgttagagaagttatattttatcccattggcactaggatgttgttgagtatatgaggacatgatcagcaacatattttagaaagatctcttattctgaagtgtaaagagtggataagaaggagacaaggtaggaggcacgagctaattagaaagcagtctcagagaggctgttagaaatcagaacagaatggctattattaaaaagtcaaaaaacaacagatgatggtgaggcttcagagaaaagggaatgcttatacactgtttatgggaatgtaaatgagtttaggcactgtggagagcagtttgaaaatttctcaaagaacttaaaagagagctgccattcaacccagcaatctcattacttggtatatatttaaaagaacacgaatctttctaccaaagagacacatgtactcacatgttcgtcgcagcactatacagtaacaaagacatggaatcaacctaggtgcccaccagtggtggattgaatgaaataaacgtggtatacatgcaccatggaatactacacagtcataaaaagcatacagtcacgccttttgtaggaacatggatgcagctggaggtcattatcctaagtgaattaatgcaggaacagaaaaccgaagatagttagaagctaaacattgggtactcattataaaggtgaaaacaatagacattggggactactagaagggggaggaaggagaggggcaagggttgaaaaactacctatcgggtactatgctcactacctgtgtgtggtgggatcatttttaccctaaaccttggcatcacacaacatactcaggtaacaaacctgtacgtatactacctggatcaaaaataaaagttgaaatcagaatgagaaggagcgaaggagacagcgacaggaggatggagagaagtgggcagattcaagagagatttctcaagtggacttatgaggacatgcttattgatacgctctgggagtgagggagagagaagaatcaaggatgacttctacactttcagcttaaaaaaccgggagctggtggagtcatccattgaacttgacagaggagcacgtttaggcaggaagatgatggtgtttgaatgtctgcgaagggaaaaactgaactgggattcaaatcagaaaaaacggtttgaagtcataccctcttaattgcattttctatcggatggtaatggctttgtgacaggctttactgataggtgatgtaactctgcctctgacagatgaagatccaaagcatcctcagattttcccgaagcctgtttcagcaactgtgtagacagcacacacaaaaatctggggggaagtcctagggctcagttagttgattggatctattaaagtagcattggagaacacagttcagtctgagatttcccaaacatattgctctataatttatttttacccagaaactgaattcgatgtgggatagggattataaaagccttcagattccagatagaatctctgaatagaaggcttttgggccacatctagtaatctcctttcctcactccatttctgaacttcttgttcacttcttcgctgtttttaggacgttcttactacactcctgcctcaaggcctttgtacttgttttctctgcttagggcgttctttcccgcaatatttgcatggcctcctccctcgcttctttatttctatattacctatctttattaaagctgctataaaaaaaaaaaagcccacacctcagtggcttaacataatagaaactttccgttcatgcaaactttacaaaaattttctggtcaacaagtagatttcctccaaatggtggatcaggggggcccagggcacttcgcttttgtggctctgatgtctttaacatacggatttcaaaatcactgtgctcttgtacataagaatgaaaaagaacaaggaatattacatatgtggtggtggttattggaggtggggttatgagccaggcttcatattcatgagcatcacttttgctcacactccattggctcgaactcagtcatgtagccaaactaatggcaagggagactgggaaatgacagctagctgcacaattaagagaaatgagtagacttgtctaatgagcagctagccagtccctaccacgaggactttgctcaaatgtctccttctccatggaaccttctatgatcaccctttataaaatcacaactgctccccatcttcccctcaatatttccatcccttttccatgcttcatttttttcctctgtaacacttactgtatcacaatctatagattttatttctttatcttgtttactgtctgcctccccttcctcccaatcggatgtaaggtccatgaggcagggattgctgccgatattcacggccatatcaatggacactagtagaccctcaataaatggctgttgcattgtgattacatatatgcttcacctagaagtagtctcatctggtggcacatttactcatagattgacattaattctctattgttttttccccagcaaaatttgtcaaggtagtttgtcagtagggagaaataaagttgtcaggtggctcatcaaaagttcaattttgagtactcctcctgtgtactcataatgttttataaatacttttatctatgtaagcacgtgggcttagacacaattctaggattaaaacagaaagctctgtatccatattttcccttttttgtacctccttttatgttctctaccattttttttgagtgctgttagtgaagcactaggctaaatcttgggtttctgcaaaaaaaactttaatcctcacaacactctaaaatgtttattgttctaattttaagacgaggaaactgagggctaaagagattaaggaactcgcccgtgttcacgtactcagctgataactggcagcatttagatttggacttactttccatacagatattcgcattgctaaccttcaggtttttccctcatcgttttccacatctactcaaaagttgctaatcatttccttaatagtgaggcataaatgactgagaaatcttgatatattatccccctcaggagcacttcattccgacaagacacaaactttagggaaaatgaacaaatgtctacttgtacaactcaagcaccaaccaggtatggtagacatgttggcttaaaaataaagttgatgcttgggttctgattctgataatgacctacggagggtatggcctgaggaggttactaggtgtgtgtagaaatcaatgttttgttttggttttccctcgggaagggtcaacttatacttgaatccttctgaagtttctcaaattacaagatggtcatttattttacttcaatcaaaacaacaaagtactgtccgggaaagatgtattgccttgacttattctcaatttatgcttattttggaggcttgtagaagtaaacctgatagaggagggcaaaaacacacacacacagacacacacacactgggagaaaataaatttaacacagtttagggattgactttggttgtatgacatcacaattgcaagagttggatgccattgtaaacaagctatggaaagaatactgttaaaagtaactcattaagtggttacatggtgtagctcatggacatatggcacagaaaaaagataaagctgtctttacataacataaaactgtattctgttatgtaaatgtgtgcttgtggcttgcagtaaaattcctagtgaaacattacctctagattcagcagtactatacctcaggccacatggatgtaagtaaagatgatgccctctggaaaactgagttaggcaacaacaagtgcatccatgaggatgcaaatttcaatgttgaaggtgcctgtgaagaatttgaacaaaattgttgcatgaaatatgaatgaagaagtgtgatctaatgacataatattttgtactatataattttaaagtagtacacacaatcaaattaatgaattaaacattatatgtaaacaggtgatcattgtatctccattttctaaagtttctatgttaaaggtgatcaaaaaacttggagagagggacttctcatttggaaaatgggatagtcacctttgggtatgtgatgtatcaatctctagaacttcagtttcttcattgaaagcatataaaaggcaatccaaaggatgtatggaatattaaaagattccactgtgaaactatctagcactttacctgaaacacttgttagatcccctcaccaaaatcatgccatgtgatttggcagtctattcctcttagcgtaagagtagcccgacagaaaatgttcattaagagttaatgttaaattcattgaatttagcaacacatgagtagcgcttcctttctgattatgcaaatctctcaccatcgtaatacgtgcttcctttaatttcattgggaacatttgtaatgtaaatggtaacagagccaatatttcaaacagaagccattctttctaaaaaaagctaaatgtctaaatgtattgaaatgcttctaaaagtaaaatatttagcacttatttgcagatgggtaatgttaaatatctcactcattattattactaccacttgtctgaataaatcctcccataagcattaagcaagtaggtaaacaaagaaataacacttcatgtgatgaatgccaatatgaagcacgtttaaactgttctgtcaagagacaagcctggaaatgctaactgtgtttctttgcttttctgcaatcatctgaatacataaattcaaattgcagcttttaaaacttcaaatcgaggcttttgaaatttcagaaaacacatgcgcttggaaaagcagattataacaaggtcccaacgggattttgtcaccatcttttttatatttcaaagtataaaaaaaatctagataagaaatgactaccaaatgttttcatatttaaaagatgctgtttttttaaaaaattaaatcactggaaaaaaagttttccacaaatatcgtgtaaaaagaaagacagcaaaaagcttagccaaagcttttactgtttaagtgatgatttattctgagagttcttaagagttttctaaattagtatatggttaatatccataaaatcatatgcaagatgctgtctttcaaattgatgctgaaggttaattataaaatgtacttaattatttatagtgtcccattgagtcccagatactctgtgtccaagaacactgtaaatacagaaagtttagcagaattatattggaaaggcagtaattcttcacaaattaacttattgatataatgcaatcccatttaaaaattttcagcgagaattgttttataatttgactgaatgatacattacataagttagaataactaaagtgggagagcgggttaacctaccagaaattaaacatattttaaagctgcaataattgacatagtgcattactgtcacaaaaatctacagtagatcaacaagcagaaacttaaaatatcatgaagaaagcaccataaatcaattcagaagagatggtgctgggggaaaaaatatcagtttctgaaaaactcttcaaggttagaaacaacactatataaatttaagatggattaaatatttggttgttcttttttaacaaatgaaagagtaaaggatcaagaataaatgagaatatctgaacaatggtaaaatggccacaattttaaggatactatcaatgaacataatatcaaagaaataaactgttaaattttatttagaaaaaactactaaaaggcaaaaaggaagctggaaacgtagtctcaattaatctatgtttcagataatgtgaaaagagctcttaaaaataggaaaacacaggaaaaatgggcaacagacattgccgataattgacagtggaaactaaataaatgacaaacatgtacacacatacaacattttcaactttcctattagtagaatacttaaaatatctatggcaagctttttatttgttttattggtatatcaattataatgctcaatagtggcaaaagtgtagtgagacaagtattttgtaactgttggtgggagtttacgagtgttctgagtaccaaccttgacagaaattcaacaatgtgtatctaaatccttaggattcccattgttaacttttcattctcattccagcagatacatgattcaaaatgtataaataaatgtgtttattgtagggttattcattataataaaaaatgaaagcaaacaaaattcctaataacacaataatggtgaaatatagggtacccctatatatcttattactaggatcttaaaaaatcaagtttttaaagcgtaattaatgacctacagagacacatagtagaataataaatgaagaaaataagcatacaatatagggtttgaacccagtaatacatataaatctcaactatgatgaataagcacaacatctctcctctgtactggatattcttgatagaaaaaaatatgctagtaaataatttgagacatatttgaaaagaggggagtgtttgatttagaattttctaaacttgagggttattattatttttttggtttgatattactttttcctgctccttaaatttttgtttgtttggggggtttggggttttcttttccttaaacgtgtctgcttctagatgaaagttgaaaatgtttaaaagccttgccaatgtgtctaggtttttcaaatgtaatcagattttagcaagattttacttaactaaaagtattcagaacactgtgcaaaatcatctggagtcaaatagtaatggaggcaatgatttgcagagtagaaacagagagagagaaaaagatgagatagaccctcaaaatctagacccaaggaattaaatctgcttggaacatttaaacaaataaaggatgcctgtactatactagacgttttcttcttccacaattgattctaaggtcagaatctgaggggaaatggtgctgttccacattctaaaacaaactgccagcaatcgagaccagccacttccccatagggtttactctaaagcaacagggattattatctctattccaagcaatttccaatctcctctgtactccgtgtcccaggcaagattaaaaagactcaggtaggaaggggtagtaagctttgtggggagtgcagtttgtggtaagggacagttccttctctttcatctctctgagtcagaagtagagacttcgagagaatcactgagagtaagtatgtagactccaagaaggaaaaagcatcctctcacttcaatgaatgtttggaatctgcagacctccttcccaggtctgtgtagcttttggagaggccagaagagcaccgtaggcattcctttggctttccatggccaagcacatagagtagaagaagaggaggaaccgtaaggttaaccatacataagaaatcaacaaaaggctttgaaattgacttttcctatttttcaatttaaataagagagaattgtcaatgattaaaattcataaaacgaagaaagaatggactcagaaaatagcaaacatgaaatgttaattattagttcaaaagttagtttaccgtgttttctctgccaactgattgctaatgactaaagtccttatttccagctttcctctctccccgagctccagatctcttgatttattaaactagtagtttccccaaaatatatgagacaacaaaatatactctcagctgaagtaaatagcattcatcttcccagtcagataaggcagaagtacttctagatcagatgttatattcgggataggttaaaaacagaccctgctcccagtgtcccaggaatgaacagtggatgtgcttatttctcattgcatgcgtgtatcaaaatatctcacgtaccctacaagtacatacacttactatgtccctacaaaaattaaaaacaataaatcataaacatttgtaaaaataagcgaataaatgtataaatgaatttaaaagagaatagacagaggggagaatgtaactttacgtgtcccagaacagactttgaacaggctcttatcatataggaaaactgaatgaatatatgcaagcataagtccaataaccagattctgatttacagaatgatcgcaactgtagttctctcaaggccctgtctttgaacaggctgtgtcttattcctgcaacatgctgatctatcttcatgcttcaagactcagatcattatcttctctgggatgtctcccaagcactgccccagaaataacttctcctcctataatacttaatcataatccttggcttacatgcttgtttcttctcattgactatgaaatcctcaagacaaggtatataacgtatatatctttaatcctaatgcccaattgagctcttagaaggtagtaagctcccaatacacatttgttaatttgaagcaaaaaaaaaaaaatagctaatcattcaaaaaactgaattatcacaaatgtccatctaaagtactatatttacacaattaaatgctatacagccaggttaatgaacagactaaaattatatgcaacatggattatcgtaaacataattttgaatgaaaaaggcgagacacaaaggagtataaagccatacaattccattttcataatattcagtaccggcaaaataatcaaagttgacagggtactggttatacttggaggcagtgactgcaaagggataagaggagatttctgagattctgataatattctatttccttctctggttgtacagtgtgttcaatttttaaaacactattgggctatacagttaaattgtgcagtgtcctgtacgtatattacacttcagttaaaagcttccatggaagctacacatagttcccaaaagacaacaaaacaaaaaattttcaattattttaagcacaaacaattttgttcagctgtcttacaatcgaatatgtaagaataaatttatggctaattagcatagagttatatgcattttcataattaaaacttccacgagtacaacatatgttaagtattttaaatcagtttttctctttcctcaaataaggttgtgagtcataattcggaaaacagtttagcatgtaataatttagtgttttattttaaaccaagctgaagccacataaagcagaactgctcaactgagccctatccaaatccttgacccacagaataagaagcagataaaatggctgctacttaaacaaaacaaaaaccttgtttatatttttgtcctctcattttccataagtatactttaattaaacattttaaaacttgtaactttaggttatatacttactttagttggttctcaaccagggacaattttgtccccacccccaaccccccagcatatttggcagtgccttgaaacatatttggttgtcacagctcaggggcgaggtgttactactggtatccagtgtgttcaacaggccagggatactgctaaataccctacaatgcagaggatagctgctcacagcaaagaattttccaaacctaaatgttagtaatgctaaagttgagaaaccttgctcagatataatgacataatgttgttagaatttttattttattcattttaatgtatgtatgtatgtatgtatgtacgtacgtatgtatgtatgtatttgagatggagtctttctctgttgcccggggtggagtgcagtggcacgatctcggcttactgcagcctctgccttccacgttcaagtgattctcctgcctcagcctccctagtagctgggattacaggcgcctgccaccaaacctggcaaatttttgtatttttagtgtagacggggtttcaccatatttgccaggctggtcgcaaactcctgacctcaagtgatccgcccacatcggcctccctaagcgctagggttacaggcatgagccactgcgcctggccaggaatttttgaatcagaatttttcttgttcgattttaatctcttatcatttagagattcttgaaatattgaaattactttgttcaaagtgaatgaattttcttaaattatgtatggttaacatcttttaaattgcttatttttaaattgccatgtttgtgtcccagtttgcattaacaaatagtttgagaactatgttggaaaaaaaaataacaattttattcttctttctccaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaaggtaattttattttctcaaatcccccagggcctgcttgcataaagaagtatatgaatctattttttaattcaatcattggttttctgcccattaggttattcatagttccttgctaaagtgtttttctcacaactttatttcttcttaaccctgcagttctgaaccagtgcacataagaacatatgtatatatgtgtgtgtgtgtatttatatatacacacacacatattgcatctatacatctacacatatagatgtatagattcaatatgtctaaatgtatataattcacagtttttatctttgatttgaaattaattttagattttacttgagaacttcacaacttcatataattttaaaaactgaagaccagattgtggaatcataaaatctaaatctaaatgggaatcacttttttaatctgtcctggttacctacctggagatttgagaagagtctttaaaaagaagaatccattttcttagggaagatctggattgccagatcagtctcaccacttcagcctctacttaaaggcattatattcccccgaagcaatgttttgttttagctgatttgtctgggggtgtgggacgtggtgttggttcacattccatttggttgaatagacatccagcttattccagtggcttttcataccgtcctactgtgatgtctgcttattactgattacttcccttggctgactgacatgctctgattgtgcaattggattaactttcatggttttagttttaggaaagcagctcttttggatctatttcattttagttgtcaagcagaaggtgaaaggggaagagaaattaatatttaatcattccctgttatgtgccaagtattagatacatttacagccactattttatttaatcttcatatcagattttgacaatggttgctattatcctcattttacacggtcacataatcaaagggaaatgaaattggtcctttatcaatgattcaggtgctttacacatgtaaattagagtccaatgtcaaacgtttatttctgtgaaacaagaggtttacacctgaacaagaaataaagtataaaaataaaatatggcgtaattcaataaacaaatatggagcactgactatacatccgatgttttactaggtatttgggattcaaaaatagaaaagagtgggaatcatttgaagatggttataccctagaacaatgaactcagtcttttcttggaaatttatctttcccaaatgtattgagtgtcatatatagtaatataattgataattcattcgaaacatatttagtggcattttcttattaattaatatgcatgagtctattttctcctgaaagaatctagatcagtgctttcaaatagaactcccgtgatgatgaaaatattctgcatcatccatttttgtaacgactagctatttgtgccttttgaatacctggagagttggtcgtgtgactgaggaacttgagattttattttagtgaattttgattaacttgaatgttaatagcgttgtatggctaatgggtactgtagcagacacagtaactttagttgacaaaaatgaagtgttaacaccatggtgattttggaggtcttgggaaagggcatacactatgtggtggtgaatgagttcgagaaatttagggatatgaagtaaaaaatgaggactccagaatgaaactacccaaatttgaaccacacctttgttgcttgctagatttgtgtcctgggagctggtatttaacccctttgtctcagtttccttccatataaaatgaagataattggatctacctgatataattattataatatgaagataaactaagataataaatgtgaaaaggttagcacagtgcctggcactgtgtatattgagagtcaatactctcaatgtcagttacctcttaagatgataatgcaatttctcagcagcaagctacggtatgctatggcatgctatgatacccaagaggctgatgaatttgttcacattgttctatttctgatagagagataggttttcagacactaactttatttggagtgttgctttaccatctcacatttttctcttaaaaaatttatgagggataatataatcgtttattttctacagagatttatctactgagggggtgagtgtttcagtcaatcagctctgtgctcagatagaaaactgttggtatttgaggtaccactgggccctcggtcaagtcgcttcattttgatagactaatcaatagaagcaaagacaaggtagttggaattgtgctgtaattcattttaaacgttgttgcatttgtctgtttcagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggttagacattaaccatctcttccgtcacatgtgttaaatgttgcaagtatttgtatgtattttgtttcctgggtgcttcattggtcggggaggaggctggtatgtggattgttgttttgttttgtttttttaacctgaccgtttgctttggctatatgttttgttgtggctagaaaaaatgatgatggtgaatggctttacattaatgaccaaatgccaaaatttataccacaattttttgcataaattattctgaagaatcagactgaagaaatggcgaagtatttaattcagtggccaggcatgtactgacagtatttaagctgaaaggacgtggtctggttctagttaaacaagtgtcataaatcaaaattaattattcacacctgtggtatggacttaataattaatgtacactaacgttcgccacaagtttatttatttacttacctactgatttattaacttgtgagttttcatctttccaccttgcatactatataaatctaacagtaatactatttattaaattaatacatatttattttatataaagcaagtggtacatatgaatttatagtaaaaagcaacatcaattgatccagcactattcattcaaagacaatcatttccccactgtattttcatggcatctttgtcataaatcaagagaacttgtatgtatgaatctgcttctggattctgtatcctcttccatttgattaaatctgtactttaacaacagtacttcactggcttaattacaatcttttttttaaaacaatcctaccgagctataattcacataccattaaactcatttaaagtgaacaattcaatcgtatttcggtgttacttttttaaggtgtgataaaatatataacataaaaaattgtcattttagtcatttcgtgtgtccagctcagtggcatttattacaaccatcaccacagtttatgccccacccccaatttttttttttcttttttggagacagagtctcgctgtgtcgctcaggctggagtgcagtggcgcgatctcggctcactgcaacttccgcctcccaggttcaagtggttctcctgcctcagcctccctagtagctgggattacaggcacctgccagcatgcccagctaagtttttgtatttttagtagagatggggttttgccatgttggccaggctggtctcaaactcctgacctcaggtgatccgcccaccttggactcccaaagtcctgggattacagcgtgagccaccgcgcccagcctccaaaattttttattactccaaccagacagtctgtaaccattaagcaatagttcccctttctctctcttcccatccgctagtagcctctggactactttctgtttctatgaatttggctattctagatcttttatataattggaattatatatttgccactttgtgtctgccttacttccctcagcataatattttcaaggttcatctatgttgtagcatgtgtcagaacttcattcctttttatgactgaataatattccattgtatgtatatacgcaatcattttatttaaacattttggatctggttgtgtaaaccttccactttgttcttcctattcaagattgccttggctacttttggttctttgaataaattttagaactatattgtctatttttacataaagccttccaggatattgattgaaattttgtgaatctggagctcagtcaacatctttacgatactgagtcatctaatttgtgaacattttgaattgtgtcaggttatttattgtattttttaaattggtgatgctgacattctaataacagatcatttacacgactgataaaatatttaggaactaaaataagtaccaattttatgacattaaaaccataatgtgcgcttaagtgtctctatttcaagcaggtagttatttgaaaaaaaaaaatcccttcttggtttctacctttaatgattgcaaaacatctgtgtaaagatacagacttttatgtatggagggaaggtggtgtcccagcaattaaattttatagctacataacaatacaaatgaaatcatccctcataaaaagagaacaaggaggaaggatacccaaaatgttctacaatatctcagtacatcttatgacaaaaagaagaacaaaaattataattgtaggaaatgtgagagaactatctaaaatatacaatagcagctttgtgggttgtgaaagagtcaaggttttatgtgtcctgcaacagaataaaaagtcaaatttttatgatagaaaattaaaactgaggttacgaacaccatcatgtatagacttatattactacagcatccataatatctgtttcctatgccaaaattataattttaatgcaatgtctttgccattaaatgccacaggatttggaattttattcattagtcatattaaaattatttaatcatcttttctccatccatatgcctctgtatccctgttagtttagatttagggatagaaagcaaatgatcagtaccagatttaggtaaataacacaagtttttttaaaagtaaaagaaaatggcttataacactggcagacagtcttgatcttcattaaatctcaagctcttacttattacaggagggtagaaataaagcggaccccctccctgtgtcctccagccctacccttcatccaaaggttagagtgggtgatataattggaactagtgggtcatagttactgtgacatgaatatgtcaattccttagtacatagtatctccaaacatatcctaatatcataatcagttggcaggtgactttctccacagctaactctaatatgctgcattctgcgtattgagccaactgaccccttactcttgtacctttattttatttttttttttatttattttttgagacagagtctcgctttgtcatccaggctgcagtgcagtggcacgatctcagctcactgcaacctccacctcccgggttcaagtgattcttctgcctcagcctctcgagtagctgggactacaggcgcgcaccaccacacccaactaatttttgtatttttagtagagatggagggttcgccatgtcggccaggctggtctcgaactcctgacctcatgatctgctcacctcagcctccgaaagtgcggggattacaggtgtgagccaccgcgcccggcctgtacatttatatttcattactgaagagagaaaacagcaggtgaagataatatagctatttctttaagggagtggtggacagggttgctttaaactgaatatagccattagcgtaaatttatgggtagcttcatgcaatgaaggctcatgaaatgatatcctcattcttgtctaatacataacttgaccttttacagcctttaacaatgatacccgtaagagccacaaagtggggatgttattaaagctagcctctgtgttcctctctctgatcatctcattctatgatcttcacccacacttctgactcaggtgtttttaatatttatccctcttcatatttctttgtattttctctgaacatgcatgtgggtgtaggaggctctctcgccatcatcatcactctcttcctctgtgtttctcacttttaggctaattttcatctatgaattgacacgtatattataggaatttatttttatatatttattaggaatcttctttttgttttttttttttttttgagacagagttttgctctgtcgcccaggctggagtgcaatggcacgatctccactcactgcaacctctgtctcctgggttcaagcgattctcctgcctcagcttcccgagtagctgggattacaggcatgcaccaccacgcctggctaatttttgtattttaagtagagacggggtttcaccacgttgatcaggctggtcttaaactcccgacctcaggtgatctgcccacctcggcctcccaaattgctgatattacaggcgtgagccaccgcacctggccatgaatctacttttctatttgcatatttgccactctttttctgccccagttgtttatgtaacacattctcttctgctctccttccctgaccccgttaatcccagtttcatctctttcatgtctttttattttgtgtcccctttcctcattcttcattgctctttgtatatgttatatgtgggtatttttttaactacccatttatttaaaaccaaaatatgctttatcattctttatttttgaacaccgagtcctagaaaggttatgtgacttatttgagaccatgtagctttctatttaaatataaaagtgattccaaaataaacagtaggggttttaaccttttggtgaagctcaagtgatttttatgtggataatatcctaatattaaaatggggatttattttcttttaaaaaaactatatgagtttttgctttggtttttgccctttttgagaactagatgctgtgttttaaaattactttctagaaccttctctgctgtggaacatttacagttgtgtaatatagcaaaacatgtttatgttgtttcagaattagttaaaatcctactatttttaatgtcaagtaattttacaggtggtgtacgttatgcattcctattagttttaataaatatgttgtcattttgttaaataagtttaaatttttcatcgcattttacatgtaaacagtaatttactatctacacataaaataccatttacaaataagatatactgtttatatgtaaatggtaaattactatttgaatttgttactgcccagacagtataaaatggtgcacataaagaaaaaagcattttggaaaacaattaagaaatttggctggaaagtgaattttagttaagtgcatcttattcactttaccgaggaaaaaggtaggtttacaaatacaacatatataacaaacctttaatatgggaataatttttgtaatattgataataatacaggtattattttcaaaaaatcaccaaataaaaattatgaaagtaaaaatacagtgcaactcctagcacaaactatcttccacaatatacagttggctgtatctaaatttccagaaatctggttcattttgtattaatctctaatcatgttgcttctaaatatgtatctgaggagtaaacatttcagatttattttcatttgtataaggtaaatgaatgtttagtctttttccagacgtatttgctatgtaatgacagtcattattagtcgtcagtataaatgtgaatagcaaaaaggagaaaattaaataaagctagagcttggctttccgactccttgctcaaaaatggacactttgtccaatcaatttcctatcacaagatgacgattaatagattgttctaatagttaccattcagtcctgcccttaacgtgatgttttttcaaccaaataatagaatcttcactggcattgttaccatattgactggtatttatggaaccccggaaaaaaaaatgctgtaaaatatatagtaggaagtataataatcattataggaaatcatttctctagctggaagtcttagcagggaccagatagttccactggagcttttatgtgctcatgattttctcccttgaagtgtatttgtaacacagttcacacagtttttaattttataaatctgtgtgctaaaacgctattatataagaaaacgggccgggtgtggtggctcacgcctgtaatcccagcactttgggaggcccaggcgggcagatcacaaggtcaggagatcgagaccatcccagccaacatggcaaaactccgtctctattaaaaatacaaaaattagctgagcgtggtggcatgtgtctgtaatcccagctatttgggaggctgaggcaggagaatcacttgaaccagggagtaggaggttgcagtgagccaagatcatgccgctatactccagcctggcgacagagcaagactctatctcaaaaaaaaaaaaaaaaaaaaaagggtgttcacctatttattgggcatatagtctgatagttcccagaaacccattatcttgaatgttttctttatgtaagttcctggaaatccattatttggatgttttctttatgtagttaataattacagcaaagctgtaattaaattatttattcaagagctatctattaaaggactactatgtgccacattctgttctaagcatatcataatcacttcccacccttcccttatttaaaggacatgcataattttatagggcttggcattataaatattcatatctctaatttatagttgctaaacagtttgaagctgagggttgggggaagggagtagtaatttaaagtttataacataagcatccttgactttgcctcctataatttcacactgacatgaggtttattactaggttgtgtgtcatgagtacatctcaatttgctctgactgttctggtttttgcctgttatcctatcataatttttaatagctccctctttcattgtcataagtattccactttagaagataaaatatatagagagggtcactctagttatgagaacaaacatcaggcttttagagctaggcttggtccagtgctcaataactattattatcatgattgcttttgttcttagtagcatcatcgtccttgtcatcatcatctaccttcctaatactttagttcagctgagaatttcggcctatccaagaaatctgattgccattattaccgaattaatcactctttaatgacaatagtatataagaatacgtgacatttaactttccaaattattgaaatgttacgctgtgtatggaaaattctttctaaccgtgttttttctctactctcaaatcgtaacaatcgtcaacacagaagaagacttttatgaccaaatttgtggaatttttttccccatacaccaaacagcaggcaccagctgggtgtctctaattcagtcctgacactatccacccagagatagtgtcagatcccatagattgagggctcagtaccgaggtctgcctcctctgcacccccctagcgcacgcgcgcgcacacacacacacacacacacacacacacaccagtctcaagtccaggcctctggaacttctgacccatgggcttcaagttggggttcccatgaccctctctttgggttcaactaacttgctggagcagctcacagaactcaggaaaacactcgctttcacctgtttatgataaaggatattgcaaaggacacagatgaagagatgcatagggtgaggtatggttggggtggagggacggaaaggggcatggagcttccatgccctccctgagtgcaccaccctctaggaatccccacctgttcagctacccggaagctcactggactctgtcctctttgttttttatggaagcttcatgacatcagcattccttccccaagggtatatggtgggaccctctaacaggaggtttttaagacctataatctgaaaggcgagggaacattaaagtgaaaggagagcaggagaaggtcagaggcctgcccctgagacccaacgcaaccaacattataacaaaaaactgtaacaagggctatgggtgttatgagccaggaacctggatagaaaccagtatgtactataataccatataggcaatgccaagaatatggatcagacactttacaaacaaggaaaaagtaaacaggagtgatgaggaggtaatttactgcaggcattaatgatgagattatgaattatggattccacttgctaccagctatgtgatcttatacctactctgtccatacctaagttataacatccataaaattcaaatactaaaagaagacacttccccaggttgtggtgaaaattcaatgaggtagtaaatgggaaatgtgtaacacagtatctggcatattgtaattgctcaaaaaatgttagattaaaaacagtaggagtaatactaaaatagaaaaatgcaaagagcaagcacaaaatcatctctgattctcacctccaaattctccaaaagtctcaccttcttaatcaaagttgtaaatatggctcttggggagaaagctgaactatgtgctactattatgaatgcaacaggtgaaggagaggagagttagaggcagcaagacaaccaaatggctctcgtggaaggcacagaggattttcagccactgctctcctattccgctgatattactttcattttctatgaccaactagcatttcagctaaaatgtgttggaaaatgatagatttttctcctcctattgcctaagaagcccaacaaagccagcattgttttcaaacaccagcattctcacttttaaagtatgaacataattcagaggacttttaattctgaacatcgtttttatcaatctattggcctgattgtaacccagaaatccaagcagaaagcaagtaaactttcacactgcttccccatcccttccccctacctttatttttgacatcagtttccctcattttggcaaagtaaaggaaaagcatttgtagaaggttacactgaagctagataattttctattaggaaacctcaccaaatacaagataatttgttcattccaatataataatgttttaaaaaatataacaaaaatccagcataaattgtgaagcactgatacttgtgtaacaactaatttccatagtgaaacttcattgttgccactatctacatactgaaaatgtatatcaagcatgtaaatgtgtcacttaagtatgctgtgccctagattttatttaaaagttaagctaattttcaactaaaaacaaattcgactattcttagcaatctctcctccccgttcatgatggatttaaaatgatgaagagtataaatgatgatgaaaagagaaaggaggagaaaaatttcataactctgcatcttcagtgtagcatttttaagtaactcctttattagcacaaaggtgtttgcctgaagcaatgacttctagaaaggagaagaaatgacataataaaaggggattttgctaatataaaatgttttttctttccttttgtttctgcaatgcttttacttacatagcaccaaccctgagactagagggagtttccttcctttctaataatttaataatcgtgaaatgatattaaatggaagttttcatatgccaactccttaaactgaggttaaataaggaacaaagattaaaggccatatttaagaccacatattgtaaattctaacccagtttcatttattatatcacctgcaaagccaatatgccatacaaaagtaaaataacagggtgatttttattaaagatcagaatcataccaaaaatgaacttttctgtcaaatctttatactcatacatcaagatgtgagtttatttatgtagctaaaataacttaatactaaatgctgactactatattcatgtcagctgacccctagtgcttcaaaccatagaaaagggataccaaatgctgggttggttgtgtattccatttttgccgtataccacctgccaaggcttataacagatctgtaatgggtttcttaccttttattgtgtagaaaatggattgttggattaggcctggggccagtgaaccatggaaccccaggtttgcaagaaagagtttatcaccctttgatgttatttctgtctcgtgtcagctgagaaggatgagctagattatctgaaagtaagctggatgccaaaatcagcattcccctcatttatccaccttatggttcggggcaagaccactgtatgggtaacaaaagggctgataagggcctgatggagaaatttggtttttctcccttttgattggcttgctgatattagaaccaattacaagacattgacgagagcatttcattgtttgttgctagagaaaatccatcaattttgttgtggaaatgaaagcatttgagctgaatgttgcacttataatttgtgaacattttcagttatcaccgggacaagtatagtccatctttggcatggttggccaagtgtggtgggaaaagagatggaccagcaaatgggccggaaaccaaagtcatcaaaagggtatttcaagaaaactctatttgttctgatggttacattctgcaggcaacctgtgactgatgactgatgcttatacctcaaatgcagtctaaaaatatttttttgtgaaagtgacacattctgactgtgatgtgggtgacatcaacagttttgaataggacagtacttcttggacttattgaaacttttataaaagaatgaacattctgaactcaattgcaatgtaaatgactatcatgaagattgcttctgttggtgctatgacttttgtgacaaattttagaccattgcagttatctcctagaggttgctttattgttttattttcatcagtgatgtgtattttatcagtgatgttagaatcactgagctgctggttaaggaagagaaaaaaattaatattcaggtgctatataggcccttattcattgagaacaaataaaggccaacacacaaaacaggaaaattaatagaaaagacactctatgggtaagatttcatatagtttgggagcagacaaaaactattttaattactaaaataattaagaaagatgttgaggctgggcacggtggctcacgcctgtaatcccagcactttgggaggccaaggagggcaggccacttgaggtcagagttcaagaccagcctggccaacattgtcaaaccctgtctctactaaaaatacaaaaattagctgggcgtggtggcacatgacttgaatcacagctacttgggaggctgaggcaggagaatcatttgaacccaggaggcggaggttgcagtgaaaggagatcacgccactgcattccagcctgggcaaccgagtgagactctgtctcaaacaaacaaaaaaaaaaagattaaaaaaaaagatgttgacattaacatgttcaagtctttatgctgaaactagaatgcagtatgattaaataatcatttctacttcgggtgaaggattagttttcttaaagatacccctttccagcttctcagttcgcgtgtggttaattcccaacgtggcctcaaatattctaatggtttgtgtaatgagtgccaccgttccaccttcttattctccatgcctcatctcagtcctggaaagatcactaaacttgcagttcataactcagtctagacccaggttcaacactcactaactcataactgtgggccacttatttaaatctcttagtgcctctagttcctcatttgtccaacagtgatgcattatgaagcatgtttgcccatctcccagcgtctagtgaggaactaaaaacacaatatatactatcatactttattacgaggagttaaattgtggttactattacaaagtaggttaccataaaattctaatagcagtggtaaggggtaaagatccacgtgccatcacgtagagcagaacttctcaaactttaatgtacggcaggtccttgaataatgttgtttcattgagcatcactgtgttataatattggcaagggaaaaaactgtatctcagctaggggggcactgtctatgtggggttttcttttgtctctgtgggttttcttctagtactctggtttcctcacatgtcccaaactgtgcacgttaggggaattggtgtgtctacattgtccccatgtgagtgtttatgtgtctacgactgtgccctgcgatagaatggcatccctgccagtgttggctcctgtctggtgctctgagttgccaggatgggctctggcctcccaagtccctgaactggaatacgtggcttggaaaatgaatgactgaattaatataaattactgtgaaataaaaattcatatagtattcaataatcataaagatgcgtgacaataattgatgctctacagaagtgctcagtgagctgccatattgattattgtttgtttttgaactttgtggtgagagaaggcaatcctggcagtttatgctttgcaaacatttattccttgaatgaaccaccgccactgcaaacactgtcactcactgattcaccaaaaactgggtaaataattttcctcctggtttttattaatctttctaaagtggatgtatatctcacatttatttctgagtttaatattagaagtgcttggggtctttatttagatgttggatcatgttttgtgaacacaggtatgcagtaggaacttaattcttgtttatcaattagcctatggtaagattggtttcattatatgtcattttgcctaagtcacagtttcccagaatctatcaacaacattaattgatgacttactgaaacaggaatcaccttgagatcttgttaaaatcaggttactgattcaatggctcttgcataggacctgaggttctgcatttccccccctaatttcaagatgctggttccctggtccccttgctctacttcttaaatggtagggaggtagagagtggctatcaagagtctgtgtaggagttgaccaccaatcccattcaatggaatgcatacagtgtgttctgagatactggaaaggcctttgcaaaaagattttgtctcttgatatttatgaagcacattcatccgaccacagaagatacatatcaactttgacagaaaatatgaacacattcaaatgatttatacctttgaaacatagatcgttgtggggttcataacccaagtataactttcccacagattcactcaatttccttcctctttctgtgcaatatattgtatattgcaagaagctcacctccactcaccttattcctcaggctttcttctcaactatcttctgtatagatttaaccagtgggaggcgttggcaggagattggagagcaggagaaggggagatttcagggtatttctttccctctttcactgctttgggcaacagctgatacagagtaagtggccaaaaaatactagctattattaggtcttctaataatgatcttctaaaatcactttttcagtggttacccccattgatttgccatgaatgtctcttcagacatctttgcaaagaattgagcctgactttagatactcattcaaaatcaaaatcagtaattttaggattgaggactctggtattatttaagaactcttaactgtaccaagcctcactcccatttctggctttcccctatatatcagttaagtaataactccaatagtgtaaaatttgcaatagtgttatgtaacaaatcaccctaaaacttattgacttaaaattatcaccatttataattgcacacagtctgtggggtcccgtgagctgttgtgttgttctggctcactcatacattttcagtcagctaatgggtgggctaggggctggcttatctagcataagcgcagctaggatgattcacctctgctccatatggtctctcatccttcggcaagcgctcctgggcttattctcatgcaagaaacaggattctaatagagaaggaaacaagacttcttgaagcttaagcttggagctggctcactcatttctaacacatttttttaaccaaagcaaatcacaaggcaggcccatattcagggattagggaaataggttacaactcctgatggtagcaactttaaaagtcacattgcaaaaagatgtgcatacagagaggtcaccagtgcaatctaccacaccttgcaatctattaagtttctcaccccctcacaagtaaggtattcagttaagatgcattcctatgtattcagatttctaatcaactaatcctgattctcacgtaatattgacacagtatcaatattctcaaaagccaatagtctagagggtcacaaagatcctcaaagatactttatgcaaaatcctaggagtatagaaacagtaccttggtttatgtatacattcagtatttattaagtgtttccaatatggtataatgttaaggaatgaggatagagttatgaacagacagacacttgtctttatggatcttacatttggagggggacaaacattaaaatggattatataattacaaatgcagccgttctcattgtcttttcagatttctcagggtgtagactgagctactataataaaaataccccaagtttccatgtttcaaacaatatagatatgtgtatctttcccacataaagtccagcctaggtacgtagtctctgctctaaaaaggaacacaggctagcaaggcagctatactattctcaatataatactgcatttcaaaatctccatgctggtcccacaaatatccatgcactctctttcttatcatcaagagaacacacagtgccttcccaagagagaccagtcaaagtctcattcacttactgcatccagctaaaagtccattgtctgtggatgatgcactgtcttctccatcagatcaagatatggttcctcatggtccagtgacctataaagtgaaagttatgctatctgctcctaccacaaccaattctctctttttaaaatttttttaaatttttgtgggtacatagtaggtgtatgtatttatggggtacttgagatgttttgacacaagcatgcaatgcataataatcacatcatggagaacgggggatccaccccctccagcattaatcttttgtgttacaaacaatccaattatactcttatttatttttaaatgtgcagttacattattttgacgatagtcaccctgttgtgctatcgaatactgggtattattcatttttcctaagtattttttgtacccattaaccatcccgctgccccctccccgactcctccactatccttcccagcctctggcaactacctttctactctctatgtccatgagttccattgttttgatttttagattctgcaaataagtgagaacatgagatgtttttctgtgcttggcttattttgcttaagataatgacctccatttccatccatgttgttgcaaatgacaggatctcaatcttttctatggcagaatagtactccatttgtgtatatgtaccacgttttctttatccattcatttgttgatggacacttaaattttttccaaaccttggctattgtgaatagagctgcaataaacatgggaatgcagatatttcgtcaatatactgatttcctttctttgggtatatacccagcagtgggattgctggatcatagggaagctctatttttacttttttgaggaacctccaaactgttctctatagtggttgtactaatttatattcctaccaacagtgtgcaaggttttccttttctccacattctctccagcccaggcacaaagacagcagtaagtgctggacgaccacctatgcaagacctagactataaatccagtacttctctccctctccacacccccatacccaccactccattctgagttttcaaatgtaagctaagctaaatgattcaataaagctttttgaagtcaaggatgagaaaaatcgttgctttttatgtaatcccaccatcaaagtaataattgcttagttcaaattgtggtgatgcaaacaaggaaagcaagagagcataaaacgggtggatctgacgcagtccagaagtggaggcaatggttgtttttagataattattagagaagatactgtgatttggtttgaaggcaaagctcactgaagttctctagttctagatacacctatcgaaaaattcttacccaaataaatgtctcagtgataagagcagcctttccccaaatgcctaagtgtttttgttttgtttttgttttgttttgttttgttttgttttgtttttgtttttgttttttttcaaaatcttcctctggaatggatgctgaccttgtcattgacttattcttcaccacaactcagtcatattaatcttgaaagagacagagaggccactatctctgctaataatttacataattgtttttctacaatttggtgctaattaaaatgtgaaaggggtagtgatgatataggtaaatgtaataaggtcattctttgttcctgagagcaaagataatgtcaccagaaaggattgtctgtatattcacataagagcaggaaacaggaagagagacacagtaaggtaaaatagcatactagtatatcacgtagtctggtatagccaatgtagaatatttatttcaaaaaacaaataaagataaagttctgcttcactttgagaagctgttttttttaatcctgtatagttagttcgacatgttactactctgcctggttcaaattttgatttcactctgttccagttatatatgctatgcaacaaaccactctaaaagttactggcttaaaataagatagttttacgatttctcataattctgagagttgactatgatattcatctgcttcacctgatatcaaccaagacactgggaaagctggaaagtccaaaatggcctcactcacatgactggcagttggtgctgcctaccagctgagaactcagctaaagctattggccatgagcctcagtttgtttccattgtcttctccatgtgtctcctttggcttccccacagcttggtggttgagttctgtgaagaagccttccaaaagaacaagcaccaatcttcaaagacttatcaagcttctgtttgtatcacacttgctactatcccattggccaaagccaggcatatggccaagttcagaatcaaaatgagaagggactacacaaaggcatgaatccaagaggcgtgattaattgtggggctgccaaataatcgccttccacaaattccttactagctgtgtcatctctctgtggtctcagttttctcacctggaaacaggaacaaaaatggccctacaaaaatggactgagatatattaggttggtgcaaaagaaattgcagtttgggaccgtgaattttaaatcattataactaggctcaagcacatctttattaatcaaagtaggaaccgttacagtcaacacatttttgccaagaagaaataagtgtgtttattcctgtagcataaaaattcatgctttgggattcaatgaactcttggaaagcattttcttcatcctgctagttgtggaagcattttccctgtaaaaagttgtcgagatgcttgaagaagtggtagtcagttggttgagaggtcaggtaaatatggcagatgaggcaaaacttcctagcccgattcattcaacttgtgaagcgttggttgtgcgacgtgcggtcgggcgttgtcacagagaagaattgggccctttctgttgaccactgctggctgcaggcatggcagtttttgatgtatctcatcaatttactgagcatacttctcaaatgtagtggtttcgccgggattcagaaagcggtagtgggtcaggccagcaggagaccagtgaacagtgaccatgacttttggtacaagtttggctttggaaagtgctttggagcttcttctcagtccagccactgaactgggcatcgccagttgtcgtttaaaatccactttttgttgcacgttacaatccgatcaagaaatggtttgttgttgttggcgtagaataagagaagatggcacttcaaaatgacgatacttttattttcgctctgcttatgaggcacccacttatcgagttttttcgcctttccaatttgcttcaaatgctgaacaactgtgaaatggttgacattgagttcctcggcaacttctcgtgtagttgtaagaggatcagcttcgatgattggtctcaatcggtcattgtcaacttctgatggccagccactacgcccctcatcttcaagactcttatctcctttgaaaaacttcttgaaccaccactgcactgtgcgtttgttagcagtaacttggccaaatgtgtttttgacattgcgagttgcctctgcttctttacaatccattttgaactcgaataagaaaaacgctcgaatttgctttttgtctaacatcatttccatagtctaaaataaacataaaataaacagcaagtaataagtcattagcaaaaaaaaaaaaagtgagaaatgctcattaaaatgatgtataacataatcacatttatttaagaatgtatttcaatatcaaatggcaagttccatgaatgtgaaaacaacacttacttttgtagtcacctaatgacacatttaagaagctgaaacctgagctcagcacatggtaagacatcagtaagtattagttatcataatttttttagtaattttcctacagagctataaataaaatgaaatactttccaaacagtgataaaactataaagcagcaatacattataagcttctatcctaatctgccttcccctcagggccttaaaatgtgtcatttctgtaaatgttacctctgacatgaaagcaccaacacactgttcagcaattacaagttgattgtgacaagagcctcactctccctatttctttttctcttcctgtcttgctttcccttttccccatcctttcactcactttgataaggcaaactgccatgtagtcacaaaatcctagacaaacaagtctgtacctatgtgggcgatgctgtggatttagtaagggaaacagttccttgataaatttctcctttagccctgggtttccaacccctgtgtcattcagctatagaaatcttctgatattttctcccactggtcattttcactcaggctgccatcaaaatgagactacccaatgttctttccatttgttctgttttcttcctcgcctctgattccctgcctggtccacttagaaagtctaccttttttccttctctcttaataccaccaatctctaaatctgacttctcctttctaatcccatagagcctgccttgtcatctccaaacaagatccatcttggcctcctgttatcctcagcccacagcagtatttcacttacaacgttcgttagtttctacctcagatgtgtcaggcatttagtttgtaccaatattttatttctttttatatctacaccaagcctgcactagacggtccaaggagaaatttaactgattcctgttttgaagtcctccccactccttgggagagttaaagattcctcagtgtgttaggtaatgatagttaatatttattaataacttactgtgtatcgactgtattctaagtgctttgcactgttagaaggagaataacctaagactgtgccaaacagcagtctagaacaaagctgaattccttgcttgcctggcaagggagaatgtggtacatactaaaggattaatacatgttcactattaaattgattgattgtggtggtggtgacagtggtgatgacttttcaagtgtgggtaaagtaattttttccaacaaatccacatccacatatttaagaaaagagagacatttcattctatctttttgtgtgcctttgagaggacacccctggcacccaactcccaggcaaatgccaccatctgtgtgattttccttcatttgccaacgaaggcacagcaggtactactaggttaacctttgctttcgcaagtcttctctcaaaatagtaaacacttcagctgttggaaagctctaatctcaaactgcaaatttaaaaatctctctctggagttcaaaaaatagaaagaaaaaataaaaatctctctcttctggaacataatgtttgaactgttacatattattcacactatttcacattatgggattatgaaatatggttttaggtgttagaaaaacgaaagaaaactattatttgttaacactaaccgagagatttttatgatattcaagtaaaatgatagaatgaattattttaaaaatgcatgaatcttcaccttctgtgaagtgtcatggaggattagttctaactaatatgcctgtaagtaactgacttaatgcgtctattggttctcttaatgctgtaagtgacagaaaactggtctcaaactgatttaaacaataaatatgatcaaggttccggttttttgtttcttgttttttttttttttttttcacatttctctgggttctatttttctgtgttgacctagcagcttcacctgacttccctcttggtgacaaaaatggcctgaagccgtttcagaacccacatctgcaaacttacttttgatgaaaatcatctctttagggaccttctttcccaaagcatccaggaaagactgctctgaaactgactggcctgaattaggtcacatgctcattcctgtactaaatcacacctcacttctacagctaaaagtcattaaatctcaaccaaactctacagctgcaccacaacaaaggtagagaagtaggtgcaaagttcctcaaaggaacgtaagggtgaaagatgattgactgataaacagacaggtagacagaatagatagatgaattaggaaaagataaccaaccaatatctgtcacattgctttgacttgattttttagtcaattaatgaaactgaatggtaattttgacattacaacaatactttccaaatgtaggcaggttgtggagatcatttaaggaaaaaatgtatgaggtgttgtagcagatactgtcggtgccccaccgatatccctttagcacttaccatttttatacgtgcttcttaatttccaacttcctgtacttgcatctctttgcttggggctatctctgctcattcttgggagagagcagaaatgtagcagttatgcccctgtagagcagcagttgatagatcaataccctgtcccccttgcccttcagatctaataactccaagcttaattccctacatctttcatataagtatatatataagtatatatatatacttgaagttctagggtacatgtgcacaacgtgcaggtttgttacataggtatgcgtgggccatgctggtgtgctgcacccattaactcgtcatttacattagctatttctcctaatgctatccctccccagccccccaccccacgacaggccccagtgtgtgatgttgcctgcgctgtgtccaagtgttttcattgttcaattcccacctatgagtgaggacatgcggtgtttggttttctgtccttgtgatagtttgctcagaatgttggtttccagcttcatccatgtcccttcaaaggacataaacaactcatccttttttatggttgcgtagtattccatggtgtgtatgtgccacattttcttaatccagtctatcactgatggacatttgggttggttccaagtctttgctattgtgaatagtgccgcaataaacatacgtgtgcatgtgtctttatagcagcatgatttataatcctttgggtatatacccagtaatgggatggccgggtcaaatggtatttctagttctagatccttgaggaatcgccacactgtcttccacaatggttgaactagtttacagtcccaccaacggtgtgaaagtgttcctgtttctccacatcctctccagcatctgttgtttcctgactttttaatgatcaccattctaactggagtgagatggtatctcattgtggttttgatttgcatttctctgatgaccagtgatgatgagcattttttcatgtgtctgttagctgcataaatgtcttcttttgagaagtgtctgttcctatccttggccgacttttcgatgaggttggtttttttcttgtaaatttgtttaagttctttgtagattctcgatattagccctttgtcagatgggtagattgcaaaaattttctcccattatgtaggttgcttgttcactctgatggtactttcttttgctgtgcagaagctctttcgtttaattagatcccatttgtcaattttggcttctgttgccattgcttttggtgttttcatcatgaagtccttgcccatgcctttgtcctgaatggtattgcctaggttttcttctagggttttatggttttaggtctaacatgtaagtctttaatccatcttgaattaattaatttttgtataaggtgtaaggaagggatccagtttcagctttctacatatggctagccagttttcccagcaccatttattaaatagggaatcctttccccatttcttgttttttgtcaggtttgtcaaagatcagatagttgtagatgtgtggtattatttctgaggcttccgttctgttccattggtctatatctctgttttggtaccagtaccatgctgttttggttacagtagccttagtttcctacatcttcttttagggataacagggagtattaagattcagttgttcacattgatgacttgcatgataatataccctttattggctatcttccctatttcacttcttctcaccctgttgatgtgtcctggaatcacatcccaaaactacttgagctcaaatttttatttctgggtttgctactgggagacccaaatcaagacagttggcttcagtactcaggtacttacaaggagatcatggatatcaattgaatcagaattccatgtcatagcttttcaaatttatatcacaataagttgaaaagatgttgattcttccttccacagtattttctgtttctgtgtgtcttacattctggtgtctcaaaacatggctgcaaccagggaaggaattgaaatttggagtaaatgtcctattttagtaggtctacatttaagacatggacctgaaattgagatcataaacaaaagtagatgtgagcataaagtagaaggtgaggttggagggggaaattgtttggatttactgtaaccaatggagctgcttagtctagtcaaggaatttcaatcatttctgtggagactagatgacttatgttatacaaggatatctctggaaaattcactgtacagttttactaaatctggctgataatatgttcactcaatgttatgatgtcaataatagaatggatattgcctttaaagacaattttaaagtaaatatctcacatattcctactcatttatcaagggctgtgtcattcatggcaatataagataattcttttcactttcaaaatcttccagatgcagaaactttccaatatttgctgtagatgaaagtgtacaatttcacaattcaatgggacaaaaagaattaggaaaaatatgtttcagagagtttatttggtatcatctacaagacctggtatgagacctggttggtgttgtatggaatgaaatatatcagtctgttctcacactgctaataaagacatacctgagactgggtaatttataaaggaaagtgatttaattgactcacagttcagcatggctggggaggcctcaggaaacttacaatcatggcagatggggaagcaaacaccttcttcttcacatggcagcaggaaggaggagaatgagcaaaagagggaaaagccccttataaaaccatcagacctcgtgagaactcactgtcacaagaacagcatgagggtaaccgcccgccgtgattcaattatctccacctgatccctcccaggacgtgtgggggttatgggaacaacagcttaagatgagcttttggtacagacacagccaaaccatatcatagagtttcgaatctgaaaaacaaaagaagctaatttagtttcagaaagctgagatttcatgaaccatttaaaaattcactttataatttttcatgcattttgaagcctttatcctttaaatggaaatggaatagaactattattcgtcatttctaaactgtgcattcatcaacaattttcagaagttaattccaacatgtcttcatcaactctatattacatgttagtacactacatctctattttcatgctataattttttactttttcctcacactttcatctcaccctctcaagatgtgttaatcccctttgctcttttccccatctcgtctctgttgcctttctccccccttcctttttttttaatttctgttctcttttacctgaaatctccctcttcatcttttgctaccaattatgttcttaattggttgaagtgagcaaggtaggaaattctccattttgattccattctctcacatggtttatctttaatatgttttaataaacagtttaacataaatcttacttccaatttaacatgtaaaatttagaaaattggtgaaaaatatgcctgctttttcacccccaaagaaccaagtttaaaaagttttgtgactttgaggcatccttttccctaaaagcaagcttaacagattcttagcattcgtctctgtgtgaaattgtggaaactttaaaaaaactatttgaagtaccaacaactcaaagataaattgtctgttttaaatgcaaggtgctaaaataaaactagaagattgacaatattattcatctttatcactgttctacttaaaatttgaaaattaatgttagaaatgtgagagggtgcatgaaaccttaatggttttatcatttcatctgagtatatatttgatttcttctttctgacattgaaactttaaaattcgccactatttttcagtaactcgttaaaatatggtccgttcttatatttgcaatactcctatactgaaaaccctacaacttcaccattatttaatttttatgttactatatttgtttcttaaaaagattataatattatgtattagttgtctattgctgcataacaattactacaaagataggggcttaaaactgtatctttagagtatcaggatacatatgggtcagaagtctaggcatagattatccatattctttgcttcggggtctctcacaaaggctgcacactaggtgttggccagggctagggtctcatttgaaagcttgccttggaaggacctgcttccaaactcacctgttgttggtaagtttcagttccatgtgggttattggactgtagtcttccttttcttgttggctgatggccacgtttagttccttcggtctctaacatggcaatttgcctcatcaaaatcagtgagagaaagtgggggaggggggaaagagacagagaaagagtgaaattgctagcaagacaaaagtcccaatcttatgtagcctaattggagaagtgatatccttttgtctttgacatattctgcttgtcagaagcaagtcaaaagtcttgaccactctcaaggggaggaaattattaaaggactcaaatactaggagacagagatcactgagtgccattttagagtcttcccaccacggattatttcccttcacctgctggcatttgaaaatgcagctaatactctgggattctccaaacctaatttttttgtataattagagaagtatttgtcataatctgttaagtgtagtaatatattaagaaattgaatttattccttcatatttcaaaaagtacatggggttgggggacagctatgttgtcataaactttaatacatacatgattggaatggattatgaaatatttttctctaagagatagtataaggctgcaaccactgaggctcccaaatacagatgattcatatgtatttagttttaatgcaaagcttctcatgctgatttaaactctcatattttcatatatggtgttttattttttatataatgaatgtctataaaattcctattattttttcaaaagtattgtggcaaatatttcctagtaaaatctaaagatatctttgacgtaatttttatgctctcatttatgttaagaactcaatattgaagtaatgttctttcttatttcctagtaactaaaatccttactatattcatgaagagctgtgcctctattaaaaagcttttattgcaaacagaaatgtcaaaatacagcaaaggtagagctatgtatgattcttcatctgtaatgtaattttaagtatacattttattgcataagcagagatttatacccacatttgctttcagtattcacagaagaattttcatatgtatttcttaaaataacaaaatggctgctttggtgtggggatagtatggtacagcatttattgtgaaaatgattcttatcttccatctttttcaaatggtgagttcagtatgtttaacattgctggttttataatattgcgaatatttttgagaggaagaaacaataagagactgataagaataattcatatttgctcaaagtttaatcagttttttatttgaacaaaaacttggacgaaatgtccaactttcctttgagatcagtgctctccaatgtggtaacaacagcctaccatatgagcatttgaaatatggctagtccccactgaaatgtgctgtaagtataaaacactcaccaaattacaaaacctaagtatgaaaaaaataaaatatctcattggtactttttatattgagtacaggttgaagtgacaacaatttggctatttaagttaaagaaaatataacattaaaattaatttgacctgttttttacttttgtaatgtgtagaaaattttaaattacatgtatcgctctcattataattttattggatgtcattgttctagataaacaatggcaatgttgagaggtgtcataatagggacaattgtctctgtgaagaagaaattatatgaaccctacaacatgtattagccgcagagttgcttagaattgacttactctgtcttgttgaaaataggttttcccttaaaatctctgcctgatgtagccaaccacgattcaatgagcaaacaaaaatcttaaaggggaaaaaatcattttttgagtctattttacacacccagtatcaaaaagaaaaatataaatccacaactaggattatacgggatgtaattcttggatttcttttggtcttataatgctttatacctaggagatgttcaacaaattattattgaatgattgtagtttaaccgtcagttacattttgcagcaatacatttattagtagcaaaatctgagtgtttactaattttcatcacctaatcagcaaattagtactgctcttatatcgctttgcctacgctctactcactggttcaatcagctaattttttcagaattttatggtttataaaccactatatgttgcacagtatttcctatacattagctcatttgagtcacagaagttataggaggtggatcttgtctttctttgttcagaaagagaaatccaggttcagcgaggttaactggccttgtttaagatcagcacgttgctaggtgacagaaggtgttcacttctcactgaactttgcatatcaaaagagatttaaagaattcactttggagagcgggagttatggggtgaatattttatcatgttgtccgtcttaataatcaccaatttgatactaaggctgctagtcatctctaacgaagagaagttactttgaagttggttgattgattgttgttgattgacagaagtattagttttcagaatgaactaattcattaaagaaataaaacattgggtttgttcattccataaataattgaacatttattatgtgtatgataccagcctaagcagatacctaaaaggaatggagattactatagttaataacaatgcattgtattcttgaaaattgccaagagattacattttaaacattctcaccataaaaaaatgataagaatgtggggtaatgcatatgttaattatctcaatttagccattccacagtgtatgcatatttcaaaacatgttgtacacaataaatacatacaatgttatgtgttaatttaaaaataaatacattagaaacggtaaaagtcactaggatcatggaaataaaaatgtttacatttatgtaaatattagtaatataatagagggcatatccaaaatatagtgtcatattaataagatgttgtatgattattatagactacaaaataataaaggaatagacagaatgtttctaaataaagaatagaaattacagtgaagcggaagagagagtaaccctaaacccttcataatcctccctttgcctcgtagtatagcttggaaagtaattatgtggaaagttgagattgcaacaaaggacggtagtacaggagttgcccaaggacagacaattattttctcaaataaactatagcagaagcaaaatggccttggaccacaaaagaaggccctcatgtagacattgttctattctgaagtagaatttgcagtactcaagagaagaggaaagattattataggtggagagactgtaaacaaaatattatggtaggattcctcctgaatagagcaaggtgattgtgtttgacattgaaaaggtatgtttgggcaagagtttgaaaacctttagccaccatgctaagagatcttaaatctttatctctgagtaagggcggtggttgtggttaatgatccttgagcacaactctgtcccattaaagacagtagattcaactgcttctagcattagtccatatcagggagtaaagtgatccgatacattattttcccccagtaaatggttcataaaggaaggccttggctctgccttgtatgtctacatgggagaatataccagaatgtctagaggagcatgggtagcgtaacctttccccatatgcacatacaacaaatactgataatccactcacaggggagggactcatttttaagaattaagttttattttagaagactcagtctgatggcaatgcaggggttgaattacagcaggtagagactggaggtctacaaactggtttgagatatatattttttccggtggcccagataataaggacttgaacagacttcttgctctgggaatgtaaaaggccaggctggatgtaagaggttaggaagttccaaactgtcccacattttcctttcttctgagccctccaaactgtaccagactctgcatgttacgcacttccaaagtcgcttccacattttcgggtgtcttttcagcagtgccccactctactggtaccaaattactgtattagtccattttcacactgcggataaagacatacccgagactgggcaatttacaaaagaaagaggtttaatggacttacggttccacttggctggggagacctcacaactatggcaccaggcaaggaggaacgagtcacatcttacgtggatgggcagcagtcaaagagagagcttttggagggaaactccgcttttcaaaaccatcagatctcatgagacttattcacaatcactagaacagcacaggaaagacctgcccccatgattaaattacctcccactgggtccctcccataacacatgggaattcaacatgagatttgggtggagacacagccaaaccgtatcagtgatgcaaaataaaagaagactgtggagtaaattacacatggagaaaaggaagaggaactaggaagtatagatactgtgagaattaactctctgttctacaaaagaagaaatgggcttaaagtggttccccccaaaactaaaatccaaaggcacataagtcataatgcacactgttacaccgagtccttccagctcttaacttacttgttttactgcactacacttgacttgagttttagacttagtaaatctgaggtaaatgcagattgagaatgagaacaaaatgttaaaaagagaagcagtctcattttcttactactaataggcattgcagtttgtgtgggctctagcagggatgtttgtaccactgggatctaagcatctatttctatattataaatagaaaaattaggttgagctatcgcgactccattacaaacttatggaattagattctctggtatggagcttggatatacatattaaaacaaaataaaacaaaaactcctacccaattgattctgctgtgtgctctagttaagactgttatggttaagaaaataaataatcgctgtatggaatgtatatcgtcctattttaaattaataaaaaaaattttgcaggccttcccaccttccaactcctagagacaacaaatccagatttgaaaatcagtcatattaaatagttgtatcgatatttaccctttgtttctacgttattattttcttcaattttcacacgtatttgttcatcagttggttatgatggacttcactttttttcagtcttacgaatgagatttctccctccaaaaatcaataggcacctgctgattttatttattccaacatgaagttgcagaaaatgaatatggccaaaaatggttaaaaaaaaaaaagcctgttcttcaaaagactagatcgtcagttgaagcagaaaattatattcagtgcactggatttatgcattgttttagccttctccaaccaatttagaaatgcattttcttataaaattgagattattacaaatcctgtgctaagcagctgaaataatgtgcctatgccaaggtcatatcttaaaagtttggaggagcacactgcaattgaatataagtttataaatgtattccacatacttttctgatatattttaataatttaatttttacattttacctatattgtcttcattttcactttacctttggtggtgtttcatacatattcattgtttggaagaaattaagcagacagtattctaaagtcaatactgagtctgctaatgaaaatggttaagttaattaactaaatggcaaccttcactgaacttattcaaagctatttcccctcatgatgtgttttcctgaagaaatgatgcataaaaactaaacccctgttattcgctattcttctgtatcagcctctaaattgtcactttacatgttacaacctgttgcatgatgattaattatgacaatttaatggcatgtaaagggtaaaaccctaaaggattactcaaaccatcattccttaagaaaagaaattgtaatgcctaggttatcttctagggtttttatggttttaggtctaacgtttaagtctttaatccatcttgaattgatttttgtataaggtgtaaggaagggatccagtttcagctttctacgtatggctagccaattttcccagcaccgtttattaaatagggaatcctttccccattgcttgtttttctcaggtttgtcaaagatcagatagttgtagatatgcggcgttacttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaaggcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacatcccttgtaagttggattcctaggcattttattctcttgaggcattaccattcaggacataggcatgggcaaggacttcatgtctaaaacaccaaaaccaatggcaacaaaagccaaaattgacaaatgggatctaattaaactaaggagcttctgcacagcaaaagaaactaccatcagagtgaacaggcaacctacaaaatgggagaaaattttcgcaacctactcatctgataaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggactataaatcatgctgctataaagacacatgcacacgtatgtttattgcggcgctattcacaatagcaaagacttggaaccaacccaaatgtccaacaatgatagactggattaagaaaatgtggcacatatacaccatgcaatactatgcagccataaaaaaggatgagttcatgtcctttgtaggcacatgggtgaaattggaaatcatcgttctcagtaaactgtcgcaagaacaaaaaaccaaacaccgcatgttctcactcataggtgggaattgaacaatgagaacacatggacacaggaaggggaacatcacactctggggactgttgtggggtgggggaaggggggagggatagcattgggagatatacccaatgctagatgacaagttagtgggtgcagcgcgccagcatggcacatgtatacatatgtaactaacctgcacaatgtgcacatgtaccctaaaacttaaagtacaataataaaagaaaaaaaaaagaaaaaagcaaagaaattgtaaaatgttgttctatcagaaactcggctaattatttttaaattttagatcaaaaactcaactagttttaatgtactacttataagtcagataaaatcattttttatttttgttttctttttgtttttacatctgttagaaacgatggggtcttcaaagtaaaagaagagatttgcaatgcctataccaaattagttattttaggatactgaatgaaatggttttctatactcaataaaggtaaaagaataagcagaggtagatctggttttctgaaacttgaagcacattctaatttggcagttttctttaagtcaaagaatataacaggacaaatataaaattaggtatgaacatgattatagaaagaaaggaaatcataacaaattatacgtttttaaaaagatgacagataaccacatacatcacaaaaattgaaaaaaataagcagaatgttttcttaataatgaaccatctctgcaatactagaatatacagtgtctgaaataattttttctatctttctggatgcatcctctttcagcacctcttcatgtgagagcatcagaaaataatttactctttcccccagcattgttgattaaaatttgacttctatcattgatagtttagaaaagtttattttacattttcaacttattattggtgatgtcacataaattattacaatttattgtccaatttaggaagaccctgccaagtttctttcacatatgaactgtaaaatttaaaagatcattcaagttatcttgtacaataactaatacatatttttcttttagtcatactaaaccctgatgctaaggatcacccaaactttttcagggaaagaagtagcttgcaaataaatcaaggaccatttatccttactttttggaagaaatggaaaaggataaagtgttagtttaaatacactcaagaacagaatgtaagacaagaaattggaagcagagaagttcatcctcaaatgtaagagtgaaagaatagggttaatgaaacaggaaaggggaaatccaagaaaaattatgccgcgctttagagaatctcctaagcacagagatattggcaatgtgcagatgaaatagctgtcacaggtcagccatgtcagaggtgattccagccactaagtatctactgcagattagatatttggaaagcagaatgagctctgttcatgccattactggggcttgacttcttaatggtttcaagtccccctttgactctaatccttctaaagtcaactttgtataaactcttttcaaaagtgtttatccctgtagaataagttcaaaactccatgtcatggcacacaaaactcttcaaatcatattcagctggtattgttttcttccacattccagtcataactaggatcccaagaattagcaaataaaaatatgaaacatccagaattctaagcataactatgtcccaaatactacaacaaaaaatactgaaaagtatcgattgcttatacaaaatgtaaatggtatcctgtattttataaggcaaccctagtcataagatctctttcttcttcctcacacactgtcaagcttgagccaacagagtaccttttaatgggctgcgcagaatagctttcgatagtttacccattaattaacagaaaattcaaatgagatatcctctgtgaaatcatccttctctcctgcctcctgtctctccattctttctccaggagacagaggccctccagactccatgactttgtagtgtattgtgtctgtctttattagagtattcatcacttggtaattgaattctgtgtttaaatacattttttttcttccagaataagtgttcatagaagggagggatgatttacctagcatactgcctggcatataaaaggccctaaataatttttcttttaaccagtaaccaactaaccaattcaacagttttttaaatgagtgaaaccactttttaaatttttttttaaattcatgcttcacctgtaaaaatatatagatgaattgcaatctggaactctgagtaatttatataaaagtgatgaaaaagaccatggcttcagatttgttgttttaattccagcttcagttcatacaaacattacaaagtcgcagtatctactgtgtaaaaagtttcatcccaatgaagaaattaaaatgtctgtctaatagagatgctctaatggacagcgatgtgtagacttcagaagaatctcctcacacagccttggaggcataagttgggaacagagcaagttctgtgtttgcctttcaaaggaatgttcctttccctttcattgacaaatattataaagatgccccaaaacttctgtgagtttcccccgggacgtaaggtcctctgcattttcctaacttgtttctcaaagcggtggttcccaaggcctgagaatagctgtgtctcagctctctcctggaaaccagagcctaaaatgttgccacatcatcgggaatgtagctgcatacttagccagagccaagagatgagccccactcgcaaagcccatgggctggacaaaattgttagccatttggtgtaggtcattgcactaggtccattacacaggttatctggcaggagtcccggctttggaggaaagacgtttaaatcctgtaaataaatggctggaacaccatggcagttgattgtgttaagccctcatccaaaattgctttgttaggttctattctattgctcattatcttgctgtgaagaaaattaagcttacatctgcttagggtgacagggtatcctgttgtcacaggattttccacattttaggcctatgtcacaagctcccaataaaccctcagagaagatcttttgtgttcacaggcatccaggtgtcaggcagacacagtctttgtcttcttgaagctcagtgacacgttcagggctgtgtatactcctccattccctgccagagacaaaatgtttgtggaacagtcaagctagaagggacctcagaattaatctgatcaaatgtctgcatttttcagttccaaggatactcagggaaggccctcggattctataagtagcggtagaggtggtattagaagtcaggttgcctgacttccaaacctctgttagttactgtcccttcccctgcatgcagcactagtgtaatccctcaactctcacttccctttttcgccacatgcctctctctctttccttcccttgattaccctgcctatccctcctacaagggaaactaccaccaggcatcctcatctgagacccgggaatggaggccaggtcttttccctccctccctccctttcccctttttttgtgtgacagtaacattattcaagtacagctcttccttttttcagtaccttccccctcagaccagaagttaatgaaaaatagggttgcgtgatatgcagcctgggggccaaaaatgtaggacaagcagtgtgcttcagacaaaactgtagggttctggtttcatgcacaaccttggaggacggtggctagaggccctagtatgagagatcaattaaacatggaggccagaaattaaccacatgggattaacatacgtaaggttgcttcttttcaatgagtctaggaaacacactggggacaccttgttcaagacaagctactatttgatgctccttcatacgcttgcttaaaatatttgttcagcatttatttagtgggggcaagaaaaattgatgttatgttaataagaaaacctctttacctcttaccttttattaaaataatcaacttagaagatatactaaaactcacatgacttttgacatctatggatgatctttcatttaatatttttctgctattcctactatagaataaaagctgctattgcattattacagagcgtaatgtgagccacatatgttattttaatcttaatggccacattaaaatagtaaaaataaacaggtgaaatttatttggattatatgttttatttaacccagtgtatctaaaattgtatcattttgacgttgcaatcagtgcaaaaatacagtcatgctatgtgtaatgaggttttggtccatgataaactatatatacactggtgatctaataggattataatacagtaggtttaccatacctttttctatgtttaggtatgtttagatgcacgagtacttgccactatgttagaatttcctgtagtattcagtacagtcacgtgctgcacaaatttgcagcccaggagcattaggctatatcatgtagcctaggtgtgtagtaggctatatgtaccacctaggtttgtgtaggtacacactatgatgtttgcataaggataaaatcacctaatgacacatctctcagaatgtattcctgtcattaagtgatgcatggatgaattaaaatattttggattctttttttttttcagtactatgccttcggaatccaatatgtattttacagcatatgtctattccaaataggcatattctgggctgggtgctcaatagctacatgtggttagtggctaccatattaaccggtgaagttctatgcccatcaaggctacacgtaatttacagggtataatagtattttaaaaattaatttttttctggcttttatgttgacatatcgtttccattttttaaatttttgttttattttctttcactgctttggaaacgcacaacttcttggaatgcaaattaaaagatatcaaataatgatgtagataatttgttattgctaaatgtctaccacttgaaatattcaagtttcaaatttcagctaactgcgattgcaagcttcagctagctggtcccagatggatggcccagctaaatcagacatttgtacatactggctacaaagtgtcccaaaaacagaccaggagggtcgtggatttaaaaaaatttccaccaaaggatgctgtcttgtccattttccaatttgggtaaattaatggatactgcatttaaaagtttttttatttctcgtacattgaagccctgtactgcactcaccaactcacccgttaaagcggctctgaaatacaggcaggaccaagacttagatggactggaggttgggccacaactccttgaacacctagagcagaggtcagcaaactttctataacggtccagatggtaaatgttttaggctttgcaggccaataggtctctgccacgactacttaacaccgctattgtggatcaaaagcagccctaatacgtaactacacataaacgaatgggcatggctgtgtcccgtgacaatttacttggggacacaaatttgaatttcatataatattcatgtctcacccatttattaattattttcagtttcttcaaatgttaaaacaattgttagttctcaaactgtacaaagacatatggtggctgaatgtgacccataagccatagtttgctgccctctgcccaagtctcctgttgaaatggggttatggcaacaatcctcgcagaatataaaactattttggcacctgacttttgccctgatttttttattgtttccagagaaatcaagtatttttctttttcaaatttatatccatattctctttttttctttgctctcttctcttctggccagcaggaagagaccaacccatctttgaattgtattcactttcctcataccgtcacacagctagtaaagctacaacttcacatatgccaatgccaactcttcccgatgttgtgttcaaaacctttctaagcatcaccattcccaggagtagcaattctatatgatattattattttacttgttggtaaggttaaaagttccagggatactgattttcttctttgttagccatgtttcattgagtggataagcaatatgcatttgcttcatagtataaataacaataatgcatcaaattgcaacaatatgaatattacacatagaaaagataaatgtgagttatgtaggtcatgccatttgatagaaaattttttttatatttatatgtttaaacatgacaataaaatgattccattcagatgaaggcaaaggaataggatttcttttcagtgtggtggttttctatttttgttttgttttgttttgttttttagagaatgagttttggagaaaaacaagctttctagacagaaaatattgaaattaaaaccagcaattcatggtcatattattgaaactatcaaattggtatatatatttgaacactactgattattttctaaaatgttacgctttcaaaaaatcatgaagattggcaagttttttagatgcataagcaaatagtgtagtacggcttgtaacactgttcaagataacttttttataatgagtatggtctttctctgccctgtctaatacaatgtgggttttgagcattggaaatgtggtaagtgcaactaaggaactgatatttaaattgtatttaagtttaatacatttaaatttaaagttacattttgataaattgctttgtttttcttttttctttctttctttcttcttctttttttttttgttttgttttttttgaaacaacaatctcactatgttgcctcccaggctggtatccaactcctgggctcaagcagtcctccttcctcggcctcccaaagtgctaggattataggcaggcaccaccatccccagctaaattgtttcttaaatgaaacttctgaatttgaggatacgtgattatgtggtgtagttttccctttctttccccccctgaaatccatattctgaagtacagtgatttatataaaagtaaaaagaaggagactgttttttttttttaaattctattaagaaaccaaattttaacagacacctcagggcctaaataaatatcaagttattgttatttgttatggttcttgttgcttgggtaaaactgtacagatcatgacttagttttccttgaatttttatcaaacaaatgaacaaaatgagcaaacaaaaatattaaaaatgatatttcctacgaatccaagggacatttttctgtatcagccaggctgatgctaaggtccttcaagcaaataagatcaaagatttctgattggagagtgtgggaataaagtagcccttgtttagtgctactttgtagagcctttgtttagagtacggctgggagggagggagagagggagaaaaatacggggttaatttgtaacaacacattctgtggtgtgcgtgtgtgtgtgtgtgtgtgtgtgtgtgtgtgtgtgagagagagagagagagagagagagagacagagagagagattaaattacatttaacttctttaaattttattgtcctcagggtttaaacagtatgtgaccaaaatcacattatttagtgaagagtttgtgggtaggtggatagttagatgggtataaatccctataaaatccattttagaactattgaggtttgagcaaatcaatgtcacctattcacttcatttgtctaatgcctccaggagccattaaagggcttgttacctaactttagggtaggtttagatcaaggtgaacagtcagaaaatattatccatgtactcacgtatattattaagtattctttgaccatggagttagatgcttatactgcaaacaaataaattaatgaataacagtgctgctcatgaacaccaaagtttactgaaaagtcaatatggttttagtgtggtaataagggcagagttctccaaggactgccaacctatttattgtacatcaaattttactgactttgaaatcttgctagaaatgttcatttacctcgtaatgtattatatgtttgaggtcttgagaaaaataacaaaatccatgtgtggtaatgaagtggttatgcaataaaactaacatacactgtgatttgacacaggggacttcactgttatcagatacttaaaactggaaacaatgtaggaaatatagatgtataagcatcgtaagtaaaatccacatgctttaaaaaggaaatccacttacttttaaagtaatattccgagagctatgccactgggggctgaatgtcataaaaatgatttgtaattagtcacttttacattgtatatggatttatagttttaaaatatctggtggcatataaccacaatgtatttttcagtcatatattcatcattattttattaaatttccagagggaaagaaaataaatgacctcctagtgagggatattttaccacgagaccagttgtaaaaataatcgagttttgtgcctgggaagatatctttgctaagtctagttctccagtgacattaatttattgttgttaagaaatgtgtgaggcaaaatgaactctccaaatatttcatactacgtgcattttatccaaaagaagataatggtttacatgaattatttaattggtattactaatttgggggaggtgatttttggttgggggcaacagaatatttgcctaaaatgcattcagagtgcgctgttatttagctattttcaaggtagagggatattggcattggagacttacacgtagccatacaatggccaacttcagtcaactacagaagcaatacagggcagcggctggaacaaaatagctactaggtaaatattgattgaattaattacacggatattaccactagtcctgcaattaattaatacctagccctgtctccagccccagaatccatgacatcaagctaactaacagaaaacatatcaagaattttattccttagtcctcttgactgaccctcaagagggtctaccctcttctactctgtattcctcacatcaaatttcactagtccagccgccaagtaacacctgttctgactgtgctagtgaacttggatattcacacatagcctaaaatgggaaacagagttggaaatgtcatgtataaggacataagcgttttcaaagtgtacaagaacataagcgtttttaggagatttaccttctcttttctgttttattagcgaatgattgattgttttgtatgattgttcatttaacaaatgctatatcatgtaagaaaagttactaacggtatataaagatgtaaaattcaattgtggctgtgtgtatgtgtgagtattctagcttttggggagagacaagagaagaaagaagacataagttggaagagaacagtaaaataaagaaaaaagtaataactgacggtgtctaatgaagtagcccaggtaattaatgctagagtttattagatagaatcattatttccttccagagggattaagcaatcttctctgaggaggtggaacttttattacccaaaacatgaaggattgggaagagttttatatgtgtcgataaggaaaagagatattttattgagggaaaagaagacattttaatggcagagtacacaatgtcagaggaacagaccaaaagaagtgctttgttattaggaagatttgaagaatggaagatagcgtcagattgttaagaaccattttttagataaaggcaggctaaagaagttggaggctattggaaatcagtcacacaattttaagcaagagaatcaatgagtggcagttttgaaaactgaatttgatagtggcaaggaaaatagggctctatcatcccacttactttcaaagttatgaagaaattgtagtaagctccagtcagtacctaaaggaatttattttgtgaaattgtgtaaacaaaaagcaaaccttcttttgcactcatatagtatattttctcaaagtcatatagctaaagggaatgagaggtaaaatagtacagtggttaacaggataggcttcaaagcctaacttcttgggttcaaatcctagcttggttaccatttcacagctatctgaccttgtacaagtcacatgcgtacactgggaacaataatactacctgtattatagagttgttattagatgttgttgatagatatgttgggcacattttaggcactacatacataaacctctttctatagaagtatacatgtgtacctatatttaaaataatgattttcttttttaaaagaagcacatattcattgcagaaaatttttttgaaattttaaaagtaaaatctctggtctaagtgcactaaaatgttttagactttagatatgaactacaaaaacctacctcatcgacacccaaccccactcccagagatatttcattttatttgcttgctatcagtaatgagaagacccaattcaccacacaatttctgttgtatgagactattgtattgcagtgcaagatagtgttttaaatctttgttaaatcaataggtgcaatattacacctccctgtttgaattttcctagtgaagtcaaacaattttaataggcctatacataggtcagttatagttctttcctaaatggtctattcctcattatcctttttaattgagtatttgtctttttttctactgatttgtgagaatgtttttatcttaagagtgtcaaaaagatgaattgtttttgcctttttctttggcttgtttgattttttatgtaaagaaattttatactgctatgaatgtaagtcattactttatggcttttaaattaaaattataagaatagcctcccatattttcattacttttatagttcaatttttttacatgtaacatttcattcatctggtatttagttaggaattgtgtgagataggattttaaaattaagttaaaattcaatcaagtctttattttttaagtacagaagtttccgaattcagcatttacattaaattttttgaaaataatgctaaaatatcatgtaaattattacttattggaattgaaaattccctattattatttttaatctttataacaacttatgttatctatgcttctattataaaataaatgacaagccaaccaaaatagagaagatgcttatcacaattatatcatgataatttaaacatgattttggattaatcataatccaaaaatgcatttgataagcattctaactgttcttctagtccccataaaattaacaaatggcaaacagtaatgttttaattttcaaaatattcatattaatattcattttcaaaatatgtttacttgcatgcatttcatttatattatttcttattgaagttgacttctcaatgtatattgctttaatgatactaagtattaagggtatagattgtactcacacaaataactattgaaaagcataagtttaaatagatccatttatcaaatgatgtctttttttttcttttttttttttttttttttttttttgtgagacggagtctcgctctgtcgcccaggcaggagtgcagtggcgcgatctcggctcactgcaaactccacctcctaagttcacaccattctcctgcctcagcctccagagtagctgggactacaggtgcccaccaccatgcccggctaattttttgtatttttagtagagacggggtttcaccgtgttagccaggatggtctcgatctcctgaccttatgatccgcccgcctcggcctccccaaagtgctgggattacaggcgtgagccaccgcgcccggcccagatgatgtcaattttgaaagatactggaaagtatgttttgggagggaagagggaaggaaagagtagaatatgaagtcagtaaaacctggatatttagtgccatctttgttacttactagtaaccttatgaatattatttatattgttgatccttaatatcctcacttgataattttagaaaatgttatgtacttcataggatcatgggtagaataagaaagtgaatataagtaaaatccatcatgaagtacctgaaatatgttgtaaacctaagttataatagtaattttattgttgctaatatttcagaggaatagccaccaaaccagtactacttattatttatttctatttaacatataaaacatataatattctttctgagtggtaactttgaaaagggacaaaaatattaaaaattacattaaaatcatgtataatttataatactcctttcaaggttactaaagtgtgcatgtatttctaatcattcacaaatatgaaaatctatgtgtaaatttttaaattttctaaaaaattgacaaataaaaattgtattattgtcatggtgtacaatgtgatattgtgaaatatcacatattgtgaaataaacattgcggaatgactaaatcaagctatagaacatattcattaccttacatacttattattttttgtggtaagaacacttaaaatctacttttagtaatttccaagtatacgttattgttactaacagtagtcaccctgagttacaacagataactaggatttattcctcctgtcaaactgaaattgtgtatcttttcatcaatatctcccaaatcaccccacccccaggatctaataaccaccatttttctctgtttctctgagtttgacatttttagatttcacatataagtgaaatcatacagtatttgcctttctttgcctagcttatttcacttgacatcatgtcttccagttcaatccgtgttgttgcaaatgacaggatttctttctttcctaaggctgaatagagttccattgtgtttatataccgcaatttctttaaccgttcatttattgatggacatttaggttgattccatatcttggctattgcaaatagtgccgcagtaaacatgagagggcagatatctcttcaaaatactgatttcagttcttttggatatatgcccagagataagattgctaaatcatatggtagttctatttttaatgttttgtggatcttccatactgttttccacaataattatactaatttacattcccatcaacattgtacaagggttctcttttctccacattctggccaacacttttcttttgtctttttgataatagtcattctaacaggtataagatgatatcttattttggctttgatttgcatttccctgctgattagtgaggttgatcatttttttttttcatatgcttgttagccatttgtatgtttgctttagagaaatatctattcatgtcctttgctgtgtgtcgatactgatatgtaaaatatgcatacaaaatcaaaaccataatttatttttaatatatttttaatatgtcattaatatttttcagtgtaataggatgtttttcataatatttactttaatggacgcaacatatttcattatgtaaaagcagtttattctatttggggagatttcgtttcactttttcgccagagtgacataattgaacattcttgtcataggtctctgtgtttatctctgatattcccctaggaaaattcatagaagtagcattttggagttgaagggaatgagtaatcttaaggcttttaaagtagttttatcaaattttctaaactgaagtataaagacacatagaaaagtacacaaatcataagaatagaaattcagggatttttaaaaaaaacttagtgtatccatgctactaccaccaagttcaagaattagaacattacctcaggagcccctctcatgttccctcccagttatgagcctctcccctgccaccaccctctcccaaagataagcactcttttgacttctaacacctagattagttttgactttgaaattactataaacagaatcatccagtatatgcccttgtatttgacatgtcctgctcaacattatttttgtgatattattctatgctattgcctgtgccatagttagtttagtttttctatgtatggtattctattgtgtgaatatgccacagtttatccattctgctaatcaatggacattgggctgtgtctattatggggctattaggaaaaatgctggtgtgatgttcctgtcctttgctgcatatatgtatatatttatttttaatatacgtggaagtacaatggctaggtcataagatgtgtacatttggctttggaatcaccaaaaaacagtttttcagtgtggtcatttcagttcattttcaccagcagtatataagacttctagttgatccacatattcatcaagagtatgtattttcaacctttatccttttaaccatttaggtgaatgtgaaatggtatttcattgtgttttaatttgcaatcacctgacgattagtgccatttttatatcctcttatgtgaagtcattatgcaaatcttttgcccattaaaaataatagttgtctttttcttactgatgtagaagttatttggatacaagtcctttgtcagatctatgcattgcgaatatctttttccaacctaaactttgctttatttttttctcttaacaatctttcctgataaatggagtttgatttatcagtcttttcctttatggctaatgctttttatgtcttgtttaaaaaataatacattaacctaaaattgttgagatttttttctatattttcttttgaaaactttatttttttgccttttacattgaggtctgcaaacaatctagaatttatgttttgtgtatgatgtggagagtcaaggttcatgtttttcaaatgactaatcagttaacttggtgctatttactgaaaagatcatccttttccaacttaagtgacaccatcgtataaattaggaaacgctatatagatgatttgttctcacttcaatcccacacaggcttaattataataaatattcatgtctggtggcaaacattcttaaacttcgtcgttcttcaaagttgccttggatattcttagccctttgcacttacatataaatcttaggattggcatgtcaatttctactaagaaatggttgctgcaattttgattgagattgcattgaatttatagattatttgaagagagggcagatatctttacagtattggactttctaattcatgaagaaggtagtcctctatttgtttacattttcttcactgtctcagtagtgtttgtagtttccagggtagaagcttaacttttcggtctgaattaccaaattactagcaacatatatagtcatgcatttcttaacaaatgagatatgttctgaaaaatgtgtcattaggtgattttgttgttgtataatcatagagtgtacttacacaaagatagatggtatagcctactgcacatccaggctatatggtacagcatattgctcctaggctacaaacctgtactgcatgtgactttactgaatactgtagtcaattgtcacacaacaatatttgtgtatctagacacagaaaatgtaccgtaaaaatacagtatacaaatgataaaaaatagtacagctgcatacggtatttaccatgaatggagcttgcaggactcaaagttgctctgggtgagtcggtgagtgagtggtagtggtgagcaaatgtgaaatctaagacattattgtacggtaccatacagtttacaaacactgtatagttaggctgcactaaatttatgaggacacatttttatcttttttttttttttttgtatttttagtagagatggggtttcaccgtgttagccaggatggtcccgatctcctgaccttgtgatccacccgcctcggcctcccaaagtgctgggattacaggcgtgagccaccgcgcctggcccatttattttcattaatgataagttaaccttagcttatagtaacttttttactttataaactttttttttaagtttttgactctgtaataacacttagcttaaaacatgaacacgttgaacacccgtacaaaaatattttatatccttattgtagcagctttcttatttttaatatttttgctgtttaagcttttctgttaaaaagtaaaacacaaacacgcacatgagcctaggcctacatgggtcaggatcatcaatatcactgtcttccacttccacatgctgtcccccactggaaggtcttcatgggcaatgaaacattcatgaaactatcatctcataggataacaatgccttcttttgaactaattaagaatatagtaaatacataaaccaataacagttgtttattatcattatcaagtattgcatactgtacatacttgtctgtgctgtatttttatataactggcagtgcagtaggtttgcttacaccagcatcaccacaaacgtgagagtaattcattgcactgtgacatcactaggtaataggaatttttcagctccattgtaatctcataggatcacagtcagtctgttgactgaaatgtggtgaatgactgtataatagggctccaaggaagatcataaaattgcttgttttccagaactttgacaaagaccttttacagaaactaatataatagataaataatagtataacattgctgttttcctttgcatttcattgattactaactgtctggattttttcttgtttattggctgtttacatttttgtcaatttctttttatgttctttatccagttttccagtagatttttcctttttttactcattaaaagatttttttatatgctaaaattattaccctgtgtctgatatatgctgcaaatattcccagttgtcatttgttttaattttgattagtggctttaatttataagtgaatacgcatattatattcaatctttttatattctttttttgcttctaaaaggcttccccacgccaatattttattccagttcttcttactatttttatgcttaacactttaatttttctaaaatgttttgtgttatgaaatccatcttaatatgtttatttctaaaacagacacttttgcttatcttaatattaaaacatatacatttgaaattaacattcagagattgaaagaataaggaaagtaatcttgtgtgaaattaggtcaagatgtgcttagatactaaattaacacataagggaattgaatgtgtttgttttctttcaccacagggaacatgttatatgaagagcatggttttataatacataaaaggattattagaaaaatgatgtattttaccggtcaggtgtttgtgtctatactttgatgtgaatgcaaaatagtaaatataaatgtaaattaatttaaaacacatagaatctgatacaaaccttaatctttttccacgttatacattactcacacctgttatatttttccgtgaagtatttggaatactctcgattcctggaaactgttttaaagtgcagaagagcacaaaaaaaatatgtgttaaaagttcttgatttccacccaaccattaagtgatattgccaaagaaaactcttcagagcatttttcactgatggctttagatatgttataccagaataataatgattcattattaaaatatgcaaagtgtaatttctcaacaacattttgtggtaggaagatgagctggtacagtagttttccttattaaataattttttacaaaagtaattgacatggtttggctgtgtccccacccaaatctcaccttgaattatggtaatccccacatgtcaagggtggagccaggtgcagataattgaatcatggaagaggatcccccatactgttctcctgataatcagtaagtttcacaagatctgatagttttataaatgtgagttcccctgagcaagctctcttccctgctgccatgtagaatgtgtttttgcttctcctttgccttctgccatgattgtgaggcccccccccgccatgtagaatggtgagtccattaaacctctttcctttataaatcacccagtctcagatatgtctttgttaacagtgtgagagcagactaatacagtaatgcatttacattgttcaaaatataaaaggtacagtaaaaaatatctcaccctacccatcatctgctctaccctcactgcacattaaccttaattctagaaacaaatctacaaaataaattcctgggaataaaatttccaggtcaaagtttacatgctttttatagatatggccaaactgccttccacaagaggtacacaaatgtatacttcccaccagccacgtagaagagtctgcattttcccacagccttggcagcatagtgtacctgcagacttgaatttttgccagtgcaatagatgaagctctaattttcatttctctcattattaccaaggctaagcttctgttcatgcttttaaaatcctttgtattttcttttctgtgaactgtccttatcttttgtccaattttcttttgggttgttggcctttttcttattactttgcagaaggtctttcatgtgttaggaaaattagtcccttagacatgagtcacaagcatttatttttcataattgttcatttgtttttgattttgcctatggctcttttggtcgtgcagaagcttttgattttttatatagtccagtttactgatatttttgtctgttaattaaagttatttaacttgaggatacaatttacatttttttgtggttgactactatagacatatactgcttcttacattgaaaaaataataatcctgaatttggaaattgtttttaacaaacttttggtgaaggtccatcatatttaggaacagagcttgtttgacccagaaatcaaaggtcagtgagaaggagcaatgtaaatagaaagttaaatagcatgaggtaaatgttatgatggtgggaaagacaagatctgagaggataaacctaaagcaacatcataattaagctgaaaatttcgtctcatgataagctatcatttcattattccagatattagtcaaatctgacccattacactgttttctgtcaggaattgttttacctctattacaaggaagggatagtatgggaggatgataaggaaaccagcagtcttagttaaatgttatacagatttctgtgcttatatatgaagcctaaatgaaacgtgaacaatttcatgatcagataaaaaggagttcatcgctcagttttagagattttaggaaaatatgatggctattatctcagtagcttcagagtctagaggcatttagatgttgttagttgaagctgtaaaacgctttttacatctacttgtgagtagaaaatgatccaataaaaataaaatgtttagttacctcctttaaaatgcttgaaaaataagttgaggacatcattagatcatgtattacagacgtaggagtatatttgtaacatcacctacatcacacatacctgtgtgcgcgcgtgcgtgcacacacacacacacacacacacacacaagagttcagcaccacaggtgtagttatggatgtgaactcacaaaacacaaatcaagcaaagagaacaatatctcaattcatgattcatggacattctgtgctatctgaaacacaatgcttcttttgcccaactctcacccacacagggaaaggctgccaggaatgagaggcaagaagtgtgcaggtcaccttcaacaggagccaccacctgtatttcccatcagtcttttacaccattgtagtcacgtggatccaaggactgtattccaactgacagctcctgcgatgaggtgcagttccacacgacaaagccaggcccaacatttcccattcatcttaaagttagtgtttccaaggaaacagtgctgtgggagcctagggtcagtcccagactgacctgcaacagcccaggctggatgttaatcctttgcttatacagtctcatgaatttttcacaacatatatacatgcatttacaagacgtttcactgtacatattgtttacgtatacaatcttgtttaaaattcatttttctgtacattaattgatttttttctcgacaactttctctttttcatctcctaactcttgcatccaattaaacaatgtactgttcattagtgacttattttaaaagtatctaaaacaattgttccaaagcatgtgacattgtttatgtgacacactggtatattatctagtttatttttaaaatcttctctattattattcataatatattattatggaacagatgtatattataaaattttattcatattgcagtgtaatattttgtattacagtggtattgttaatagtctcgtaaagagctatcattacaagtttaaattctttattctgggatgccagttttaactcttgatattctgaagaaaatagctttactcttgtttattctggctctgtttttttgttttgttttgttttgttttttgttttttttgttttttttttgtagagatgggagtgttgctatgttgtccaggctggcctcgaactcctgggctcaagcaatcctcctgcctcagcctcccaaagtgctgggattacaggcaagagctacagtgctcagcctatcctggctctttatttacatgtaagcttgagcaataatcactgctacttaataactttattgtcattcattatcatgcagagtattgctctaaggtatgttcagggatgacgttactgagtcctaacagtaatcctatgaagcaggtgctatcattgtccccaatctacagaggaggcattgagagttagagaaaacttggctaaaatgttaggcaagaactagaaccagaattgaaatccaagtggcctaactctagacctcacaatgcttaataccatgtcatgctgcttcctaacctatttaatgtttttttcaaccccaacgtcatcacccatgtgtgatagtgggatcataataatatctatgtcgtagcattgttggatggattaaggaagtctacaaatgtgaaacttccaaggatgatggttggcatatactgatctcttaataaaaataacctataatcattctgttacagtctactctaatccaaatgttctttttacttctcatctcaaccacctgcttctgtttactaggactcacaaactatagctcacaaaaacgcataacttaccaattttccttgtacatgaagggacttccttttacaatcttccatgacataaaagaaagctagaagcaagtatagtagaagaaatgattgctatacaaacaaaattatagttggtttggttttaattttaggatgcgcattgaataaaaatcactcatttgggatttagaagacctgtgttatatatctggtgctaatgctgaataacttggcttattcatttttataactgcaaaggaagcgcgtatggcatataatacacaacacaccagtatatttagtaactgagtgaataaatgaaagatgtatttctttactttatcagttgcagttggctatgcctttgtgtaaggtgtgtgttttgaaattccaaaaaggtattagtttctttaaagcaaagaatttttgtagcaggttaatgaataattttgaatacattggttaaatcccaacatgtaatatatgtaaataatcaatattatgctgctaaaataacacaaatcagtaagattctgtaatatttcatgataaataacttttgaaaatatatttttaaacattttggcttatgccttgagaattatttacctttttaaaatgtattttcctttcaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggtagggaactttttgctttaaatatttttgtcttttttaagaaaaatggcaatatcactgaattttctcatttggtatcattattaaagacaaaatattacttgttaaagtgtggtaaggaagactttattcaggataaccacaataggcacagggaccactgcaatggagtattacaggaggttggatagagagagattgggctcaactctaaatacagcacagtggaagtaggaatttatagccaaggagcagtgtaggagtcagtagatggaaaattattaagaggaaacatcaggggtaagtgggattctggctaaaccaacctcacaggattcttgctgaagataggccagggttatcttatcagacaacccttggggaatggtggagaatactgagggtgatcaggtaccaaggataaagggttcttgtaaaactgacaggcttctttgctgaacctggattttacaggggagtgcaaagatgagcccaggcgaaggttcagaagcctgactaaagtttagtcaagcagggaatctttgtcatcatcatcattgttgtcataatgataataattattattattttactagaatatgttgctttttcctcagcatttactagaaataaggtcttcattaaacttatgttactagaatgcctgcatcatatttgttactgtgattcattttctatccctgttttaattgtgcttaatacatattcatagattccttatccaaaattgaagttgtttatgagattaggttcctaaaatataatgtctgggctcttttgtagacattgtaaagccctctcagactgactacactttacctttctatcttctcattctgccagcaatctccccgtatagtctggccacatcaaattacctggtacctttccatccatgtaatttcatgtcatacctgtgatcttggttttctctcttctttaaatgacttctttcagtttattttgatataatgaattttcttccattctttaagaatgaattcaaagtcattgcgtcttccaagttttcttccgtaccccaagtagagttagaatccctgttaggatttcttataaacctttttattcatctcccattgttcatatgttgatttacacttaaattttatacacctgagtatttcattacacatctgcactgttctttgagtgcagagggcattctcttatttatctctgcttctccactcatatcatacacactcagcctaggatccagtaaatgatgcttacttgtgagtgtttttaagtcaatgaataaagacagtaccaagacacccagaatacgaatgagatactgcaggtaagcgtaaggcttcagacaatcctgccaattgaacaccactatctccttcttctagtgtccttgtaaatgctgattgatcttcttttctccctttcaaggaatctattccaaagattctttcaatatgctgccccgttttgcgtctccttatttgccaaaatctttaagtagccaatcaaataaaccgaatcgttgaaattacaatctattaatgaatgtattgttgggcaacttcagagtaaaaaggataagtaacatttttgagtagttttttcttttatttaattgactttaattgttaaatttatttactgtccagtattgtaaaaacctaacattttaatctccatttagctgttgttttgctggaactgagagcaaagggaaaaggaagtttgagaatattctagtgaagaggaagtaaaagtttcgggaagatgggcatgagtaacaaggagatagagggaagtttgctacaactaaaatgagttagattagcaaaatgttctcgactatgtttaccttacttcctcctgacacttatgtctaccattctgatagctactcctcaagagcagatggcactgtggaagtcacaagtagacatcatttcactagcacaaaactcagcctgctcagccagtggcacagtcttgggttcagtctgatgattaaatttacgagacataataggctttacccagtaacaaatttagttagctttaagaaattatacaggatgggtaacaacagcctgcacattaaaggcacagtggaagtcttgataccaagacgtggcttctgatgtcccatcaccctgaattttagtcatacatgatcacaaggggcaagactgggtgcgtacaaaacacatcatcgtctcagggaagccatcagttctaggatcctgaccatttctccacttagctagtacatattgtactcagaggtgtttgactagctcctattcaccagtacaattacatctcatgaatactgatttttcactgctcaataaacaaccccaacaagaaagtacagttacttggcccaatacacaataaccttagccaaattctcaattatcttatatccagtatattcttaaaaagtaactggcgtaatattgcgaagaggaaaggtcataaagtctttcctcccaaccagaaatagctttttgtagctcacggtaaaagcacattctactcttttaaatgcaatctttggttaaaatgtgcctctttattataatagtttaaaaaatactcaatgctagctatctctcttcctggaacacatttaagaaaagatttttttttgaatcccttggtacaaatagatcctgtttactcaatcaaaatgacttttgtcccagtctgtgccccccggaatggttttcaaataatgaaaacctgcattgtgtcttcgattgtctatggcccatagggctctgccaaatgggtccctgcagtttgaagtgaaagccatactcggctgtgttaatcacttttctttatcaaagctacaagtcaccactcactgctgtgtgtagtttctgagagtcatgatatttgcctcctgcagcttgttttaaatcactgaggggagagggagctgcttttttcctggcagaaaactccttggcttcagtcctctgagcacattccgagtttcttatctctggagtgcagacttcaaaaatactcttttagcctttttcttctgcttgtggctgtgttcaaggtggggggaggggaaacataaaatcatagatttgatgacttgagagtttctcccaaaaattctcaaacccccagcttataattaggaaatggtgacctgtgtgaataataatttaccttgttttttatccctctttgtctagcttccattcctttcactaataaatgatttattaagattgcacagtttttctgatttaagatataggatattagtccttacagcctgctgtattcctctgcttaaaggaattaaactatttttccattaaagaaagatgggacactagactttgctttacttagtttcaaactactgaacaccaaaaataaaatttttaaggagttttgagcacatgcccttttttttaacacaaggtaaaaaaaaaaaaacacctttactaaaatcttaagaaagagttaatgcaaaggaagtagatatacgaacagccacgcccctagctccaaatcctaaatgtaaagaaacttgccttgtctggccatggtggccatagctgcctcggaaacaaagggtctgaggccttgccattcgggtagtttgttttctctagtcaaactctgagcacacctgttagaaaaatatgtaataccctctctctgtgagcctcagttttgtctgcttggtacttcactcttattgatgaaatgcagctagctgtgtagtgaaacccagataaaaaaaagctttaagggctgtgttctaatacattgtttatgctggagtgaaaattgactgcacattgcttggtttgtgcaatttactcccgaaatattcctattcaggaaatcctgcaaatagcaatattcatcttgaaaatcacctcacagaacccttagcaagctgagaaacataatcaatgagatcgtgatgtagagggtgaaaattaggcgtaatcacagccctttcccatcagtcagcccactagaaggcatgcctttgaattttgattttcaaatatactctcaatttagacataaaatatgttgatttcagatttcagaaatgataattgaatgctaagatcccgggaccagtttagaatttctataaagggtcttatgtttttaacctttaatgaatgctttcaataatgagctagaggtatactatttatctgacataagactgactactgctttccaaactttttattaaaatatgaggtgtggcgggacacataattttatgttaaggcttagtgactgaaatactttcatcttaatcacagggagggggttttttcctcccctcaagaatcactttccttctgtggtttataaataaacatgacatgtggctctgctggctcttccttgcagtataaggagcataattgcccataatgtcaaatccacactaaaaactaccaaaggactcaattgtagtgactgaccattaaagtcactgaacactgtgtgtgttcacattgctgtgagtgttgtcaaagaaaaatagcactagacaacagacaagaaagactgtgttcaaaacttttgcaatagaggagacagattgaactcaattctgctgaaataaaaggcaggagagcctctaagtgctgagatgagttagtgagaaagtactagatatcaggagggaggttagtcaatgtgcttatttaggccatctgtgtttgctgattggcacttatcaaagttagattcctatcctcccaacagaagactagcagattggggcactatcttttttgatgattctatatcaaagtgctagctcccaagtccttgagaaagtttattcctgaggtataaaagtggcaagaggctaggagaatatttttgtctcaaaaaagtagagaaataatatataaagttttctagagtaaatgctctaagaaaaggaaggtcaggtctaaagtcaggaagaaatctgtctcaaatgtagtcaaactcagggtatttttaaagctttctttgtcaaccctccattttgttcaagggaaaccagttttcccattgaaaaacttaggaacgccagttcatctagttcatttcagcaggtttctgttgttgaaggactagctgaacgaactctgacacttggtagtaatcagacatttcatgaaggagatttccatgaaagttagaaggaagacgaagattaatggttgaagcagactgcaaactcagtttttgagtccagagggcagcaagtcaaaaagattcctagaagctgggctgtaggcattctcagatggtagagtgaggatggcagtagcaatccgatggatttcttggagcatggcacggaagaggttggagtttactgaactttttgcatggcctacaaagcagcagctccaggcatgaaagttgtctatacataatttgctgtggtggtgagtcctttgtagtttatagcaagtcatccagcttctgcttgcagggcttctttagatattgtggggaaatggcagctataagacaacctagagaagagagtccttatctcagtaataatatgggcagtcacgttttagttctcagtgtcaccaagtcaggatggtgggagaaaaatttgaaatgttaatttggagaatcgcagccagattgtaaaggaaataaactgaaaattggtaaggacggacaaaatgtgtaagacagcaggatccagatcaatttacaggtaggtaaaaaaaaaaaaaaaaaaatcatgtcgtttacaaagaaatgcaaaatagatcaaagacaatgaacaggactagaatctgataaccccaagggttactgaaactctatctctaccatcacccttttgatcagtgttaatcaaagtaagactttccttgtttataaaataagactggcctatttatttatataggggtagcaaaaatggtaatttaccaaataggctattttaagtgtgattagctggaagttttcatgaagaatcacaagctgaataagtttcagagatatactgtacagcatagtgcctatagttaacgatactgtactgtacaattagaaatttgctgagggcagagtttaagtgttcttaccacaaaatactactactctcttttaggagcagtggtacataaggtgagaggaaacttttggaggtaacgcataggtttatggcatagattgtggtattggttttgtatatatactttatctccaaactcatcaagttctatgcattaaatatgtacagctttctgtttgtcaatcatacctcaataaagtagtttaaaaaatatgaaacctcagatttgattttttaaaagtctccaaagtttaggaaggcaagtcaagaacttgacatcagattttacctgaagtaaaatacctatagattcagctgaagtgttctgttttccaggttcctaaaatacccttggtttcctgggtctcctaagaatagaccttccttactcagttgtaagattgggaattctgtaagccaggtaccgggacagttttcccaaaaggggcttatattagctccatatagtcaagagtagctccttaaaactggtcacatctgactctatgcacttaattctcaaatatgacattccagtcaaagccttggttatatatttttttcaattatgtcttgttacctaaatatatttattgagcctatgcaaataattatattgccatgaaaataagaatactcggtaagaatttctgaattttacagggatcaggcagggataaaaagattaatgtttcattctgtttacaaaagcatactctaaattctcatgagttatagataacttaagagaaaaaggaaaggcgtttcttgtatttagcaaacagaacattaaaacatgaggaatattttaaacaaaagccataatcaaatcttttatcagttcattcaggcccatgtagttaattcttgtcttgcttgatcttgagttagtagtttcatgaactcatcagcttcttcacagagtttcataaatcctgactttgtccaatggtataatctcgaagttatttaagcaatggcatcagaagtctgtgtcccagagtacctgtcgtagtacttcctatgggtctcaaagatggtcctgttttactgaagatgatgcattctgacctctaactgattgtaagagcactcagggaagcatcagcataaaccaaaaactatctgtgaacgacaaaagacttaaaatggccataattaaagatctgattcattcgacaagaaattttttttttccctggtgccatgccacattttaaaataacaactggagttaggactgatgacataatattattatcggataaagtagcaccaggatgtgtcatggacacctagagcacctagagcactaacaaagttctaaggatttattataatttttcaagtatttatactaataatagttgacccatacaactataacctagtcaaggttcagcatctcttcttgtcaaagctttttatgcaactcaacataccaaatgaacctagttatttttaacatccttcattttacaagggtgcaggaacaaatcctttgaaatttttcaaaccaatctgagattaaaaaaaattttatttaagaattgacctgggaaaagcaaaatatcaaaggttgtaaaatgacaaaaggtttgaatacttggctgaataggatcattgctcactatgaaagaatgcatggctacctatgtaaccaagatgacaataaaagatttcaaaaataaatgtagaaggccacatgacggtaaaagtttttagttctttccaaagagaaaacactactttctaaaaaaattcaaggacatacaaaatcaacacaggtacttattctgataagaaacaatatttgtttcctatacagattacccaaaatataaaaaaaaaaacaaattttgcaatctcttattaagagaagaccaatagaaaagatgaaaatgttaattagtttgaccgaaataattgttttgcaattttgtgtgtgcgtatatatatatatatatatcaaaatatgttgcatacttaagtatattcaattttatttcaaaagagcagaccaataatccaagaatattttatcattttttaacaaaaagaaactacaactcatttttgatcaatacactgttgatactaagggtcatttgtaagagtttacatacacataaatccattccgttttagccagcattggctattaacataagactctccttccacaaatcttctgccatttccaatgttcattcagattttgtcctataccttcctcttcctcattttcacagtcattttaatttaggacaaagttattctctttttccttaacaaaaacacatccaacataccttgtatattttgcatacaaagttgtttccctttacccctaatgtttctggaagttttatttacatatattgattatatttttaaccattagtaagtcttattttatagagaaaactaggaattagctaagtgtgaactgtttgtcatataccagtatttcatagccaactagcaaagcttatgaatacaagttaaattcacctactcaatatgagggctaaaagtttacatcaatatttgtggaggagccttttaagattttcttttgccctgatatgtaatttatggaggctgtgttctaaaatttgagtaaatgactgaggagatacctagtggccatctgggtatctccaaatcccatctgaacgtacacggtatccagtctgtttccaattagctttttcaacctcaggtggttgcttctggggtttgagttttccagagcccccagtagtggcagggagcataacgctttagagaccatagagagttgagagactggagtaggaagagaaaggtctgtcatggatggacaaagagatggagcaggtacgggtttgaagaggaatatgctgaaggatttaagggagctaaagggaagatcaaaagtagtcaaaggaagaaggaggaatggtggtgatgggaagggagaggtcttagatgagccagcttagggagtgcttatgttttcggaagaggccattgaagttcatctttagtaaaaatcaaactaacaagaagagaagcctagtttgtgccatagaggtgaagcatctaatcagcagtagtcttcagaggaggagaaacagaatagtgagaatgtctcctggaggaaagaggcaccgaaggaacagcaacaacaaaaaaaggaaacatgaatgaggtctctacaaacgtgatctgtacagaaaatgatttctctaaatactgaaaatctgaagttgaaccaaatgagatttcaataagaattttccatgttctaaaccaatgatgcttttcaaacaaagaagcctgggactctagactcaagaatatactcagattactgagaatcaaaatctgatgttaccatgcttccacgctttcgtgggtaaggagtcagacttaccaatggattcccaattaatcagtcaggagtgtactcaacattcacaaaattagctttgcagaggttaatgtcattaaattcactttagaatggataattcaaattcaaatagtaactcccttagatagatgtgtactagctcaagttcacctgttatctgatttcatttttaaaaaaaattttttaaaagtggtgttcgggaggtaaggaacaaggaagagacctttagaaaaaagtttcagtgttttatattggatatgaaaatatcagtggaatgtgtcctgaaaaacactggatgacagttactggacaaaaagacaaattattcccttttaccatgcaactgaacacagatttattgaatgtttttctcctgagtttaggttgcctctgggcaagagtataattctggcttgataacaccttgaagcgtgtttgtttaagtttgtggatagtttcatctattagtggaattaggcatctgcttctctttatgaacactgggtaccataatcttcctcttactttttgttttttctactcaactccaaaaaccattgctgagttgaagtagaataataaggggaaagaaacaaaagactaagtttgaatcccagtgctgacacttactggctttacgatattgtttaactcacttaccctttttaacctgaccttcttcttcactaaaaatgaaaaattgagtgaatttccctgggactctgttagataaggcaaaactaagatgggaacacatttcctaaggcgtagaaaaagacagtgaatgggacctttcttgttgtatcaggagttatggtaagaggtactaacaataaaaattaggctttcagccaggcatggtagctcacgtctgtaaccctaggactttgggaggccaaagcaggtggattgcctgagcttgggagtttgagatcagcctgggcaatatagcaaaaccccatctctactaaaaatagaaaaaattagccaggcatggtggcacgcacctgtagtcccagctacctgggaggctgaggcatgagaattgcttgaacccaggaggcggaggttgcagtgagccaagatcacaccactgcactccggcatggggaatagagcaagacttctttaaaaaaaaaaaaaaaaaaaaaaaaggccttcaaaatacccctacagcagcaagttggtaccagaaaaacactccaaaaaagggagtagatggtcatgagattttcatcgttcaccaacctaacttgcccatataaggaaaaggataaacttgagaacagtttcttgaatgagaattcctggaacagatcattcaaataggactaacaatttgttggacatgagaaaacttctatgacttttactgttccctttcttatgagggaggggagaagagtgcttttcctctttgccaagccaaggaagagggcttcaaagaacctctattatagtggcattcagaccattgtatttataaaaaataaaaatattttagaaaattgaatatctgcttgcacattttaaagatgacatctattttctgcccttgggatacagtaaatattgacattttaaaagggtttatagtacagtttagaatgtatcccgtggaatccaaataccattgcaatataatgtctaccatcatatacttaaaaatacatgaaaaagctcatatttaataaatagaagttttatattattcctttttatttaaatcatatttttcaacttccccaatgaattgtattctaatgtgataaatatgtgatacatatttatgctataaagttttattagccactctatcataattctttataaaattatatttatgtggacttaaattcaatttttaaaaacaatttcctgtgactacaaggctctaagtatttttaaaattctctagattgagtagtatttaaagtattaataataaatacacttagtaataaccaaataacctaaatatatgtaccttttgataaataattattaaacatactcagtggatagttattgaaaatgaatctattatgagatggatgggtatttgatggtaccttgagtaaagaaggatttcagtcgctaatattttgaattgtacttttatttggcataaatgtatcttgactacaatgcaccagtgggataggtcagagaggtgtgcttttattttgtaaagcggaagaaagtctgtcattaaccaaaaagtgggcaagaaaattggaatgaagtgcctaccacaggaacaaatccagtcaaatcttttttttgtttgtttgtttgagacggagtcttgctcagtcgcccaggctggagtgcagtggcgtgatctcagctcactgcaagctccgcctcctgggttcacgccattctcctgcgtcatcctcccgagcagctgggactacaggcgcccgccaccacgcccggctaattttgtgtatttttagtagaggcggggtttcaccatgttagccaggatggtctcgatctcctgacctcatgatctgcccgcctcggcctcccagagtgctgggattacaggcgtgagccacctcacccggccgcaacatgctgttttaatgagcgcctgggtgcgggcagcctcaggcctaaaatggcgttagccccaagtgaggactggacaaaggttttatagtctcctgtaaacaggaagtctcctggcctgacgtaactgctgcattgtacccggatggcctctttctcgatcttcagaggtacttgtcttctggccggctctcttcctgcttctgctatttcgccggtgcatgctgctcaggcaagtagccttgtgccttaggaatgggcctgagaaaggaggagttactcatctccttaagctttcaggcccgggagagaatcttacaacccactgatgagttatgaaatccatttaatgggtaaaataaaatagaataagatagcatagggtaccaaagaatataacgcaggttattacattgtgttacgtgtggtatgcttaagtgttgttttctggaactgttgttatcatttgtattgtacttcatttttgtttcgaattttaagataatctgcacagttttatagaaaatgagttaattagtactgtatcagtgatgtcatactgggttaattattacaaagttgggggtaaatttatccctgtataacagactttaaagataatataaataggccaggcgcaatggctcacacctgtactcccagcactttgggaggctgaggcaggtggatcacgaggtcaggagttccagaccagcctggccaaggtgatgaaaccccgtctccactaaaaatacaaaaattagctgggcatggtggtgagtgcctctaatcccagctactcgggaggctgaggcaggagaatcccttgaacctggaggcggaggttgcagtgagccgagattgcaccactgcactctagcctgggtgacagagcaagactccatctttaataataataataataattttgtttatttattgaatagatactttcttccagtacaaaattcaaaagcattgaaatcctctgttgcattgttgtctttcagccacacagtttctctccccatgtgctgccaaggttttcagtttcctgggtagccttccaagaataggatgtaggtgtgtgtgtgtgtgtgtgtgtgtgtgtgtatattattttctactcttgtcctcttaaaataaagccagctgttagaatactataaatactgtttctgcatccttcaaaagatggttcttttgaagcccttttccttggcttggcgagggcagaaggaaaagcactcttcttcctccttcataagaaaggaaagactaaaatgcctgtgtgtgtgtgtgtgtgtgtgtgtgtgtgtgtgtatagcactcttctccctcccttataagaaagggaagagtaaaatgctgtgtgtgtgtgtgtatatatatacacacacacacacacacacacacacacaggtgattattttctgtattagtagttaaagaactgtctctttttttttttttttacagttgcatactattctgttctaaggatataccataattcacttaagcagcactccaattagtgagcctttagtttgtttcgacttttggctaagataagaaaatgtataactttgtgcacatcattttacacgttgcaaatatatctatgtgataaattcctagccgtcgaatggctgcgtcaaactggcatttgtcttgttagtacattttgccaaattgctcttcatagaacatctcgtcagtattaggaaaggtttcttttccccatacccgtgcccactcagtgtgttatcaacctttttgatcttctaaacaagaaaaatggtgatatctgtcattttaatttgaattctttattcattttgtgagtgaatttgaattttttcatgtgttgcagaatcatttttatttccttttctatgcactgtttgctacttttttgttttttgccaatgttctcttttgggttattggtctctttcttactaaggcaaatatagtttacaacttgaagtaaaaacatggttttctatgataaaggttttaatgaatgttttctacaacagacagattctagtcttaaggttataacctgaaaacatcaaaactaacctttgaattgcataggaatggtctttgctcttcttagccatcaatcctggacagaagttcaacatgatgacaaattgtagcacaagtagagatttaaaaaatttttaactaatatgtaaatatttgctttcattttcttatttatctaacaatacattgatggctagaacagggtttgtctttgcaaagagcctgtgtcaactgactcccattctttcaaaatacattacctaaagaaggtttgtggcttctctttgcattgcattttctagccaaatctgaaataactatctggaagcttaacattttattcccacacttatttttccttgtgaaaatcaaaactgcactttcccagtcttcatgagtaaccacaatggtttgccatttgacttgccagttgtattagcatactgagatgtaatttatctgcatcaagagagttaattctgagcagctgggggctttctaatctctttacccatcttggacaccagttccctctcactgctatttgttttattctttgcagttagaataccattcctcttgacatacaagaaacaaacccaatagaaattaaaaggttccaatttctattttccattcaccaatattataccattttctcctaaagcagttctactctctcctagatcattctcttgcttttgaaataaaccttaaaaagtcattttgtcaccctaaatatgtttatactttcttgaaataatgcttttactgcatattagaattttagtttttacttagcagtccttcactactcctttagaaggaaatttagataatactttgaaggaagttatgagagaacgtcagaagccatgctatcagttttttttttttatgtactctaaagaaaactctgctctgcccatgggtgtcatctctttctgattctgtgtggaggagaaaaatgggaacacttccaatcattttcaaacaatttctgcttaagtggatgaatggaccacctggtttactaactataatgcccaggggatggctttgattggcagacagaacgcggtgcagaaacaatggaagttaaatgaggaaggttttaaacttgcaagttacctcccttggtggcattgactgttggtagaaaataacacgttgggatttcagatacattcagacatgctctgcacttgcaatttgcaatacttaaaacaacacaattcttctaatcataactttttaaaaaatttggccacctttctccattgtctcataaagctatattcatgaagctgtttattcacaaagtcgtatcatttaaagataagtgttatatccataagtatgtaaatgaattaaaatctgggaggctaacacttatccattccttattctactatatcctatctagagccatgcttcttaaaatttaatgtgaaactgttatttctggtctgtggaaccacagtttgaaaagcactgtcatagattcttaagtagatacattttcatgcatacaataaatatgcaggagaagttaaatgggtatgtccgggagtcaaatattgattctcagaatgaaaacttcttcatttatttctcagtgatcttcataaccctttcccatactgggcagtgagaaaaaattatcatctcactctgaaatagtgatttcaccagtctctttttatgggttgggacctcatggataatgaccagtcttttagatttccttgctctcctcctgctcctctccaaaatggcagctgggttgacagatgaggaagcattatacatgacctgagatctctatgcaggtacttgcagtctcctctgaccctctgctctctggaacagtgcctcttgtctgcctgataagtctctaccctgctgaccttgtggctctgagcttgtattttcatcaggaaatacggttctctgctgactatatcagttactaaagggattcttaaatctctgagttactgctgaagaacacttagaattctaaatttgtaattatgatacctctaaaaacaagcgtgattatccattatgtataaggatgccttccaaaaagttggagcaacttgaagccacttgttacattgtcatttagtggaggagggagtgaacttggtgtttacaggtagaactctctatcaggtgctgtgaggaaaaacaaaagcaagataaactgtggccataatctttgttactttatttcccaatggggagaaaaagacaaatatatatatttgtcaaaactgaacagatgttatttgaacattatactgtatatgccattataactataatgtatataatacatatatataaattattgaacactaaaaagaacactttaagaattatctattttattttttttattatactttaagttttagcattaggagaagtatctattttaaataaagctatttcactcttcagtttccatctcaagaactcataccaatttaaacttccactcatatttgagagttgagaaaaattaccaaatgataataatatattatctaaaaaataatttaaagatgcatgtctctaacaaaactatgtaacattctgaagggttttaagtaatacttcatatatcctaattcagaataaacttagatgttatcagtatgaaaatatatcataaagtaacatgattctctccaatgaagatgtaatcatccaaactttatgcgttgaatttacggcttagaaatgccatagcaatatgtcctcttgaatatacaattctatatactgagatttcacttagtatattaagttctgtatcactgaagagtatattatgattctaattaacaaatacaattctattttatataagtacccctatcatctactaggcaaagttagctgatgttactatgcatttttttgtcagctgtactcaacttataataactttgtattccaaatacttcaaaattgccatatgcttactgttttcctattcacatcattttcccccctattcttcctgaccctcctttgagcaatagtgtcagtgggattagactcatgcattcacatactgaatgaatgaatcagtatgtgattcatgatatagaaaatttaaattccttatatatttcatatatcatatatatgatatatgtatctgtgcatataggggatattaaacacttctctgtatatatctgacatatattttgaaaaggaaacaccgtagggccaagttaactgcttcaattattacttagtgtaaatgcattcagtttgttctgtaatttcaaaatgatacatataaaaaagtagagtttgcatgtttaatacatctgaagctacagtttccaaattctgaacactttggtgacccccttgacacaatgaatatttggcagttaccgaacataacagggcacaaataatatagttaatgaaaacatccataattatttaaattaggctattttaagaaaagttttaatttgaacattaaacagcttaaaatcatttataataattgattatgtaacatgctggtcattaaaatgagattggtattctctttttttttttttttttttttttttttttccgaggtggagtcttgctccatcacccaggctggagtgcagtgctgcgatctcagctcactgcagcctccgcctcctgggttcaagggattctcctgcctcagactgccaagtagctaggattactggtgcccaccaccacacccggctaatttttgtatttttagtagagacagggtttcaccatgttgaccaggctggtctcaaactcctgacctcaagtgatccgtcagcctcagcatccgaaagtgctgggattacaggcgtgagccaccatgcctggccaagattggtattcttgacattaataattttggtaagcattaagaaggcaaaacatggaagcactcacaataatgtataggatccaagtaaaattctccttactgaaacatgaaactacaaagccatgtgcgcatacttttaatttttaagatttgtttgaaggaacttttgtgaatgacaagtagagaaagtgtggatagatagcatctctgtctttaaaattatttgatgaaataggtgataagaaacacaaaaattaataattcatgtgacctttattacaatacgtcttctggtattagcatagtaataagtattagtgatttacataattggagagataacacaaatacaaattatgcacacacacatacatacatacacgttcctgtgcttcactcaaaactgaacagatgttatttggacattgtactgtgtatgccattgtaactaaagtccaatttgttagagatagtattgttattttattatctttagtatcttcaatgagtccattatgaatagtagcattaactttgcttatgactagcttaaatagaactttggactccataaaaatacgaacaaagatttttaatggctttagaatacagaagtaatctggtaaaagtattcttgattttaatagaaaccaaacaatcaatgtgcccgttagattaacagtgaataatcagattgttccagctcttcactaatgaacaatgctgaaacaacattctctgtaggtctcctcagatagacatatgagaacacctagaagtggaattgttacctcattagagtattcacatttttaattttatcatatattgcaaattgcttttccaccagcagcaagaagtggcaggaatttattattttaatttgcatatccctggttgaacaagttttcaagtttgttggacagatttttccttctgtgagttgactcttcatatatttaccccaattttccgttggattgtttactttctcttaccgattaatatgagttgtctgtatattctagattctagtagagttctggattatatgcacctaatatataagtctacaattccttatccaaaatcttatcgttgacttttcaggagactagtgaaaatggctacttagtggaacatatggaaatcatgagttataagtgtataaaggctaagtgcaacagtctaaagacctggtatcacagatgaagactgacatattgagtaaaccaggaattggctttattacataatgtgtcctttttcttgatttcagaaacccatatatttgctgtttcctgtacatgtttaggaagagtattcagaagagagaatgcagatatattgttgctgtttttttttaaaaaaatacgagtttaattcaattacccatttgattgcttgagtttattagttatggtagcacttagaaagagttgttttagataatgactatgattttggtacagaacctaatagtaaaaacaaaacatctttaattttatttaaagtgcatgtcagtcatgaagtcagaattgaattgctcttttctttgcttttaatgaaaattagcctaatggctgttttatctttaaaaagcaacttctagtgtttaataataacagatttaagtaaatattctgttaagacttaaagaaccatgtccaattactatatggataataacttagagatgctctatattggtttaaaataatgcaaatatcactggccactattcagagatatgtcaaaatcacttttgtttaatatgtgcctttctagtccttagatctactgtattccctaatccttttggggtatataatccagagatattaggacccattcagccagaaactgaaacatgccatgatggttagaattcatcagaaccacactcaaatgaatgttaagagacatagcgtgataaaagtgcatctgaaagagtatatgaacagatgacattacatacaatgttgtatataagagaaaggaaggaaagacattcatatcatgtcatattaattcatgtacactgaaaatacagaccgtgaacagacattctttcatttgttccttcatgtattcaataatagaatgcttctctaccacagatgattccaggggaatttggcaattgctggagatatttgtggttgtcacacatgggggaggagaaagtgctactggcatcttgtgcatagtgaccaggcatgctgcaaaacaccctgcagtacacagggtagctcccgacaagaaataattatccagtcccaaatggcaatagggctgaagctgagaaaccctgattgaaactcacattacatcctaatcgaaactactttgttccgttctgagccgtaggattcatcaaataaaacctactttttattggtacaatatttaaatccagagaccctgtagcatagtaattatgtatgcaggatttgcctcagaaagactagggttcaaatctcagattcaccatatgttaggttgtgccctaggcaagtttctgacctttcgtgactctagttttttaatctgaaaaaatggtaatagtattgctgagaggctctgcaatggagattgagattaattaagatgatttatgttaagtgcatagcagagtgtttgcacttagtcagtttccaacaaatggtagcagtattacctttacatgtactaaatcatttcatcctgacctactatgaaaagcctgatcactttccatattttactgtttttaagataccattgattagagtatgcattgttattttatttttcaccaagaaaaatgtgctgccgttttagactatgacacgctatcatttataaaacgtgtcccaatttcagagcagctaacctgttgaaataaaatgtgagtcttataattgattattgtaaaacacaacagtaagtcttctttgattaggtgcaactgaacaatactatgaccacattcagtagcaaaggcacttagaaggatataggaatatagcttagcaggaaggtagcatcgggtatctctctttagtaggatgagtatgcgtagcaatctctgaagcacccagggagccatccaagagctattcactttgcagcacctgtccactctctcatgacatctcaggtgcacaggaaggaaacaaatcgagatgctgggtcaaccctggcctagaagccttatgcatcccagaggccaatgccttgtaacatagtttccaaggtcctcaaaaaggacatgcttagttacaagaattgttgtacttggggacgccccacaattatggttttccattaggtatttatagttcatatgtagaacacctaaccaaggtgtaatttaccagtccccatcatttttttttttaatctgaagcaatgttgcctgctcacacatttgacattccaactttatcagttttctagggagaagggagctagaaagttgatcaaagtacaaattctcatacagatggacaaagggtgtttttaaccctttactcacagtaatatctgttagtttcatttattttatatttaaagatactgaaacctgaaacttagagcagttaaatgacttgccccaactcatgggctaataagcctagaacccagatgttcttatttctagactgattatttccaacaacactgtaatatcctaaagcaagagtcagcaaactatggtccaagggccacatttagtcctccacctattttcagaaataaagagttattggaacacagccacatttatttgttcatgtattagacctgactactttcatgccacattggcagaatttgagtttggcccacaaagtctaaaatatttactatatggtgttttatagaaaatgtttgctaacctctgctctaaagtataattacaaattggccaggtgcagtggctcacacctgtaatcccagcactttgagaggccgaaatgggtggatcacttgaggccaggagttcgagacgagcctggccaacatggcaaaaccccgtctgtactaaaaacacaaaaattagccaggcttggtggtgcatgcctgtaatctcagctactctggaggctgaggcacaagaaccgcttgagctggggaggcagaggttgcagtgagccgagatcatgccactgcactccagcctgggcgacagagcgagactgtgtcaaaatagtaaataaataaacaaataaattctaattataaattgtttaactctttctatgagtctatataaggagtttatagaaaagcatttgtttctaatgtttgattattaaaaatacccctgtattttttattttattttaattgacaaataataagtacatatatttatgaggtacaatgtgatgttttgatatatgtttacattgtggaataattatgcatacttgaaggattttagagccacagagcctgaacctaaccgtttctctacatcagtgttggccaacttttttctttaaaaggccaaatagaaaaatttcagtcagtttttgaggcttcatgggccatttggtctctgttggaaatagtcaattcatgctaggattggaacctagataaccagactcaagagcccatactcttcaccagtaaggacttaggaaggcagcaagacctgggagtaccagtttaaatgaatgttcttctaagcagtgtcctgtgctgctattaaaccagaccagagctttggcccttagttaagaactgtatgtataaagttttccaaaataatggcttcaggttttcacaaagtccttccatccaaacaatgcagattgtacccccttaagaatctgttcttaactgccatctgttctctgcattcttaaagtctaatcttaatacagcagccagaatgatctgtttaaaaataagtcagatcacatcactcctctgctgaaaactctcctatgcttcctaatctcactcaggataacagccaagatccttccaaagatgcaggacctatcctcctccatccccaactctatgactatcattcctactactctccccttgctcactagattccactcaccctggtgtccttttttttttaattgaacatacacatacactcctgccccagggcctttgcacttgctgtctctgcacagattgttctttcctgagatagctacttgaatcgttccctcacttccttcagatctttatttaaataccacctactcagtgaggctttccctgcaggcactttctaaactctccacatgccacctccctttgccccatacctaagtctcttattcctatccagtgctttacattttgttctttagcacttttcactctccaaagcaccttaatttctcttttactacacattatcaccattagaatgtaagttttatgaggacacaaaaagtttgtctgttttattcgctgttacatatctagtacctcaaacaatgtttagcagacaataagtaatctgtcaatatttatggaatgactcaagtgattttttggaagagttttggtaatatttcatttgccaaaagaattctgccaaaaagactttgaaacccccactttaaggtggagagcttccatagaggcttctggatgttacttgatggtcacacctatgcccactctttcactggccttgaacatttcaagtatgcagcttagtagattatatcttcacagtttcacaacactttccagtttaaaaatcaatgctgcattatgctttgtatatttggacagattatttttgaaatccataaatctctaagttttttttttttaagtctccctttggtgagctgcccttgattagttcaaaatgggaagagagaacctgtcattctttgtcaatcaggttggcacgtacttgacagcatgcagttatagtgaaagagagctgtgttgcagtggtctagcaaacctaattgtagttaagtaaaagaacagtcacccaacatgagaggaaagacaaagaaactcaactgaacaatgttgtgtttttccatccatcagccttcatttgtcagagtctgactgacaatctggactgcagaaatcaggctctaacacaatattgattccatttcatattttgtttcttgctacactttttagcaaacagtttctgtatggaatgagagatagtgcagtcaatatatgcgaccagggcacatttatattaaaggcttactttggtttttttgtcccagaaatcacatattgtttgtttgttttactataatattgtaattgtcagctcttgctgcagtaacaaacaatgacaaaattccagtgacatataacaacaaacatttattactcactcatgtgtctgcagatcagctgcagctttactccacactatgaatcaagttaaggtcttttcattctagaatatggatctgctctaaatgtcttctcatcccaggaccctagcggaaagagcagcttttatatggcatattattctctcatgatggaagataagaacaaggggaaccagcaaatcttgaactgcctttaaagttccagctaagagctgccacacagtcccttctgtctgtccatggtctattggtcaaaggtacacagtcaagcccaaagtcaatgggaagggaagtatattcactgcagggcagccatattaagagaggaaatgaataataatgaactgacaaatcaaccatagtatccacaaatgtcttaggatttcattgattcccaaatgcattttttagtatttcaacacctctgaacttgagatatatcgtacaatagataatgtttacaaagtgtaggtttttttgttttttggctttcttagtttacataacaatagtggcccttatcatcaatgatagattagatagaaaaactgttaattgtggggttgacaaaatagccaaatggtagaaggcactccttataagtaagtaagttatgagtgggagctaagtgatgagaacacatggacacatacaggggaacaacacacaatggggcctatcagagggtggaggttgggcggagggagagaaccagaaaaaataactaatgggtactaggcttaatatctgggtgacaacataatctgtacaacaggccctcatgacacaagtttacctatgtaacaaacttgcacgtgtacttaaaataaaagttaaaaaaaattaagtgaatggacacttaatgtttacaaaaaagttgtcatttttatcttgaatttcttttttctgtagcaatatttatatctcattcagatcagcttatttgattagaaaaccaagcattaatagtagatcttatgtctatttattcacatattcatataccttcatttataaatatatattcatatatatttagaagatcaattggaaaacataagtgccattcccttatttaaaactcttgtagcttctccactacagttctgagggtggtatacaagatccttcttttctctggcttttgctttctatttctactccattacttcccattcccctacgtgatagctccgtacttcttctgcttcctgtctttgcatgttccatgttccctcttggaatacattctctctgccgtccatccccttataatgaggtgcatgagctgtttctgctcccagcctttctgtcctgaccttcttgtctatcaaacacaaaagtgatcagttcctgctctgtgctccattatacattgcactttactagttgttatacctgacctgctctaaatgtagtatatatttgtgtgtctgcactccccattcctaccccagtgaaacatagtaagcactgaataaatgtttgtcgaatgagcaaataaataaataaataaataaataaatgtttgaacatacatggaaaggttgtttatgtcctccttataatgtgctttgagatatatattcttaatatatatataatcatatattctaaggttattagtaggtaaaatgaaaatttaaagaaattgagtacaagaaaggaaaacaaggaagaattttttcctttttgtactatttctaagaacaccaaatttctagttaaacacacgcacacacaatcggcatgatgtagaattagaaatatgttgaataaatcaattattagaaaatgtaaatatatattaatttgcctctgacttgctacttttaccctcaagggttttttttttctacctcttttcatcactaatctttgcttcactgcttgtcagatcagcaactgcccattattagtaatgccatttaataagagataaataaaagtaaaggtgcttagagttactccatttcaaaaacctatcagggctggatttcagaagagaccatgaaattctcctactgttattgaaccattactccctattacctaattaatacaagttattttcttaaaattatacctgacattgtagtgaactatcaatactatgaagaaaatcaaactctcctcgtatcataaggatcttaacacctggtacacaatcttgcattggaggggacattaagaataaggcatggaggaaaaaaaaaccttaatggaaatgttctgttattagaaatgagactttttggtggaaatcccatgacgactttcttgtctgaatgttctttgaagttgaacactttctccttacacaagccggccactataattagctatgtttccattttagtggtggccttcttcaccttatctgaaatcatataaagatgtgaggccatttgcgagataaaaggtttgctcaaaccagttctctgacctggatatcagaggtttggcaatcataaacccactaagagaaaccctcagagctattacaaggctatgtaaaactttatttcattttttgtgagaagggacaggattttctctcatttatattctggaagaatattgtagaatgtatttgagttcaagaggaggagaaataattaacataatattaagaaacgtcaattttggaaagaaataataagcatatatgcacatgtgcgtgtatgcacacacacacacagtatacacaacagattcagaaagaaggaaatagagatttggtgacacatacttcctggatataatctcaactctgccatttgcaagccacatggtcttggataattgacctaatctctctcaattgcagcatctgtgaaattagataaaactttctttgtaggagtgtatgtgtgtatgaaaagcacagtgtttgacatataataaatgttttagcaactgtagcttgttaatattatcacagcagttaatatcactatagcagttagttgccattttcagcacagctaataattttagtagcattttctgatctttccatctcatgtggtttctttggagttgtttcttgctttgttttttagcttttctatgtcacattttatttgcatggagaaataacaaattttacaatttatttcacatattctttaatttttaggataattgtcagtttcttacagtttattttccttatactcactgaagaaaatatgtacgaaagaatattttcagtgaagttaattggatttactacagttgacccttcaagcaatagtatcttgcccttaataactgacctatctttgaactaataaattcaacctgcaaataaatgtagtgaggtaaattgtagaaatttatcttcaaaatggtctttctaaagtgatctatcaaaggtgcatttaattagaggtccagttctccaaaaatgtgccaaggaaaagtagccacaaagaatttagagctgaaatgaattctttcacccattgctctgtttctatagaactgagaataaatctcatatgggtacttaaaatctgtactatgtcattgaaggatgaaaagatgacaatagtgatgatagaaggacacggtaataggaaacatttcaatagagggaaatgatgtgagtatgcaatgttcattcaccagaggactaaatctagggctattttggtgacttgaacagggaatattctacttcctgcaagtgaaaaatatggacatttcatttggcatgccacctgctcttcagtccatcatgtagcaagcacccacttagtactttggagctctaagtaatacttggactactcaaatgccagccttgttgccatttctgtttattcgccaataacaattttattaattaaaatttgtatgtggatgtcttaaggaaattccttgtagttgtcaaagcagactcctgatcctatctatctgccagtgccttctgagtagtggtatctattcttcatgatttttggaactatttatgggtgattgaagaatatggagtggatagagaaggatgctagtcatttggctgcacacaagaaacacagatgaaatttttgactatttctgttcattttctaaaggtacagaattttcactggattgtacttgtaagcaattttaaaggaagaaatatccagccttttgaatttgttacagtgttgcaagacttttttaaaatgttaagaatttttatcatataggatgaattaatactctcataattttaggtttgtttcttccataattaataactatccttaaagattgtgtgtgtgtgtgtgtgtgtgtgtgtgtgtgtgtgtatttcttgattttccagagcaaacgttcccattcatttgttttactcaccttgttatagttgctcccattgtaagatatatctagtaagtttactgttgttacctaaatctgtttgctgaattttaaaaatgggaacatgtagtaaatttgggggaccacgagctagtatttacaaagtaaaccgagaacattggatataaaaccttatttcatttaacctccaatgaaggatatattcagtattattatttgtattatttcttgagcttccttgcttatctgtaatatgtaacatggtggcaccccttttcatataattctctcctcacttctattttgggtttttacatgttcttgtttcagtctcttctgctctttctatcttttcttggttcaactttcttctcttatcctgtggaggcgaatacctaattctggctctatcctcttcagtcactctacaagtatcactgggacaatattgtccaactactatttttacctccaaacctgtattcttagccttacccctaatctgcacactacgcttctttttgcaattactttctgtacatttgcatcagtgttaatcacaggcatcttgactcatgtctccaacctgaaaacattattccttccatatagggacaggctcctctgtcttccctgtacccctagacagtttctcccaagttataaaatcttggtgattctgaaaattttctttttccccatcaagtcctgccagtcctttatccacaacataggaataatacttcctgaacatccgtgctgctcctgtttgttcaataagtactcggacctctaaaggcatttcctatgtttcttccaccagccccttatccttaaaatcttgcctccaatctgccgctagagttatcatcttaaaagagtcaaatcagggttggtatccaagaaatattacaaagtactaagctcttggtatatacaatcaacttgagagaaagagagggacgggaggagagggagagagagagagagagagagagagagagagagagagagagagagagagactttattctgtcctctataacacctgaatgattctgtacatatttatgttaacagagcattgtactacttcaaatccttatacaagcaaaactcctcaccgccttttggcaatggaacttgcttttccctctgcctgaaatagtcttcagtatgttgacatgactcatttcttcacttcattccatttcctgaagagaggagcagtcttctgtgctcacattgcctaaaatagagcccactgtcactctctacttactctttttaatctttcttcatagcatacatatacatatatatacacacatatacatatatatacacacatatacatatatatatatatatgtatacacatatacaggcatacctctgagacactgaaggttcagttccagaccaccataataaagtgagtcacatgaactttttggtttcctggtacatatagaagtcaggtgtacactacactgtaatctattaagtatacaatagtgtatgcctaaaaactaatgtacatgccttaatttaaaaatatgttattgcagtgttcaagctgagagccaaatcaagaatgcaaactatttacaataaccacaaaaaataaaatatctaggaatacatctaaccaaagaagtgaaagatctctacagggctaactacaaaacactgctgaaagaaaccatagataacacaaacaaatggagaaacattccatgttaatggaaaggaagaatcaatatcattaaaatggacatactgcttaaagcaatctacagattcaatgctattcctatcaaactagcaatgtcatttttcacagaattataaaaaactatcctaaaattcatatgaatctaaaaaacagtctgaagagtaaaaacaatgctaagtgaaaagaataaagcatgatattaaccaacttcaaactatactataaggctacagttacccaaagagaatgggacttctacaaaaacagaaacttggaccagtagaacagaatagagaactcagaaataaagccgcatacctacagccatctgatctttaacaaagtaaacaaaaaaaaaaaaaatggggaaaggactccctactcaataaacggtgctgggatagctggctaaccgtatccagaggaatgaaactggactcctacctttcactatatacaaaaattaactcaagatggattaaagatttaaaaaaataaaatctcagccaggtgcggtggctcacgcctgtaatcccagcactttgggaggctgaagcaggtggatcacgaggtcaggagattgacaccatcctggccaacatggtgaaaccccgtctctactaaaaatacaaaaaaattagctgggcatgctggcgcatccctgtaatcccagctacttgggaggctgaggcaggagaaccgcttgagccagggagtcggaggttgcagtgagcccagattgcactgcgccactgcacttcagcctgacaacagagcgagactccgtccctaaataaatacaatacaatacaataaaatctcaaactagaagaatcgcagaagaaaacctaggaaatactattctggacatcagccttcagaaagaattcatgactaagtccttaaaagcaaatgtaacaaaaccaaaaattaacaagtgggatctaattaaactaaagagcttctacacagcaaaagaaactatcaacagagtaaacagacaacccacaagatgagagaaaatatacacaaactatccatcagacaaagatctaatatccataatctatagggaacttaacaagcaaaacgcagataaccccatgtaaaaagtgggcaaaagacatgaatatatagatacttctcaaaagaagacaaacgggtggctaacagatatgaaaaaatgctccacatcactcatcattagagaaatgcaaatcaaaaccacaatgagataccatctcacaccagtcagaatgcctattatcaaaaactcaaaacacaatagatgttggtgaggctgcagagaaaagggaacattatacgctgttggtgggagtgtacattagttcacccactgtggaaagcagtttggggatttctcaacttaaaatgcactgtcattcaacccagcaatcccattactgagtatatatccaaaagtaaataaatcattctaccaaaaagacacatgcacttgtatgttcactgcagcactattcacaatagaaaagccaaggaatcaacctagatgaccatcaatggtggactggatgaagaaaatgtggtacacatacaatatgaaatactacacaaccattaaaaagaatgaaattatgtcctttgtagcaacatgcatgcaactggaggccattatcgtaaatgaattagtaggaacagaaaaccaaataccactttgttctcacttataagtgggcctaaacattgggcactcatggacataaagatggcaacagtacatactggaaactagtaggggaagagataaggaaggggcaagagttgaaaaactaactattagatacggtgcgcactatctcagtgacaggatccatcatactccaaacctcagtatcacccaataaatatataaatgtaacaaacctgcacatgtaccccttaaatctaaaacaatagttgaaattatttaaaaaaatactttgttgctaaagcttgctagcagtcatctgagccttcaatgagtcttaatctttttgctgatggagggtcttgccttgacggagatagctgctgaccgatcagagtagtaactgttgaaaggttggagtgactatgccaatttcttagaataaaacaaccatgaggtttgctatgttggttgatttttttcacaaaagatttttatgtagtgtgtgatgttatttgataacattttacccacagtagatctttcaaaaatgaggtcaaggctctcataccctgctgctgctttaccaactaagtttacagaatattctaaaccctttgttgtcatttcaacattgtttacagcgtcttcaccaggagtagattctgtctcatgaaaacactttgttttgctcatctataagtagcaactcttcatccattgaagtttcattatgagatgacggccattcagttacaccttcaggctccactttattctagttctcttgcaattttctccacatccagtgacttcccctactaaagtcttggaccctcataggcattcatgagggttggaataaacttcttccaaacaccttgtaatgttgatatttacctctttctatgaatcacaaattttcttaatggcatctggaatggtgagtcctttccagaagattttcagtttacccagatccatcagaggaatcgctacctagggcagctatagccttacaaaatgtactttttaaagaataagacttgagagctgaaatgactcctttgtccaaggactgcagaatggatgttgtgttagcaggcataaaaacaaaatctcttggtacatcttcatcagacctcttggctgaccaggtgcattatcaacaagcagtaatatattgaaagagattttttcttctgtgcaataggtatggccagtgggcctaaaatattcagtaagtaaaccatgctgtaaagagatgtgctatcatccaggctttgttgttccctttatagagcataggcagagtctattagcataatcttaagggccctaggatttttggaatagtaaatgagcattgtcttcaattgaaagtcatcaattgcattagcccctcaaaagagagtcagcctgtcctttgaactttcgaagccaggcattgacttctctctagctatgaaagtcctagatggcatctttttccaatagaagactgcttcatctacactgaaaatctgttgtttagtgtagctaccttcatcatcttagatattagcttgatcttctggatagtttgctgcagcttctccatcagcacttgttgctccacctttcacttttatgttacggagagggcttcgtcctaaagcctcatgaacaaacctctgctggcttccaacttttcttctacaatttcctcacctctctcagcattcatacaactgaacagaattgggccttgctctggattaggctttggcttaggagaatgttgtggctgttttgatcttctgtccagaccactaagacattctccatattaacaataaggctgttctgctttgttatcatttgcatgttcactagactggcacttttaattttcttcaagaatttttcctttgcattcacaacttagctaacgggcacaagaggcctagcttccagcctctcttggctttcgacatgccttcctaaccaagcttaatcatttctagcttttgatttaaagtgagagacatgcaactcttgttttcccttgaacatttagaggccatagtacggttattaactggcataatttcaatattgttgtgtctcagaatagggaggcccaaggagaggaagagaggtagggggatgactggtcagtggagcgttcagaatacatacattaatggattaagtttgccatcctatatgggcactgtttgtggcaccctgaaactattaaaatagtaacatcaaagattactgattacccatcaccataacagttataaaaatattgaaaaagcttgaaatattgtgagaattatcaaattgtgacacagagacatgaagtaagcacatggtgttggaaatgttgctgatagacttgcttgatgcagggttgctacaaaccttcagtttgtaaaaaaaaaaaaaaaaaaaaagcagtatctgcagagccaataaggcaaaactcagtaaaatgaggtatacctgtacatatacatacatgtgtctatatatccactcacacatatgtgtatgtgtattatatgtgcatattatacatatatgttgatatgtgtatttatcatatctaatacacatatatgtatatacatgtatatcacacacatatattcatattgtaaattgaaaattttctagtgctgtatcccaatctctagcttataaatatattgaatagatgatgcagcaggtatcttttgaatacgcactccaattttagaaatataaatcttttttaaaggttggaataatataagtagtttggtgttcagtgcaaaaggttttaatgtataaatactatgaaaacaaaagttagatcaaatgtatcaaatacaaatgatctgtattgggggacagagggacacattaaatttaagggaatatgaggagaatattgacttcctatgctcgatgagtgaaaaagaaaagtgaagtgggagtgtttgaaaggaaagatgagcttttccatgctagtacatcacaggttttaatactcatagaagtttttagatttgtataggaaatatgatcctccagcctttccaagtttactcttctactggaattacaaatcaaaactaataaatgtttactatgcttcaagtgcaatagttataaagtacctgattagaggtcccacattcagatgttggttatataaaatattcatgctaaatcatataaatgctaaaacatttgtatttgtgatgttctcttggattgctagatggagattaaattatacaaattcagctaagaagaaaaatgtgggataaatggaattttagtttaaaggaagtcaatgaaaggattaattaagtataaaataatcccattttaatttgtcatagaaatgagttttctgagacattgttgtaatcaataacgtgaagatgtaaaattttgcaaaaaaaatcattacgggaaatccaaaagcagaagagtagactctgtatttaactctagcagattatttagaaagaaaatagtctatgccatgaacctttcgactgtctgcgtgaacaaatgtctctagtaatacacactcttaactcaattcccataggctcaaagttgcaacagtatttatttgcccgttcaacggttttttgtttagcacttactatgtgttaggcacttccagggatatgagtgaacaaggtagttatgggtcttactctcatagaggataattctttaggaatggtcaaaactatacatatacacataatgtgattaattgtgatgtgttttgaaggaggaagcaaaggagttggaacagtttaaataagactgtaggttggcagtgggaacaatggtctttgctatcatttttcaaaaattccaatgaatgggaatgacgactgttgcattaagttgcctgtctccctctgacccatagtgattctctattatcagagaggtagggcatgtttttcagcatatgtgataatatcaaacagattcagatggtgaaagtaaaatttcttaatgcttagaaataacataatttgatcaaatcatttggatatgttattaagttgttgtaagatatgaagacgtagctgttactactgccaatagtataaactttggattcagacctagctgtgtttgaatattaactctcccacatcccacgaggttgtgggcaagctattcacatcattgtcactaccgtcactactatcccacccacccttgcttcattttcttatctgtaaagtggcaatctgttggaatcagggttggggaaggcaaatagtagtcattatacgaatggtaactatgctatcatcaataatatagtctacagctatgatgaagctaatcagaaaacattgtctattaccagtaattagctatatcaataactatcacaagaaaagtcccagctgtcagtgaataaatagaaaatagtgctttgtcttagagaaacacatacaaaatgaatggtggtgacagtgctttaagttaacttgtcagtttatatgtgtaatgcatatataatttcaaatgtataatttagacattgtacatgtatatttggcctggtaatttatggtatacataaatgataaatgtataggttgaaaattcagttactttttttccttttcttaaatcatttttaccttgctgaagatatgctcttttctctacttccttagaataatatattttattttctcttaaagtattttgagaccatatcaccatttactacaccaaaatgtttttttgcaaatgcggtattcaagggtgaatttatagtggctggggacctatttggaattcagtaagtaaaactagattttccttattcctcatctgagatcagagctatttctacctctagcaaagacatacagtcattccgggtgctgcattttcagggaacaatgtgttttcttggcaaggggcagtaagaccatcaattaatagttcttcatgtaaagtagctaaactactgttataaaggaagtgaaatttgcatacataaccattaacacatgaggttagttatgtacaattttgaccaaagtgcctgtttgctgctggtatttattataataagaactggaaaaaaatagtctatctcaagagcatgtgctgagcacccgtaaattgcaagagactgtactgggcagtatgagattatagtaatttgggatttcctactaatgaactgagagggaacaggtacaaacacagtatacgaaggaaacagtggcacggagacacttaaacacagcagtgctgggaggctccggggtaggggagggaggaagagagatacgggttaatcaggagctgctctctggggaagattgcccaggccctgactgatgcctgacattgattaattgatactctatcctagtgtttaacaagtgttccatccaaaaagtcttctgtaatatttaacttcacttccttcagcttcaatttctgcacaattcttttgtcgtctcatcaagagagctagtcagcagacagtaacaaaatgcttatattcatatacctgaaggatttttttttgtcatgcttcagccttctccagactgaagaaaagcaaataataaacaaaattaatcgttcttcagaaggcctgtttgactcattaataaataataagctttgatactgtgctttaagtgtttaccctttggaaagaaaataattttgacagtgatgtagaaataattatttgatatttatttcaaaacaaaatttatatccaatactaaacacagaattttgtaaaacaataagtgtataaagtaaaatgaacattaggattattgagattattgtagctaaaactagtgtttattcatataaattatgttaataaattgtattgtcattattgcattttacttttttgaaaagtagttaatgcctgtgtttctatatgagtattatataattcaagaagatattggatgaattttttttaagtttaatgtgtttcacatctctgtttcttttctctgcaccaaaagctacatttttgtgcccttatgtaccaggcagaaattgatctgcaatacatgtggagtctccaagggtatatttaaatttagtaattttattgctaactgtgaagttaatctgcactatatgggttcttttccccaggaaactgaaatagcagttcaagctaaacaaccggatgtggaagagattttgtctaaagggcagcatttgtacaaggaaaaaccagccactcagccagtgaaggtaatgaagcaacctctagcaatatccattacctcataatgggttatgcttcccctgttgtacatttgccattgacgtggactatttataatcagtgaaataacttgtaaggaaatactggccatactgtaatagcagaggcaaagctgtctttttgatcagcatatcctatttatatattgtgatcttaaggctattaacgagtcattgctttaaaggactcatttctgtcctggtgtgctgccatcaatacaaaagtagtcccaccttcaaggtagattaaattctttggggctttattgctttgcttgccagccttgatgcttttcatattgtttggtttaattcaaatcaagctactgcatcatagtgtctgtctccaacagctgtaaagaatcacaatatggtccgtgacctttcttttctttgttgctctttcttataaaagagtaaaatcggcattgaggcttcagtattttattgggtcaagaatttttagtgaaatgtcatgtaattgcttatttctttggcaaaaagctggcctgggataaacctttctacttttttttcttctccatatccatgttgaagtctaggtcacatttattcacaggctattacataaggagggagatggaaagccaggtcagttttcaaaaaatagctaatcaatggcttccatttgcaaatgagagtccagtgctaaatatacgttagcagtaggttacctgattctctgtacctgaccagaattataatggctcccattatgatgaaggttcctgagatcctgtaatcatggctgtttattgatcagtcttggtttctcagttaatgttgcaggcttggatacaatgaacctcgtcctcatgtttaaaactgcttgaaaacagttcaggtcaataacctcattatacagaaccagtttgtccttgcaaacaacattaccatgacttagattctgtctctaaggtcgctgcttagtttcccttgcgcttggcccaagcttcatttctagaagattgtttgttttccttacagcttacaagagacttttccttaggtagagttgaagtttgcacctgagcttaatgtccaaacaccagacactgaaaatcacaggtttctctgtagatatcaacatacttttattcagaaatatattgcaaccactccaaaaatctagaaaagtagtttgtatccagttcaagcccagtataatcatttttcataagctaacaatgtgctcagtatttagttggaagagctaggcaaagtcctgaaagcagcaaatttcagagtttccgttgatgttctgaagaaagccagccctcagagcagttaatatggtgactttcattgtagcaagccatgcagtgcacaaatggacaattgcatacgtttctatctactctttgttgatcctcaaagactttatgccttatggtgtatgactatgaattaaggtttgtcactaattgttagagatcacaaaggtacatgtaatttggcttttacttttgtgcctttgtaaaagagagagagagagatcttaattaaaagccactgagaaaatttttgctttcattatgtataaaacaatccaaatgcttgatgctaacttatcgcacctccacccacacactcaactactgggccacttggagatcagaactgggatctgccatgcctgagcatatctgcttcctgctgatgcattagtgatgtaaaaggagaattacttttctgaaataaaaagaaagaaccaggagctgttgctttccttctctttcacaacccttaaaaccatttttgtagcagacagcactgtttttttccttcctttttttttttctccttccctgtttccctattttctctcaatttgacacattgggagaagctgaacttaagggaaaatttattcctgtcttcccatttctcccttggatttggagaaaaatcaacatatcaagttggctgggcatggtggctcatgcctataatcccagcactttgcgaggccgaggcaggcggatcacctgaggtcaggagttcgagacctgcctggccaacatggtgaaaccctgtctctactaaaaatatgaaaatgagccagctgtggtggcaggcgcctgtaatcccagctacttgggaggctgaggcaggagaatcacttgaacccgagaggcagaagttgcagtgagccgagatcgcgctgttgcactccagcctgggcgacacgagcgaaactccgtctcaaaatatatatatatcaagttgataggggcaaaaatgcaagaatgatttgagaattatggggtttaaaaaaatagttgactcacgcacaacttttgctgtggaccatgaccttggaaacatctgaagattagctggggtttgcggtagcctgaaacacctagaggctcaaaaaatgacctcacagttttgaacatgacacccagcaatacaaggcagaaagctgtgagggctgtttaaatctctgcatggatcaaaaatttatttttaaaggttagagatgatttttctgaaggacactccattgctctgatagaacgtgaacaaagcctttttaaactttgagtccatatatcaaaatttaaaatttgtcctatttataatgcctcttcttcactctgggtcttgttacctcttaatagaagaggaaatgagtctgagtagcctgcagcacattttcatgagagaattgtgtttctgtttttgttttttgggggaggtgcatttggaaactgtaataattatgaagaaaatgatattctttaaaaagaaaatgaaaatctctcacgatgtatatgcaagatctagtatttaaatgcataattagtgtgtccaccgcttacaaacattctaattaaagacacatcagggagcaattctgtttcttaggaaattgacttgtctattggcacctccgcattctgcatcagacagcctgtctgtccagctcctacgctcacctcccaagctgagttctgattggaagctgggttcatccctgctcagtttctttcctctttcttctttccttcacttcgtcaacttctttaagatttcttttattttcaaagatggtatatttctggtttcttttttaaaatctctgactaaccaacttctttattttctttgaggacttcctgtaaaaggtcaaatacatattatgaaatgataatactaatgacgtataggtagtactaatctctgctgcaaaataactggaaaaatcttaggatcgtatgatcaaatacctctccatctttgtttagcacttcaactctctttctctctctctgtctctctctctctctctctctctttccctccctccctctccactctctccctctctccctctctccctctctccctctctccctctctccctctctctctctctctctcccccttcctcccccatctacacacatacttttatttatttgtatgttatttcttcatcttaacttcagaaattactgaagactgactatatgagttatataaattgtttaaaattttgctaaagttatagttttggtataatatattacattaatgccatagatgaaatagtctttaatgtgttccatttttccacacagtaataactaggtcctcaatagcaccccatttagcagtttaaaagcagcaaaaacaactgctatcagtaacaacaatataaactacaaaagaagccatttgttatttgatttttattataaaattgtatttttaactgtcttgagcttaagcatttaggtgccattttcttgtattcatactcatttttaacttaagttggaaaactacactttcagttaacttttaaaaatatgtttatgtactttcaatgcttacatcacctgccatgtattagaactgagagcattaatggaattttaaatgtcttggttactttctaaagtgataaaatgaagccagctggtttgctttgctaactttttatattatcaaaaaatgttacttacacaaacctagtaatatgttttacttactgctcttgaattatttttcaatgtaacagaaaaaggtgtgaggaactttctgtatttggccaaagcgttccatcccaacctttaacacaaaataattgctgtagacaaatggtcaagagggcaattataatcttccaggcatcatttcctcagatatgaactgcaaaatgacagcatcattagtcattttcaattacagtcagtcacaaccagggatgattcattttcccagctgttttgttgttaattaactagatgaagctgtttttttttctcccaatgagtttgttctactgccaacatcaacatcttaacatttttaaaaacttccttagggtttattttttgcctaacaatctttaatatattactcacaaaagatgtgcatctcaagatttatccacggtatagcaggtcaaatggtatttcattggtcgaaatgttgccgaaataaatataattacacttaaaacaatacttggatttcataaatcatctgccatgcgtacaatctcatttacctggtgtaacttcacttgtagcaacagaaatcaatagagagataacagacaaaaattgtcccctgaaatgaacaagtctattttgactgactcatttattgagcacaatttccatgccaataacaccagaataagttgggagaggacttctagaaagaagataacaatattagaggcatttaataatttataagtaaatgcatagcaacattttatttttttaaattacaagtttgcgactgggcgcggtggctcgcgcctgtaataccagcactttgggaggccaaggtgggcggatcacaaagtcaggagatcgagaccatcctggctaacatggtgaaaccccatctctactaaaaatacaaaaacaaaattagccgggcttggtggcaggcatctgtagtcccagctactcgggaggctgaggcaggagaatggcatgaacccgggaggcagagcttgcagtgagctgagatcacgccactgcactccagcctgggtgacagagtgagactccatctcataaataaataaataaatacaagtttgctttacaactgaaaaaaaagtcttggagtataagaggttgaataaatgctaatcccaatgcataaacttgaggagagcttcactttcccaatgagaagagaaaaaatttataatagatttttgggcaacttgtaaacataaacatttagaaatatggatgagattgtcaaatgtctaattatattcaatttcttaattgagtagcatttccatatttgcagtcttacattttataaaataacacactcatttagaaatacctggcacatttatattttatgaaacaatttcattcaaacccttcgtatgtatattctagaattgtagagctcatcaccttgctaagttatttgtaatatggcattgtttgaatccctacataatactctgaaagccctctggccaagattacaagcaacatatctgtaatcaaaaaattaagaatatttaccttattgcagcaagagcgtaaaacacttcagagtgtgggcatctcagtaagagggcattggaaaaagcttcttacagagttcagctggctgcatgattctaaggaggaattcagaaagtagaagccatttctggattagatgctttcaagaaacagagtcaatgtagtgattaggtatcttagtgtttatctagaagatgagattaaagtagggctagacacgtcgttggtaaaggagcagcaatgcctcatattagtcatttctgtgatagcagaaaggccttgtctctgtcttgtttcaaacacggccatggggtggccttgtgtctgcctagtttatttctatgagtgttttttaacatccagctgggaccatcatggcctagctagctgccagctgccagctatcagcagagctatttttcacgttctcaatgctgtcgctgaaatttttatcccaaacttcaatacccattcacaaaatattaggaaaactgtttttttcatttttcttagatatgattttggttgtttgtttgtttttgagacggagtttcgctcttgttgcccaggctggagtgcggtggcgcgatctcggctcaccgcaacctacacctcccaggttcaagcgattctcctgcctcagccttccaagtagctgggattacaggcgcccaccaccatgcccagctaattttgtatttttagtagagatggggtttctccacgttggtcaagctggtctcgaactcccgacctcaggtgatcaggctgcctcggcctcccaaagtcctgggattacaggcgtgagccactgcacccagccagatgtgatcttttaaaaattcccaatagactaacatattctttctgctttttaagttgtttggctttttaacaaattctttgaaagactcgtttacaatgatctctgccacgagtgattgtgaagctatacattaggaatgattgctaaagatttatcaactttctttgcctccctttttaattaagcaaattctgtcagaatacttatgtaagcatcacatctcttgaggttatttcaggctaatatacaacattgtggttccgaataaaataattgagacataagagatagtataaagtcttgaatatgagccaactttcttttctgagagaatatttgagtgaaaagtctcatgtactcagtagctcatgctgaaattagggaagcattttagagatttgaatttcacctcttgtcctcagttgtattagttacacttaaagagagagacaaagagacatagatgtttcagttacaatattcgaatgtatgcctgtatatatacagccgtaggtagagtcctttatttattcagtagatattaattgcatgccaaccattgacacaagatatatttttaaattttgaaaatctcaaactcaaatagagtttaaaactatattctagtttacttttttaaacaaatgattttttatgattgtattaaacaaatacattatttttccttacttattctacatcaaataatatctatttctagaaggcttttttccttgtcttaatgatagaaaacataaaaatcatttaatattttttaaatatccaaaaaatatgaggcaagaaagcagccacaattgtagctaccttaggaaacttaattaaaaaatttttttttatttttaattttatatgtgtataattgtacatatttatttgtgcggtacaagttatattttgcttattttttataatttcagtagttttgggggtataggtggtttttggttacatggatgagttctatagtggcgaattctgaaattttttatgtatccatttcctgagtactatatactgtacccaataaatagtcttttatcccttacctcactcccaagctccccacttagagtccccaaagtccattgtatcactccgtatgtctttgtatcctcatagcttagctcccacttacgagtgagaacatatggtatttagttttccgttcctgagttactttacttggaatagtggctgccagctccattcaagttgctgcaaaagagattcttttttatggctgagtaatattccatggtatatagataccacattttctttatccattcattggtcgatggacacttgggttggttccatatcttgcaattgcaaattgtgctgctatttttgtgctgctgctttcttttttgttatttccttttctggttttggtattagggtgatactgacttcatagaatgatttagggaggattccctctttatcttttgaaatagtttcattataattggtaccaattcttctttgaatgtctggtagaattcagctgtgaatccatctggtcctggacttttttttggcaatttttaaattactgatattcaaccttgctgctcgttactggtatgttcagggtttctttcttttttttttttttttttgagatggagttttgctctttcacctaggctttagtgctgtggcatgatcttggctcactgcaacctccaccttccagtttcaagtaattctcctgcctcagcctcccaagtagctgagattacaggtgcccaccaccacgcccagctaatttttgtatttttagtagagtcggagtttcactgtgttggccaggcaggtctcgaactcctgacctagtgatccacctgcctcagcctcccaaagtgctaaaatcacagacgtgagccaccgcgcccagccaaagcgttcagggtttctatttcttcttgatttaaactaggagggttgtgtgtttccaggaatgtatccatttcctctagattttctagtttgtgtgcataaaggtgttcatagtagtagtgaatgatcttttgtatttttgtgatgtaggttgtagtgtttccagtttcatttctacttgagcttatttgaatcttctctcttctttccttggttaatcttgctaatggtctatcaattttgtttatcttttcaaagaactatttgtttcatttatattttgtatttttttgtttcaacttcatttagttctgctttgatctttgttatttcttttcttctgctggatttgagtttagtttgttcttgtttctctagttccttgaaatgtgacattaggttgtcaatttgtgctctttcagaatttttgatgtagtatttaacactatgaactttcctcttagcactgtttttgctgtatctcagaggttttgataaattgtgtcactattaatcatttcaaaaaatattttaatttccatctcaatttcattgttaaccccaaaatcattcaagagcagatttcttaatttccatgtgtttgtatagttttgagggttccttttggagttgatttttagttttattccactgtggtctgagaagatacttgatatgattttgattttcctaaatttattaagactttgtggtctcttgtatgacctgtcttggagaatggtccatctgctgataagaatgtatattctataattgttaggaagaatgttctgtaaatatctgttaagtccatttgttctagggtgtaatttaagtccattgtttctttgttaagtttttgtttcagtgacctgtctagtgctgtaaatggagtattgaagtcccccactattattgcattgctgtctatctcatttcttaggtctagtactattgttttataaagctaggagcaccagtgttaggtgcatataaattgagtactgtagtaaatatcttcttgttggactaatccttttatcattatacaatgtctttctttatcttttatttacggttattgctttaaagcccattttgtctgatataagaatagctactcctgcttgcttttggttcccatttgcatggagtatctttttccgtccttttaccacaagtgatattttgatacaagcatataatatataatgatcaaatcagagtgattgcagtatctatcaccttaaatatttatccattttaaattttaaaaggaaagctatattcagaaatcactttttcttgtaactaattcctgttcttcataaagcagaaatttcatagtttgatatagttgtcttaacatttaatgaatattttcaagcaaagtatatacaatggagaataatgctcagctgcaaaagtcacctataataaatctgatttttccatttacaaacaaaagaattcccaaagtttatccattttggtagaacacgaattcactctgttgagtttggagctcttgtgcggaaaaccttggacctgcaatttagttagcatattcaaagttttaaaattatggagatgtagtcaagaataggacttgataactattatcccactgatacgctatttaaataagttgggatttaagtacttatttgatttccttaaatttgcttatagatgattaacatgtattgcaaattgttaccttttacagatttctattgagcactgcttaaattttattatatgatgaacacctgactagttgctacagccaaacattttttgttatgcaaatgaattttacagcttaattggaatgatgagagaattgaaaatatgggcaaatgccagagaagtgaaaagcaaaatgaagcaaaacaaaaaagaacttgtataatatataaataatccatttcaactctacagtacaccaaactcttgaaaaagtagcaagattgtttttgtgaacagccaaatcaaaaactgtagtcatttcataagtatttgctaataattataaaagattggaaattatacagttctgagcttattgaacctttgacccattgcagtgtcctcagacatttgtgatacattggtagtgccatttaattttaaaaatccacctctacattagagattatagtaacccctcatttacctatctggaaataagagtgggaaagataatattagagtaaatggacagactatttagagtttatgtattaataaaagagaaattgcatgtacaaacatgttattttctaggtaactaaaacctagtcctttaataaagcactgaaaaaaattttatcgtaactattttaatgagaacttttcttgaatatcttctgttttgcttcattgagcagcgcataatatctaaccaacaaatttatagtgctttgtagttcacagcatttttaccatataaaatatctcgtttagtttctccaacaaagctatgagttaggtggtattattatatccatgtttcaaggatgataaatcttagtgacccatctcattttccaaggatcacacaaccagtagtagtgaattaggaacgaaacctaagacttctgattctaaatcacaatgtaaattaacttttcttaattttcaggggtgtcgttatcacatcaatttttgctctgtttagtgatacagtgttatatgaggaacatgaaattcaaagcaccctttcttcagttgagacccagttgaagtggttaatttgcttttagaagctagactgtaagataaatacatacctttaagtattaaagctaactcaaatcactgagatacttacaccatgagaagagagtggaacctaagtcaactggtagaaacatagaaacagcaaactttgatctctctttatcctcattctgaggggcaatatgcttactgagtggaaagatgggcatacccccagcagtatttaaatcaatccctaatctatcactatctctccttttctctctatctcagcacatataggtgatttcctataaattaaatggtgtaggatgagatttcatcccatgttgaaaggtcatttcattgataaatgactaagattaccacatttctcagttttaagtttttcatgttcattgtctcctattgctactttctgttatcagaatgattacttctcattgcttttagtattctgtctttgtagggttacagaaacttcacagggaaaccagaagatcaaatatattactcactagtctcttagaatatttaatttttagtgtttaggttctgatgtcaggacaggaaaatatcttccgtgagtgatgacttccaagggtggttttcctgactaatcagaggcattattttttgtttgcttttgggttcaagactgatttttaataaataaaaaagttacatttattgatatgctagtaaatatttacatcatgcattctggataaaaacattgaaagccttgatttgacttgatgtcagacacaatagacatagtctcaagagcactgatgatagttaaattaggaagtgatgaattcttactatatattatcttttgttcttagcacagtttattttatatttataaaatttaatttatattaatggttatgtttaataaccgattagcaaaattactgaaatgtgacaataatatctctattcctgtttctttcctgctttatccttttaaaatatattatttataagtatattttaaatttataaaagctacattgtgctataaatcttgtttcttagcttttctaacattcataattgtgttttaaagatccacccatggccgggcgcagtggctcatgcctgcaatcccagcacattgggaggccaagatgggcagatcatctgaggtcaggagttcaaggcagcctggccaacatggtgaaatacaaaatacaaaaattacccgggtgtggtggtgcgagcctgtaatcccagctaccgggaggctgaggcaggagaatcacttgaacccaggaggcaaaggttgcagtgagccaagatctcaccactgcattccagccagggcaacaacagtgaaactccatctaaaaaaaaaaaagaaaaaaatccatccacattgctctacatatacccttatccatttctttcacatacatacccatgttggcctcaattccccacaatgcagcaacaaactttcttgtacttccttatgaccttaagaatgtgagagaaacttctccggtatacactggtgagggaatatgatcagcagggttttttgtttgtttttctgtgttttgctttttaacttatgcccacctttctgttggcagtcagcagccacatctgaagttatagctctctgatttagacaaggcttattcttccctttgttacaacctagtccctatagggacctgaatttgtgaccctagtctatgagattactttttaaatacagtttggttcaggatttataaaagcctaataaggctgggtgtggtggctcacacctgtaattccagcgctttgggaggctgggatgggcagatcactggagtccaggagtttgagaccagcctgggcaacatggcaaaaccccgtctctacataaaaatgtatgtactcagtagtactactcagtagtagtactgagtagctactcaggaggctgaggtgggaggattgcctaggaagtcgaggctgcagtgagccgagatcttgccactgctctcccgcctgggtgacagagtgagaccctgtctcaaaagaaaaaataagcctaataaaatgattgcacgcctggaaaacctacataggctccttcaagtcccatatatatataaagtcatccatggtatgtagttcacattgaagtcaagttgggggaaaagaaacttatttatctctttctcttttcctttattcaagtagcaattttcatttaattttattcaattcagaaatatttactgaactcctcttattaggaagcactagactggatataaagaaaacatcgtacaaggcatagaggactcagtcctgccttgcgaagggcacatagtctgactggaaagacacatgctgacagggtagactgtgttaggaataatgctcaaaatcctgaggacattgaacactcgaacaaaggattcttagcaaagcaattttacttctgcacagaggggtgcctccttggccagttgccatgagagcacacctgaacaaaggggcatgagagcctttattcctgacgcaagtcctgcccctgtaccctttccccccattggctggggttgggtcgtacaatctaaactaatcccagttggctaaacatttgatttttttagatagggtgggcacgtaaaatcaagtggagaggaaggggaaggggcgtctgtaatgagctagaaagttagtcctctttccaaataaggaaatgaatgtgagctggtactgaggtgtgcctgggcatctaacaaaggtaaaaaggaaaaaggagaaaaatcagggggtactatgaattaaagaataaaagattgatcagattatttgaagagaaacctcatcatatcccacaactggaagaaacaatttgatggcaagtttctcttcgtcgtttaccagctcaaaatctcaactatcaaaggcaagaaaaatacacacacacacacacacacacacacacacacacacacacacacacacccctctgcctttttctgtatggccaaagccttcagtccagctgaccacttcccactccagttaccatgttagcctcccaacttgtatctctgcacccttctgataaagcctccacaatgcaaaacacgaatcgtatcatatggctcttcttctctaaacacttccatctactctgtggttttagaagagaatgtaatagtcccacattacaaggtcttaataaattgcattcttgcagctctgtatcattacttgtaaacactgtagtctagatagccaggacacactgcatttcttttttaaggctcgatacctcttgccattttgcacgtagttttccttctgtctgaaatgccctttttccacctggcgcttgaatggccccttctgaaaacttcctagtcgtctttcaaaataaattcaaatgttagcttttgtgggtaacctattgacctctccaggctgagttaagctgttcccccgaggtgtcttgttgaaatcattattttttcctaaaatctctgttctaatttacttacatgtctgtgaatgcttagaggttacgaacttcagttttgtaagcttagtaactggcacaaagtctggcacagagtagcacctgaacaattatttttctggaataaataaagtaatggtttcattgaaatgattcgcattaaattaatgattagcattaaactacaacgtgtatatgaaacattccagttaggttgggttcattccattcctatttaaagagtttgtagtttctggctcttttccaactctgattcttcagactagaaatgcaatttctgctaatgtatttattttaaccaaacccgacatcaatcaagttatttgtattcctcataaggtaagcataggaatttacagtgatacaaaaacgcagctattatctcttataggcactggtaaagcttttgtgactagtgctactatactggtaaggtattgctgcttgtaatgaactaaatatttcagtggcttaacacaataggagttcttttcttgctcacatgacaacccagcgtatgttttcctagtcaagcagctttcttacatatgttattgcagaaacctaggtcctgttcatcttcttcctctgcctgccattcccttggtagcttttctctgctcgggtttcgcaagaggatgaaatcctattgaaaatgatctgagggtctattatgttctcaagaatggtacatatctagtctatgataaatgctcaggtaactgattaggtgtaatagatatcttaggattttgtcatgaacaatcagcatcaacaccacctggaaaattgttaaaaatgcaaattattgggctccacccagtatctactaaatccagaactccggggctaccatgcagcaattagcaaggtctccaggtgattctgttgatcctaaagtatgagaacaactgccctagggcgttaggacttaattctctcctcagtaagttgtaaagatttgccgtaggacctaagagtcttctgcttccagcaatagaaaggaaaaaaaatgtggaaacctcactaaatttttcaaagcctcagccccaaactgacaaacaacacttctgctcacattctgctggctataaattatcgtatagctagctgcccagtgaagtggaaccagctcaggacggcctactgttatattgccaggcattttttgagccacttgatgttatcttcttggtaatttaaatttaaccgtggtaggaatatttacaccacagaaattggcaaacactaaaaacaaggtgtttttaaacaccctgagatcagagatccagttgatatacatctaccagcacaccactggccatatacaggcttgccttatgccacggggagctctgcagctgaagtagcccttcaaacttgtcctgctttgagccaaattaggcctctatactttcaccttcatcagtcactgaatgagggctgcctggggaaaggcatgaacttggacaaggcagctctctgcagctcaggcagtccctgaagggactgacagttgaagaatgtctactgacatcatttccatcatctagaacaagagtctttctttgaagggggctctgagtagcatattcccgtgtccactgcagcccctccctttaagagactctgatataattgactgggggtgagccagtacattaggattttcctaaagttatctggataattttagtatgcaaccacaatagatactcttcaagaattaagctagttgctgagagggaactgttttttgttggtttgttttcactaatgtttgcactctacttcctttaaataaaattatgcctggagaaagggtttttgtatggagcaattgataaatatttgtagggtggttggctaaaataattataattcctttaaaagaaattctacccactaaagttaatttagaagtaaaatataatagaaatccaataatatattcaccaaatggattaagatgttcatgaattatcttcaaagtgttaatcgaataagtaatgtgtatgcttttctgttaaagaggaagttagaagatctgagctctgagtggaaggcggtaaaccgtttacttcaagagctgagggcaaagcagcctgacctagctcctggactgaccactattggagcctgtaagtatactggatcccattctctttggctctagctatttgttcaaaagtgcaactatgaagtgatgactgggtgagagagaaaatttgtttcaattctaaagatagagataaacctttgtgttattgactgtgcaaaaagtcttagagtacattccttggaaattgactctgattcaaagtgttgcatgacaacgggatatggggagtgttctctggagatacacccacaaggaagagaagagcacaagggagattgtgggagagtctgaaatgtgatttgtctgcagcagaggcctaagccagtctcgcaggagccctacatctgggctggctgtgcagagctgtcctgaattgcaggcagtgggcctggcccttgtattcctgatccagccagccattggccaggggctggctgctgcctgagagtggaaggacaacttggacaagttttctgaggccgaaggcaattcttagtaaggaacaccattaacaaccaatattcctagcatccagggatgtgtgcattgttcctgaagagggacaagtatgtctacaaaaatcacagaaaccacagaaacacacacagtcctactagcacctctccctgtcccatttgcaaacaatttaagagctctcccatttttagttcaagaaaaagaaaaatggattgggaggaccacaagctgacttgggggaggaatatttcctcatttagctgtagttttaacttttgttttcactgcatattttcagtctattttattttctttcctcttcagttgttgatagaaggtattcataaattctcatggcaatgttaatgctggctttgactctcaggggaaagaggccagaaaacttctttgctgtaccattccataattaggcagaactaaaaacatctttgggtgttgttttttgtttttgtttttttttttgccttgtctgcttttcaaagatcaaatgattgaagcattaaagcatggtgactggttcttcaggtaaagttgatttttattttatgtcaagtagaaaaatactgaactggaagaatcacagctggggtagcacaatcataattcattagaaggcataaatagtgcttggattaaaagaagccctacaatctggggacagtgcatctcatgtgccctctgggattactcggcagtcatcagagttagatttaacgactttggagacttaagcattatggttttttttttttgtcaatctgggacactgaaattgctgtatcagggttatactcaactgtgtcaggtttatttgtttttatgagctgtaatttttggttccctcagcgcatatgcatagtttgttcctatgttatcatttattggtgtctgttttctggctgtctctggtaggttcagcctcagactctgtaactccatgaagagattatgttccaatgatgttttataagtttgttaaactctgaactcatgagtttatgtcccatataagccacgttacacatggtaggaaggctccaaaaccagggcgccgaaatccatttaacgtgtaacttacctaaatgtaacaatgtttataagaaaaatacattggaagttccagttttgacttccagcaacatatataattcatccactttatttattaacttccatgtgttgagcatcatactggtgctgcgagtacagcatagaataaaagtctctcctttcataaaacatatattgtaattgaaagagaaagacaataaactaatgaagaaaatatatactgtctcaataattataagtgctgtagagtgtagtctacagattgatgtcaatgggtatttgttagacacacagaatctgaggcccctatcctagacccactgaatcacaatctgcattttaatagaatccccaggtgaatcctgtgcacactgacatttgagaaacaccattacagagaacaactaagcagggagatgggatgagggtattattgtctatagtgtggtcagggaagcttgtctgttaagagaacatcagaaaactgatgtaagtgaggaagtgagcctggtgtatttctgggaaaattattccaggcagggagagaaaagactgagcaacgatactgaagtaggaacaagatgacggaatattaaggagatcagtgagactagaggagtgggtcaggggaagtgtgatggaagccatgagagatactcatctttcatagcactgccctacttccttctccccaacatgagggtctcatcaccccccaccactcttgtcttctcctatgtcctccacattgctgccagtatggagagtctgggaatgccctcagctcaaagctgtttggtgatagctggcagagttgtggtagtagctaaaaaagaattaagggaaagaggaattttctcaaaagcaggtgcttttcatcctctttagcaaaccgaaacagatctgagcattaagtcaagatgttaaatacacaaatgttgaatgaaaaaaaaaacaaaaggtagtcatttaaattcagagctgcttttattaaaataagattttcttttttctttactgtggtagttcaaatatcagaataaagaattgtttctattcccgacttcctgacttgcaggaagttaatcagaaataaatgcaatataaaaaaagaaaatctaatttgtattatgcttcttgtatatgtttattatttcatgtactgtattacaatgtaatagaatttataattcattatagcagattgtttccattgcattcctactattaaatatgtagaagctacacatatacttgtagctttaacatatatgtctttatcctcaaaataactgcaaagaacatatagataatttttaaagattaaggagcctgaggtttagaggggagatagctagattaaggccacacagctagaaagcaagcaagcaagggtttcagtccacatgtcaagctccacagcctgtgttttgttttgtggctgtgctttacactatctctctgtccaagaacctaatggaaaattacagatacagatgcagctggccagcagttaatataatttaactcaatcttaaatttatctggagtaaaagtgatacaagtttccgtgttttttcttttctttctttcttttttctttgtgtgtgtgtgtgtgtgtgtgtgtgtgacagaatcttgctctgttgcccaggctggagtgcagtggtgcgatctcggtttactacaacctctgcctttcaggttcaagcgattctcctgcctcagcctcccaagtagctgggatacaggtgcgcaccaccatgcccagctaatttttgtagttttagtaaagacggggttgctccatgttgatcaggctggtcttaaactcctgacctcaagtgatccgcctgcctcagcctctcaaagtgctgggattacaggcatgagccaccttgactggcctgtttctgtgttttttctacttaagaagtagaaaaaattggttcactctatttgaatttcttagaaccatagaaatccaaacttggaataattattgcaattattatctagttgagtattcttcttttatagatgtagaagctgaggcctaaagttgcttgttttgttttatgaacactaaaccaaactaccttgtggctgcttacttaaattataaattataatggggtggccttgcctgagctgtataaattgttttaattatcaggacaaatcaacatactggaaaaaaaaagcaaaacttgcaattgttgttgcttagacacctgtccatatcagtttctattgttgcatagaagcaccccaaaacttaacagttcaaaacgagtgatttattgctcataattctgtgtgtctgaagtttgctctgtgattagctggatagttattctgatggtcttgcttggtgttacttatgtggatgcagttatctagcaagtgaacaggagctagatggtctaaaatgcactctctcagatatctgacagctggctgttggttgcagaaccttgattcttcataaggccactcatcatcctgtaggctagattaggcttcattacatggtattctcagggcagttttccaagagagggcgggtggaagctacaagaccttctgatgcctaggctttgaaacgtgtaggttacttctgctaagttatattggtcaaagcacctcaaaagatcagcccagattcaagagatgaggaaattacttcatctcgtgaaaggaggagatgccacatcgcatatcaaaggggtatgcatattggggatagaaggttttattgtcaccgtatttatacacaaatcactacattggggaaaaggagggaaactggagatcaaaagtgttggtcttaatccaacttaattctcaaaaattaccatgcgttagaaccacccagttcttcgcaaagtatagattactgggcttcaaccccagagtttctgatttactagctctggggtgagacctgcatctctctctctctctttttttttgagactgagtcttgctctgtcacccaggctggagtgcagtggtgcaatctcggctcacagcaacctctgcctcctgggttgaagcggttctcctgcctcagcctcctgagtagctaggattataggcacccgccaccacgcctggctaatttttgtatttttagtagagacagggtttcaccatgttggtcaggctggtctcgaactcctgacctcaggtgatccacctgcctcagcctcccatagtgctgggattacaggcgtgagccactgtgcccagccaagacttgcatctctgaaaagttcctaggttatgctgatgctggcctatgctttgagaactactaccacagacatacagtgagtggggaagaataaattcatcccttctgctgtgtgcagcaaggagtgggattccaatgagatccagtgctgtgaatgctaaagggaaatccatcttattttagcacctctactccccatctccccaccccgaggatgttatagcttagaagttcaaggagatggacaacacactaaaccaggcagtatttgccctgcagagctgttcagtgttcctggatgagacctctgagaagaaaagccataagttcctctagagactttcacaatcatttaggtagacaggactttgcatgggtctgaaggcttgcatggcagatggaggcaaagagccagcaaatctggttgtaaatgtcaatgtgaatcctttcttatccacaagctgctgggcctgagaacattaatgttctacaatacccgatttagcatttttgaaagaaattgcatatagacatgcttaatgtgaagactccaaatcaggatatttgattcaaatgtctcttggtaataactatggaatgaataacccattgtatatggacatatagaagagccagttaacagagttttctttttttttttttttttttttttttttttttttgagacggagtctcactctgtcgcccaggctggagtgcagtggcgcgatctcggctcactgcaagctccgcctcccgggttcacgccattctcctgcctcagcctcccccgtagctgggactacaggcgcccgccaccacgcccggctaatttttttgtgttttttagtagagacggggtttcactgtgttagccaggatggtctcgatctcctgacctcgtgatccgcccgcctcggccttccaaagtgctgggattacaggcgtgagccaccgcgcccggcccagagttttctagttgattaaacactggtaaaatcatctcttcctgtaattaagtttggagagagcaagtctcaagtgtaattaggaaagcacagtattggaggtcaagaagcctaaattctgatatctcagttgtgctaccaactatataagggatcaacagactgtttctgcaaaggaccgatactagatattttctgctttatgggtcatgtggtcaactctgtcattgtatactaaaagccacagacaatacctaaataaagggacatggctgtgctccagtgacactttatttacagaaacgaggcaggtaagatagatttgacccttagtgggctacccatttccccttagcactcagccttcctataaaccatgaagcgtctaactacaagtacctgtgagtcttcctgagtcctttctctgcctgtaggagtagctctcccacttgcagagcaggctggaagctggggaggagattatctctggaatagcacttaaccaatggacaaaagctgggggataaaggtgttggtcttcatagttttcatactgctatgaagaaatacccgagactggataatttatacaggaaaaagaagtttaatggactcacagttccacatggctggagaggcctcacaatcatggcagaaggcgaaggaagagcagaggcacttcttacatgacagcaggcaagagagcatgtgcagggaaactgctctttataaaaccatcagatctcatgagacttattcactatcaggagaacagcacaggaaaaccccacccccatgattcagttacctcccacatggtccctcccacaacacgtggggattattggagttacaattcaagatgagatttgggtgagaacacagccaaaccatatcaataaatatcccaccttcttctccccttgggtaggacacctccaatgcatgttccacactaaaaatctccagtgaattgggcagttgaccacaatgataagcatacttattagcatgcctcgtataggcttccttccgatgtgtaggctttcttcccattttggcagaatctggacccaaccccacatctcctgagtttgatttcagtcctcttcagtattctcatatatctcaactttgttccctgctgagatacaactgacagatatatatgtatcttcagctctgcagctctatcttctcttctaccatggctttctgggatcagctcccaattgaattatttgtatttaaatccttgtctcagggtctacttctgagcaaacctaaattaatacaagtcttagaattagtgccacagttataccttttgagtaagttatgttgcaattcccattttatagatgagataaccaagggtcagaaaggttaaataatttgtccaaggttacagagctagtcagtgacagagtgggtattcaaaaataagtctctatgattccagagcttatgctattaatcagtgcaccatgtatcaagcagtgatttagttatcttcatttgaattttttgaagtctctatttaaattgaatatcaaatcctcacatataaggttatttatacctttttatttgttttatttatttatttatttttgcttaacttttttttattatactttaagttttagggtacatgtgcacaatgtgcaggtctgttacatatatatacatgtgccatgttggtgtgctgcacccattaactcgtcattgaacattaggtatatctcctaatgctatccctcccccctccccccaccccacagcaggccccagtgtgtgatgttccccttcctgtgaccatgtgttctcattgttcaattcccacctgtgagtgagaatatgcggtgtttggttttttgtccttgcgatagtttgctgagaatgatggtttacagcttcatccatatccctacaaaggacatgaactcatcattttttatggctgcatagtattccatggtgatttatacattttaatttgaacttcactcacctctacaaagttaaataaagcattccatttccatttcaataatactttaaatatctaggcagttaaagcatgaggttacttggcacttaaatgtactcttgtcatactacttttgttggcttaaattgcaaaaaaaaaaaatggttaatttattgtgacaataccctacatttatctgcagtgatcattttttttgtgaaaatggccttcgtttatctgcagcaaaggaaaaagaggatggcaattagttcttgcattcttattcctctcttgggtcctgatccttctcattaatagaaacatggcaggggaggggtatataacccacaccctttcctgttgtggttatgtttccactgttgattctgcttcaggtgaacctttaggattaggcaaataaatttccgtgaggccaaatctttttcttcctcattaacagatgatttctctgctaaaaacacttacgacatggctatactattgccggttttatagttacaggctctaaaccttgaaaacttcctcaaagtctaatacgtcaggagcaagcttttgtacaaaaaatgtgaagacccttaatcagttccaataacaaaataaatccattttaaaccctatcccaagatactgcaaggccttggagcagctggagagactccttaactcttgacattaattaattaatttaaaaattcatatttgtatgtatcagtgaggtaagagtgcttgaaatataatgagatgtgtcacactgtagaaaggggagtgacaacagaaagccctggctggtgaggccccagcacttctcacactcatcagaaggaagtctttccatgaaggcagtagggggtccctggtcccaggccaggtccttcaacaatgctcactggttaacaggaaaggcactacagtggcatcattgttaacatccaagacagtgatagaatgtgaaacttctactgtttagtatttagtattcagcatttagatgttaattatccattttgtgatgaagttccctttcttctccctctcttaaccttttggtagttttattgcatggttaccatttccagttagggttgtgctttggggtctgaactgatgaaggaagagaaactctagttcatcatttctaggaaaaagagaaggctaacatcaattctgatgattagagattttttgattacctatgtcctgcattttaacagaaataaaatgttaattacagtaaacttactttaaccttcttatgctatttaacactcttcaagaaaggacttttgcttgaaatcactacagagtataccataatcttgactgtcatactctgaccaagaaaccagaactatttaggcatatttatgagagtaagtaccctaccgctcaaaatggaaggcttcaacatgtattcctaatatttcctaaaacttcactgaatagttttaaaattgaatataactttaccttcagagagaaacaagatttcgaaaggaaattgtagcagttttgtacttcaattgtcgattttaagattgtggtctgaaaagtatttgaacagtcattctttcttttccactatctcaggaaaggctctcattctattagaagcaatcttagaagcgtaactgccaactctcttcttaaaaagtgaagagcagatggagttctaccaatctgctatacttgacagtttttcaactacctaacctaagttccagttactgtctaaattatttttattcgaataggaaaaatacatttatgcttactgtacatttcgacagtgttcattctttgaggtctgttatttaatctccttcccacttttcttttctatcttaaatcagatgagtccccatggtctggcaacaaaacagctgtttctcaaatttttaacgtctctgtggccctcctcctacccttccaagtgttttccatactatttttctgttgtgggcttcagaattggatgctgttccataattactggtcttcccatgactctgtcacatcataaagtctatatatacccttttcctacgtttacatgccaaataccaggtgtgtctagctttaattcaatgactagcatatggtaggtattgcactaatattttttggtcaagtgaacatatattttacagatagatcaaatacatcaaccttcccatgtaataataataataccaagaagattaaatgatcgcgtgcttgaccagctgtttagtggcagaatctggacccaaccccacatctcctgagtttaatttcagtgctcttcagcattcttatatatctcaactttgttccctgctgagacacagctgacagatatatatatatatcttcacaatctcagtagtaagccctatttttttaagattacagtgctgatcaaagagggatattctatggcattgatgcaaatcttccaggccagatataacccctatctccttaaaccctcattcttgactgtgtcttgaaatcaaatttgagaacctctgctttacatgctaccttcctcttaaaattcataaggtttattccttctctcatcttcagtatttttatgaaaatatgttttactcttatttccaaagtgcttgccagcccatgctgagttcattagacaaacaatctaggtatcctaatatttaggtaaaattgctagcagcactaactataccagtacccacttaaattgcaatataaacctacaataggaaaaaaaaagtcaaaattatactactttcaattcctacttctggaataattatcacaccttcaaaaaaactcataattgttctccaatattaaaaaccaggaactaaattacatcactatatatatatagctatatagacatataactgtatatagtttatatatatattacatgtcactatatatggttatatatacagatagctatatctctatatagtttttatataggaaactatatatataaactcatatatatttatatataaactcatatatatataaactcatatatatttatatataaactcatatatatttatatataaactcatatatatataagagattttatatgtatatatgagagacaatattgaaataaaacaaactagccaatctccaatgtcccttcattttcccaggactcttctttattctcaaagaaatgtatgaatacacaatataaataaatgttctataatgttcattatggattataatagttttcttgtcatactgaagtgaatgggaattgtttcttcgattattagcatacttttcataactatgtgatttggtgataggcacttttgcttactaagttcagcatgatcaaaacagaactcctattatttttattgttgattcttatttctttaaggtaaaatatgcccttttcctttgaacctgcacactgtttaacaaataagcacataactcaggattgaattgtacacttcgatttgagcttttttttcaaggtcaggacccagtttcacaagaagttttattttttccaatacaactgacatccactcccaccagctgaaagacaagaaaaacttgtctaataaagctttcagattcaatttgctgcctgcatacagcttgaggaatctctggaggtcactcacagcatgtgttgcaaccccaacagggagaagtaatgaaaagattctagttaaaaagctgacactgccccttccaacctctttgaatgtgaatataataagccagtttacagacgcaaatctctatgattctggggatttccatcttgatctctgactccaaggaacatttgaatgcatggatttgtatccattatctgggtgaataaatgcttcatattgaaaaaaggggtgctttaacaacataagtctgatgtaaatcaggcaaaacaacattgtcacttcatgtttaactctcctggagggtctctaaggtctcacagtttggttctattccagtaatatataggcctatcatagccattttcaaaaataatacctgctttcatttcgattattccccctagcttttgcattgacccgaacatacctaatatttatcttagggctaacacgcattaatgccttgctctgtaccaggcattttgccaagtattctttgtgcatttttctgtttaatcttacagcagccttatgaaataggtactacattattattatttttcaccatgagaggaaatgaaagcctagagagaatggttatccaaaaacacccagctactaagtgggcacagcatggccttgaacctgagtctttataaagttcatgcctgtcttttacctttatgttaaacatactgaatcttggtcatgcagtctatgaatgaagactccatatactctaggaccaattctaccatattgtgcatgcttttgtacatattttccaaatgaaattaaacaacaatactctctcttcccctttcttttccgttttgcatgacatctaaatcttttattaaatctccgtgggtggaattgggccttaagtagtagtacctttgaagcttaatactataacctcagagttacggaagtggtttcaatatgaagaaatatatacgttcttttcttttcttttcttttctttttttggctcctctagaatagaaggcaatcaggagagaaaaagacattaagatgataggcttgattctcccacagtgttactacttagctttatttattctcccacatctgtaactgtcaattcaaggtcaaaaagccagtacagcagcagaattacaaaaagtagatctggaaaatctatagggtaccatagtccagcaccctgctgcaagtcaaaatcaattaaataaatatgtttaaacagcacttcatttaatcttaagggcaccacgactcccttggaaaattcttttttgtgttcagacctgattctctgaaagtattttctagtgttttctttgttcggtggctgtggtgaataagtggacccaattgcctacagcatgaaatcgtagaaatgaatatgggctggaacttcaatcaatcacacaaaccagaaacatagagttcatcacctcttctggaaagcgtccccttcggccgtcaaaagggtagagtttcctccaacatatgttcatacttccctttgcctcccatctgcaatttcaaccagtctgttgctctcgccctttttaggcttcacataccggatttcttcttaggagctcacttgaaaaaagggttgtatgctttaaaaatactaaaagtcactggactagatgataataaaatttctgtaaaataaaaagggagttaacagaggtgttaccacttatcataatggatattgttgacctttcctctagccagtgtcccacttaagcatgcttcttggctggaatttatttttctcatctggataaatctgaagcattatagtaaaacccagtgtgagcaaggccatggatgcaagtggattgagatgaatgagtggatagacctgcgtgggcagaaataatgaggtcagcaataagccataccaagggatgcacactcaaggaataaattggaggtagcagaataactgaacaaatgatacatttgatcagactgtcacatgaatatcaactgaaacaagttatgactgtagttagtgaaccctagagtgaagaaaacaaaatattgaaatccatctgatcaaaaaataataaaattgtttacatgtatatattatctaaaatttcccttaagaatgaagattataaattcccgcagttgaggaaactgaataagaggagaatcaggacagaatcttttctcttcgtattcctagtccatttttcttctaactacagtagtgagaacaagaatttattcaccaaatcataatacattgcaattaggggatgccatttgaatcttggaagacacgatttgaggcaaataaaaaatccatatttataaagtcaattattggtttatataatttactgtttcagcgggaggtataggttagtaatgtaagtcacttcaagaaggttttggtcgaagttttgccaattttttctgtaaaaagccagatagtaaatattttgggttttacaagccagaagatctttgttgaagttactcaactctgctaatgaggtgcaaagcagccataggcagtttgtaaatgcataagtgtggctgtgttccaataaaagtgtgtttgcaagaacaggcagttggttggatttggcccacaagccgtagttcactgacccctgttttagataaatactagtcaatagattccttgtagctaataaagggaatatagattgtttaatgtgtttccctaatcttcttaaggcttcctccaggggaaaaaatatttcttatcatcagcagtgttattaatgcttactcagaacaaagaataccacttacttagcatagaatggacatttataaagccactcatggaaagaataaagagatgtgaaatacctggtacaactcttaagagtgttccactatcatttgaaaaaatgatgagtagtagttatataaaaggactcgagcctaaaacatttgttctcactttggataacgttttcctatctcagcatcaaaaaatacaaagaaaggggataactaggtcttagattttctaaattctcatgactataagtcccatatatttagatattgaagtacccttaaatatacctaagtagaagtaataatttcgatattatgggaaatctaattactgctcatagttctcgagattaaaatgttatacaccacatctcagctttctttgaaacttgaaatggcatacttgtacaaaggtagaatggtctcccaaagcagcgtcatagattagcagaaaagagctatgataatgccacttcaactgactatcatttaaataatgaattagttaggaagagttaaattatatagttacaggcagcaggagatgtcaccatcagggggataagaagccattttccagtacactatttgacttaactggtgcagttccttctttaactgtaggttactcatttgtatccttaatttatcaatatactaatctgacaaataatttattaaggattactgtgtgccctcctgtgtgttagattctagggatacaatatggatcaagataagcgtgattcctagactcctagaaagtaagaaaactaaataactgtacgtgacaaatactaggatgtagaatactagggaagaatcaggaagaatcacctcacccagtctggagtattgcaacagagcgatgtcagaggaaaaattctggaaaaaaaaaaaaaaaaggaaatttgaagatgagacttgaaggataagtaggtgtacctaggcaaacaagtaggggagagtgttccaggcaagagaaacaagtaacagttggaggcaaaatggagcctagcacgttttaaaaatatcagtatggctgaagcactgagttggggttgggaatgggtgaggagcgatgtgtcagggaggacattccagatgatgctggaaatgcatgcatgttcgcaaactgcattttaagacatgttagagaaatcaaacacattttatttgaagggtaattgaaagccactgaagcattgtagagagactagtgacatgagcatatttgggttttagagggattactctggctgaagaataggtaactgattggataagagcaactttggaggctattccagtggttcaggtgatagataataatgacctaaactaaagaagtaataaagggaatggagacaaagtagacagattcaagtgatacttggcacgtggaaacaacaggccctggtaactgattggacataaaatggagagatacagagaacgcgaatagaacacccaggcatttggcttgataaaccgagtagaccgtggtagaaattactaaactatggagtattttagggttcaggggaactgtgagttcaattttagacatctagttttgcaaggccactgaggtaactgagcatatgagtcaggagagaagtttaggctaaaaatatggatgccagagttaaccagcgttatgataaaacaaagctgaagtctcgagggtaagaacacctaaacatctaggctggagaaggcagcaggtaaaaagtaaaaggagaggccaggcacggtggctcacgcctgtaatcccaacactttggggggccgaggtgggtggatcacctgaggtcgggagtttgagaccagcctgaccaacatggagaaaccgtgtctctactaaaaatacaaaatcagccaggcatggtggcgcatgcctgtaatcccagctactcgggaggctgaggcaggagaatcgcttgaacccaggaggtggaggttgcggtgagccaagattgtgccattgcgctccagcctgggcaacaagagtgaaactccgtctcaaaaaataaaaagaaagagagagagagagagagagagagaaacagagaaagagagagaggaagacaaagaaaggaaggaagggagggagggagggagggagggagggaaagaaaagaaaaggagaaaaattcaggagaatggttacttccagggagatggaggcgattgtgctgtggggaacacaagggtggggtcaaggtattagcagtattctatttcttgattggggttgtatttacataaagtgttgctttataattattcttcacactttatgtgtacgttctatgtaatcatctatagataagacagatttcactgtaaaagaaaataaaagcttccaaaagattatcatcacaattgtaacagattcccctggtgcctggagtcacacgccattttcctgcactgcagttgcagctgcagtggacagccctgtgtgagttcagacttgcctttagctgacagcatcccatgtcaagggaatggctcccatttttctactttctatctaagggacttctctgacatcccaggagcccacagattttgtgagctttctcacccttgaagttttagtgagtgagcaaccttcaaccaatggagatgggagcccatggatatatttttaaccactattccttccgggggcaaggggaattctctgtgattctcaggaacatacaaaagttctgtcaaaatacagtccccatggtccataagcattaccttgatgataatacatttgattggcatttcctccccctctgtctcactcttttggtttttcattcttgcttcctagggatcagcttccaaatgagctatctgtacccaagtcctcatccaggccctgttttcaggggacccaaagacaacaataagaaaaatggaactgaaagaggagaagactttaaggcatgaaaaaagttcctctgtattccatactgcatatttaactgcctactcaacagttccacttagatgtctcaaaaataatctcatgatcttttactgctatgaaatgcatgaccttcccctgatatattcctttcttcaggttttgtagcaccacttagctatccagtaacaaaatcttgggggtcattcttaaaaccttcccacctcacccctgctggacatccaccactaagttcagttgatttttttgctcctaaatatttcttggttcagctttcatttttagatttatcctgcatacccctgtacaatctcatcatctctttcctggactgttacagtagtcttatattaggatgatcatagtcttgatttgcctagagaaaacatgctttatgtcattgcctcagagtgactaatagtcccacctttcacttgtaacactatgcaggttattgggttaaataatactgtcatccaaacctaatctctcctcattcatttcttctctcctatgcatcttagctgtgtgaaaattcaaaatataaatttgatgacagacagaactctgtttaaaatgctccagtaccttaccatttatctcaaaataaaaatttcaaaaaaagaaatgatatcccacaggatcttgtatagtgtgaccctttccatttcatcatccttataccagatactgtgaactacttactctcttatctccacattgacctccctcctagttttgttttgcttatgaaagtgcttattttctgttttttaaagccattgcacatattggtctctctgattgagacactatccttttgaatttttgacctcatacctactcacttttcaggtctcagctcaaatgttatactcaggaaagacgctccttacctcccaaactaggttagtgtaaatggcactatttatactcctcttccagagcacacaccaaatcttatatttatttgtgggacaatttgaattcatgttgttccccctactcaattgtgagcttcttgaggacatactctgcctcctccttacctagctttattgaagtataattgagaaataaaaactgtatgtattcaaggtatacaacatgatgattttatatgactatattgtgagatgattaccacaatcaaattaattaatacatctagcacaagaaatagttactattgtgtgtgtgttgggggggggggatgaggacacttaagatccagtcttgtagcaaatttcaagtaaacagtaaagtattattaactatagtaaccataatgtacattagatccccagacatcttataactgaaagtttgtgccctttgaccaatgatatggtttggctgtgtccccacccaaatctcaccttgaattgtaatccctgtaattcccatgtgttgtgggagggacccagggggaagtaattgaatcatgggtttgtttccccccatgctgttgtcgtgatagtgaatgagttctcatgagatctgatggttttataagcatctggcatttcccttgctggcactcattctctctcctatcaccctgtgaaaaggtgccttcctccatgattgtaagtttccggaggcctctgaagccatgcggaactgtgagtctattaaacctcttttctttataaattacccggtcttgggtatttcttcatagcagcatgagaacggactaatacagtaaattggtactgcagagagtggggtattgctgtaaatatacctgaaaatgtggaagtgacttggaactgggtaagaggcacaggttggaacagtttggagggctagaagatgacaggaaaatgtgggaaaatttgaaacttcctagagacttgttgaatggttttgaccaaaatgccgatggtgatgtggacgatgaagtccaggctgaggtggtctcagatggagattaggaacttcttgggaactggagcaaaggacactgttgctaagctttagcaaagagactggcagcattttcccctggcctagagatctgtggaaatttgaacttgagagagatgatctgaaattggaactttgttttaaagggaagcagagcatcaaagtttggaaaatctgcagcctaacaatgtgatagaaaagaaaaacccattttctgagaaatacaagctggctgcagaactttgcttaagtaaaggagccaaatgttaagcgccaagacaatggggaagatgtctccagggcatgtcagaggtcttaatggcagcccctcccatcacaagcccagaggcctaaaaggaaaacatggtttcacgggccaggcacagggccgtgctgctttgtggagtctcaggacttcgtgccctgcataccagctgtggctcaaagaagccaaagtacagctcaggctgttgcttcagagggtgcaggccttagtggcttacatgtggtgttgggcctggggttggacagaagtcaagaattgaggtttgcaacctctgcctagaattcagaggatgtatggaaaagcctaggtgtccaggcagaagtttgctgcaggggcagggccctcatggaaaacctctctgctgggacagtgcagaaggaaaatgtggggtcggagctccacacagagtccccactggggcactgcctagtggagctgtgagaagaggaccaccatcatccaaaccccagaatagtcagaaatgctgatagtttgaaccatgcatctagaaaagctgcagatactcagtgctagccatgatagcagctgggagggggctgtaccctgcaaagccacaagggcagagctgcccaaggccatgggagcccacctcttgcatcagcatgacctggatgtgagacatgtagtcaaaggagatcatttgggcagttcaaagtgtaatgactgccctattggatttaagacttgcatgtggcctgtaacccctttattttggccaatttctcccattcggaacaggtgtatttacccaatgcctgtaccccccattgtatcctggaagtaactaacttgttttggattttcaggctcataggcggatgggacttgctttgccttagatgaaactttggacttggacttttgggttaatgttggaatgagttaagactttgggtgactgttgggaaggcattattgtgttttgaaatgtgatgacatgagatttgggaggggccaggagcagaatgatatgttttggctgtgtccccacccaaatctcaccttgaattgtaatctccaaaatccccaggtgtcatgggagggacccagtgagaggtaattgaatcatggaggcagtttcccccatgctattctcatgatagtgggtgatttcacatgagatctgatggttttataagtgtctggcgtttcccctgctggcactcattctccctcctgccaccctgtgaagaggtgccttctgccatgattgtaagtttcctgaggcctccccagccatgcagaatggtgaatcaattaaaactgttttcttcataaattacccagtctcgggtatttcttcatagcagcatgagaacagactaatacaaccaacatcccctcttgtcgattttcattgaatccccattacctgggaatgaatgaggaaggcagaaatagaaatcagcgtattgttcaatatagaaatcctgaagttacacaagataattacgagcaagactcagtacagagaaggaacccttgagctggggatcagagtcttctggaaacaaggagtaccaaaggggagtgaaaaagagaagtggagaatgagtagtagcagtaaaagaggaagtatgtaaagaaatggaaataaagatgaaataaactgtcatcttgttccagagacaaagctagctaggggagctaaggaaatttagagggataaaaagtctcatccaaaccttcataatgagctaagggctagtttttcatagaccctagcccaacttgcaaccctctcactctcttacttttttcctggctctgttttgctttactgcctttcatataatctaaaatgatgttaaatgtatatttcctgtctcttttctatatcacaatataaattccatgaggccattgcctgtgccacatttaccactgtactcccagtgcctagaatggtgcccagatcaagtagactcccagagtgtctgttgtcaaatgattctcagtccagtgatgtttgcactacatggtgctgccacttttttttttttttttacttcattccatttggaatttggatcattttgccaactttagggtttattcctctttatttcccctgtgtttgctgaatatctgactatctatttttctcagctctcttctcctcacactttgcctccaacttcctctctgctacaaattatacttagcacaagactggagccacttttcattgattttgatgtcagtgcttgagtgacaactccatgtggagaactttcaacctcctgctgtctcgttgtttgctttgaaaaaaaaaaatactcatcttcttcctgaacccactgggtaaatttatgctcacaaaaaagacaaaacttctagaacaaaaactgtatgagcttcaaaagtattagttttcccttgattttgagactcaaaagtaccatagaaattttaaaagggggatgaagtaattttgtcattcaacccgatatattttacaatttgaatgtcagaaccatgaaatgtcttttcagtgtactatcatcctcactatttccacctataaaagaaaagcaaaaatattgtttgagaacaaaaaaatattgcagtagcggaaaaattcactttaagtctttttttggaggttgccacatcacgcctgtcttcagctcctctcactgaagattctttgttttcttgaaaccagttggtcacttccaattcttaccacctataaatcttcctggttctttatatttcactttatatgtcccttatctcctctgatttttgttccagtctttcattttttacattctttgtcatcctatatgtcagaaagaatctgccactccaaattccttaatatatttatctaccagtgtttatttgcctgtcacatgtactcttcagtaatccattgacttgaaaactttctactctgtctttcttactatagtttgcttcttgagttcaaattattaatatattaggtcaagtaattctatttttatgcacattttacctaacattcttggtaaatataattgttttttaaattgcatcacatggtgagtattaatttaagacgtaattagtattaatctactggacaagattttatttattaactgttttgccctttgctagggttctgtaatctcaccctcagtgcctttaaatagtcttacccaaggatcacctatccctcttcaatttaaattctctattgtgttagtttctgagattgcacattctctggtttggtttggtttttcagtgatctctgtggtcacttccaaccatttctacttagtttacttttttccctgttagccctcttcagtgttaatatcacctggaagttaacccattcctagtctgcattgctctatggccagcatcttggctgattggccatcacctatcctgtacttattgtcaatttttttaaattttttattgtggcaaacagcacataacggaaaatttaccatctgtctttgttcatgtatgttgctataaaggaatgccagagactgggcaatttataaagaatggaaggtttatttggctcatggttctgcaggctgtacaaaaaagcatggcaccactaccaacttctcatgagggcctcaggcttcttccattcatggtgaagggcaaaggggagctggtgtgtagagatcacatggttagagagcataaacaagagagagaggggaagtgccaggctgttatttggcaactagctcttgcagaacctaacagaatgagcagtcactcaacctgcccccaggaagggcattaagccattcaagaaggatccacccccatgaccccacacttcccgttaagccccacctccaatattgaggatcaaatttcaacatgagatttggaggggacaacatctgaactatagcattatcttaattcaaataattttactaccaattccatttattagagaatctaagattaagactactgaaactatgccaatgattatctctagttcaggcttctctcttcaattccaaactcatattttcacctgctgacaagctaccacgtagatgttccacaggtatttctaactcaggatatgtaaaattgatgttatcattattttctgaaaatctattcctcttactatattccctatttttgtgaatgacacaatctaatggactggccatgttaaaaatcaggaagtttttctggcactttctttattccttaatattaagccccacgataaattaccaatcctttcgatcttgttaagacaaataagcttgaaatttcttatctcttatttagcactgcaattttgttttctcattcattcagatagcatcttctacaaaacctcttcactagtttttctgtctctcagctcatcttgtacactgcaaatccattaaaactacactttttaacatgccaatcataatgtattagtaaaggttgtataatagttctctttctcttctaggataaaagctaaatttttcagcttggtacacaaggccgttcatggatttggtacctactagtctatctagggtatttcctacatcttccctcctctctcttgaaaaatcaagtaatactaaactatttgtaactccctaatcaccaattgctgcctttatactttaacatatattcttccttttgctagaaatacatttgtcataataggctctttggtaaacttaccattacattctcagtttataatattatttgtgtaagtaccttttttcctacttagtcctccaggggaatgcatgtgcttctctctccatattatcattttaaaatttactcctatttcagcaagtatcataatattttactgagattaattgttggcatatttatgttaccctggtgacatatttaatagttaagatgctttgggctgcaagaaagagaatgcactttcaaagtggcttcaaaaataagaataattcaactcacataactggaagttcagaggttaaagctggctccagatgaagtacaagcagagctctgtcactctttctctatgactttctttgtcctgatttttttctctgcgtcagctttgacctcctcactagttgccctccaggttccaagatgactgccagcaacaaatgggtaacataatttcttgttacagtgagagacataaacacttacctcacagattcagagatttcaccctcagataagaacaatcaaaattttaattgtgtatctactgtatcattagtatatgtattaggtattcatatatatctactattgtactaaagatgattcagaatggtttcataagctggttgatttaaacttttcttcctgaaccaagaggatgagattatcttgactggcttagaatcgaagatttaggtgaatctaaatccatctccagaactgaggatggattccgtagaaacttgaagacaattggaattctcctagaaagcagaatttcagagtgggtgtagggatatctttgaatggaagttgtttaagccaccaacaatattcactccattggggtgacactgggcccaaaggtacccagttaatatttgttcaacgaacctataggaagacaatattatctgcaagctatttataaactaaatgacaacgagaagtatttttagaaaagttaatcatatacaatttagtcattcacattgggaggctcttcctaaatttcgtttctgatccttatcttgatctttgacgcaatcatatcttggcctccatctaaaagccagtagaagcctctggccattttttaaacaattggtttaacaacattaattggaatctatatagctcaacttaaaaaaaaaaaaaagaggaactagcttatcataatacaatattgtcaaggcaagtgatacttccatgcagctattcagcatttggtgtattcttggtttctgcagacctaataaaaagagattatctcagcgtcctctaggtttaattttaaaaaacaagaaaccatgaacaatgaaaatgatttcaaaacatcttcactcacatctaaaatatgaaatagctagatcagaggttcttaataatttaatcggtgaagcataactgaaggatttagaaaaagtgcctaaactattaaaagattcttcagctgctgcttaatgttgatatcaagttattttttacactggcaaacagctaagccattccctggtcacatccacttttcagcatttagcgctcctctcaatcatcccgatcacagccccaggaatgtttcatggcatctccgcaataatagtatattactattgggtcctgaattttgaggtagtttatctttcagaaaggatatgaatagagcaataagtccaagtagagtgggctttattaatgatgcccaagattttagacgtatactataatcttcaatcaattttaacaccacttcccttaccctagttttagtctaaaccagtccaactgtgctgtagtctcagataatacaatgttagattttttttttcaagatatagaattgtcgggaaaacttgtatgtaacctataccaatctaaatttcttagcatttaactctaaagagtaaagcttttagcacttcctgtgtaatacaagggcaagtgctgatttctctgaatataattttcctttgttagcacatatgttcactgtttaataaaaataagaatgcttcaattatctccttttgtcaagggcctgagaaataaagaaatatacagagggtcccaatctaaaaatgttttgatttacaatggttcggcttaggatatttttattttacaatggtgtgaaagtaatatgcactcagtagaaatcatacttcaagtactcatacaactgttctgcttttcatgttcaatacagtattcaataaattacatgagatgttcaacacctttaataaaataggctttgtgttagatgattttgcccaactgtaggctaatgtaagtgttctgaccatgttgaaggtaggctaggctaagcaatgatgttcagtaggttaggtttattaaatgcatttttcaatttatgatgttttcaacttatgatgggtttttcaatttatgatgttttcaacgtatgatgggtttatcaggaaataatcccattgtacgttgaggagcacctgtatcaatataggcatttacacaactctcgtactgatagcggcaggaggcagagaagctctaggcagaaaagggatggtccccagcgaaaaccccaccctcaagccaaaaagcctgaaaccgcagctcaaagtgggaacttatatcccagttttcctgctcgaatgttgcctttttctaaaccacccatggccccaccccaccccatcctgtgcctataaaaaccccagactcagctggtagacaggactacagctggacatcagagagaagcagcttgacttcagagggacaacttgatggcataactttagagaagaatccggctggacttcaggggaagattacttgccacccccatccccttttcagctccccttcccactgagagccactttcatcggcagtacaatccctcacatttacaatccttcaatttgttcatgtgacctcattttccctagatgctggacaagagctcaggagccacaagtgtgaatacaaaaggccctttgcccttgctggtggagggcagctgcctcctgtgaaaagacaaatggcccactgagctgttaacgcctaagctgtccgtggatggcagagctaacagagcactgtaacacaccctctggggcttcaggggtcgcagacgcctccacctagatgctgctccagtgctcatgcactccagttcccacctcgtttgcttgcacactccctccagtgaggagttgagagcagtgggctaagtaaataaggcacccctgttgcgagttccacaaaggggtcagggaaatatcctgcttcgttactaagtaggtataaaccctttactaagttagtaattattcagtaataatacttaaatgaaagctattctgttagactaaattcagattatcaaagacacgacagaaaacagctttctcattcatgaacctattatttccttttgtaaaatatgttaaatgaaaatacagccgtcatgctaatttctaatggtagaacatattttgaaaactcctttatgtttggaagattttgctttagtgcagataatcagaatgatgtgatatactaagaaataatttttaaaatgagatgtgacatttctcataatctaaataagaaatggcaaaacattgtcctaagctaaataactcatatgaagtgataaaatattgctttctaaaggtccatgatatgtagtgatttctaatgtgtttaatagcattgatcctattgggtaattgggtggttctaacatgtaaggaaggcctccagtactaatttcatgtactgggaaactactgggcagggatgaatcccttaactcctaagtaagactatcagatcatataaatctgctttttgatttgcaaagactcttaggcatacctcttgagaatattaaacatctactaaattatatgtaaagcatttcagtctaagatttacaatgctcaaaggagaaagattttaaagttcagcattggaatttccataatttccttccaattgtagaattttacaattgagatagcaaataataatataaataaatatgtaagactgaaatcaacataggagtttggaaagaagactgtatgggttaactagagttgtcaacaaagacttcacagaagattgtgatcgtagacattagtaaggaataaaatgggtgcaaaaaaaagtctaagaaacaacaaggataaatttattttgtaaagagtgaaagcatattgggtattacataaagagactggctagtttgacacaatgtgtacttttggggtaagcagtgggaaatcactttctgtaagtaaagtggaagagaattcaggtattggatatggtcatataggatttttcaacctttgttttgcccccatccctatcctaccagtatcatcacagatgttggcaatattcactcacttgcctgaagatagatattcatgtcaggggctacagatatgtaaaggtgaatgaagttaaatagcaaaattcaagcacactagttctgactgtgcaccctctctcactcagaaaagcactttggaatgcgagagtactcttatattgacaacctttagttggttctaatttataaaaaaatataaaaatatttagacaatttggatattttatatctatgccacaacccattgtcaaatgattgagatatcattgtttggcaacaatgaaactgaaatcaactctaagagtaaagagtacgacttttaaagatatttggttaagagtaatgttgcaaggcagagaccaacattatagaagttctcaacctgtgtgctggatatagctaaaatttcccaggaccattgaaagaaattctcaaatccacaaccacctcaagtgttgtctgtgaatcaaaggagtgatgcattacccacaaacatgtagtagacattttttaagtgatgtagatgctactgcaattaataaatgcaaaattatattacaatattactgaattcagaataagttgattttgtcactatttttctcaatctacgcatgctagatataaagttattatatagagacgtaacatttttaatatttcagaagcatgctcatgatattgtaaaccaggcactgttaaaagatcactggattgggaattaataaacctgggatctagtcctcatttgatctcttgttggctatggtttgggggttttgggcaaactattcaaccttttctgccttggtttaattgataaatgatggtgttttcccagataaatcccttcccaacttaatattaccagatgtagcatctatggtttagaatgtacagtataaattaaccttcctgaagatcttcacaagttactataacctatattttcatggcactgaaaactaagtttttgatagcttacgtttttataaataatttacttactcatttttatcataataataaatctgattcactaatcaccaaaatatcatttttgaaaatagatgcatgaaaggatccgaacttgttatggttttatctgttcaagtcacctaattttggtagccacaggcccccattgtcaataggggaagattatccattttagcaatacagtctctgataacttcagcccatatgcccttcaattccacttttacgtcagattgaatgggaatgtgaggcccccagtagtaaactaaccctactttctctttggaaattggtctttctacctagctctttgcctctgttcacgttcttgtattccacagaaaatatatacattaggtgttaaaatcacaatgattaacaatttttaagtagaaatagttattaagtatagcataatcatgcctttgaattagtacaaaagtaggaaacagagctttagtgacttttttcattctttccaccatttacagggcaaaaatgaagaattttaccaattcaaaactatgcacatgtatagtttccaccagtatttagtagttatgtttctcaagatgtataattcctttcctttctgttttctgtagtttgataaaccctagataggagttaatgttgtttcagttaggtttattatttcttttatgtggtttaatttcatgcaataagctagagattttgtaacataacttgataaaaattttctcccttcgtatctttttgttttaaaataatggattaatatagattgtaattttacagtagaggaaatacattttacttttagttcttatctagatatcttaggaaaaaagaaacatcatttttaaggattattatttttctactaatgaaaaaaatagcatgattttccattctggactttgtaattaactttaccttggaataattgaatcttaaatataacttcattgaaaattttattttcaagtaacattttaaaatgcaaaatttgtgtgatctctactaaaaagaactctcacatcccaatgtgcttatagctacaataattggttaaaagagacaaattataaagaagatataggttgtgacattgaaattacaaaatgtggattagggaagtaagcgtgtagagttttgtatgcaatcaaagttaagttattaccagcttaaaaaacccttacgtaagatgtaaagaaaagcaaaaacctatagtagcaaaagcaaaaacctatagtagatatacaaaaggtaaaaagtaaggaatcaaagtatactactgagcaaaacagtcaaaccataaaagaagacaacaaaaaaaggcatatagaacaaaggatctacaaaacaattagaaaacaactttttaaatggcagtagtaaattcctacctatcaatatttactttgaatgtaaatggattaaattcaccagtctaaagatagagtggccaaatggattaaaacaacaagactcaactacatgctgcccataagagactcacgtcatcttttaggacacatgttgactgaaatagaagagatagaaaaagatattttggtttccatgcaaatggaaaccaaaagagaatggggatagccatacttctattagacaaaataggctttaaaaatcaaaaactaaaaagacacaaagaaggtcattaaataatgataaaaggatcaattcatcaagaaggtataacaattgtaaatatatatgcacccaacattggagtacctaaatatataaagcaaatataaagtgataaaaagaaagagacaaactacagtacaataatagtaggggacttctaccccaaattcaacaatagacagaaaatccacattaaaaaatcaataagaatgcattggactttatgctttagatcaaatagacctagcagacatatacagtacatctcatctaacagcaggagaatatacattcttatcaagtgcacaagaaacaattcttcagggtagatcatatgttaggccacaaaatgagtcctaacaaatttaacaagattgaaagcatgtattttatgtaaaacaacgccatcatggaaaaagtactagtgtaaacaaggtttaaatatgatttactgattgtttaaaaaggaattatcttagccctgatctgatgggatttcccctttgtaagcagcaaaaataagttcataatgaagcaactgtaataatacagcttcacagatctttctgaataaacagagttggatatgtttctacttcagaaaccatttactgtgggctcacagcttttccatacactctttacactcttaattttaaacccattcatcaaaaggattaagacaatgagattcaagtccaagacaataggaagtatgtgcatcaaaactgtcatgctaatgctctgaggaacattgttatttcaatagcataatttaaaaccactgaaaccatgttttatttatgattacctttcatacgttcaaaaagaatttgagatggtttggcagggatgtcttaaagaaacaaacaccaaatttttatttgttgtgcttctaacaagcaatttttcctacgtaagtgttacctgttttctccccttgattttgatctcttttgtatggttggtagttgtcgcacttctgggcatagtatggttttctacaagttaaataaaaacataaattgattttgatgtagctagttccactatttcagttagtgtgttttccatacctgcaattcataacatgtttactgacccagaacgttaaaactcaagtttagttcaatacagtcacttcaaaccaacttaagatagcagttacatttccaaggtcattatgaagacggagttcaagacttcagcagttgaatttgtcaagctcatgggtcttttagttacaggaagtgtgcatatttcacataagaaacagcaactctgatgatacattgaaactcaaatatacccaaggagtgtaaaactactttataagcccttaaacaataaatatgccaacaatcctctgcatactttttgtcattttttagagcattcaattgaattatataacatgtgataccaataaataattaactttttatttatttatttagagaatgattcttgctttgtctcccaggctggagtgcaatggcatgatctcagctcactgcaacctccacctcttagtttcaagtgattctcctgcctcagcctcccaagtagctgggattacagccatgcaccaccacgcctggctaattttgtacttttagtagagacagggtttcaccataatgatcaggctggccttgaactccggacctcaggtgttctaccacctcagcctcccaaagtgctggtattacaggcatgagccacagcgcctggcttataattaactttaaaaaatattctactatcgaatgcctgaaaaaatcatattacttctatgtattaaaaacaaactattacgtaaatagaccagagatacggtgtcagagatgagattccttggcaacagtctctgagacaaaaagttgcacacagaaagtattttgagaagtattgttgctatttataaggaagtgaaggaggcagtattgggcagagagaaaagctcatccacactgcagttgctactgaggcttcagcccatgtgacagggacactggagctgggatggtctttcagagttctaccaaattgaggcaaatgggcgagacttttgtatctttgcactagccaagagcaggcaccagggagaaatgcagctgtgatccttttgtagatattattattctggagtcaatgcaaccacaccacaaatactaggaataatattggtagtgtgggtgcatcgactccagaagaggatcttgatgaagcattacagtatccactacagagaggcactggcatattctgcttaccccacaaatattgcaatgaggatgcaagtaggagtagtgaggacataaaataaatcgattattttccactgggccttaatatatcagaaccattggaatttacaggatgatatttattatagtactcaaaaaaatctcttttaaatctccttaactcagaagggaattttaaaaagtccacaattcacctggtctatgaattcccttttaaaataaaatgtggtttaatcaaatttacaagaaaaaaacaaacaaccccatcaaaaagtgggggaaggatataaacagactcttctcaaaagaagacatttatgtggccaaaagacacatgaaaaaaagctcatcatcactggtcattagagaaatgcaaatcaaaaccgcaatgagataccatctcacatcagttagaaaggcgatcattaaaaagtcaggaaacaacagatgctggagaggatgtggagaaataggaacgcttttacactgttggtgggagtgtgaattacttcaaccattgtggaagaccgtgtggcgattcctcaaggatctacaaccagaaataccatttaactcagccatcccattactgggtatatacccaaaggattataaatcattctactgtaaagacacatgcacacgtacgtttgttgcagcactgtttacaatagcaaagacttggaaccaacccaaatgtccatcaataatagactggatacagaaaatgtggcacatatacaccatagaatactatgcagccataaaaaaggatgcgttcgtgtcctttgtaaggacatggatgaagctggaaaccatcattctcagcaaactaacacaggaacagaaaaccaaacaccgcatgttctcactcataagtgggagttgaacgatgagaacacatggagatgggggaggggaacatcacacaccagttgggggattggggggcagagggagggataacgttaggagaaatacctaatgtagatgaagggttgatgggtacagcaaaccaccatggcacgtgtatacctacgtagcaaacctgtacattctgcacatgtatcccagaacttaaagtataatttaaaaaatgtggttgaaaaacaaaacccacataatacaaactttgccagcttaactgttttatgtgtacaaaccagtagtgttaactatacatacattgttattcaacagatctctagaatgttttcatctctcaaatccgaaactccaaacccactgaagagctcccattgctccctgtaccccagcactggcaatatgaccactctactttctgtctctaaagagtttaactactttagatacatcatataaaaggaagcatgcagtatttgtcattttatgactggcttatttcacttagcataatgtcttcaaggtacacccatgttgtagcataggaaaggatttccttctttttttgtggccgagtaataatattccgttgtgtcctataccacattttttaatccgtttatcaatcaatggacattttagttacttcaatttttggctattgtgaattatgccgcagttaatatgagtgtgcaaatatctctttaagatcctgtttttaattcttttggatatacagatgctcattgatttacactgggattacatcccaatcagcccatcataagttgaaaatatcatgtcaaaaattaatttaatatgcctaagctaccaaacatcattgcttagtctagcatactttaaatgttatcagaacatgtagattacagtacatctgggcaaaatcatcttgcaacacagtacatagtagagtatcaattatttatcctcatgataaatatcatgctgcaacccaatatgtcagaagagagtatcatactgcatatttactagccctagaaaagatcaaaattcaaaatttgaagtatggtttcttaatgaatgcatatcgctttcacaccattgtaaagtccaaaaattacaagttagaccttagtaagttggggactaaccgtacacccagaaatgggattgctggattatatgataattctatttttattttttgaggactggattatatgataattctatttttatgttttgaggaacttccatacggttttccatagtggctacaccttttcacattcccaccaacaatgcagaagtgtttcagtttctccacatccttgccagcacatgttattttctgtttatgatcgtggtcatcctcatggttgtgaggtaatatctcattgtggttttcgttcttcatttgcatttccccgatgattgacgatgttgagtatgttttcagatgcttgttggctgtgtatatattttctttggagaaatgtctatttaaatccttgcccattttaaaatcaggttaattgtttttggtgaattccttattaattactcacctcagagcctttcttcttaaaatacagatttctcagaacctttcatctaatttactaaatgttgatcttgaagaagtattttaatttatctgaatttagtttcccgttctataaattgatagtaatcatgttttccctatccacaccagagtggtatgatgaggaaccaatgcagaaaatgactaaaaaggcatttttatgctgtccagatcttgtgcaaatatattataattgatttgaaccaaaagaatctacattttaagactatttaatattgtcgcatttacattgcactaatggttcctcttttttctcactgatgaagttctagattgaaactctgaggaaactgtaaatcacagttacataactctgttatattaatttatataacttctctgtctctctctaaatatatatatttagactatatatacatatgcatatatatatttagagagagaacgagattacacttaaggactctgcttagtacattgcaacttgcacctcattctaattgtgaaaacaacaacaaattttgattgagaccctgttatttttcagacctttggtcttgtgaggaaggaaaagatgattctgatacttatctcaaatagcttatcatctcctctggtggatgaggcttgtgagggcctgacacatggtagaggatcttattcattatataacaactttcaaaacacatcactaattatttttctgcttaaggtgaaaacgtagctctcccaaacaaataagagatttagactgaattctgtagaaaacactgcttacctcattttgcttagttttcactgcagagtcttgtctctaacattcaggtaggaggaactctattttaaaaaattgaataaacaaacccaaatcagaataaattatttaattcaggagttttttaaggtgctcagaattttggtagaatagcagtgtattttctgtaataagaactacacaatgttctctagctggttatactcaaatggttatatggattttattctgatatcagttttgcaattgatgaccacccttcatcaatagcgtggtctttattatggtttcatctggctttttcttcccttgtcttctgcactgggctgcctacttcttggctcttattattacatactctacttttttcatatacaaaggtcttagtgcattaatagtgagtttctgctaaaagtgttactttcttcaaatatcctgtcaaatgctggctgcctgatttattgacctcatagagtgactatgtgaatcttccattctctgtggaattccattccacattttaacttaaagactccgtcttttccagctgtgttctctctgctggataagcatttttcttttaatttctgtggtaatgggaagggaattttaaatcctgttttgcgtacaagtgtttaacaggtaaaaatggatgctgtgtcagctatctattgctgtgtaacaagctaccccaaatgtagagacttaaaataagaatcattttttttttttagctcatgattcttgattctgcttggggcttggttcatcgaggcgattcttttgctagactcagctgtgctcattcatgcactcgtggtcagctggtagttgatgaccacatgtggcattcatatgtctggtataactttttggttataagttgagacggtgtgggtgacaggatcacttgcctgtaattattcatcaggctagcatagttccatagcggtggaagagttccaagcatagcccaacacccaagcattgttaagcctctgcttatgtcatgtttgctgatacctcattagccgaaacaagtgacttgaccaatccatattcaaggagtggagaaacagactatggctcttaatgggagaatctggaatatctcttgacaaaagtgtagatgcaagaggagaatctgtggacatttactctccagcagagatgttgtcatttttgtcactaagacagttcctgtgtaatattatttattattccttggcagccataagtttgtggtttacttatggatacttcagtgcctgcccaatatcatgttggaaagagaagcccttaacaatttctcttaatttctacttctgaggaatgagaaaaaaaaaattggataggcataaatgatttccagcacaaattctaagcagctatttgagaggtgggtgggtagggagagatggaaaatccttttaattgagacatgctcaaccataagcaatttttctttcctcaggagacatttggtaatgtcaggagacatttttggttgtacatctaggagggagctctggccagagatactgacaagcaattctgatcctacaatgcacaggacagccactcacgacaaaaaattatctgggacaaaaatgtcaatagtgctgagattgagaaaccctgcttttcactgagcgcatgtagatgaattcatataatgttagttatagaagggcacttagatgatgccaactaaaacaggaaaaggcaatgattatttctctattcaagttagtgaaggaaggatatgtttaaagtcaggttggagatatttctcaagggtaatatttaagttgtgagtggatgccagatgcgcttgattgttacaatccatatttttatagctatatcaaatgatcttctctcccaaattaaaatggatattagatatatttcatggataccatatattataagctatagctcttagaagtatttgagtgattaataattcttgcatattgaatgagacatgtaagaaagatacctgatgtcctatgattcttagaaatatgtgcagtggttaagcacattgtcttggaaacatcacttgttaatgtgagatcctgaacaagtttcgttaccttggtaaaagggggatgataacatctaccctgaagatggtttggtaaaggtgaaataaaagagggtttatgaagaaccttgcctagcacataagaatcactgagtaaatgatgggggtgatggcagtgttggtggcaattatcttacttgtaagtagtagcaaatatttatttggattatatttttaatagcaagaaagaatctattaaaatgtaagcaaatagcaccattaagctttaaaaatccatagctcccaaacttaacatttttttttcttaaatccagaaatacaaatggttatcatgaatccttgagttccagtactccggccttgcctatgtagagtacaagcatttatttttctaaaatgagaattattgatgttaggtgtgtcatatattttatttactctttagagtgacagaaaagaaagcagacaaaaataagtgtttatgtgttcatagtgtttgtttctaattttccaacttgtatgtgcagactgtaaatatttagagggaagacatgaaattcttccttacctacacaatagattgtctttcttagaatctagacatgatttcaaattttcttcagaagttctcttgaattcttacggaattcattaatccaaatgccatcctttcaaatattcaaaaagaaaatattctccaatgttgcttacatggaggagagttattttatctactagtgagatggaagtcgctaacaatctttcttataccccatagtattaaatagtaatgcaatttgatcacatataacattgctctcctgttgacatggaatgataaggaggaagggaatatctaacagcactttttagatattctctcatagaattgttaatgtgagcccaataacttattttgtaagttgagtgatttttcaaatataaaagtgaagcaaacaaaaaaagttacccacattcattcaacaaagctagaaatagagtatgtgcttcttgctttcttatcaaccaaaggagacctgtgaattacaggaaaaccatgtgtgaatacttcaaaggaaatatgccaaacacattgtgtgtgtgttttaaaagatttagtagctcctttaaagctctaagtaaagctgttagtctgactaatcatgtacccctgaaaccaattaaattttcagactagagaagtgttcttcaaacacttgaaaaaaataagagttccttcctaaagccaacaccttttaattaacaaaatactcagagcaaagctgtggtttgcaatagtatattacacctactgttattcatgctaccattctggtgtgccaaactcaattcatttcaactattttgagcttgattttctgtctgcttaactatggagggaaaaccacaattttagtagagtcattttaattttctaatgaatgcatgagaaaggtattatgctacatagtatgtcctcagactattcagatgccctctctctctcttgctctgtctctgtctgtctctctttacacacacacacacacacacacacacacacacaatgtgtgtatctatctgtctacctagatatacagtttaattttgtacattgtaatacatctggttctggcataaggtgattgagcaaaaaacaaacaaacaaaacccacccaaatctgttactggaggaacctttaatagcataacatcagaaagactattttcagtaaggaccctaggcaggaaaagacaattcctccaatggacttgagaagaatacccttagtctctgaggtggttagagaggctgagatctgaaccagctaataccagagccagcttcttgtaacccaagataggggcataagaaacggggtgaatgcccaggcatgaacagacttggggttaagattaaatagggtacacgggaaaggatttccgccagctggaggggaagccatttcccatgctccttagggatgacaacaggagacccagcccagaacatcattgaaaattctatgtaataatttatatatcctaactctttacccgttcgttctagattatggattcaggcactcttagcaaaacaaatcctctttcagtcttttaaaatattgacttaacaggaaatatccttggcacaacaatacgaccctgcctgacccttagaactgtgaacaggttgctcagactgtacaaaaccactaacaaatctgaccagcctacacttcactgaaaaaggtgatttgcatatatttctagtactatgacatggtggaaaagaaagaaccgcatatgtgttagataaaggtaaacgcatctgaaagtgcagtaagaatcaatgtgatatatacaataaaataagataaataggccgggcatggtggctcatgcctgtaatcccagcactttgggaggccgaggcaggcagatcacgaggtcaggagatcgagaccatcctggccaacatggtgaaaccccgtctccactaaagtacaaaaaattagttgggcatggtggcaaatgcctgtagtcccagatactcaggaggctgaggcaggggaatcgcttgaacccgcgaggcagagattgcagtgagctgagatcacgccactgcactccagcctggcaacagagcaacactctgtctcaaaaaaaaaaaaaaaaaaaaaaaatttcaggacttcaaaacttctgtcctttgaaacactttgattaaaaaatgaaaaaaatatatacatgcctgaatccagaggcaagtctttttagaaaacataaaatattttaagtaatgtttttctgaacagaaatggctctaatgtgagaggtcgatgaagattagcctcttgcttctttatgttttaaagtatattccttgagacccaaagtttctgactttagaatccaactctcaactactatcagctatcctctagacactttcaaaatcctccaaaacctaatagtggtgcaagattttgtccttcctagtgataactagatttaagtaagaaaacgttaaagactaaaaagtgtttaggacccacaagaaaggtgtaattctgttcctcatggagatattttagttacacacttcttattctggtcctccccaaaacacagaaatctagagttgacatttaaagagaaaatgagatttttgtctggaaacaggagagaaaaagttttcaagaagtatagaaagcgtatgaaaggacacaggtttgaaatggcctgtgctcatgagagaatgcacaatagacatgggtgtggaggagcctggaaagaatggagagaggtaagtctggagggtcaaatctggttcagagtacagagcataaaatcccatacgaatgtagaacatgaggagccaataaccattgtgtgagaaatgcaggaaaaagaggaagaaaaaaatccacatagtgtacttacagtcagaacaatcctaggaggtgacttacatgtatgatgtcataaaatccgtaacacaattccattagattggtactgttttcatagttacacaggtgaaaacttttgagggtcaagatgttcattgtagcaggcatagtataattccttacctcaagatgcctccaatgtcagtgaacattacttttccaagattgtctatttaggaaaaagtaaggccagttgtctatgaaggaagtactattataatcgccactttacagaggagtaaatggagattcagagaggttaagtcatctgactatagttacacagctaaaaaaaaaaaaaattatagagcaaggattcaaatacaacaatctggtcctagaaagcctaaatattctacaccctgctttctgattcagagctatttcctgcttttctcccttcgataggaaaaaaaatgtatgtgtgtggggttgggggcaaataaattgactggctgtattttctctctttaatatttgatctttcattgtctgctccaagcagtgggtcttcctccattatcttctcgtgaaaatagctaaaatcacctaactagtaaaaacctaggcatgttttgtgttctagcctccattcttccattctaatgggtggctgttaaattttagtactcattgtatgtagaagacctctaagttcactaaagagcttactgcacattgacttttctttagattcaaagggaatcaattgagcacctcctatactccaggacatgtgcaagatgcaagagatagagcagtgagaaagtctgataaggtttcccctccctttcccagcagtgtacagatagatgttcttcaggtggtgcatgctggagaagagaagaccagaaatactggcctgacgggtctatagatgagattatctgcccatgactggcgcagggatggccgcattgctagacctctccatcatcctctgaatatgcttcagctaatttatcatcccaatggcatatttagtcatcatgaaccattctctctttttgagtctcaggccctggccttgcttttcaatagacttccaatagattccttcctccttccttcccttactgcctggcttcctgacttccttccttcctgccttcctgccttgtcttgccttgcttttcaatagattccctccctccctccctccctccttcctccctccctccctccctgactttcttctttccttcttcctttctgtctttttccaaacgtgcttttcaggaaacagtggtctgcttgttgaagtctgataattctctagttcctcatccttcactttattgaaatttagtgtgacatgatcatttccacctcattaggtacttctttcatggtcagaagtaagtctggagaaaaaaaaaaaatctcttgtctctgctcttatttgagggtcaaattttcaataagtcactttttaaaaaagcattttctgacacttcccataagcttgaaatcctcctaaattgctgtatattgcctcagtataccttgtgtatctattttaggaacactccatccacatttgccagtcagcctggtgttctgcagttagttcctacagtgatattttaatttagctctcttttcatcctcacacatgcatcctctctggatatttagctcctttcctggaatcccttttaagatttctagatctttttgcttccatgatttcttctcctggactgtgacacaaaatgctatttcttctttacattacatttaattctttctagaaagagcctcagagtagtcagatagctttgagaaacaaaactttttctttattgcctcactgttactgcctttcaatcattgtttcgtgacacaaatttttttattctctctgacaattaaaacactatttttttctgtctgcattgatcaaaattagttccttcattcatagaaaactcttggtgtccctgagaagcttgagagacaagaaacattcttccattctactcatcttcttctctaatgaggagacaaccttaaaagcacagttacatagccataaaaattaatgattggctacctcagaatgaaaattcaatgtctcatttttttttaatattcttagaatcgttcactggttgtccagtgtgagtctcctgttgagatgtcttttgcagctttccttgaaacctttcattccaaactacatagtccaataattttgccaccaatcttctggttatattatgctcttgagtctgttgtctataaacttgattaggcattccttcccctcaccactcacctctgataacccagctgtgtgttggtatttagtatcaattcacaccagcaagttcagccctcttcaatcaatatagggccacacacggacttttgactgactactccccaagtatttcacattttggggccttatctccagtttctcaccacagttgttcatcactgtgtttcttactagccaggcgtttataaaaacagtaatacctaacactattgatcacctactatagtgtcaggcgctgtaataatattattgtgatgatgatgattatgctgctctttctggcattgtcatacgtgtattgcttgtactactcactgaatctacacaactgcccttatgacatttaccctgttattattcctcttttaaggtaaatacatgaaaaatgcttcccactttgccttgcttactgcttattgctagtactgaacaaatgttagaactgaaacttagagaggttatgtggctttaccaaggtcccagagttcctagggcagagaacaggattgtctaccagacattttaattctagtactatgcatcttaaccattaccataggctgacttactctacagtgtccaacactattcatattaagatttatttaatgactttgaaacagtatttcatgtctaaatagaaaaactactaactcgcatttttaagaaaatattgtatcttggtttttcttcactgctggccagtttactaacaatctgaaataaaaagaaaaaaatatgataaactgctcccagtataaaatacagagctaagacaagaacgtttcattggctttgatttccctagggtccagcttcaaattaatttacttcctattcaagggaattttaaatcagaaagaagatcttatcccatcttgttttgcctttgttttttcttgaataaaaaaaaaataagtaaaatttatttccctggcaaggtctgaaaacttttgttttctttaccacttccacaatgtatatgattgttactgagaaggcttatttaacttaagttacttgtccaggcatgagaatgagcaaaatcgttttttaaaaaattgttaaatgtatattaatgaaaaggttgaatcttttcattttctaccatgtattgctaaacaaagtatccacattgttagaaaaagatatataatgtcatgaataagagtttggctcaaattgttactcttcaattaaatttgacttattgttattgaaattggctctttagcttgtgtttctaatttttctttttcttcttttttcctttttgcaaaaacccaaaatattttagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggtatgagaaaaaatgataaaagttggcagaagtttttctttaaaatgaagattttccaccaatcactttactctcctagaccatttcccaccagttcttaggcaactgtttctctctcagcaaacacattactctcactattcagcctaagtataatcaaggatataaattaatgcaaataacaaaagtagccatacattaaaaaggaaatatacaaaaaaaaaaaaaaaaaaaagcagaaaccttacaagaatagttgtctcagttaaatttactaaacaacctggtattttaaaaatctattttataccaaataagtcactcaactgagctatttacatttaaactgtttgttttggcactacgcagcccaacatattgcagaatcaaatataatagtctgggaattgattattatccactcttctaagttgtctgtgccaatttgccttctccaatgataaggataattgaaagagagctataacttaaaaagagaaaagtaacaaaacataagatatttaaaattaccctagatcttaaagttggcatttatgcaatgccatgttcaaatgaacatgtttttaatacaaatagtgcatttttcagcctcagtgtaatccatttggtaaaattatgacatcaactagaaacattagaatacattgatgtaaatatggtttacctagctagatcaaatatactatatatcttttatatttgtgaatgattaagaaaaataatgttggaattgttatacattaaagttttttcacttgtaacagctttcaagcctttctaaagaaatacaaagttgtgctgaaggtatttaggtattaaagtactaccttttgaaaaaacaagaagtgaggcagacagagtaaggggaatttctttgtaaaataaacttcaccaattccataggaataaaagtaatttgatagtaaacaacctgcatttaaaggccttgagcttgaatacagaagacctgaattcagtgccatttgcaaatgatgattgtggtcaagccatctctggatcttcgtttcctattctgagtacagagcatacagagtacacattcacattcacaatatagttatggatatggatgtatataaatatatgtaaatactacatatatgtacctaaaatttgttttacttctgctttaaaaaaagtaattatagccacatttttcagaaaaagtaactgaggctcatagatgtcaaattcccagtaagtagcagaacaaggattcaaatccaagtccatttgattcctaagcttgtgttattacttgctactgcagagagtatacgtagcaagtaatatatgtactgcaagcaatacatactattgctgcggtaataactgtaactgcagttactatttagtgatttgtatgtagatgtagatgtagtctatgtcagacactatgctgagcattttatggttgctatgtactgatacatacagaaacaagaggtacgttcttttacaataccatattgagttatataatactcccaggacttttatttaccaaaggaaacaatattttataatgtttaaagcccaggttttgaagttacattgtctgggttcaaagcttggctcccaagctgtgtgaccttgagtaagttattctgcctacctgagcccaagtttatctagctataaaatggggatagttgtactatctgccttgcagtttgtcatcaggattaagttggttggtacatgaaaaatgcttcccactttgccttgcttactgcttactgctagtattgaacaaatgttagtaattatatttggttccaccacgaactctagaaatctaaccaatgatggcatttgtattatgcaaactgtatatcacatcataatattatatggaaatgagagcttgtttccgcttctgtagcctagtctaccattgacatagcttcctgcagaagttaccagataatagattgggagagaaagtccacacttccttgtgacgggtttgtgagtccagcatttagggaagccattgatgtgctcagtagtctccagagttctctaaataaatgtgtccttttcagaaaggactactgatttgatgccccctcacagagatcgtctttaaatataggtcaaaaactaatgtagagggccaggtgcaatgtttcacgcctgcactcccagcgctttgggaggctgaggcaggtggatcacttgaggtcaggagtttgagaccagcctggtcaacatggccaaaccccatctctactgaaaataaaaaaattagctggtgtggtggcccatgcctataatcccagctactagggaggctgaggcaggagaatcacttgaatcctggaccagaggttccattgagctgagatcacaccattgcactccagactgagtgacagagtgagactccatctcagaaaaaaaaaaatttagggggaaaaatcaaaagccatttctgagacacaaaaatacaggatttataaattatatatggtatatataaaaatatttttaaaatagtatatatagcatattatatataatgatatgtaatgttcatatattacatatttataaaaaaatctaatctcccttctcttgcttgctgaatagggggatgctttgcctgcctcttcctcttatattaaaaaataattcttaaagacattgtcagttcttggcttttatagcctcaatcaccaaattgtcggtaaaatggccctaaataatcattaaacaaatgtgtgtgagaggggaaataagaaggataagtaagtatggggaggattttgttataatttcaggaaatcaatatcaattttatgtaaagttttaaataaagcaatcccaactttaatgtttgatgtgtgaaaaattaggcaaaattccaaaagggctttataaactgaaaaaaactttactaacacctatccatttttattattttaaccaacttctattgagctgccactaagtacctgggaaacataaagttgtacaacatagaatgtgcaggtaaaagaggttgaaggaagaaaataataacactatgatagagataaattttaggataatagctaacacatatgatatgccagtcattgatctaagtacttcacgtgaattctttaatgcttacaacattactgtgaggtagatagagaggcacagtaaggataataacctgcctgagatcgaggaagaaagacaatgatgagatgtgaactcaggcagtttggttccagagtcctctcccttaaacctcatagttttcaacttctctgatattgtgtgggtgatgctgttggggctttcttcagggaaaactaagccaggagagagaatggatgctagtgagatattcctgaagaaggaaaaacttaagccaggcattaaagaatgagttggaattacctagctagataaaacgagaagggcaatccaggcagagggaacagactgtgcttttcactgaggtggaaaaaaaacagagtatatcagaggaattgtgattccatatggctgaagttaagggtatatgatgaggaagaaattgatgaggttgaatagagaggactggggctaaataatgggaatcctttgttgccagactgaggaattttgatgatggcctacaggcagtggcaactctgaaaggattgtaaacaggaaaataaaatcatcacatatagtttagttgcctatcaattagagctctctggatgcaagcaacagaaatcattctctgattaaatcaggcagaaagtaaatgtgctgtaattagcacaaaggcattggaacaaaacttacaaaaggaaaaagaatctgagcatgcctttctgggcatgtggctagcaagaagtattccagtctgtttgtgatactctcttttctccatcctgtgtgtaactctgttcaaattttaaagtcttaaaagagagtccagttcaccttgtttgggtcacatgttaatacatgagctagaagggagcagaaaactttgatttaaatccctctcctcccaaagtctcaaaattagggaaaggcaattctcctgaatagaaactgggttctattgacaatagaagaaggaaatgattctgaccaaccactaaacaataattgtccactgaactcagtcaagaacatgtagaataagttggaggatagagcaaataaaggagatttgtaggaggtaattattatgatctaaagcaagcttgttcaactcatggcctgtgagccacatgcgtcccaggatggctttgaatgtggcccaacacaaatttgtaaactttcttaaaacatgagatactttttgtgacttttttttgctcatcagctatcattagtgttagtgtattttatgtgtggcccaggacaattcttcttccagtgtggcccagggaagccaaaagattggatacagctgatctaaagcaacaggttcatctactcaacttcacaacgtgtagacctgaaataaagaccattcatataccaatacctgaaatataaatttgtttgaccatgacacgtacagtaattggttctcaataaatgtggatagcttgatggataatgtgaatgcaatgtgataaggaaacttcatattcaacaaagactggaatgtgaggattataattccaaagcaccagaagatagataagataatgcaatgagacattttatgactcaaggcaaagttagttatgagattcagaccaaaccttagacgtgcagtaattgaaatatttgccacagaaggggtataaggacatgacattcaagtaagctaacctttcactagctttagactttgaactcagaaaacatatttggtgaaaagcttatggtcccctttagtatgtattgcttgattaaagtattattttagaaaatggtgagctgcttccattttgaaataaaaataatttttactaagtgaattatattcagtgaaaaaaatggaagctacaattacaactttaatttttttaagttttaagaatacagccatttaaaaaaattaagcaaatctgcttcattttagacagtagaaaatataccattatcttttagaagaatagagatgtgaaatatgcaaattaagcctttagaagtaaagcacacatgaagttcaaagtttaatttctagaattgtgaatcaatagcagtggatgatttgtactttatagcttagtgtcggagaaatctgattaaaaaatgctttttctgtttcatcacataaacataagtaaaattgctctgaaacaacaatatttgacaagaattagcagttttcttttttgacataatctatcaaatgaagggaaaaatatgtcctgggttttgctttgagagtgattactaaatctgacccttaaggaaaggaaggagagaacaaagaagggaggaaagaaagggaaggaaggaggaggaaagggaaaaaaagaaggaagagaggaaggaaagcaggaaaaaggggaaggagagagaaaagacaaaagaaaggtagcaaggaaagaaaaaaagacaagaaaggaatattaaagaggacaaaagaggagtgaggaaaggaggaaatggaagagggatggtgggagacaggagggagaaaggtggagggggaaatatgaagagaggttcccagcagtggagactagtgttgctatcaacaaatagaatttagatggccatatgatattatttttcataatactggtgtctgattgcctgtgctgagttaattgtagtcttttttttcaattccgtttggccaggtgttcaggataattcaccacaaaatctcaaccactgcacttgtattgaataaagaattgagttggcaaaggcattttatcctccagtaagacctttccagattggggttgagacaaattggccaatctggacaagatgataatagcattgttcaagattaatttttaaccacacattgcactgttacctgggagatttcattatctaaaaattgaatgagcagttttagtgggtatagtgtatatttaaatgggacataattacttgaatgagtttaatttttgttgttgttgttaaggtcaaagtacttaaaaattatgattttttaaaactctgtctatacacaaaaagcatttgaattagctacagaataattctgattataacttttggtgaatagattcagtcaaaatctgattactaaacaacttgtgtagtatagccctggaagaattgatgggacaatgtgtgggtaaagtggcattggctatttaaactaaaagcaatacaaaacagaatgtttcttggttttattctgttgtcacaaacccagcagaaagtggctattacaatagtttcccttattcaacaaatgagagaagttatagacaatttagttaattgatctaaagtcacttagtaaatgtaattgtcctaacataaacccagacccccagacctcttgggaatagataatgtttcttacttcttttctatttcctcagccacccccctcaacttcttacacatctcatttctccatccaaattataacaaaacaaagcaaacatggtttatttccatgggcatcaaatggatttcacgaggttgggtgacagtcatcttagggtgaggagattgattattctgtttttctctttcatcgatcaacaatccagcccttctcatctcatcatttcatttctgcacaaacttgtttaagaaataccaattaagaaattaattaagaaattaatgttgtaatctgtttggctgaagatatttacaaattttgtgctttaattatcttccaacaaatgtacatgtctctggtagacagcttgcgaccatctggatgactgatccatatttatataattttctttctttacctaatgagaccaaatccactattatcttcaacgaaggatgtaaagatatgtcagtgtcagtaatgtgacttattttatattctctggtcataacaaaaataaaccgccccttaaataaaaaggtcatagagttgcaaacacacacacacacacacacacacacacaaaatcatattttctaagtctcctaattacctttttatggaaaatgataccatatgcttttttcttaaagaaactacataaacttataaactatactaaactacacatttcaaagtctatgaatggaaatgtgtatcttattatattttaattcaattcactgtaaacttttctgtcaaaatcttatcaagcaaaactgatccaggatatttacatgaattctgatggaagtcactgtactgtgttttccataaaataccagtgggattctgataaggaagtttatgtttgccattgtgtttaaatagagaattctgggccgggcatggtagctcacgcctgtaatcccagcactttgggaggctgaggcgggtgtatcacctgaggtcaggagtttgagaccagcctgaccaacatggagaaaccccgtctctactaaaaatacaaaattagccgggcgtggtggcgcatgcctgtagccccagctactcctgaggctgaggcaggagaatcgcttgaacccgggaggcagatgttgcagtgagccgagatcacaccattgcactccagcctgggcaacaagagcgaaactccgtctcaaataaataaataattagagaattctatttacaaatttcctttcttggatctagttagggctcctttatatggagtgatttttattgttttcatagaaatacgtagaatctgggtcttctctaactttcttacaggaaagcaatgtaataaggtttttttttaattttctgaaagttatataatgttattgttccctaaagtttaggacctgccttttaggctttccatttcaccataacttttggtccttaaagtctgtaattgaagttacagtgtgttatgatgtaaatttttcttattattacctttaatgttagggtaatgttaactaatgttaatgttaggtatatggttgtttttttcattccttcgttcaacaaattgtctttgaaacccatgttacaaagcactctagagtcaggttgaagactattaagaaaggagaatagaaagagacactagagtaataatttggatttaaatttgatttccttgtgtatgatagtgaataagtgtgaataagatgaggcagtgatcacacatcactattagtaaaagtgtttctgtacctgtatccacacttttatgtatatggttacttatgttaaagtgatacatattatataaaattaacgtatacattaagtagatattttaatagtctgtaattaaatactactagtattttctttcctccttcaagtgcttacttttgatacctcgagttacagtgtcataaagattctttagaaatatattgactgtcttttaagagcttttgatacaatactgagtttacattcatctgttatttattgaacacttgctggtgaaaggcatcagtgttatctgctcttagggaacaaaaattaaaaagggataggccctaattttagagtgtatcctctataagaaaaacataaaagatagggcagtcatggccacaaaagaaaaaagtgttatggtggtttcaatcatatatgtattagaatgaataaatcaactgatcaattgtgatttcttattctaaatatgtgcctgcctttttcatatagatgaaaattaagctatgtttatctttccagggatcttgttgatttttattcaataacttgggagtgaaagttgatttttgcatatgttttaatgtttttaaatttcataaatgaattgatcagtaatttccaaggtagtaatggctgcattgtttttgaaaaaaaaaaagcaacaggatttgattgtgcttttatgatttttaaagaattcattaaaaataatgccacggtttctaaaatgatttgagtcaatttcttattcgatttataaaaataactttgaatacaattttagtaattcacaaatgctttcagttcccttacctttatattttatattctgtgtaaacaagtgacataatatttaagaattatatatctcctatgatttattcaagaaaagaatatatactgtattatttatttcaagaacagaaatgctttgatttaactgtcatcttctctcttcaattatggaagcaaaataaactgtaatgaccaatgtaacccctcccccatatcaagttaatctatgttcaactccagaattatttttgaacactcaaactagaaattaaaaaaaattaaatccatgaagacgatttttgccaaaagcatatagataaattgagttgattctatacttaagaaagtggagaggagagagtaatttggagagagtaatttactcttaatcccatattttttccctaaatgtgaaagaagtagattgtagtgagagggaaaataacctgtagcaacttcattgaggctaagctttctgtcatgttatattatacgaaagtaatgaaatgcttccacagatagaatcagaagtcccctctgagaaattctacataaaaattagcctgccactttaccacacttactcaagtttgatttttttaagttatgtaatagatgttaggcactagaagaggacatttactgggggcaaagatcagtagttggaaagaatgcaagcaggcaagaagctatatataatgagattttacagtacaattgttttctaaatgaaaatgaggacgggtccagacacaatggctcacacttgtaatatcagtgccaggatggaggatcccttgaggccagaagttcaagagcaacctgggcaacagagtgagacttcatctctacaaaaaaatgaaataaaaagttagctggctgtgatggtgtgggcttgtagccttagctactcaggaggctgaggtgacatgatctcttgggcccaggagttcgaggctgcagtgagctatgatagcgccactggattccaacctgggcaatggaacaaaactccatttctaaaaaagaataaaatataaaactaaaataataaataaataaaaatgaggatatattttattttaacatttggaaactttgtaggtgaggaccatgcaaacattcaaggtgtgagttctgaccaaatccaattattaaccataccaatgacttaaggtttcttcacactccttaaagttgattaatataatgattatatagttgactggtatgtcacagcttgaagcctttgagatttattcctgccttttctgtaaaggttgttttgttaattccagtatgtactggtcgtttttgttttgttttgtttttgtttttgttttgtttttttgagatggagtctcgcactgttgcccgggctggagtgcagtggcacgatctcggctcactgcaacctccgccacctaggttcaagcgattctcctgcttcagcctcctgagtagctgggattacaggcactcaccaccacacccggctaattttttttatttttagtagagatggggtttcactatggtggccaggctggtctcaaatacctgacctcatgatccacctgccttggcctcccaaagtgcggggattacaggcgtgagccaccgtgcccggctgccaatatgtattggtctttttcatcaatgattcagtccaaaatcattttgtcctttaactatatattttcttgtaaagctgcttctgttgtcttgaacttttcttttcaaatgtatgttgtcatttgactttttagattgttattttctggtcctcgaaataaatttaaatttcctgtaaaggaaggtgtaatattctatttgacatagccgctaaagatgtactaggtgctttataaatattgttgatttactttatcttcacagattactagttttacttagtatttggaatatgacaacattttatagagctatattcatatatatgtttatcttaactgttaaatgcaatatgattcatgtcttgttttggtcaatgatgaatgaaagtctcctgagaattaaatttactgcatcgatgcaaaaacaatcataattttagacactctaagaattttagaaattaaaggattttttttttccagtttactctgttaagattgtgtttagctatgcgtgacagcattctcactacagtggcttatccagatagtttctttttctcatagagcaagacttccagaattatgtgttccagggtcagtgcagcacctccaaaaccgtatgtcccaactttttcctccaaccccagtcatctccaacatgagactttctttttgttttgttttgttgtttttgtttttgtttttgttttgagatggagtctctgtcgccaggctggagtgcagtggcgcgatctcgactcactgcaacctctgactccctggttcaagggattctcctgcctcagcctcctgagtagctgggattacgggaacgcaccaccacgcccagctaatttttgtatttttagtagagacggggtttcaccatgttggccaggatggtctcgatctcctgacctcatgatctgcctgcctcagcctcccaaagtggtgggattacaggcgtgagccaccgtgcccagcaagactttttttcctgtggtctcaacatggctactctgcctccaggcactatgtctgtactttaaaatggaagaagggaaaatggggaaagtaaaagcatattccagctgtgtcagctcctgtttgtaaggaaaaccagtgcttttctggcagccccacacagaagagtttctacttgaacagtgcattaaccagaaatgtgtcacgtgaccattcctaacttctaaggatcttgggaggattgagtgttttaactgaataggtgtgtttctttcttcataattcaaaatgtgaaaattggtaacttagttataaaaccttgctagtctgaacagaatttggatttttttagctaagaaggaaagaaagggtatcggataggcagctggctatgctagccaagatactcttaataatgcacatttttcttctttggacataagcagttttaacttagctaaatatgatgtgattgttttcctgtcttcttagttctgtttaaatttgtttcagaaatcaaggaaataaaatggagaaaaaactctattattcatgtctatctttctgcctctgaatatttttatgttggagaaagagaaagcagtaactttcataatagcttacatagtctgacaaattctaaacatgtccgttagcatcaatatacgtggtattaggtcatcagtttttatattctgaattattaagacccaaataaacccactgagttcaagagaaagtatacactgagcaataaaaacattaccagttctagcaatgataatcaaacaagaaaacaagtaatatagtctgtttagaataacatgttttaaagatcaagtttttcttccttaccaatgttgcctttcttgtaacacttttttttccttcttgagataggctttcctatcttttgtcacaaaccccaatatttacatggccattcgtagtctattcatagcagcaccaccccatggcccaaacttgtagatattgccctccttctatggttgttctaataagaataaccactcttgtctctcataatctcagctgttttgtgccgttaaaatggaaaataatgagtattaagatactaactaggggccaggcgcggtggctcacgcctgtaatcccagcactttgggaggatgaggcgggcggatcacgaggtcagaagattgagaccatcctggctaacacggtgaaaccacgtctctactaaaaatacaaaaaattagccaggcgtggtggtgggtgcctgtggtcccagctactcgggaggctactgcactccagcctgggcgacagagcaagactccatctcaaaaaaaaaaaaaaaaaaaatactaactaggtttcagtcatatgagatgaataagtcctacaaatctgtacagcctagggcttgtagttaacaatgttttatatttaaaactttgctaagagagtaaatctttttttacctgttattatcgtacatgcaaaaataatagtaaataaggaaggtaagagaaaaattttggaggtgatgcataggtttatggcatagattctggacatgatttcacaggggtatacagtcatgcattgctcaacaacagatatacattcggagaaatgcatggttagctgattgatcttgttgtgcaaacatcatacagtgtacttacacaaacctagatggtacatcctactatacatctaggttgtatggtatagcctattgctcctaggctataaaccagtacagcatgtgactgtactgaatacttcaggcaattggaacacgatggcaagtatttgtgtatctaatcacatctaaacatagaaaagttacagaaaaatattataatcttataggaccactgtcctacatgtatacagactgtgcacatgatagtggtccattgatcaaaatgtccttatgcagcacataactgtaattatctcgaaactcatcaagctgtgttcattaaatgtgtatagctttttatgtcaataaagtggttaagaaatcaataaagtggttaaaaaatattttgactaggaaatatactatcatttctagttgataaaagatctcaacatttccaaaattgtcctacagaaaaccaggttcatcaggtgttcatacatgatcctcatgaaaaggtcaaataagctgaaaaacatgcatagacgttgcctatcctagcaatctatgatgtacatctccatagtaaggtcactgaaaagtcttttaggaatgttagtattgttagctcagtatttctcagtgatttctccatggaaaccatttgtgtagagcatcttgaggagcacagctgagagaacattatcttagttggatgtgtatgtccctctgagtcacttgatttctctacatatgcttttaccaaattaatcttttagaaatcttttctcttcgcactatgtctataatttgtgaagttgttaccaggataacatttgtgcctctcaccatgatgtacctaccagggtccaagcagccattccttctctagagcaactgtctgagggaaagaatttaacacagcattctacgaaatcattttatttataaaaatagattactgctttacatatagtaatttatatttagaatattgattaattattaaaatctgcatgagagctttaaagagtagtacataatatatagcagtttgtactcaaactgtcttctaaaaaggattcactttttgtttgtattctattgtcctattcgttgatagtgttacgtaagtaattataaaacttaaaatctggaaagagaatgtggactcagaatgccatctcttttgttatttcaaatggattagaaatgaacatacatattcattttctttcattacacatccagagaaatagaatggattttataaatatgtaaaagcaaggattttgatcactgataaaaagggaaggtttggtcactaccttatttcattccttttttcttatccttttttttttttttgtcaattatttgatgacatctctgaacatcaccttttattcatgacaagaattgggtatcatggtaaagaacactgttaatataattcagttacttcaccccctcctgaaatatagagaagctttaagactatgtgaatatttttttctggttttcttgtatttgtagaaatagcatgagctttgtttaaagtcaggcatctaaaaccttgccctgtatgttattgacaacctgcacaaattttaggatctattctattacagtttgttcaactgtaaaactaggatagcaaactctatgtcatattttcgttatcagaatttaaaaagcatgttttaagatcttagtaaataataaatctctactctgtagttgaatttgttctatattctttaagaaattccctttgatggttatgccaacctctgtattacttttcttcacactttaactttgcgctgaaatcatagtagtattttacgttatcagtcaaaataacagtcatccttaaaacaaatatgaattttagatgattaaatagatttgtatggaggttcttcttgctaatcatagcagttatccttggtgaaaaatgatagacacttgaaaaaaccaattaatcatgatggctatttttgcatcataaataaagctttcaaatttgagagggaatcaaaagggcaatggtagtatagtgtctcaaagcccctttccaattgatggtacaaatttaaaaagagagagagagagagaaacatgtttcactgtaattgttttctaagagcttccaaaaaagcgtattttcttaatagattcaaatttttcagttggattgaaagggaagtcttggagtgtagtgaggagggcaccttctgttgagaggtgttcagacgacagagtgtgcccaaggccaaagatgagatggttttgcgaaagtcagtggccacaaacaggtgtgtttgacccctgagagatatgcaggaagtctaccccactttaattcttccaaatattctttaccttaattcccaagtacttgataaaggagcaatggggagaaaatatgcacactattatggaaaagttttgacctacactttggagagttttagattaagagcattctagaaatcagtcccaaatgcctagggtttacttacttaaagataatatcatagtttgggtgactgggaagcataccctgagattgaggtgagcatgcagtatgtctatttaggagtgttcttggggtcaacgtgtaggggcagagggagaagttgagctctgacgcagtcttagtaagggcctcagctgaccgttcagggagttcttaagctggaatgacccttcagaagtgctaggaaacgaagaaaggggactggatctttataaccccgtgtcaagtcatgcactggatgtgggctactccaggaaggcaacgaactttagcaagatgattctctttagccacgggaatttccataagggggctgctatggtctgaatgtttttgtccctccaaaatgtgtatgttgaaacctaacactcaaggtgatggtattagaaggtgggggtttgggggggtgattaggtcatgcgggctctgccttcagaaacaggatcagtgcccttataaaagcggctccagaaagcttccttgccctcccaccatgtaaggacacaccgaagatgccatttaacaggagtgggccctcaccagacaatgaatctgctgatgtcttgatcttggaattcccagcctccagaactataagcaataaattctgttgtttataaattacccagtctaaggtatttagctatagcggcccagactaagacaagggctgacagctgaaggctgtctaccagcagcactcctagcagctggggaactaagtccttcatttccaaaggggaatctaggcagcatatttacagcttttcactacagataagctcattatttcaaatagggactagcaggaaaaaattaaattgcccaaaatttagtgggatgctgaaatagattgtggtgtgtaaattggagtatagtgaggagagcaccttcaaaccagtatgtactacatgatattgtttttgttgcaatatttattatatacccaaacacacatatattacttttagaaacacacaccacatatatatctatgaatattttatatacacatagggaaggattgttgatgttatttatgctattttaaagatcgatgttttcatataattatgtattggttatatattatttcttgatataaggtaaaaaaaaaaagcaaaacaaactttaagtgatcactatgaaaagaatcccaatgctgcacatttaggtttatccaactcttcccattaaaatattaaatagtagaaataattgtgaataagaaagagcagattttgaaaaatggaaagaaatgcttaaagacatagcattgttgcccaaccatcattatttaaacatacagtgtttggctttgaccaaattgccttcaaacacttccttttggcccaaaatgttaggtcatatatactaccataaaattcatgatgcttaccatgcattaatttctagtatataccaggcattgtgctatgcatatcatattcaatatttctaatcctctcaaaagtggtacaagctaactggcgtttttcttgttttgaaagggagaaactcagagaggttaagtgacttgcccaaggcaatgccattgataagtgccagattctatcacaggtttattggcaacaaaccatatgtgcgcgtgcatgcgcgtgtgtgtgtgtgtgtgtgtgtgtgtacacatacacgaataacatatatggtataaatacgtggaaacataataaactgcattgagctgcgtttataattagtatttaggacatgtttggcaaataaaaacagtggagattgaaatggatttgcttaggaaaaatgatacattaaaataggctttattatgagtcttcaactattctgtgaaaatagatacccagggaagaaataatagagaatatgaatcttgagcaggcaactgagaacttgtcgaagagccaagataaaaatgtcagagaggagaatattttggcagctcagatgagcccccagagggtgggaggcaatgatctcaccgcagtctcgtatctgaaccccaggtttttgcatctccataaagtaatttcttacacccctcaataatgatcgggcttactctcaatctctcgctctctctctgtgtctctctcacgcacacaaacatgcagaacatttcttgcacatgcataactcataagacgattatgtaaataccagcctttttatttcataactaaattacaaggcctggttattgtttggactgtgaaaaaataattatgtgaataggtgcctcaagatgaaagacaaggcaagattgtgaaattattcatatgatagtaatagtatgcaaaaaataacacaatctttaaagatctttaacgacctagttataaaaccatgctttataacaaatataaccatgaggaaataaaaagaaaaatgtaataatatactccaagaataaagtcaaatgtattgttgaatgtaaggagttggttacacttccttatagtggaggttattttaaaatttgtggcttacgtggtgttatgaattgccctagatcaacactattatgcaaggccaactattaggttatttttggtagataaccacagcaaaactttagtataataggtaaaggttagctacactcccataccctcactctcaggtgttgtcatactccgtataaaaggttcaatcaagggagacatgagaatattccagaatctagaggcaggatgcagttaaccttagagaaggcatcagacaactagaatcttcggattcaatgtggaaacaaagcatagtttaggcattaaatcttgggcaccattccaaagaatacaggttccataacttactatatttttatacctagcaagctagagatgaggaattgctctcaaatattttaaccaaagcatgtatcttaagtaacactaatctcataagtgaaaactcatttctaatattcattttgctcattagcaaggcctctagtgttgactgtgataaaaaatagttcaaatgctggtagaacccaccccaggagactggcctttctgattaaattctaactctatccccacgtgaattcctgacttaagtaactgagttcctgcacatcagaatataagtatattatagatataaaaacatatgtaattaataaatattttaagtgagacacttctttcatctttatggcttaactatatcagacatttgattatttttagcggtctaactacaaaacaaaacacaaagcccacaactaaaaatttctttgtatatattgcaaagaggcaaccatttggtgtcaattcaatcatgagtgaaatgctattatacgagtacatctccctggcttgtatgggggtaatagggcatggaatttacagattcacaataactgagatattcacaataacaaagatatcaatatgtagcttttcccataactttgtgtaatgaaatcctcagtttgtgctgtgtaaaaagcttattgtttacttctcatgaaaatcatcttagtttttatctttatttaatagtctgtaatttgggggtaatacattcgttttgttgatactatgtgaagtggcaagcagaaaattctaacaggaatagataagcaagtatcctataaatcagagtcagtgtctctctctctctcttttaatgagtcagtctgtctctctctctttttccctgcctggctatctatctgtatttttcagttttgctttgcaaataagagaattgtgtgttgtaaaccaaccaacttaccattaattttctctgaattcaaaagcaattacaagcggactcttgagtttgtgctgcctggttgtctgcatataggccagatgtctagaataggatctttatttactatttttaccctcctaatttcatggtaactccaaggtagatgatatttgtaatcgtacactacttgtcagaaatctttctaataacactgctattttataaaaataaacattaattcagtataaaattttattttaaattgttaattcaagcaaatcagtgaggtaacttttacactgccgagcgtacgtgtgtgtggattagtacagccatgccatagacttcacttgtaatcttttctttatattttttatacacctgaaatgttcatcattgtgctgtagaaaacaatctcattgtgtttttaaaagctagagtgggtattgagaaggggaagaggatcatagaaaaagttggttaacatgctacttaacacttcaaatctttactcgatgtcatcatcagcaacattttaaatttatgcttctactagtttgcagttcttttcctttgattattcttatgatacaagcctttccacacaaaatttatgtacaggaattgtgtagaatttttctttggaaaatatggtgatttattacaatttgggcaacatcatcattttaaaaattcagaatttgatttttctcagaatcatcagaaagaataaagcatatatatggttcatgtcaggagaattagaacatgagaattaatatatctctgatcttttaaaatattttcatgtttgtgaatcagcagatttttcctagtttgagatttaaaaaatctagatataattaaaatctcactgatgtttcaccatcagatgattttatatttgtattttcttccacttcataacttgtatagagaagaatagaagaaagaaaaagggaggattgataatctttctctctcagttcttatagcacttcattttttaaacttattacttccttctgcctgctttgtttgtctacatgtttgtatttcatgatttcttagaaatccatctactgccattctgaaggtcatttacctgaaaatgatagaaagcagcatatattcaaacaactgcagagtaattgtctatatcagttatcattgttcattacttttctgttttaggattgaggggctgcctcgccacctccctcacacccccagcatattatcacaaagcctactgattcattcacatccctgggctgaatttgccacccactgtgtgttcctgttgttttgtgtatggaagtgaaaagatttaatttgatgttgttgaaaagacacagaggctaactttcaattttcatatgtagttcttccctctccctctgcaccacctcctttacttgttgagaaaattgccctctccatggtaacaatagaagaagctttcagattttagtagtagttgttgcagagaaaagaattcaaaaagtagatgaagtttaaaaatgaaaaagagagaggaagacagctgggaagaaggcttaatgtttatgagtgggtgtggaggggaagaactaagttgaatgaacaaagctgagctaaggggaagatggtttttctgcatcccagaaggcaataccctagcctttcctgcagccttcactccccaaaagataagagctttatctgaaattcttataggattcattcctgaagagcagcttgtcaccaaacagaaacactgtgatttcctcagggagtcacagtttattattatttttttaatgtaacgcttttgtgaactccagtttccacctcaattcaaatggtcttttggttacagggtgaaagagacccaacaatacacctttcccacttccggaggcctttggttaaaccatgtctgccacaaggacacaggagcctggtatgactggttgttttttgtttgcttttttgcctcctgtgctttctagattgtgagatactgtaactcttgtcgatgacacatagtaccgaacccacccgaagaagtatgtcagtatgtcacattgtgacaaacagcttctcatgctaagtaaatgcagaaccattgtgaaaggtttaataatgcccactcctcccccgccaaagatgtccatatcctaatcccaggaacctgtgaatatgttaccttacatggcaaaaggctttgtattaacagatgtggttaagttaaaaatcttgacacggagagatagcctgggttaccccagtgcgcccaatgtaatcacaagagtcctcctaagagagaaggaggtgatgatacaagcagagtaaaagagagattggaagatgctacactactggcattgaagatgaaggacagggccaagagccaagaaatgcaggcaggctctaaaagctggaaaaggcatggaaaagaatcctcccctacatcccttagagggaatgcaagctctgccaacacattgtttctagcttgtgagacccattttttggactttggacctccaaaattgtaagataataaatttgggttgttttaagccattaagtctgtaatcatttgttacaacagccacaggcagctaatacagccatgaacatttagtaatgactaactttgcacaattttaatacaagcttcttattaaggtttattttttcttaattacaaggaataaaagtggggtctgggggcaatgtcatggtccactccgttttagccatatgaatttgtatttccagcattagaacaaaaggtgacaaatctgaatgtatttgtgtgaaataataataaagcagaacaaaaagggaaaagtgtccagctggaaatgaagttagagaaagatgaggagaagcaagccaattgtgtagttttcccttctgctttttaaaatcatgatttgtttaacccactgaattctattttagaaacaggactgcaaggaagtgttgatggatttggtggcatgagaaccagagtcacagaggcaggaaagtaaggaataagtgttagaataggaagcagagttgcttgggaagagaccttatgacatgtggacagggctagacttaggagtcagaaagacctgagttcaaatgctatcctttagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccatttacacgatattgattcttcctacccatgagcacggaatgttcttccatttgtttgtgtcctcttttatttccttgagcagtggtttgtagttctccttgaagaggtccttcacatcgcttgtaagttggattcctaggtattttattctctttgaagcaattgtgaatgggagttcactcatgatttggctctctgtttgtctgtcgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttctcctaattgaataccctttatttccttctcctgcctgattgccctggccagaacttccaacactatgttgaataggagtggtgagagagggcatccctgtcttgtgccagttttcaaagggaatgcttctatagtacaaggctacagtaaccaaaacagcatggtactggtaccaaaacagacatatagatcaatggaacagaacagagccctcagaagtaacgccgcatatctaccactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaagggcaacaaaagccaaaattgacaaatgggatctaactaaactaaagagcttctgcacagcaaaagaaactaccatcagagtgaacaggcaacctacaacatgggagaaaattttcgcaacctgcttatctgacaaagagctaatatccagaatctacaatgaactccaacaaatttacaagaaaaaaacaaacaaccccatccaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgaggcactatttacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcattcataggtgggaattgaacaatgagaacacatggacacaggaaggggaacatcacactctggggactgttgtggggtggggggaggggggagggatggcattgggagatatacctaatgctagatgacgggttagtgggtgcagcgtgccagcatggcacatgtatacatatgtaactaacctgcacattgtgcacatgtaccctaaaacttaaagtataataataataataataataaaatctcaaaataattaaaaaaagaaacaaacaaatgctatcctgatcctaactggctggctgtctttggggaagttggtaatcttttctgtgcttatttcctcatgtgtaaaaaaatgaatatagtacccagctaggtagagttgttgttgggattaaatgatgactataaagcatctagcccagcttcggctacattatagctgcttacgaaattgtagttacgatgtaaaagagaaaaacactggaaaaggaggatatgggccattttattccaccttcaccaccttttagcttggtgaccttgggcaaattatgcttcattccgtgcttcattttccttgtctataaaagggtgtaagtacagaaccattgaggggtggtcattattaacctacctcaaatggtgtctgtaagttaatatatattgtgcttttcctatgtacaatatctagcacataattacaaatcaaatccatcccatgtgcaatatctagcacataggaaaagcacaataactagttattactcttgttgtagtaattgctacgctgtaggagtttgaattgtaaggcagtggagagtcactgacctttacgagaaagtgtagcagaacatttgagtagatagtaatggggaatattacataaatggatagatattaggggcagatattactattaaaatattacagcatggatatttattaaggccaaactggttaattagttgcatctctcaggttcctaatgttgcttaattttttaacctcccattttgtgctgccctttgtacgaatatttaatgctcccaacacctcttcagtagcacatgtactgtgagtttgttttgttattacttgtgtgtattagcattcctttgtgaaccaaaagcatggaattagctgttgcctctaggctacctagttttgtagtttggattgaagccttcacctcagtaacacctattctgtctactatcttacagaaaacttgtaaaattaagacagatcattaatatagcagaaagagacaaagggcagagaacattgagatactggatattggaaccacccaatagtgttgatttatttatgattatcagtttttgtctctgcctagcctcatgccactaaagtctctgaggcaacaaagaataagcaattttgctcaccttatacaaataaaacacagaaaaaggaatcactagagaaatggtactgcagcctttctgcagggattactgcttatttttaaattacttaaaaggtattgaaattattgttcataatgagaaacctgcctaataaaacagaaaattaaacttaacacttccctataatgtaaacagctcggttaggaacacaacattacagaaaccacttaagaattgattgtacttgttcttggagcagaactagaagctcaccgtttagaagctgtgcacatttccctatcaaacagtacataaagtttccatattcctcagaatcggcttcatttgtgccatgtgtttgcttggaactatgccacagaaagcagttctccccctcaagctgggctcctttcatgccgcagtgcaagtgtgtgatatactggcaccatgtgctaatgtagacccatttttatatgataagaattagtacggcctagggaatagacaagtatgtctaaaatcctccccatagaatatgtcccttcctttaaaagctgtcatactgtaagttccagctgagttaaaggccactgtgctcctatagggaaatatattctattgtaatttttacgttctccaataacagtctgttctttgtttactgaagagagctttcatgtcataaaatggtgttttttgacagagaagcagaatcattgttttattatagaaatttgctcttacaacagcaaaaataaatagctcatctcttaagctcctgatcaatgtctaacacctcctacccccagcaacacttcactgcaagtatattaacactctataatagcaattccactcacctaccaagaaatgatcttcacaaatgatttacagctaaaccagagcttaaacacatagcacccaatcaagggcagatttttatctttttcccagtcatataagttctgagaagaaatagattaatgttgatctcccagacaactgctgagaaaatgtacaaaggatgttgtttattttgaagaatgagacctagttgttaagcactttttccccttatatgtacgtccaaaggtaaccattacaccattttgatgcaaatttaggatatatatttattcatacctctcttctccattcggatgttgtctgtgtgagtgctcacagacacatgcacacatacacacatgcactcctgtttcacacttatttgtaaaactcacaaggatttccaagccattaatatagcattgtttaaggtgaacacatggttgttcaccatccatatgtatcttcactttgtagcactcagaatttggcaaaatcagaaggctgaaacctcatggattaaatatattctatataacatatgtcttaattgctgttactgtaaagaaacctggactagccatatttgactaatttctacctaaggtatttgaattcttataaatagattcattgctttaatcacacaagagtggtttatatgaatgtaattatctccactttatagctgaataaactgagcctgattctatccctatatgggaaacatgaattgaacagctgtgccaattattttgataattcaaatttcacatctaccatgtgaagacagcagaagagggttagggggcttgaattattctgattaactgtgttcatgagtgtaatcgcctctagataatcactcatttcttcacttcacttcccatctacaggtagtatcagcgaatggtaacatctcttgctttgcctcagtttattgatggctgccgttagaaataaaaagcatggttttgtttcagtacttaaatgaataatatcttcaaaatgtttttaaaacgtgaaaaggttgaatgcatttttaacaaatgttttgttagctttgacttttatttttgaacagatgagcacaataccccagtactcctttcctagaaataggagtactacctgaagacttatttcccaaagaaaaatatcaggtctagtgcagcaatacgtattaagggcattgaaaagttatattcacaaaatgtgacatcataacatatgttaatacttcttatcactgataataatccttgaagttgtatttccagagagatctcaatttcttctcacactctgaaagtctctgtttatcctttagagtaggaatgtaagaatttaacaaaacattctgaatgtttaccttttttctaaactgaaactacaatccctttttacccctatatagtaaaatataatattacaagtagaatcagcaaatttgtttaataattctttgggacagtttttacaagcaatggggttgaatttatgttccttgtgtgcagtggagttattatattcttcttaaaaagatgcatgaaggtaaattagaaatgttttacatgttttcatgacaggacatttaatcaaagaggagatacaagaggcttttcttgggttactgcaatttaattttccatttctttcttggaagggacattggatgcagttgtacgaggttaatatttctaacatgccacttttattgtggcattcttctgctctcaaacctctgatgatttcccatggccttcaacatgatgtccttatttgggcatctagtgttctgagccctcacattctggccccagcttcccttctcaacttgatcacagccatcgtaattctgctaactaattacacagctgcccttcccactctttctcaaccactctgctgtattctgacttctacactttagttttaaagctactccttgtcctgaaattccttctcccattaggtcattattaattgagttcatcctctaagttacagttcatgttgctgttcctctatggcaccttccctgaacctggtcccatataaaatcccatctctcagaatcccattagggtaggatatgtggtctgtagactattacgtttgtcatttacatattgtcttctattattgggtaactgcgtgtgcgagcatgcatgggctggcctgaaggtcacctccccaactgcattgaaagttcatcacaagttcaattatttcactagagagtctctttcatgtcatccatgaggcacattccctactgtgatgtgttatgcatacaattatttcaataaatattttctagctctttgattgaccaaagcttaattacctgtcaactctagcctcttgtatctggaatttctacagtctttggatagtatctttaggatgcaaaattaggaggagtatgtaccaggcaaactattacaaataatgccctcaaatagttacatttcactattcatgtcttgtaatttatcttctgctttggtattttagtacacttatgattcaatttgctgtatagattcctctgaatagggacaagagaattcgtcttgataagtggaagttcgaaggattccaaaatgatgttattcaaggtagaacaagaaattaatactgaaaaaattgaggagtaataatccccaaatatgtacatgcgtatctcgttttattgggtttcactttattgcactttgcagatatttcactttttgtaaattgaaagtttgtggcaaggctgcattgagcaagtccgtcgggcacaatttttccaacagcatgtgctcgctttacgtctctgtgtcacgttttggtaatttgctcaatatttcaaacattattattattattatatttgttatgatctgtgatcagtgacctttgatgttactattgtaattgttttgagatgtcatgaactgcactcatatgagatggcaaactttgtggggtgcagtggctcacacctgtaatcctaacactttgggaggccaaggcaggaggatcgtgttagcccagaagtttgagaccagtctgggaaacaaagtgagaccctgtctttaaaatatatatgtagaaaaattaactgggcatggtggcacatggctgtaaggagccctgccagctgcatgggaggctgacacaggaggatcacttgagcccaggaggtcaaggcggcagtaagccatgttcactccagtgccctccagccagaatgacagagcaagaccctgtgtggaaaaaaaaaaaaagacaaacattttttcaactttgattttagattcagggagtacatgtgtaggtttattaccttgatatattacatgatgccgaggtttggagtacaaatgatactgtcacccaggtactgagcatagtaaccgatagttagtttttcaacccttgtttccctccctccccactctagtagtcctccgtttctattgttgccatcattatgtccatgacaacgcactgtttagctccacatgagaacacgtggtatttggtattgtgtttctgcattaattcacttagaataatggcctccagctgcatccatgttgctgcaaaggacatgattttgttcttttttatggctgcatagtattccatggtgtatatgcaccgtattttctttctccagtctgccactgatgggcacctaggctgacttcatacctttgctattgtgaatagtgctgaaatgaggatgagaatacatgtggttttttagtaaagcaatttgttttatttgggctatatgcccagtaatgggatcactaggttgaacgatagttgtgttttaagtcctttgagaaatcttcaaactgtttcactgtggctgaactaatttgcattcccagcaacagtgtatcagagttccctcttctctacagcgtcagcagcatctgtcatttttttgactttttaataatagccagtatgaatggtgtgagacggtatctcgttgtggttttgatttgcatttctctgatgttgagtgatgtggagcattttttcatgtttgttggccacttgtatgtcttcttttgagtagtgtctgtttatgtcttttgcccattttttttgatggggttatttgtttttgacttgttgaattgtttaagttccctatagattctgaatattagacctttgtcagatgcatagtttgcaaatatattctcttattctgtagactgtctgtttactctgttgataaattctttcactgtgaagagctctttagtttaattaagttccacttgtcaatttttggttttgttataattgcttttgaggacttagttataaattctttcccaagtctgatgtccagagtggtgtttcctaggctttcttataggattcttataatttgagatctaatgtttaaacctttattccatcttgagttaatttttgtatatggtgtaaggagggggtccagttgcattcttctgcatatggctaaccagccatcccagcatcatgtcttaaatacagagtccttttcccattacttattttcataagatggcaaacttaatcaatcaatgttttgtgtgttctggctactccactgatcagccattccctcatctctcttcctctccttgggcctccctattccctgagacacaacaatattgaaattatgccagtcagtaaccctacaatgtcctctaagtgttcatgggaaaaaaaagagtcacatgtttgtcactttaaatcaaaagtcagaaatgattaagattggtgaggaaggcatgtcaaaagccaagacaggctgaaagccagacctcttgtgccagttggccaagttgtgaatgcaaaggaaacgttcttgaagaaaattaaaagtgctactctgttgaacacaggaataagaaagtggaacggccttatttttaatatggagaatgtcttagtggtctggatagaggatcaaaacagccacaccattatcttaagcaaaaggctaatctaaagcaaaggactaattctctgcaattctgtgaatgccgagagaggtgaggaagctgcagcagaaaagttggaagctagcagaagtatgttcatgagccttaatgaataagccctctctataacataaaagtgcaaggcagagcaacaagtgctgatggagaagctgcagcaaactatccagaagatcaaactaacatctaagttaataaaggtggcaatactaaacaacacattttcaatatagacgaaacagccttctattggaaaaggatgccatctaggactttcatagctagagagaagtcaatgcctggcttcaaaagttcaaaggacaggctgactgtcttgtgaggggctaatgcaactggtgactttcagttgaagccagtgctcgtttaccattccaaaaatcctagggcccttcaggttatgctagatctagtctgcctatgctctgtaaatcaaacaacaaagactagatgactgcacatctctttacagcatggtttgatgaacattttgagccctctgttgagacctacttctcaaaaaaatgtgtctttcaaaatattactgctctttgacaatgtccctggtcacccaagagccctgaggaatatgtccaaagagaatgattttattttcatacctgctaacacaacatccattctgcagtccttggatcaagaagtcacttcaactttcaagtcttattacttaaatcatacatttcataaaggtatagctgctatattgtggtgagtccactgatggatctggataaagtaaactgaaaacggaaagtcctcaccattccagatgccatgaagaaaattcatgattgaggggaggaggtcaaaatatcaacattatcaggagtttggaagtagttaattccaacactcatcaatgactttgagggtccaagacttcagtagaagaagtcactgcagatgtggtagaaatagcatgagaaccagaatgagaagtggagtcagaaggtgtgactgaatagctgtaatctcaaggtaaaacttcagcggatccagagttgctgcttatggatgagcaaagattgtggtttcatgagatgcactctactcttggtgatgatgctgtgaacattgttgaaatgacaacaaaggatttagaatattccataaacttagttgataaattagcatcagggtttgagaagattgactcaaattttgaaagaagttctactgagtaaaatgctatcaaacagcatcacatgctacaaagaaatcattggctataaaggagagccaatcgatgcagcaaacttcgttgttgtcttattttaagaaattgctacagccatcccgaccttcagcaaccgccaccctgatcaatcagcagccatcctcactgaggcaagagcctgtaccagcaaaaagattatgactccctgcaggctcagatgattgttaccattttttttaggagtaatgtattttcaaattaaggtatgtacattttttagatacaatgctattgcacacttgacagatgatagtagagtgtaaacataacatttaatgcactggggaaccaaaaatattcgtgtgcctcattttattgtgatatttactttattgcagcagtctggaaccaaacacacaatattccaaggcagtcctatatattgtttcatgtctctctttcttctaaaatgtgtgtaggagaaaaaattatatcacttatgttactgggccataatatcaaaagcctgcgaatctgatgcacatgataaaaactggtcttaaacctgtcttgattatcctttgttaatatgccaaatttatagaacaatagagtttcaagaaatgtgaacaatgtagaataactaaaagatctaacgttgaatagctaaaattatcaacgccctttatatcactttagaaatgcgtttgcaaatcattatcaacaaattgtagcataaaattctttttttttcttgactttgaaattgtatttcaagatccgcaatttacaccacattatttacttactggcttgtgaaagtgaaaggcattttcatttttggatgttaagggttttagtaaatgacaagtaaatcaatcctttaagttccgtgtggtataatagcttggaaaggaccatcttaatctttttttcaacacagggagataatttattttaaaaataacacactaatagtagattaatattattaccatttcaaagaagtcaccaaatttggtaggcttaagaggttttttttttttttttgagattactatgctctttttttattttatttattttatatttatttatttattttttagttttttaattttactttaagttctgggatacatgtgcagaacgtgcaggtttgttacctaggtatacatgtatcatggtggtttgctatactcatcaacccaacatccaggttttaagcccccaatgcattaggtatttgtcctaatgctctctgtccccttgcccctcaccccttgacaggccccggtgtgtgatgttcccctccctgtgtccatgtgttctcattgttcaattcccacttacgagtgagaacatgcagtgctaggcttaagagtttttttaactccccaaaatatcaacaaattgaaacattactacaaagaaatagagaaataaatttcactgactgtcttattgttttttaagtttgaatagctaataatgatttcttaaacagctatcatattttttatttttaaagctagccaaatgatcagtgatttttataatactgataaatactgcttagaaaaggaacatgtgttctagcaatttccacacatttctgattctaattacttgtttctttttgttttatttttatatttttaagttttgtgagtacctagcaggtgtatatatttatttggtacttgagatgttttgatacaggcatgcaatgtgtagtaagcacatcatgtaaaatggggtattcaacccctcaagcatttattctttatgttccaaacaatccaattatactcttttaattaatgtaaaatgtacaattaaatcattattggttatagtccccctgttgtgctatcaaatagtaggtcttactcattctttctaactaattttttgtacccagtaactatacctacaccacccccacctccccacgacccttcccatcctcaggtaaccatccttctactctctatgtccatgagttcaattgttttgaattttaaatcccacaaataagtgagaacatgcaatgtttgtctttctgtgtctgatttatttcacctagcatactgacctccatttccaacaatgttgttgcagatgacagaatctcattcttttttgtggctgagtagtattccattgtgcataggtaccacatgttctttgtccattcatctactgatggacacttaggttgcttccaaatcttggctattgtgaatagcgctgcaataaacatgggagtgcagatatctcttcaatatactgatttattttcttttgggtatatacccagcagcgggaatgctatattatatggtagctctatttttagttttttgaggaacctccaaacggttctccatagtggttgtgctaatttacatttccaccaacagtatacaagggttcctttttcttcacatacttgtcaacattggttattgcctgtcttttggatataagccattttaacgggagtgaggtaatatgtcattgtaattttgattttcatttctctggttatcaatgattcagtgatgttgagcaccttttcatatgcttgtttgccatttgtatgtattcttgatctgccacaagtctctaattacttgtttcttgtaccactgtttcccttcattgtagtcagtgatttggtcaatcaacactttttacgtatgggtatctgttaactgtatttctaggaatggaccaagaattgagaaatttatcccaaccagaaagaacaaaatctatggaggcacaggattactgaaagctttgctcctatagcctcagtttttttctgcaagttcgctgcttcccagttgtccttgtgataaaattcaaaacctcaaactgatttttaaaaagccaactatatactgcttctactatgtctacctaaacttatttgccattatttgtaaagaattccaggctctaaccagcccatttgaggctttattttacgttcatgcctttgttcatgtctgtctttcccttataatgctcttctcattctctagccaaatctgccaaagttcagctgtagtgccatacttgatatgaagtctttgctgagaattcccatatgtggtcatttccttcactgatttgtttcaatagttgttgccattattattattttttttatactgttgctggatactttcgcagatccaatctctaacctgttgttctaccctaggaggttgaccaatatggcagtagcattgggcttgcttgtctattggcttggtccttgtgttgggaggcatcagcagatcaatggatgagaggagagtgagtcgagggatggctaggttcctttactcacagccccagctcctgtcaagaggtcttgtccctgcagccacttctcagattctactaactataccctccccttagcctttcaggccttgaggaggaaagcctcctcatcccactttgaatgaactatttattgcaagaaccatgactgattcagaatataatctgtccttgaatgaaatagttaatttccccttttgtattctcgtttcatatccctgtccctttatccattcctatattatatcatactatcatatagctaccttatattatactatgacatgagtaccttgtaagtatatcatgctatattatagttcttaagtgtgtgggctttggggccaacttacctatgttagaagttctgccacttattaccatgtgatcctagacaaattgtttaacttctttttcattcattttctttactagtaaaataggggcaatattagtacccacctcacagagtaatatgataattacattgactgatagtttttatttaaaacttttattgttcttactatgaaatgggaaatgttctaaacaccttacaaatattaactctattaattctcataatgaatctgagaggtagagactcagtatctccatttcacagtgctggaaatgatacagacagcatttaagtaacatactgaaaatagtaaaccgaataggtggcagccagtatgcaaattgggaaagcctgactccagagttcattcttttaactagtatgctgtgatagactcttttggcatatggtatgcactcaataaacaactattgttgttgtcgttagcattacttcccattgtattattacacaaaaaataattgtttatgagtatttgtttgctagattataagttccttgaaaaaagaagacaagttttatttgtctatgtgtactagctgagtgcttggcaaatagttgcagtttagtaaatgtttctaaaacaaattattagttgtttcttatgtatttcccaagtctatcctagccttggaaacagctaacacttagctaaacctagaaatgtcatttgagatttcagcagccatcattgttgctgaagccacaggttctcctttttatctccaatttcttcctcagatgattcaccactttctttgtcgtttccctacttcatttttcctatagtgacttttgttctccaataaccattgatagtgatgacagtcccaccttggaaccacttctaactgtcctgttcagcttttcctgaggccagatttcccccaaaatacattttttagcttcataactgctccttccagaaatttgaaacgcattctcaggaattaagcaagaggcatttgattgacgtcatttaatttgtgtttaaatgtgttcttcccatcaacgattaaccagtgcttcagccaagatacataacttttattctccactaaccttagggttgaggtcacaatcaggtacgtaatctgtagagcccagtgaaaaatgaaaacgcagggcccttggttaaaaaaaaattaagaatttcaagatggcaacagtagagcatgaaaccaagtatgaatcccttctaatgcagatccttgtgtaactaactgcacaagttatacgttcaagaagctggtcctggttgaggtctttgtctacctagggcacttctcactcagagaggtggaataatcttaactttctgtcttccgtcatctgaaaacttgccccaaagttccttttgccatctcttgcagcaaacctagtggttgttatctgttaaggattcctggtggcttgctttagtttcctacagttcttgagctgcatgtgttgaatggaactccaccattaccatgtaacacatctgaatactcttattttcctccagttaaattctgcgctccttggaaataatggtcatgcaccctaccttagtgatttctaaatagaggtagtatgtaaaaatacatatttacttgaattgcatcttaagaggccagcccatgggaggcatgaagaaacctatgttactaattaatattcaataattgacagttacacattcaggtagtagtgtcatggaaccatcacgttacatggaactgaagagctgatgagaggtttagggtctaggaggacaaaagtgagtgtattagtcagggcctgaggttatatgtacccagacaggataaaatgggacaatattttattagtggaaatatctatgtgaaagaaaagaaggaggaagccaaggaaggtgcaagagatgttagatcaagatgcaattctgactctgcaaggaagagagagggagagaaggctaggcagaagcatcccagtgtgcggtctagtggaaggaaattttggcaaagctgttgggaagtcattgaggcagagccaggcaaagaagtcccatgtctcccaaggaaggctctctgccttagtattcccaccacacccaatcattgggtgaggagaagtctgtgagaagcttggctttggtgcagtgcaatcatggatttcaaaatgcagtaacaggagtcctcagtcagttaagacccaataatagaaggcctgcatattctcatggtggccacttgggtatgaggagcagtggtgtttaaaactgttttgtataatttaaataaagaaaagctgaggactacttaagcttgattccttcagaagacagtctttggcctttatatttcatgtgatatctttgccatatgctctgataactctccatgtttcccctaccataatacctcaggttgttgcaattgcttttttattgcctgtcatcactactcgtttgttttctctttgagaacaggaattattttctccttcactgctacagcccctgcacctagctcaatgagtgacacaacagaagcacttaaaaaattgctataactcaaatttgggggatattctacaaaatacctggcctctgttggtcaaaactgtaagtgttataaagttcaaagaaaggcaaataactatttcaacttaaaaaagactaaggagatacgacaactaaaagcaatgcgtgagtctggaccagaccaggaaataaaaatatagctataaagttcattaatggggtaattgtcatactctgaatatagagtatggataagattatggtactaaagccacgctaaatttcctgactttgaaactgagctgaggttatttaagagaatgtctttgctattaagaaataaaacctaaagtatttaagggtaaaggggcatgatatctgcaaattattctcaaatgattcagaaaaaaaatatatatatataaaacattacatatacagttatatatctatacacacagagagaatgataaaatgataaataattaaaaataatgtggcaaaatgttaacaaatggtgaatccgggcaagggttacctgggagttctttatcttgcaaatattctgcaagcttgaaattatataaaaataaaatgcatcttataaagtatttattcagtgaataaagaacaaaaaaggctaactgcagttggaagatatttatgaagttggttatgaagattcttaagaagttaccgatggaggtgctagtagaacattcaaaaaagaagtagggaaggttgaccaagtaggaaaatatcaatatccaagccagtataaaatggaaatgagaagtgaggaagtaagtggaagacaatgaggatggttttcgatttggccactctatttggagaggcagccgaatgcaagaatagaagccagaagaagatgctcagtgagatggttgaaagctagatagattacagcatcctcaccagtaaaaccctttcggtaactagaaaggctacaatttagtaccttcctgacttctatgcttattttcttcaatacataaaatggttccgtaaactcttttaccttctgaattctttatattaattttttgaagttgtaaataaaatagcatcagttctacattgttacatttcagcttaattcatattcatttactgaaaatgggaacatttgaaaaatcatcatgggcatttatgctatgtagattgttgatttttatagaaaaatataaaaatatgaccagtttgattttcaaagtcttttcttagacatgtaaatactaagcattcaactcaacatatagagtttttatttgagtattatttaggtggaattctattttaatgaatacaataaaaaattgtaattttgtctaaaagcctaaaatgccctagttataatatgtatgatttcactgtttaacttcctatttcatagggttgctatttataaccacttcactcaactctggggggacttagtgagattaaagacttctgattcactttgtatttgaagaattttttttcctccatctttgctcagctagtggaatccatgatgaattctcatctccaaggggtaagcagtttttagtaaagcccagtagctgacttatgactccttagaaatagcattgattccttccttctcctgtgttttgtttcctctagaatgatagaatccatgtagacacgatccattatcatgcttaggtactggtaagcatgtaatgattttagttttgttcgctttaagttatttgtgtcacaaatatctgggatcatatcagagaaataaataagcacaattagcattctacttgtttgttatgactaaagctaggttgaggaaacagaaaaggaccagaggtcatatgaggatgaagataatactaggaacagcatgtttgggagagtaacatctggtaggggtagcagattgggggcagagaacagaattttatagatggatattttggaggcaagtagtttgagtaatgattagatctaaggtgttttctcatctgtgggtggctcgaaggaatagaggtgaaggtcagtttatttgagaagttctggaattataaaactaagttgaagtcaaagaaagtatagtagcaaataaatagaatacccttaaaaggaaaccaaatgaaaaataatcgttactctcaccatatgcttgtgttcttattagcaagaaattcttttaaccactgtttttataatatcttaatgaaaaaatactgaagcgtatgccatattaaatccctctctttatttctagaaagggaatcaaaggagaaaattcccattctgctatactaaaagaccactaagtaaagagcctattagtgtatgataaatcccatagcaatatacattatcattttacagcttctttgttgaaatgaatgtttgtatgtgttgaccatagagtgggataaaaagttgaaattttgttttgaaatattttagaaatgcatagttgtactgcagttgtgaacctccttagatttttaaggaggctgcttcaaaggatctcattaataatcttctcaggtgcttacaaagcatgtgtctgtcagcagaattagagaatcacccaactagagaacaggtttcacaataccctgagacctattttgttcattagagaggaaaatggcttgttttgagtctaagttgacatgcttgctaatttcagcaataaaagctgttcattgtggtcaggtttaatttagagcctggtaaggttcagattaaagttgatcaacttacttttacaacatacttcttaaatgaactttgaaatcttaaaagaaggaaaaaagtatagcaaacagtgaataatgtatctaaaactgagaagcaaaaaaaatctggttatgtgagagtgaattaaaagaagaacaacccaataaagataatctttgttatataaaaatttccaagtatcgaaaagcacgatttttcatgtgagttacacactataccgaatatatttgtccactgccacatgcatagtccctagaatagtgcctagtgctgaaaaatatttattaaaatgaatggatgagtaaatgaatttatgtattttgccagccctgtgtatttaaagttctctgttaactttgaggtgaaaatttgacttcatctgaggtttctgggtaagtccgttttaaaaattctattgaacatattcaaacattttagggtaggcaattccaaagcaacctttcagcttcccatgtcacagatgaccagagtttcacattctaacactggaaaacatcttatttcataaaatctacctgctactatatggttcctactttaaaatttgttcagtactctccagctgacttatgccacttacttcaatagctgtctttggcaatttgttccatatttcaaacactctgttgtgtaaagaaaccataaaagttagaaacctgaaaattggattttttttctgagcaatcacagcttacaaatgtggaaaatttgttaaaagttagcccctccaatttttcaatacagagaggagaaagtgcctaaagtagatgtacaatgtttggaaaagttttttgcattattttactattaccaaaagcaattgagtttaaatcacaaagcctgtctccctacctcttcacagaagaaacactacagaatgatcaaaatttggcctttccaaaaccaaaattcgttagaaaatcagcaggagtcaaagtacagagtaaataactaagtttcatataagtttcagatacattactatctaccactttcatctcttcatcttcattggcctcatgtggtagaacatcatatttaaaattatacaaacttgctggcttgtttactagtgtggttattataagaaaaaaatgagaaaatatagataaaacatctgtcacatattgcttataaactaacagtaaatattacttgtattttccccaattaaaataaaatttactgagttttagaaccagagctagtcagatgcctttttttcataaatttcttcataaatacctctgagattgtggtccttaaatctagagagactaagatgacagagaaaatagacactgaagaaagggaagaatatcttaatgatttacattactacctataaattaaaaattgttaactttattatatttgtatttttatttaaaatagtgctatattaaagtcatttataatacaggggaataggaatactaacctgtaatctgatgctctccaaacttgcctaaatcataaaagttaattagataatttatttaaaatgcaagatttgcagccctttccactacatattcattagttctggagggaggcaaaaaggtttggtgattcttacggacaggcagcttaggagaaaagctgatttagctcgtctacttcaccttttcatttgacaggtgagaaatctcaggggtacaatgaagttaaataagtaatatctcttaaatcggttctgtgctttttctgtttttaaaataaatataccttaattttgacgtcacacagaatgatattataagtataaatagttatctatcttttaaatacattgtcgtaattcagaataacatttcttactcaaggcattcagacagtggtttaagtaatccgaggtactccggaatgtctccatttgagcctttaaatgaagaaaatctatagtcaagattttcatttgaaatatttttgatatctaagaatgaaacatatttcctgttaaattgttttctataaacccttatacagtaacatcttttttatttctaaaagtgttttggctggtctcacaattgtactttactttgtattatgtaaaaggaatacacaacgctgaagaaccctgatactaagggatatttgttcttacaggcaacaatgcaggatttggaacagaggcgtccccagttggaagaactcattaccgctgcccaaaatttgaaaaacaagaccagcaatcaagaggctagaacaatcattacggatcgaagtaagttttttaacaagcatgggacacacaaagcaagatgcatgacaagtttcaataaaaacttaagttcatatatccccctcacatttataaaaataatgtgaaataattgtaaatgataacaattgtgctgagattttcagtccataatgttaccttttaataaatgaatgtaattccattgaatagaagaaatacatttttaaatcaattcagggcttatatagttgcaaagcatgcattgatgggtgtggtgaccacagtgtggcagaacatttgtggcagaacatttgttctttagttgtcatctgggctggcatccatggagatgccagtctctccctcatatccttggctgttggtccaagcaggcagtggcttcttcctgggccatctttcattcccatgtgcagtgactttcagatctggatatctctccgctactttgatgcccccattttgtaatatcaaaaatcatcgtactgtaccttatgccgtagtagggtgggcaggaactttggtaagacccatctgactagacgctgtgcatattcttttcttctgacatacactcctatccatttaatggggagagtgattcgcagtgattgtgtgttgtgtcagtgagtttccatggggtcaggaagagtgacagacgaaggagtaggggaaactcgccacccggtttccctcagagattctcctcagaaatgaggtccaagtcagctctgctttcaggttctctcagatctctctcggtttcttcacttctctctaccttccttccctccagggacacacactggtattgaattttcttgcttcctctgcaatatcccctcattttccttcccacaacccgaagaatcctttgtagtgcaggaaggaggaaaacctttcagccatctttttttttctctttgaaatcttttgtcttttaccaggcttagacttttcaaactcggaaaccatgagagtctatatcttcataatttatattctgctatgttaacccttccctaaggaaatgactagttgtcaatatgttggggaaagtgaaagagtaaccagagtaaaaggttaatattttaaaatattattagtcatacttccacatattgggtaagtacttattgataatagctagtatttattcagtacctcataagcattagatggtgtgtgcacatgtgtgtgtttctgtgtgtttctgtgtgtgtgtacaaaatctttacagaatcttgtgagctatattttataatccccattttatagacgagaaaacaggttccaagaacagttactcggccgggcgcggtggctcacgcctgtaatcccagcacttggggaggccgaggcgggcggatcacgaggtcaggagatcgagaccatcctggctaacacggtgaaaccccgtctctactaaaaatacaaaaaaaaattagccgggcgtggtggcgggcgcctgtagtcccagctacttgggaggctgaggcaggagaatggcgtgaacccgggaggcggagcttgcagtgagccgagattgcgccactgcactccagcctgggcgacagagcgagactgcgtcgtttacaaacaagcaaagaacagagcttggaatttgtaaatgtctctttctgacttgaaaatctgcgctctttctagtatgtttaccatttcccatcttgttttgttgcttttgttaatgaccttaatcattgtactaagactaaatacttcttttgtctgaaattatgtatgttttgattcacttcctaaagacatgtcttctttcagttgtagtgattgctaattaaaataggctgttcttggttttgaaagtttaactctttattgttgcttaaacaatgaatgtggatgtatgctaatgtattatttcagtaacactagccactataacaggtaatctcccaaatcttggaggcttactacagcagaaatttacttcttattttagtgcagtccaaaataagcagccctctatgaagtcattcaggaacccaagctccttccatcttttgtgtccagagcataagactcatatgcatttaatgggcagatgaagaatgagtattactcatgaaaatttgtcatgagccacgcctggaaatggtgtgtgttaattttgttcatattctgttggatggatcttgtcacatggtcacacctaactgcgagggaattagggaaatagtgtacactgttgagcctaggaagaggaacagatttggtaagatagccatacaattgatttagcagagcattcctccaccatactggaaccttgagggttctccaacaagttgcaacacactgacccaaaagagtgaatcttagtgagtgatttactcaatatgagactgaattcccattacacaggtaagtgatcagtttcttgcctgagaaatatggaaatttggcagtgaggtttatgcaaatctgaacatactatacagagagtcatttgttattttactaatgaaaaatcacttcaattttttccctaagaggaagacaatatgaatgtattatacagtatttgttcaacattgtctgaacattttccattatcccctgcatttttttttcatattgcattgactttttcatgatagagattaaaattgaatgaccggagggcaagtttgtatctctctgccaatattcagtgatttgaatagttcttcttttctaagcttttgtcttttaggaatgaatacctttatgaatatttgcagcctagtggaaaggctgtaatccaaatggtccaagaaagcattttcttaaaagcaagtgtctgtcgagatgtgtcatagcgcttattaagagtctaagctggaatcttagttccaaatatgcctggagcctctaaatggtaccaggataattctgacaagatatgtttatctaaacaatgtcatttgcagccctgctacacttcagtttatctctccctttgaaatctataaaatgggatggaaattcaatactcataaacttttcgatcgtgttcaaaatagaatttttcttagtaaagatttggttttcaggaaaaggacagaaataaaatacttgctcataaaattgtattttctcatttgatgattttggtcttcctttttattgccatgaaacttctagaaatgctcaaaaagaaatcagctaaataaagaaaaaatagttaatatatgtatgtaatactatattgaaacatttttctttctctggtaaatcccatttcataactttgaacagttgggaaaatctatacatagttattgcagtctatcaagagaaaagttcagtacaaagctatttatgtctactagaaatattcatgttaaacttcaagtaattgggtgtgcaagccaccaccatgttttactatatgaaactattaccgtggtatctgttgtattcaggtaattatattgatggaaatcatgcagtaataatctaggtaagagagtaaattttgtctaaatcagatcaaatgaaaaattctccctctttctaatattcgaattgctcatttttctttaactctttggtgtctgaatttgtcaatcattcctggccattttcttctgcaaaagggctgggtcaggggaccaaaagcagataagattagaagaatttaaattttcttccttggaggcgtctgaattacatgaaactcttgttcgtgtctgttaatactgcaaggcataataccataataccttgcatagcagtgaagaggatttggaaagataaaactgcttccttttatcattctgtttatttcacaaacaatattggtgaatgtcgttcctgtaacatttggatttaagagccttgtttctgtagcttctccctccgtaacccccaccactaccatttcggggctatacagcaatagcatgcattactttaaaaggcaggctgcctagactggccacttgttagctttgtggccttgagcaaatgactaatctcagtaaactatctgctcttagtttccttctctgtaaaataggctcacttataactatctcatgggttgggaggattagatgaaataattaatgtagagcccttagatcagggccatagtaaaagctgaatgaatgttagcatttgttattttaattataatctattggggtgctttgaaggcttaatgcaaaatacttaatgagctttttggtagctgtttagttatttcgccccccaccaccaccccaaaaggagagatttaaaagaccgacaggagaaggttgcttggaaaagatggaataagatctataaatagaattaaacaaatattcaggaaagccttttgtgggaaatactgcaaaatttttattatctataaatttaataggtagataaaattactactcccattttagagacagaaaaccgagactcggagagctaacgtaacttgtctagggtcttaggaagatgacaagtgaggaagtagaattcaagcccacgtctatatgattttaaagcccgaggcacatcaaatggaaaaggctggttagtcagaaaaataggaaggtatatttatctgacaacttaaaatattaggactaacctcaggtaattatagtctggatatacatttttgctgctcctgtttatacttttgacttctgtgtatttgagtgtctaatcaaaggattgtcttttacatgtgttggagatgtacagactagtggaccccaatgatctattagctgtgtaaccttagccaagttaattctctttcctaaactgtggttctctcatctgtcatgtggggctaataatagtacttatgctggtagggtgattaagaaagtaaaataattggtgtttctaaagtaaatatgtggcacatattagatgctcattaaatggtacatattgttatggtgagatggatttggtacagagagaactggagatgggagaatatgaagggtgtataatgtggccttttattagctaaaccaagggaaggacttctgaaacagaattccaagttttaagagggagtcgtttattttggaattattttttcagctaaggatttttcaacccagtccagaattcttagagaaatttagtgatagcttataaattttaagaaaaggaattcacattatattgcataaagaactggtatacagggccatagaaggggagaatgttcttctgtatgagaataaaaaaaaacatctctcacacgatttttgaattaactgacagttttatagcagctttgtcaacccatcattcattgctgcaaccaaatctatgaaatccttcatggcgaaataaaaaggctctgttgttctccacatttgtatgaaatctctgttgctaatgaaatgccagccagtatcttcctctcaggtattgtctattagatggttgcttattttagaagaagtggagtcaaccatataaatttccttcttttgacatctagcacctgctgtcaacctgttatagctacaagcagctctcaaaattcacatccactaggatgccgctggcaaccaaagagttcagttcagttcagcgaacgtttgaatgcctactctgtgctatctaatatcagagatggtagaggggatacaggaaaaaagtaagattcagcctttgtctttaaagagctcacaatcaaatgtgggtatttggacaagtatatttaggcaaggcagtttaggataggtgcttcagtagagcagtattacaaaatgttgagagaaaactagaggaggagttttaaatgagggcttagtggaatgcttccaggaggaggctgaatttgacctggtcatgaataagactttgaaaagcagaaggaagctggagagggaagggtatttcaggaattgatgacaggagaatacataattagacctgttaacagtggggtggaagacgaatatcagcatgggagtgtgtgtgtgtgtgtgtgtgtgtgtgtgtgtgtgtgtgtgtgtgttgtggaggataagggagtaaatgaagtcagtaagaccagttagaaggcaagagagcccaagctggagcagtgaccatggagtaaaaagaaagaagtgaaattgagacataaggtggagctagaattaacaggattttgacattgattgcatatataaaactgtcaatctaagagaaggcctgcctctaagagttggagattgaattctttggaagattaatgtcataaccagagacaaactcaggataaggagttgattatgggagacaaagtaatgtgcttaacatgaagctagatgaccatactgagattttaaagaaatggttgaaaacatagagattgcaggagtgatgttacttttggacaagaattcaaaagttacctggaatgtctgagcttgcacagagagagggtacctggtgcaaagaaaagtgaacctaggaaaaagcctagaagttggtttacatttaaggaatttgagaagaggtagcaccacccaccccccacacaacccccaaccctgccaacttacaatatagaagcatttagacacacactgaataataattttttttttgagacagagtcctgctccattgcccaggctggagtgcagtggtgccatctttgctcactgcaactccgcctcccagattcaagctattctcttgcctcagcctaccgagtagctggcattacaggctcccaccatcatgcccagctaatttttttgtatttttagtagggacggggtttcgtcatgttggccaggctggtctcaaactcttgacttcaggtgatccacccgcctcggcctcccaaagtgctgggattacagacctgagccaccgcgcccagcctaaataatgaatttatagatgctacactgtatggtttcctttttctgctgctgtacaaccattcaagtaacataagtttcatcctggttcttaatgataccatgaataaagtatagaaactctttagctgaggattaaagattgttgtgtttaggtagaccaggtttctgatgcagccctcagtataccagggaaattagccattactgtttgccttgtaggtctaatgaaccctttagctttttattttgtatatgtctaagttactctacaaattcttatggaagtataaagagatagtgaaagacaatcttatgagaaattttaataagaattgaaatacaggctgggcacagtggctcactcctgtaattccagcactttgggaggctgaagcgatggatcacctgaggtcaggagttcgaaaccagcctggctaacatggtgaagccccatctctactaaaaatacaaaaaaattagccaggcatggtggcgggcacctgtaatcccagctactcgggaggctgaggcaggagaattgcttgaacccgggaggcggaggttgcactgagccgagatcacgccattgcactctaacctgggcaacaagagtgaaactccatcgtaaataaataaataaataaataataaaaaagaaatacaacttactttttgtatcaaataaattttggtgcacaaacatcataaatgacataatatctgtcacacatcctttagcaaaacaggattgttaaaattcttacagctaatattatgtggtgaagttcttcctgttgaataattaagtggattaaaatatcatatttcctttctgtcattagaaatatattgtgcattaatcagtccttgggcctgagaacatttatctaggttttcatcatctgaaaactcacagtccaatatttcacctgtattatcaattcaccattatcattagagtttagaatgctgctgtctctttccatctatcttctgttgtatctaataattaggagatatatatatatatatatatatatatagagagagagagagagagagagagagagagagagtgagagagagagagagattggtaataatactaatatatataataatattatatatatacacacatacagagagagagagagagagagagagagagattgattttaagccattaactcatatgattgtgggagctgaaaagtcaaaaatctgtaaaatccaaaagcctggcaggatggagaccaagggaagagttgatgttgcaatcttgagtccaaaggtaatccgatagcagaattccttccttttctggggacttcagtcttttctcttaaggacttcaaaattgattggagaaggcccacccacattgtggagggtaatctgctttactcaaagtctgctgattgaaatgttaatcacatctaaaaaataccttcacagcaacatctagattggtgtttgaccaaacaactgggaaccatagcccagccaagttaacacataaaatttaccatcatcagccatcatcatgaggttcataatgtcatgtgtttcttcacatataaatctcgtggttcttttatttttttagtagtacctagttaataaggtacctggaaatatacgttaaataatagaaatggtctttaatatcttaatgaatttcagagttctatcagagtaattgtaacttgtatataaaaactgatatataaaaaacaagtatgttttttcttcctatacgttgtgttaaattaatactaattacctatcatgaaatgaatgttttccatttttcataaatgtatttcatttttaaattaagaggattaatatcaaaacatatttgaataggatttaaaatccaaattacctgttgcgattatatttaattataaatctttcaagtgagtttataataggaaaaatattttttattaaagtgatgtaccataattatgaacataaatagtgttttctactaattgtttttgtcttcattatgtttctttttaaggggaaagatctgggttaacaaatgttttattcatccaccttgaaaattaaacataataaacaaaactattaaataaataaaccaattaaagaaaatagtttttcttccttttttgtgataaagatgattatgagtaaatatattaaagaattttatactcagacaaagtgagctaataagacaaatacaaacagagatgagcccagaaagagatactctacatgtttataggctagcatttttatcttatgacctacagggtcattgtaactaaagtcttgaatttctgttatattttggtacctgtgggcataaataggaatattactccctgatggcatcatgcattttagataaaactaagccaagggttaaacacgtgccatggactgttcctaaaaaatgctctcagctctcaagttatagaaaattgtagggattattattttgtacctactacttctttctttaccaaaatttacttatacatgatttgaaaattgcttgccacctgtctttattctgttgtacttgtcttaagtaaaacatttataaagtaagtaggaaggattaatagattgtgacctttctacatgaaaaggggaaagccgagcttgttctacttttgtcaggaaagagtttgaatagttacctgttactgtaaaacaatcaccccaaacttagtgtcctaaagtagcaataatcatttattatcactcataggttctgtaggtcaggattcatgcattgcttggttgaggggttctgtctcacgatcactcatgatgttgcactcagatgtcaattaggctgcagtcatatgatggcttgactggggctgaaggattcactttcacagtgagttacttgtatagcttgtgagttggtgctgtctagttggtttccctctaaacgagttcctccatgggactacttgagtgttcttatgatgtggtggctggcttaccccaggacaagcaacctatgagttttgccctgagttttctgaaacatgatcccatgttgctttgaatatccccattagacactcccacaaatgtcaatcatactctttgccctaaaagttgcagactacttgtacatgtcctttatcctacatgtgtacaggaaacacgtgcagaataacatgtgtttttgtttcttgaaagaaacaagaacccaccaaaactttatagctccgggacatgatgataattatctcaggtccactcagcctggctccacatggaaaatatgggtattgtaaagaaagcttttgaattttggaggcctaacaaaaagacctaggaagctaatagttggttatgagataattataacaatggtgatgaaagcaattgcgattattacttttatgttagtgagataaatacataagaatgtccttctttaatttcattccttaatttccttaatccccattcttgatttctggattagaggaaagctatactatctacctgattacacaaaaagactggactgaggggtaaccattaggactcttgttagttgaaggtaataaactatattacttcagtggctaaaacaaacaggagcttttttctcatataaaactagaagtcaggaaacaaatggttgctgatgttggtttatccgtttgacaggttctacctttatcctggagattctttggcctttatttctttagtaatatagtagtaacagcactgaatctaaaataagagcacttggtccaagcactggctctgcccccttagtgacagtgggacccatggcaaattatttaatctctccaacagttaattttctcatctgtaaaactgggatcctgataacttccatactagtttggtgttaggattcaatgaaatgacgcatggaaaagtccttttcaaatggctactcactatacaaatattaatgtcttagtaagctcaggctgctataaaataatgccatagactgggtggcttaaacaacaggcagttgtttttcacggttctggaggttgagaagtacaagatcatggtgctgacagatgtggttcctggtgagaaccttcttcttgctgtatcctcgtatgttggggagagaggtggtgcagagaggtactctagtctctcttcttgctcttcttaaaaggacactaatccaattatggaggcctcaacctatgacctcatctaacccttattatttctcaaaggccccacctccaaatatccattgggggttagcacttcaacatacaaattttagccggcgggggggatgccagcattcagtccataacaatcaactatcctcattattgagagttccactaggccttctcaagggttgacaatgatagtgccctgctagctataagagtaaaaaaattttcacatctagaaaatgggtgcacgaatattggtaactgttctaatgtctatgcacagaatttttagaacttgctcgagaaatttgtctttcctgacagtgttgcttctcttaaattccagtcgagggccttgaaaaaaataggttttccatcaagattctctgaatgaataaatgaaatgctctgatattttctttcaatattaagataaagcaaaatgtatacagaattttctattttcagtgtttccaattactgcatggtttggcttattaccatctctaagtctaaccctgggtcataggagtaaagccattgggggtcccctacaaaggatacaaggcagtggtagatacaataagcctgacaattggagtcagatttttctctttcatacaggaaccatggaactgttgccctgggccacagctggctctcagaaaaacgtagaactggtcgaggaaaggaaaggcagggagtccttgattcacttgttatcagaaaattgtctgttcaaacaacagaatgtttgaaaagataaaatcaagtctcaaatgcacagaataagaatgaggggaaaacacctttctctgtaattaaacagaaaagtgtgccatgaagtgataaaacccagtcaacctgaaaatgtgaacatcaagtgtaattgtgcagaacgataaggtaatatgaacagcacaggaatatataggctcacgttggcattttaaagcaatggcactttacctgttcctcatgaaggatttggtttagtctaatcccttgtaggagccactaagaggagaaggcacagtccttttgggatgtaaaatggggaattctttctatgattacaagaatttgtaaattgctcagagttttaggacagcaggttatgtgtctctcaatgttgggtaccatgccaaacgtactttaagagacatagcaataaatagaatgggattcatttttttcttaatgtctggcagggcaaccaaaatgcccacgtttcccttcagtagcttggtattttggtaactaaaaacatgttccagggaactccagaatatgaaacatttcagacaatttgaaactgtcaaaattttcacttctttatgggacaaataaaatctaactttattcagattttaaagtatctcataaaagagtaatactttagatttgtgctgtgctttatacgaattggatgaggaactcttatacatatataagtggattttattttcacaacagtccctatggtagatattgtccttattaagtaaatgagagaaccaactatcaaagatattaatattttgcataagatcacacagatagcggaaccaggatttaatccaactcctctgattctaaaaataggtgttagatgggtattctttccccaaacctatgctgaaaggaggctacatttggagtcagttattgaaagtttaaatatatgtgtatatatatatatatatgtgtgtgtgtgtgtgtgtgtgtgtgtgtgtattcttatatactcatgcatgtagatagttataaagtacatgcttatatgtcaattttatatatacgactgatatataaactatcaatttgtgatagtttatttcaattaagttcaaacatattgggtatttattgactcatgggacttaaaatttctcagaggcattaatttctatgcctttaagcaaaataatgtttagcccgttttagaaagataaaaggctaacatatgttttgtttttgtttgttttgttttgttttgttttgttttgttgagatggagttttgctcttgttgcccaggctggagtgcaatggtgcgatcttggctcacagcaacctccgcctcctgggttcaagcgattctcctgcctcagccatctgagtagctgggattacagacacgtgccaccatgcccggctaattttgtatttttagtagagacagagtttctccatgttggtcaggctggtctcgagctcccaacctcaggtgatccacccgcctcggcctcccaaagtgctgggattacaggcgtgagccacggctcctggccgctaacacatgtttttaaaaaataaacaccattcgagtaggaaaagtgggagaactggtggttcagctagagatacggagatgggagggcaagttgctttctcatgttgccacatctgtaagttacaaatgccatagattaggaatttcaacgttgttgtgtctctctgaggacattctccatgtagtatatgtttcgcctccctgatggacagtaagcatcaaacggttactcctttatatttgaattattttaattctaacatcttgttctgaaaataacgggaatgccataaatacttactgattgattggactgtctcgcaggggagctggcagctagtgtaggctacaagctgccatcatcatctccatgaccatgagtcatcactggaattaccctaaagaggttaataaaacgccttgtttgaaaagcaaacaaaaagccagaagaaacccaaagcaaacagacccagactttgcaatgggtagtgaattttcagtcttaagggattgagagtccttttagtacaatctctcataaacatataacagattttaaaagcaccttggtctgattccagttcacatacctcatccttgcagaatacaacatactaggccatttgaaatgttcctcagtttacttttggaggatctgctgatttgagcaaaatggaaatgaaatgtatatagaaagctcttaatttttttttttttttttttttgagacggagtttcgctctgtcgcccaggctggagtgcagtggcgggatctcggctcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccagctcttaatcttaagaagttcagtttcgcagctccccccccaccaacccccaatcttgaaagcaggaatttggattagggttttttaataaaactttctttttcttattaccatgatgttttttgagagggtacagagaactcattaaaatgttatgttataacttaagacaaaatgggaatgagaatttgcattatataaacaaagtgtatgactaagtaacctgttacatataaagtgtttgactaagtaacctgttgtccctaggagaagtagaataaatatcaacatgtggcaactaacagaatgtgttgtgatcactaaagcagcacattcattgactttacacttcattaagtaggtaacgaattttacaaattttaggacttaaccaggctgtccataatactttgcatcagtaagtaccaaaatctacgatagggcacttcggagttccttaatttaataatattgataatattttgtttacattttgatttaattgtatcatttcattatttttgtgtcctgattctaaatatatacgtcaacaagctatatggccattcaaaacaggtaaactttaaatatgtttttgacatagaaattatgtaacagtcttcatcatgagtataggagtcagatttccaattgaaaatttcatcctctaaaatacttggcatatgtatacagttgtctagttcagacaaaaaagtattgaatataaagttgattttgtaaaaccagaattggcatccttaaggaatacaaataaagggaatcttaagataatataataatgctgatttgaaatgaaaattaataaaattgttattctattttagtatgctaaattggacagatccttatttcattgaaaaattagattcttcagtatatcagtgcactgtgctaataacacaagaagattaaattatgtccatatgtgatttggtagaatttaattataaatataataaatccttcaatatgtacagcagtgaatattccaaatttatctctcatataagttgtgagcaacttaaggataggcaccatcccttaacatacctagattaagaacagtacctagaaaacagtcatcaaatgcttcctaaataaattttcaccttcaagcttatggcagcaaattaaacatagattgacccttttctaatagagacagaatagatgagactgatgacttttttttataaatgtgtaagtctgcaaatatttagtaaggatctaatttacacaaagaaatcaacctagagtgagattattttattcatttcccggaggctgtgactgaattatatttgcaacttgccctaatttttatacttaataatttgcattagtatttaaattatgtgaaggaaaaatataagtttaaaatactgaaaagtatattcacacattcatcaaatgttgattatgtgcttacagtgtgcaaggtattggggctaggaattatgtggtgttccaaggaaaccatgatacagcctctttcattacagtgtttattattaggtagaaaaagtaaaattagtataatattagataggatatatgtgtcataggagtaatataaacaatattttatgaacaatgtatgaaggtataattttgttcatttatccatttatcgctctgtacatccatccgtttattcattgttcattacttcatttaataatactttagtgaccattggaaaagggatttataaaagtgagtaaaatgttaatcattttctaaagaagttgataatctagggaaagacaaatgtgtaccaacaataacttggatataaagcataaattagaggtacaagcaaagaaaaatgaaagtacaaaggagaaaaatatttggctgcatgagagcagggactgtgtcttgtttcatcatagattttccagaacctagatcagtgtttggcacaaagtaggttcagatgagtttgtgttgactgactgtctactgaagtaattgtggaacatatcatagaagaagtagatcagaggctggatcttaaaactgggagaaatacatttcagctccgtgaaaccccagaagtgatatttgacattagaaagcacaaagtcacactctaacagtgacagtactgagtgaagtaagaattttctgcaccccttcttcttcttccactcccattaacccttgttagggtgagaaatagcagctggtgaatggtagagaagactagcaagacagaaagaggaagcccaccatgcccactaccccaggtagtaaaggacctgtccacttccatcctcttctaattgaggaagaaatcatatatgtgagttcagattgaagtattgattaatatattgagctggatattctaattttaatgtctcgatatggagcaggactttgtttccttaatgatgaccagaaaagacatgaaacttacccatattttcacccaagaacagaacagaacaacctacttgaacagatttaaagggagaaccaaaggcagataaagttgtctttattcttacacagcataagtcctgattattcatcaatttatacattttatgaatttaagaaaaaaggaaaggaagactataaagggattcatatcaggatacacatgaaggtaatgtagtcagttttttagtggaaccaaaatattacagtcatcactgaacgaaaatattacaatcattacatcattcactagattaagtgaataaattaaaaatatattaaataaaattaacaaagacatgagcttttcaaagtgtgtggtaacctggagcaataagcagtgtagttggaatgttacctcttaaggattatcaaagaggctggctgttcagtaggacagtggtatggtaaagcaagcttgctacattgcagaactccagagggcaacattctaattatctttagctatggggtctgttcccataggataactataacttagtaggttgacagagcctcccaagaaaccacagcagtgctcaattgtggcgaattacttctctatcccatcaaaatgtcgtgattggacccacaactgtgcatacatttttttggcattttcctgccagaagcatatttacatttctttaatatccagtcatatccttcccttatttaaaaataattattcagagaattccagttttttgtaatcctctcttctatgaattttagcaacacttatatacagatacttgatattctggagaaatatgcttcaagaccatgtggattaacagattttcaaatgccgttatagtatatgtatatactatatatgtataagtatgtgtagtccccaaaatgcgtactttaaaatcctcataatagatctcttacagatgaggaaaagaagatgtagaaaggttacataaagtagctaacaagtattccaaataatattgaacttcagtctgactattccaaaattgcattcttaactctgatttctatatttgttttccattctaaactgtgtattgtgatataagttcctcactaaggctctttttcagggtcttcctaatactaaagtcactcttacaatgagtattttctttacgtgtgaaatccaataggcaaaaaaaaaaacttggcaataaattttaggcattaacctcatgccaagtaattatcagaaggctgtaatgctttgaaacttcacaagtctgattttaagataatggaatgaggcttgcattgtgaactttcttgatgctttacattgcaatatgctgtatagattgacttcctaaaaataaaaaataaaaaaaaagatttgtagagcatactgggaaggtcttgccaattaaaaaccggagattggctgaaggcttgcagcaattgaattttgaatacagatggtgtcaaatcgagtgtttccatagcaacagactcttccttaataacttttagatgggagggggtacataaaagagaaaaccatcttttagcagatgtatgttttcagcatgttttcagattgattttggaagctaatttgtacttaactagtgattgttttaagtggatctaaatattactaaattctcctgaggaaacattttgagaataacagaaataaactctaggaactttataaagacatgaaaagggcacaattttacaaaacctttttttttttggtctggagccaatcaaacagtattttatattgagtatgacctatcaatagtcaaagagttcttgattcttaatgcctgttaatattgaatgtttagaatatgggtaaaatcaaggaaaaagtgctatgtatctcatggatttggaatatcttaatatactctttcttcaggttaatgattatttttaaaaaatgatgatataaatcatttcaggaaggactgcataaagaggtcattgatagagttcatatcatatagcagagttgtcgtagatttaatgtccaatcctcagttttgcatagccaacaactaaattttagtagtttacctagagatgatcaggctctgggagactgattcatgctacacaaactcacaaggcactggtttataaaccatttgaaagaagaaataataattcaaactattattttacaacaagactggcaggaaaatcaataatggtaatgtgttcggggtgtcctccccagtgaggactatccagaagaccaaatgatagattattgttcaaagtgatagaattgggagaagggtaataaagcattatgaaaggatgcttccttaagtgagaaaagctacataaactacccatctttactattctagatgaccttaaaaatattaatagaaacagagaaacagacaattcatctcagatggtacaaaaaacataatagcacatgtttgctccctggcttccttttagattccctgcaagaggttttcccccaaccaccaccatatacagatatacagctttaccttcactctcctattatctgtcacagaacaatataaaactcagatatgttagtataagttaatagttggtagctttatgttaatgacattgctacctgttacccccagattcatctgggttacttcatccccaaaaccctttcaaaacgacatttcccacaaagatttctagtattactggccattcccggacatcttgcttccaacataagaaattctgacataatagggatataagaaggccttgggaatctgtatttataacaagctccccaggctatctgaggctcagccagtttatttttgcagatagctattactatccacaatctcttttatcctattgtaattgcagaagaaaatctttctttctagtttctttgaaatttctggaatgttaggacttagagcctctaggaacttgtacataaaaagagagacttaaagagatatcaaagtagagatagagatagatacagataagtgcatagacatagaagtagacatatataatagaaacatatatgtatacatagaaatagaaatatgccatttagaactcttaagaaatatgtgcactcttaaaatatagtttaaaaatgtaaagaacttgctattaattgaaaatagcataataaacttaaatgaaataaggaccccaaacgcaaatatttctctctgacacaccacacacacacacacacacacacacacacacagacagagagagagagagagagagagagagctgtacaataacaaccaattcctgacccagataaagaaaaaatttttatttatcttctttctcattctattattattttttctagattaaattaaaatggtaattatgtgtaagaacaagcattattgccatataaacaatgcaacaaaggaatcaattgaaaattaagtgaaaataaaaggtacagcttcgttaaagacccagttcttagagcttagtctcaaactctttgtactctgcactcttttcttgatttgactcgattgattgattgattgattgattgagtcagagtctcactctgtcacccaggctagagtgtagtggctcaatctcggctcactgcaacctccacctcctgtttcgagtgattctcctgcctcagcctcctgagtagctgagactacagacatgtaccaccatgcccagctaatttttgtatttttagtagagatgggacttcaccatgttggtcaggctggtcctgaactcctgaattcaagtgatctgtctgccttgttcccccaaagagctgggattacaggtgtgagccaccacgcccagccgattttactctctttagaactgcaaaagtaggaatctagctcatatgcagacattctagaaagtttgatttcaaaagtcttctcaaaagaaagagagcaagagcaagaaagaaagcagagagagaaagcagaagataaaatggcattgtttgaacagggatggaaactgagtaagaaatttggtcactaaacactttagtgtctatcatttaagattgtaatttggttatttatcactggaaagtgattaataatctaaaatgcattttataatactaatactattaaaacattaatttttggagaaagtttattatagattgatttatacttaccactgaatattaaaatgtttaatggaagtagtttcaaatagtatttaatgatatagggaattattacaacattaatgctcaggaaaaaaagtaggatatggaattatttatgccataggatcctaattttgtaaaaaacagagaaaaccagcaaaagaaattataactggaaggaaatacatcaaagtggtttgcagttatcactcatgaaattgaggtgaacttgatttttttccttttatatccatccgtgttttaataccacagacatgctttagatctgcccgtatattgtggctttcagagggtaataaaccattgtgactcagaaatagctaagaatttttatctctcaagaacaaattttcactcccttggggtgtcattatctgttgagaatgcatgcaatagttcaagagccaaaagactctgattcagtaagtttagggtagaaaaaaattaagtacatttttaaaatagagctctggtgtttcaaaggcaatgtgcaaatatacctacttaatattattctaattttttcaggatagctgaaatataaacatctatttttagtaataacacaaatgatggaatgcttttacatatttataaatcattaaggatttgctttttgtttctactgtctggaacatataaatttgaacacaatttagaacaacattcaggaaatatgatttatttattaccttcttgacctttattttatttttaccatctacttttatgtaagtcttttttttcaatcattgtttatttctttacttttccttccacatagaattaaagggagattcgggcttagtgtccttaattcatagttccattgtggctattaaaaggtgaactgaaagcttgcaaacacgtggtaccttgtagataattttctccagtcagacagttagataaaggcctctgaggtttctggggtcattgttgaagctatgttttaaaatcctatatccttctctcattgttggttccttttcacaacacagaagttttcttttttttaatttcaacttttagatacagaaggtgcatgtgcagatttgtcacgtgggagtattgcatgatgctgaggtttggagtacggatcccatcgccatgttagtgagcatagtaactgataggtcgtttttttaacccactcccctccctcctccctctagtagtccccagggtctattgttcccgtatttatgtccatgtgtgctcagtgcttagctcccacttataagtaagtgagaacatgtgatatttggtagaacttttcatttttaagttaaaaaacaaaacaaaatgaggatgagtggaagaactattcagcacagcaggttataaaccaattaggatgatgacgccctgaatggagattttcatgaacatctcatattagctatttcagctttggtttttttaatgttcaaagtaaatagaataatgaagaggctatttaggaaggtttagactgagggaaaaaaatcctttcattaggttccaaataacggttagcttattaaacagcaagaggcagagatttagcagagaaaaaataaaaagatttaaaaaaaaacaacgagattaaaaggtcagtaataccattggaactggcagcatggcaagtttatatcagctatcttttgttttggaacacaactatgctaattctgttctgaacctcttgctaatgcctgtctcaagaaaatttaacatactttatctgtgtgtacaaaaatacctaaggacaaagctattacccaaactgtattcagattgaaagaatccatatagaaatttgcagctaacgtattagtcagtgtatgtaatttctactgcttcacagcacaactctttctaattttcaggagcaatatagcaactgcttgccagccaagagaaaaccataggagcattcttatcattggagccaacattagttctgcctacagtgactaacatagatgcgtttattgctagctggaattttccattggcactagttacatgtaataagttagtgctttcaaatggaccgtggaatataggaaaactagagtctgacgtaaccaaaaaaaaatgttgataaactcagagattatgaaagagaggagaggagtggtttttgtggaaatgatagaaaagcaaaaaaagatggcaggatttggaaaaaagaaaatcaggttagagatttaattagtaaaggagctccttttaataattatataagagtatgagtttagagtaactgcctggctaatatgtacaatcttcaagttcagtcgttttccaaaattctaacttttagcattttttttttgtaaattttaagtggaaatcttccacttttgttgactaacttggctacctgatattttactcaacctcctactttcttgttctctacttcttctgagtctttgcttccacaatgaggtagctcatattccttaagtttcctgtctggttttgcttttttttttttttttaacagctaaaataaactctacaagcatttctatcattttctttacatccaatctcttgtcagccatgtcctaatcactttggtaaagtatcagtgaccacccaagaggttcactttgcttcgtcaaaggaccacctgtcatgctttatctccagagcttctgccttgaaagtaagaataatataacctttcctgaatgtcttatttcaatttcatgcatttgatctgcctcttcagaccattcccaaggctttgcccttgttctttaccctcatggcttcagttattcatcactatatgaatgacagctctcaaactgacagctctggcctctcacctatttcatctattccatatggcaaactgtctatattacatttcatcatgagggataattataattccacattcaacaagaaattgtgggtccgtgttgatttccaacagcaacctttattttttagactatgatagagaaagggtcaactttctctcttacttatttatctcaaataactcaaagtcaagctagaaaagccaagcaagtaatatttcccaacaaagcagctttaagcaaaatgattttcagacacgacatgcagcctgtattgtggaagaagcacagtgacctaggtgtactttgctgaaaagcagtggtcacagtccattagtttcatctttttcctgcaagagagaaaagtatggcagggccaagactcctaagaccccttaaaaaattgtgaggtttttataaccctgttcatttcccatcaaaagcattcatgaagcacctgccatgtaccagatgatgcattctaggcagagggaagaacttgggcaaagtcctgtacattttatcttctaaatcttactaatcttttcttatctttccatctaccacccaccatcaggctgtgcctggactcctatgctaacatcttactctgtttttctgcatcttttttgccctcccctccaatctactctccaattagcaacatgactaatgttttcaagcccagattagacggtgtcacttccctgctttaaacctttcagtggattcccattgcactgaggttgaagaccaaaatctttaccataactcacaaggccactgggagctatgaaaattttcttttttagtttttccttttaattagtgatgcattcaataagtggagtctatcgtgaaagcatagattccaaaggcatgtgaatactcaattatgtaatttacttacagaatgtttattacttcttttttagctttgattttgtatacatcctaactcaatctcagttatataagagattataaaaaagtttgtgatgaatgcatacataaaggaacaaataattaacaaatatataaagacaaatcagtattgaatgaccaaatggctctttatttattaaagaacttagaaaaatatagtcttgcttgagaccaagttctggcaacgtatgtgtgtctttttgtttgggttaaaaagcattagttttatatgttttaaaaggataggatcttcccttggctgcaaatagtataggcaaaatgctattctgtatcttattttaaagaaaataacaatcataccttattatttgctgacagttttgcagtttacaaagcactgttcacatggattaccttattttaaattcctcaattttttttccttttactatgggaattctgtttcaggagaatttccctttaaaattaaggtgattatactattctgttcctgtatttcgtagccatatgtttcaccaaggtattgtctctctccaggtctttcttctctggatgtatagttatgattttccaggaggtaaatgaaaacagtgggagcaattgacagagtgttttttgtttcccataaacccaagcattgcatttaaggagctgctgtactattgtaagagttcctatactaattttaaaagttcatttacatattttgtagatttttaggataagtcatcagaaaaaaattaaaaataaatttacatattttgtattaagctgttttgttacttgaatggggattattggaacgaggaaagaattacttttatctccccatttttcaaatcatttactataacattcatgaattgctgaagtttaaacaatcaaaaatatctgaaaatggagcctaggaagggtaacttatgtctttcatactccttcctttttggtttttctaccagcattttagtctaaaatatattttattttcactgatcctgtgtttgtcttaataatatagtatgtatgttaaatgaaccagaattcattgatctttttttttattattcctctttttgcttttctggagaagcatttgaagaaatcagttcaggctacacttcatcaattcatttcctcatcttccccttaatacaaaagccccattttcactcttcaaaacatttgatcacatacttaattttcatagcattgactaaatgtatgtgtttattttgtttatatattgcatatttgtgatgattttcacttttacagtttaggcatgggtaggaaggacacttacatgagtacttaagttcttggttatgacttgagaaactcacaaggtagcatggaatggcacgtaaacaaggctttgatagggtgaaagggaattatcaggacaaaactgactagtggcagtgacttttgagcagagtgctgcaaactgaaaaggcagagagcattgtaggcagagagaaagcatagacacatgtgagatacatgtgaaatacttagacaaatgtgaggtgtgtggtaacattgtacatacctagggctccttcctgtgtagctgtaaagctggagtataggcatcacaacaggcagcagaagccaagaaactagaaaagtagacaaaggccacgttataaaagatcttgtaggataggtaaagagttttaatactatcctgaaagcagtgtggggtgggaggcatgacattaaggaaatttaataagtgatgaaagaccaagattttcatcttcagaagacttctctggaggtgggtggaccacttgatgtcaggagttcaagaccagcctggtcaacttgatgaaaccccatctctactaaaaatacaaaaaaatagctgggcatggtggtgcatgcctgtaatcccagctactcaggaggctgaggcaggagaatagcttgaacccaagaggcagaggtggcagtgagccaagatggtgccactgcacttcagcctggatgacagagggagactccctattaaaaaaaaaaaaaaaaaagacttctctgactagagttttaaagaaggatggggagtgcaaaaggctaacattaaatcagtggttctcatccctggctgcacgttagaatcactagggggagtttaaaaaaaatgccaatacttggactccaccccaaaccagttaaatcagagccttaatagggcccagacattcgtagtttttaaagcagccctcttgattcaaatgcacagacaaggttgtgttccgctgaactagagagaccatcaggaggcttttaactaaagcaatctagggaagagagagatgaatgatatagaggccagaagagctattaaggagaagtgactcggcatcttcttggttaaagtataaggaagaaagaagaatgaaggataatttgcatgtttctccttcagtgactaagtagaggaacagatgtgtatcagtgattaggggagaggaagaatgaagatgatgtaatccagtttggatatgttggctatttcatagagatttagtaggcgtttggctctatggatacagagttcaagagacaattcttagcttaaaacacagattttactctgattattttagagatagtaaatgaagcaatatacatacatgaactcaccagagagaatatgtaaagtgaaaacaaaaagatcaaagggagacccctagggaatagcaacatttaaggaatgggcctaagagagtgaggagtggccaaataggcagaataaaatccaagaaggaatcttccatattaatcaaaagagaaggtttcaaagagggttcgtcaattggcaggtactgaagggatatctgaaaacataaagactttagactctctaatactgtagcaactttaaggtcactgctatcacctacaaaagtaatttcagtggcaaaagccaaaacgtaatggtttagaagggtatgtgaggtgtggatgtggaaatagtgggtatagactattgcttctcaaaatgtaatcacctgaaaaatcttattttaaaatgcagattttgattcattagctctagagtggagcctgagattctgcatttctaacaagttatcaggtgatgctgatgctgctcatacacaaaccatcctttaagtagcactggtgtaagccactctcccacaaaggaggaagacatagggtttccatcaggggacgcaggtggggtgtaggaccaaaggaaataatactcttttgtcttttgtttggttggttttggttgttttcttcttaaaataaacatggttgtagacggagattgaagacataggaggggtaaaagatggaatcacttctcatagaagatggaagagactggaacattgagtacagcgagggaattaggcatgggtaggagggacacctaaatctgaagagaaggaggtaaggaagaattgaaatacagaaaagttctgtcagtaagcaatgtatggaattgtgctttttagccatagtttctgttcaagaaattgttttccatttatttttatttcttaacttgaatagttggatggtggagtatgcttgtaaaaataagagtgaggccactttgtttttcggggttaatttccgttttctgcactcatcaagtaaaagttgaagtggcaaggtgtagatatgaaattcagtgtgtgctaagggagaaaaaaatgctttttattctacatgattttaaaaatatttatattccaacaaatgcatcaaatttgatgtgcaaatttacagtgatgaatgagttttattgtgtgcattgcatgctggtgacatggtaataaatctgtggtgctagaattataatggtcccctttagcttcgctttaatgaactcttgctgaacacttttgagttgttagtactttatttgctacatttggcacttaattagttaatgactgagatgctggaccgatggatcatctaatgatatgttaggcctattatcacatctagatagtttcttttctgtgacttgtaagtgacctaagatgataaactgaaatatttttgcatagatatacatcaagcttttctcctaacttcaggctttcatcttaagcaatagtttccaacacccccaaaagagaagtcattatgtttttaaaaaaattattcattttaatgtgatcaaataatatcacatttcagcattcacctatttaattaataaaacaacttacatgtttcattatgactggatgttgatattttttcataatctattatcctccaaccagtggtaaaaacccaatcctcctctcacccagctcatctttccgtatgggaagcaatacatacttccctatgttttattaccaaaacaggagaatgagctttctttagaaggttaactcattttctctattagaatattcagcatacttttaaggaggtaatctggtctttgacagtctgttgattagaaaattaagagacctgcctaaattccatttccaactcctctccatacacattgtgactttgagcaaaacgttttgccatttccactcgtataagttctgtttagtatctttaaacttccatatcccacagatggtatttttttcttcattggaaagtggtgttagtgattcagaaaactgcttaaataatacactgctttgtgttttctgtgagagaatttttttttttttttgagacagagtctcactatgttgcctaggctggagtgcagtggcgcaatctcggctcactgcaacctctgccgcccgggttcaagcgattctcctgcctcagcctcccgagtagctgggattacaggtgcctgccactgcgcctggctaatttttgtatttttagtacagacagggtttcaccatcttggccaggttgatcttaagctcctgatctcatgatccgttcacctcggcctcccaaagtgctgggattacaggtgtgagccaccgtgcccagccgagagaacattttatctaacattctattttaaaatttttcaaatacacagaaagctgaaagaattgtacagtgagtgctcatgaacccactctctagattttgttgtatcactttacttctttctctacccgccaacccctattattttctgatgcccttcaaagtaagttggtgacatcggttccctttacccctaagttcttcaacatgcatgtcattaaccagagctcaatatttgttcacatttcttttgtttgtttgtttgtggcaaaatttgtatagactagaatgtgtaaatctcatgtgtattatgaaatgagttttgatgaatgggtatacctgtgtgacacatgcctctcttaagatacaaaaaaatagccttggcccagacaggagggaacattttttaggttggcttgagtttcctttaactgacatgtagcatgactgaatatatgaccataagattgccaagttgaaatttaccaaaggtccatccaggggaacagtatggctattgatacgtcatttgttcatctaggcactgggctgggtgagttcttcacaaaaaccttgtaaggtgagctttcagctctgacagaggcatcaagaaacgtatttcacaaactgttagagctgaaaacatctccagggatcatccaatctatcctcctttgctttatgactcaggatttaagaagccccagaaaagtccaacagtgttaccaaagtacacgattgcctatttacgcccctataattgagagctgtctaggggtcaggtacttttctcagtgccttgtgtacattatttccttttatctttctagattattaattttcttgttattatccccatataatagaggagtaaacagtgtgaaaatagcactaaactgttgatcttttccatgttccaaactaaccttaaatgttaggctaatattataaaattttaaaatttagtcatttgttctgggtctggcttccatgaacttaaccaaaatgcttggctgtttctgcattctagctttttgggatttagagaaaaagcaacttggtcatcatagtggccaggatttatttatgtgccaataactcccctctgtttttagctttttgatctgttacatctcagatactttattctctatttgtaaaacaaccacattcctccttttctatatctaagtgaaaaaaaatgcccgttcatactagctacatggttagcatatatgtttcttcctctttgtgggtttgagttgaaacttcttttgcaaagcttaactatagataggtcttccacagaaccctgtttaaatgccttgtggaagtagaagggacatatcttaatattccttataatctgtgttattatttggactttcctcagttccttatatgtctttgtatgtcaaacattgagttatgcttacattactctaggtatagttgtgtcctagctttgtacaaggttacaataatggtggtttccttgttttcagcttcattcttgatcatgcctaacattttttgatggttttagcctcggagaacagtctactgctatttctccctttttcctgatcccaacaaatagtttagaaatctttgtcttaactgcaattgggatcatttttcctttagagttgcccacagttagtcatgtccgtcactcttcactcactcaaatgacctcaaaagatttacctgcaatttaagcctttcaccttggcattttctacctggaactctggcgtactctgtgggatcagtgagatccatagtgtgcactccctagcagatcgtgaatgtttgttgataactataattcattgtttagtcttgtctatacagagaagcagtagcaccttgctttagtaggatcctttatgcttttattcattattgaattttatcttcacaataattctgtggttctgcagttgtcattatttcagtttgggagttgaggaaactgagatcgtggcaaatcaacttttcccatttaaatccactatttcatcgctaatccagggttataacccaagactaactgctagtcaaagttgctttctaaaaatcagttacacagacttctaattctcgtgctgtacagtcagtgcagaaattgcaacagaactgttctttgttctgtagcaatgtgtattcaaaaggtaatcatttcttgtgtataaataacattcctccctaagagagatgttgtgggaatttatatcagtcaagaatgtatatcgataattaaacatagctagtctaaaaaacttgaagtgaaagattggttcgtattcaatcaactgaactgtttctttctctgcaatattgtggttcttgacatgattgctgagtttccaatttgacacttctggaggttcgtaaatcaggacacatgctgggtctcagtctgtcatcctgagtcttagcattggttatttatttccctttattacccaacatctatttactgcacaaattagtcgagaagctttccatgacggacctttgtgagaaaaaaaaaatgtgtacattgggtagctcttcaattacaaacatgcacagattgtctgggtttatgtgcatatactttattattatttcacttttgtatgtcagatgaatttggtgtaaatgtaaatctaacaatatgggctctagtggccaaatacattgccataatatgtttttgatctgtcagtctcctgggtgaagtgtcgcaagtgtggtaaaattctgtagtataaattgatgctcagttatggacaattaccaggtctatatgatgtcagactaccacactgatccacttttaggataacagcttcgctctgatgatcttcagattttagatttgctttcattccttgacaaaatgaaatacatttaaaacttctaaaattgtcttttgtatatatttctgcagggtctactcttgggactactataacaatcaattgtactgctttgtttcttttattaaatagcagaatagctgcttgattcgtctgtatgtgctgatgtgtgtctgtgaatctagtccagttcactgtccaataagaatttctgaaatgttctttgtcacatcaatgtacagtcaaaatcgtattgtgtttgtagcagaatgattgcatcttttattattcacagcagccaaaatgacacatatttcacacgtgacaccttttttaaaaaagatgaattgtccaaagttgtatgtagaatatatttcacaaatcaaattccctatttaataaatggtgctgggagaactggctagccatatgcagaagagtgaatttctataaatagaatgcaactgtgtaaatagcatccaaatcaagaaacataatataatatagccagaagctcaggatcccccttcatgtcttctccagtcatgaacatttcacaagggtgactactatccttacttcaaaagttttctattactttttcctgtttttgtgtattatatgaaggaatcgaacagtcatatctacttgtctgtggctgtatttttccccccaacaatatgtttgtgagattcatccatattattgtatgtagttgtggattgttcacttttcttactgaataatattctattgataccacagtgtatttacacatgttgatatagatgagaaattgagtagtttccaacatgaggaaattgctgtcaacaattctgcaatccatagccatgctatcaacagtctagtacatggtttttggtgaatatattaataactatgcatttctgttggatatacacctgggagtggaattacaactcaaataatattcattttaaaaattttatttcgtttttagtcgacaactatattatggggtacattgtgatgtttcaatccatatatatacattgtggaataatcaaatcaggctaatagcatatctatcacctcaaatacttctcatttttgtggtgagaatatttaaaatcctcctttttagctatttggaaatatacaatatgacaatattagctatagttcctgtgctgtgcaaaagaacaccagaacttattcctcctgtctaactggaactttgtacccattgataaacgtctctcatttttccatccacccaccactgcagcttttgatcaccaccataatactctccatttctatgagttcaactttttttaaactgcacatacaaatgagattatatgatatgtgtctctctgtgccaagtttatttcacttaacctaatgtcctccaggctcatccttattattccaaatgacagaatttcctaggtttttaaaattttttttttatttttaattttttggggtacatagtaggtatatatatttacggggtacatgaggtgttttgatataggcatgtaatgtgaaacaagcacatcatggagaatgaggcatccatcctgtcaagcatttatcctttgtgctacaaacaatgtaattgtacttttagttattttttaatgtacaattaaattattattgactatagtccccctgttgcactatcaaatactaggtcttactcattctttctaactattttttgtagccgctaacaatccccacctatcccctacctccacactaccctttgtagcctctggtaaccatccttttattctgtctccatgagttcaatagttttaatttttagatcccacaaataagtgagaacatgcagtgattttcgttctgtgactggcttatttcatttaatgtaatgacctccagttccatccaagatgttgcaaatgacaggatataattcttttttattgctaaatagtaccgcatcatttatatgagccacattttctgtatccattcgcatgttgatggacagttagcttgcttccaaatcttgcctgttgtgaacagtgctacaacaatgtgagagtgcagatagctcttcaatacactccctccttttcttttgagtatgtacccagaagtgggatttctggaacatatggtcattctctttttattattttgagaaacattcatactgtctttatggaggccgttactaattcacaatactaccaatagtggataaggtttccttattctctgtatcctcatgaacacttgttatctttcaactttttgataatagccaatccaaaagatatgaggtgatatctcattgtgattttaatttgcattttttgatgattagagatgttgagtattatacatatatgtgtgtgtatatatatatatatatatatatatatatatatgctgtttgtcatcttttgagaatgtctattcatatatttgcccatttttttattagggttatttgttttcttgttattgagtagcttgagttccttgtatattttggatattagcaccttatctaatgtatgatttgcaaatatcttctcccaatctgtgggttgtctctttattccattaattgtttcctttgctgtgcaaagctttttagtttgatgcaatcttacttacctatttttgtgttgattgtgtttgggggtcatatgcaagaaaccactgcccagaccaatgtcatggagctcttctcttatgtttttgtagtttttagtttcaggtattacatttaaggctttaatccattttgagttgattcttgtataaggggtgagataagggtccagttttattctgtatgtgaacattcagttttcccaataccatttattgaagagactgtcctctccctattgtgtgttcttgctacctttgtcaaaaatcaattgatcaaaggtgtgtaggtttattttagtcctctttgtcttattccattggtctgtttttatgtacttgccatgctgttttgattattatagctttgtaatacattttgaaatccagtagtgacatacttccaattttattctttttagtaaagacagctttggctatccagggtcttttgtggttccatgcaaattttaggattttttaaaaaaaattctataaagaacaatatgcagattttgttagtattgtgtcgaatctttagattgctttatgtttaacaatattaatttttccaatttatgaacacagaaatctttccatttatttgtgtcatcttcaatttctttcgtcagtgtcttatagtttcaacacgcagatctttcactttcttggttaaattcactccaaatattttttcatgctattataagtgagattgtttccttaatttctattttagacagtttgttgttattgtacaaacaataacaattgttatcgctactgatttttgtaagttgattttgtaccctgcaactttactaaacttgtgtatgaattctaacagttttcagtggagtccttaggatttgctgtataagattatgtcatcagcaagaaggggcaattttacttcatccttttcagtttggttgccttttatttctttctcctgcctaattgctctggctaggactcccagtactaagttaaacaagggtggggagagtgggcatctttgtcttgctcctgatcttagagaaaagccttctacgttttactgttgtgcatgatgttagctgtgggcttgtaatttatggcttttattcttttggagaacatttcttctatacctaatttgctaagagtttttctcataaaaggatgttgaattttgtcaaatgctctttctgagtttattaaaatgatcatacggtttttgtacttcattctgttatatgttgaatcacatttattaatttgcatatattgaaacaaccttctatcccagggataaatccctcttggtcatggtgaataatccttctaataaactattaaatatggttcactagtatttcattgagaatttttgcatctaatttcattcgtgatattggcctatagttttctttccttgtagtgtctttgcctggctttgggatcagggtattgctggccttgtaaaataaatttggacgaatcccttcctctttagttttccaaaagagtttgagaaagatttgtgttaggtcttctttaaatgtttgtagaattctcccatgaagccatctggtcttgagctttcctttgatgtgagaacttttaaatactgatgcaatctccttaactctttccttagctgttactggtcttttcagatttccaattttcattattcagttttggtagattatgtatttctaagaattcatccatttctgttaggatgtccaatttcttggtatataattgttcatcgtagtctcttaggatcctttgtatttctgtgttatcagtcataatgtcttctctttgatttctgatttgatttatttgagcctgctctcttcattcttagtctagctaaggatttgtcaattgtgtttagcttttcaaaaaaccaacttttagttttattgactttttttctattgtttctctagtctctatttcatttatttctgctctgatctttgttattttcttctttctgctaactttgggcttaattcattcttctttttgtagtttcctgaggtataatgttaggtatttcatttgagatatttcttcttttttgatgtaggaatttattgatataaacttccctcttagcactgcttttgctacccccagaagtttttctatgttgtgttttcatttctgtttgtctcaagacttttaaaaaatttcctcttgaatttcttcttttgacccaataattgtttaggagcatattgtttagtttccacatatttcttaattttatatgatttctcatgtaattgatttctaattttatattgtggtcagaaaagatacacgatgggttttcttaaatttgttgagacttgtctgtggcctaacatatgatctatcctggagaatgttacatgtgtacttgagaagaatctgtattttcctactgttcagggcacaatgttctgtatatgtctgttaggtccatttggtctaaaatgtcattcaagtccaatgttttcttatgaatttttctgtctattgcttaaagtggaatattgaaattgcctgctattattatgttataggctatgtttcccttcagatcccttaatgtttgctttatatatttaggtgctctgatttgggatgcttatatacttgttatgtcctcttgatgaaataacctttatcaatatataatgatgttctttgtcactttgaacagatttgacctaaagattattttgtctgaagtaagtgtaactaccctgctctctttttgttctcatgtacatggagtatcttttttcatccctttactttcagtctatgcatgtcctttaaggtgaaatgagccacttgtaggcagcacatatttgggtcttgttttttgttgttgtcgttaatccactcaaccactctatgccttttgattggagagtttaatctatttacattcaaaataatgatggatgggtaaggacttactagtgtcattttgttcattgtttcctggttgtcttacagattctttgttcctttcttcctctattgctgtcttcctttgtgttttgatggttttgtgtagtagtatactttgggtcttttgtttttatcattcatgtatgtattataagtttgtgctttgtggatactccgaggcttacataaaacattttataagctgataataacttaaatttgattgtgtgcatatactcaacactttgactctccctcctcccacattttatgtttctaacatcacaacttacttttttttttaattatactttaagttctagggtacatgtgcacaacttgcaggtttgttacatatctatacatgtgccgtgttggtatgctccacccattaacttgtcatttacattaggtatatctcccaatgctatccctcccccgtcccctcaccccacgacaggccccggtgtgtgatgttccccttcctgcgtccaggtgttctcattgttcaattcccacctatgagtgagaacatgcggtgtttggttttctgtccttgtgatagtttgctgagaaagatgatttccagcttcatccatgtccctacaaaggatgtgaactcatccttttttatggttgcatagtattccatggtgtatatgtgccacattttcttaatccagtctatcattgatggacatttggattggttccaggtctttgctattgtgaatagtgcagcaataaacatacctgtgcatgtatctttacagcagcaggatttataatcctttgggtatatacccagtaatgggatagctgggtcaaatggtatttctagttctagatccctgaggaatcgccacactgacttccacaatggttgaactagtttacagtctcactaacagtgtaaagtgttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatatccttcgcccactttttgatggggttgtttgttttttcttgtaagtttgtttgagttctttgtagattctggatattagccctttgtcagatgagtagattgcaaaaattttctcccattctgtaggctgcctgttcactctgatggtagtttcttttgctgtgcagaagctctttagtttcattagatcccatttgtccgttttggcttttgttgccattgcttttggtgttttagacatgaagtccttgcccatgcctacgtcctgaatggtattgcctaggttttcttctagggtttttatggttttaggtctaacattaagtcttcaatccatcttgaattaatttttgtatatggtataaggaagggatccagtttcagctctctacatatggctagccagttttcccagcaccatttattaaatagggaatcctttccccatttcttgtttttgtcaggtttgtcaaagatcagatggttgtagatgtgtggtattatttctgagagctctgttctgttccattggtgtatatctctgttttggtaccagtaccatgctgttttggttaccgtagccttgtagtatagtttgaagtcaggtagcgtgatgcctccagctttgttcttttggctcaggattgtcttggcaatgtgggctcttttttggttccatatgaactttaaagtagttttttccaattctgtgaagaaagtcattggtagcttgatggggatggcattgaatctataaatttccttgggcagtatggccattttcacgatattgattcttcctatccatgagcatggaatgttcttccatttgtttgtgtcctcttttatttccttgagcagtggtttgtagttctccttgaagaggtccttcacatcccttgtaagttgtatttgtaggtattttattctctttgaagcaattgtgaatgagagttcactcatgatttggctctctgtttgtctgttattggtgtataagaatgcttgtgatttttgcacattgattttatatcctgagactttgctgaagttgcttatcagcttaaggagattttgggctgagacgatggggttttctaaatatacaatcatgtcgtctgcaaacagggacaatttgacttcctcttttcctaattgaataccctttatttctttttcctgcctgatcgccctggccagaacttccaacactatgttgaataggagtggtgagagagggcatccctgtcttgtgccagttttcaaagggaatgcttccagttttgcccattcagtatgatattggctgtgggtttgtcataaatagctcttactattttgagatacgtcccatcaatacctaatttatcgagagtttttagcatgaagggctgttgaatttggtcaagggccttttctgcatctattgagataaccatgtggtttttgtcgttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcgatgttcatcagggatatttgtctaaaattctctttttttgttgtgtctctgccaggctttggtatcaggatgatgctggcctcataaaatgagttagggaggattccctctttttctattgattggaatagttttagaaggaatgataccagttcctctttgcacctctggtagaattcggctgtgaatccgtctggtcctggactttttttggtttgtaggctattaattattgcctcaatttcagagcctgttattggtctattcagggattcaacttcttcctggtttagtcttgggaaggtgtatgtgtgcaggaatttatccatttcttctagattttctagtttatttgcgtagaggtgtttatagtattctctgatggtagtttgtatttctgtggtgtcggtggtgatatcccctttatcattttttattgcatctatttgattcttctctcttttcttctttattagtcttactagcggtctatcaattctgttgatcttttcaaaaaactggctcctggattcattgatttttttgaagggttttttgtgtctggatcttgtaggtatgcttcattgtttcttattatttttttcttttgtcttctctggctgtgtattttcaaataggctgtctgcctacaagatccagaaaatagcctcaaaagggtcaatctaagagttattggccttaaacaggaggtagagaaagagatagggatagaaagttgatacaaagggacaatatcagagaacttcagaaacagagaaagataccaacattcaagtacgacaaagttatagaacaccaagcagaattatctcagagactacctcaaggcatgcaataatcaaactcccacaggtcaaggataaagaaagaatcctaaaagcagcaagagaaaggaaacaaataacatgcagtggagcttcaatacatctggcagcagatttttcggtggaaatcttaggccccgggcatatccagagatgctgtctgagggccagtcattggagtcaaaaaccttagcagtttacctcatgttctattctattgtggctaagctagcactcacaccacaatataaagtgctccctgctcttccttgcccttttaaaaggcagaggatcctctccctgtggccctcaccaccatgagggttctgcttggcctccactggtgttcacttaaagcccaagggctcttccatcagcttgtggtgaatgctgagagaactgggacccatattttagggccttgggctcccctctggcccaaggcaggaccaaaaatgctgtccaagaacctaggccaggactcagaaatcccagaagcctgcctgcttctctgcctttctgtggctgagctggtacctaaggggcaagacaaagtcccctttacttttctgtctacttttctcaaacagaaggggtctttcaccataaccaccacagctgggaatttgctgggtgacctatgaagccagcacatctcagaggccaagtcccacagtgtactccctgggtattgcaactggttattcaacgttcaaggcctctttagttagtagctgatgaatcctgataggactgagtccttccctttaaggtagcagattcccttttggcccagggtgtgtctagaaatgctatccaggaactagggcctggaatgggggcctcatgactctgcccatgccccatcctactgtggctgagctggtatccaagatgcaagacaaagtcttctttacttttcgctctcttctccttaacgagaagtaaggagtcacttctgttgctgcaagcttcactgctgggagtaggggaggtatggtgcaaccactcccttagccatgccagctggtgtctccctaggtcatgtgggagaccctaatccactggcttcaatatatagagggacgtttctaaattatttatctgtaatttgattaagaagatagacacaggcaataggatatgccaacagattctctctaacctatagttattttaagaaagttagggaaagagaggtcattgattagttttggcttactgaattatttgaccctcccatatcttttaatttatggattttatataaggcacagatattctactagtaaacatgacattaaagatgttttatacaaatgaatgtggttgatacaaaggcattaaataagaaacaaaggaaattcagaggacatttgttcgcctggaatagagatcattagcataagcataagaggaaaataaggaaggaaatgggaaagtcttgagtccattttcaaattatgaaaacttgaaatgcaacaaacaaatagtggttacttaagaagaaagactgaagatgctgggcaaaggttaactttagaaatggcatttttatatcattataaagagaaagtggggataatggaaataatctacatgtacaactcatttgacagacatttattgaaggtattccaaatgccaaacactagtttgtgcactaaggatgtttttaatttttactttttactttatttttattttctagcttcttccgctttgccagagaaggatttttttaaatggataaaatactaacttaggctagcttctttcagaaacagacctttaaacaatgattaatggtgaaagtggtttggttgtaatgtgatcccaggaagtaccagtaggagagtgggacaatgagataataaatgaaagaagccaataattaagccagttatggaactagttattgctttgggccactggggtttgatcctgatgaaggagctctgggagatagtaaacaaacaaacaaacaaaaaacatgcctcaaagttgtcaaccacaagggggtaaaggcaaggaaccagggctaactattccaactcttatccatcattggctaaatgcttcctggtacataaactttccagcacttctggccagcgcacctagcaagctgaggaaaatctctcaggtttgcagtagggcaaatgcttgtactaggacactgctggcatatacttgaaggatgagtgccaacggcagatagatgggccctgacagcatcttctacagattctgtccttgcctttgaggcaaggacactgtctagagtcagagacagaaatgtaaaatgtaaaaatgtaaatcatagtagcacacagtacaagttttaaaatcttaacaaagtgttatgggagaaccacggtgagagaaaatgactgcacatatgagagcaggggaagtctttatatgtgatgatgacatttgagtgggtgttccgttatcaaagatctacttaaaagggaaaaagagtagaattattttaaaccatggatgtaaccaggcgtggccaccctatatgtgaatgtcctgggataattttgtccccagatgtctctctttttgagtgtcattttcatttatgtattcataatataaagaaattgaatagaaagaggtaaacattggtggcaaaaatcccttcctacccataaggctcacagaataatgttgtctaaatgccataacatttttggtaagttttggttctatgggctttggaaattttttatgtaggaactcctccaaggtgatataagcattcagtgtatttatctagataccctagttaaagctactttaagcaggatcaaagtcctcttttaaacttttgtatttgaaagctattcccatgtacaattcccatgattcttgtacaattcctaggagacctttgtttacatcaaaagagtttgtctctctctataagttagaacttgtacattgtagtaatggaaaatccatttcaaagtagcttagacttactcagacaaaatgtattgatcagtgtcattaaacagttgaaagatagacgaggcttgattcaggaattaaatagcatgaccagattctagttttccttctccattgcatggctctgctccccagtatttgttccgtttaattcctcttaattgttctaagatggatatcaggatactgcagaactacgtgctttctcatccatcttaaacaagaagcaatgggttttctcttttagaatcacgaacaacaacaacaacaacaaaaatcctagagttgtttcattggttctgattgaccttacttggaaccataagtccatctttgaattaaccactaaagccagggagatgagttaaaactaagtacacaccatccacagagcaaagagaggtctattgtgggaaaactgcacaaatggaaaaataacaggggaaacacaggagaaggaggtagttagttaatgttcaatacacgcaccttctcagggacttttcttccatctggcatcatctttgtcttttgaccattttccccaatcaatacctatattcatactcaagttttccatatttgggaaaaaacttctcttgacaccaaactcccctctgacttccttcttataatgatctatggttggatagtctacaatttactgtccttactttttcataggtattttttaatctcctacagtaagatttctaccactgcactgaaatcattttgtgtatggtcttcagggaattccatgtggccaaagccaatggatacttttggcatgggctttggaggtctaacttcttgaatccaagtgtcggctctaacaatcactatctatgtgaccttagaccagttatttaacgctgtctttatttcctcatttgttaaatgaggataattgcagcaatagaaaaagaacgtaaacaattatacttataggattgtatgatgattaagtgattaatgcaaggaaagaacaacacagagcttcagacagtgtagatattcaaataaatgttagttatgatttttattatgtcttgtgacatctatgagatttgaaagtgttaatcactcttgtgtttttgaaaatctttcttttccatgttctataaaagtacactttcttgatattcctcctccttctctagtctttcattcatcttatttgctctttgtgttttatttattctttttacgttgtattttccaggagtccattcccagcccggtgttgggctcagtctatgtgccatataaatgagaatgcacttgcatttgaggctttgctttttatttctctgtagtgacggccaatcccagatttctgtctctcccaaaatacacagctatgctatagatccttcagtcctcctgactaaaatgttagttttatgtgtgtgttcctcacaacctcccagtgaataggtccaaaactgaactcattatcttctccatgctcactctgcattctttggataggcagtgaatagcaccactatctaacaggcacctaaaccagaagccaggtaatctgtcttaaacccttttgttttccaagttcttatcataatggctggtgtctaacagatggtaaataaaatagagactagctggctacatggatggatgtgtggggatgcacagagggatagatggattattgagtgagtctctagcctataaatatttttaattaactaataaattatgataatgtacagttgaaggtcaagggtgaaaaagcataccctcagtgggatgcacaccccaaggagccattttaacttgctacataacacacatatgaccacttttttgctgaaagccttctattattgagcaagcattcaaatcccatgtttgcctgaaataatggttcaggttataaaagtttccttctttttccaggattaaaattatcttcctacataataggaagaactgctttatcttttcctaatatctagagatggccttttaaaaatatagactgttttccctattgaaatgaactgtaggatgtacaaaatatttactggcatgaatcaaaagagcttgctatgtttatgtgaaaaccactaggcattctaaaaaatattgctagcatagtaaaatgttagtaattaagactaacgaaagcgaaggcaaattggaatcagagactatttttaaggaatgtcaactgtattattttcaaatacacatggtacataacagtaggatatgagaaaaagtcccaagtatgtgtactaaagtagcctgctatgataagttgaaaaagggtttgtaattggaatatccacagaatatttcagaacacttaaagacattttcatttacactttatacagctttcttataagagcatttacaccatttattttataaaccaaagattaattagaagactaaacaattacaaggcctcaactacgaaagctgttccactacctagtggaacaacaacaatgagacacacaaaacaatggcgttcaaagattagagagagacttacggttaaacagaggttgacatgttaactgaagttgcaatataatatgtcgactagttttgcaatacatagcaaacacccaaacagaaataaacctgataaaaaaacagtagtctataatgtgtgccacttactgagttttaattattctggggactatatttttgatttcatgttacaatcactagttttgtggggtctttctagtcctgatgcttatttacaaaatatctgaagtatttctttctatgtatttatttttgagatggagttttgctctgtcacccaggctggagtgcagcggcatgatctcggctcactgcaacctctgcctcccgggttcaagtgattctcctgcctcagcctcctgagtagctgggattacaggcgtgtgctaatttttgtatttttagtagagactgggtttcagcatgtcggtcaggctggtctcgaactcctgacctcatgatccacccgctttggcctcccagagacctgggattacaggcgtgagccaccgcacctggccatctcaagtatttctttaacttataacttcacataactttgtggaggcaacagggttaattaaaaaggactttacttacataacaaaataagaagcatagttttatattcctgtgccatatacattttgtttgtccatctgtagccattctttgaccttctctcccttgctctttattctgggaggctgacctctgtcatcattgggctcccatgccctttggcttccagttggtttaggcacccaagagccctagaaggaaattgaagacaggaggtaaagtgaggtcaagatatttattctcctaattccctccctttgaggttgccacaggctgactatgtcctttgacaaaaggttattgctcttctcagggtggtttctcattccaattctctgcttttggccacttttccctcccctcatcccttgggcctagatgtagtaacagctctactgttgcaaggttcttgtattatctgtgatggtttcttataccctgcttatcttgtgatttgttgctttgtagataaacctctcagattatctaggcaagatcatagaagaacacgtatgtccagctaagatattccagaagacagtagggaaacattgaagggttttataagagggagtgcagtgatcagatttatgttagttttaatctttaattggggtagaatttacattctaaaacagagatttgggtctgggaggatgatatagagcctcttatggatgtgagggcaaaaaatgatagaggtttgcagtgccaatagaaagaggaaagaagttatatatgagagaaatttgtaactaattatatgaggtgttgggtgacgcttaggaaagaatctagaatgtctatcaggtttcatgcttaagggataaagtagatggcagttttattacttgttttctgtattatttttatttcataaaaccagcttagagaagttgcatagaaaaaataatgtagtcctgtttattttaatatttgaaaagaacatatttcagagtagaatctatatagtacctccctcttggacttccaatgataccagtgatagcctcaatataagccagtcttacaaaatgcacccagcgtgaattcttaggtattgttaaaagaagttggccaggcgcggtggctcacgcctgtaatcccagcactttgggaggccgaggcaggtggatcacctgaggtcaggagtttgagaccagcccggccaacatggtgaaaccctgtctctattaaaaatacaaaaaaaaaaaattagctgggcatgatggcacgtgcctgtagttcctgctactcgggaggctgagacaggaggatagcttgaacccgggaggcggaggttgcagtgagcggagattgcaccattgcactccagcctgggttacaagagcaaaactccatcaaaaaaaaaaaagaaagaaaaagaagaagtttctaatacacttatcttcccttgggttcactcagaagacccttggaaaaggttttaagagcaagtgatttatttggggggtaaattaatcagtagaagagtggaaaaatgagacaggtgaggcaaggcagccagtaaagagtggtgcattatcaagccagctgctgttgtgggtcactggagctttatcccttgggaaactctggaacccttgtaaaatacatgcctcagagttatttcccctagcatcaagggagctagtgtaacaatatcccaattcctacaattagtcattatatacaggctgcctctgggagctggaggggaggcatcagttgcctggtatgtctagcctgtcacatggatggcaaagcaaactcctgtggcaacagaaagccttcaggcaatgaaatgctggcactgggaaatcaggctgatgggtgctgaagtggcaaggatgaggggatatggatattctgctgtagtgcttttctaacagatgattcatatttggttctagggatcaagaattgagttaaaattttatatatatgttgatgttctatgtcaccttcaggaaaataatttaacagaaactaatatttgccatcaaaaaagcaaagaatcctgttgttcatcatcctagccataacacaatgaataattttttaaataagcaacataaatgtgagataacgtttggaagttacatttaaaatgtctcctccagactagcatttactactatatatttatttttccttttattctagttgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaaggttagtatcaaagatacctttttaaaataaaatactggttacatttgataaaattataccatagattgtaatttaatgatgtttaatgtaaagttattaacagaaaatcacgttaaagctgaaatgaacagtagactttgtatatttattttcttagagacagagtctcactgtcacccaggctaaagtgcagtggcacaatcatagctcactgagccttgaactctggggctcaagcagtcctcctgcctcagcctccctagtagctgggactactagccaggcgtgtaccaccacgcctggctaattttttaaaaatttttgttttctgtagagatgggttcttgaactcttggcctcaagcaattctccttccttggcctcccaaagcactaggattacaggcatgagttagcatgcctagccagtagacttttgagtcaaggtagagaatagaggaaaattgacagctaatgtcaatgttaaagttaattttgtttagtaatctggatatagttggctggttttctgttgcaccatctttaagatcacttcaaaattggtatacgtatttatgtagttgcatgaagtcaaccattcgggcttaattccttcctagaaaaagtaacaggtctactctttcatatcttatttggaggccctggatcaagaaatgggggtgagtgggtatcaggattggggaggaataaggagtactctcactttctccccccattctcttacctccagcccagctcattcttctcttctttctctttcctctgaaatttcctcaaatatctgtctgcttagtagtctataattcctcaggataaaagaaaaaggaaaaggaagaaaattgcttaataactatgttttatcaagcagcatgcatagtgctttgcatgcgtttaatcccttcaaacttagtatttactagtcagtttgaaaagcccttaaatgttaaacaatggttaagctttagggtattttgagcagggaagtaacatggtaggaggttgatcagattgggcacttgatcaaaaccctctatagatattttatctgacagaaaaggccttttgctaaaccagtatctgattctcaaattggttatgtcatctaagaaggaaaccgtatcattttcttggatgaaatggcttccatttccaaattagtcaggttaggctatgctaagctatagtaagaaatgaactctgaaatctcaatagcttaacacaataaagactgctttcttggttatatcatagtccagtagaggttgacaagccattcttaggagctgtcccccaacatggtcacttggaaacccagacttttccaattttgtgacacttgtcattttcaacacactgccaaaagccactgcagaaaaggaagacagaatgtggtcagtcaatccatggtgttttatggccaggcctggaaattatgtatatcacttccaccacatcccatcacacagaacttgttctcgattgaatttcaggaagagttaatggaattagtgagcttttagccaatctctgtcatagccattttatcgaagggacctgagctgctatgaggacaaggttttagtttatatgatgaggatgttagaaagccacatagaattttacagtcttatcattagctctgttggagtcaaaatctaggtgaataaaaattctttcaagagacacatgttaccactaatggttttttcaatggatgagcatagatgaattaggaatctccaatggtcattttcctaattcctggtctgactatgtaatatatagaatcatgtggttattcttgaaagctctagtcatattcgtgaggtagtcagcatgttatgctacttctttttcttctctataagtttcggatactatgaatctattggatcacaaaccaaagtagttaactggtaagaaggtataagcagaaaatacgaagtttggactggatccttgagttagatgagaagaaggagagatgagaggcatacagtgatagatttgactagggcaagaggactctggtagttagcaaatgagaaataaatttaacctaagaaaatcctaaagtgatggtaagaatggttagggtttaattgctcttagaagagcaagtagctttaaataagagacaaaaatatctgcagaaggaaatatgaaagtagaaaacaaaacaattgcattgtcaaaacatgtaagatgttttaatcacctaaaataaaaccagaattgtattataattgctatcctttgtcaaacttttgaaattaaaaaaaaaaaacgctttggaatggtctaaaactacatcataaaaatggctcagccactatctatagagattgacattttttgtttgtgctctgtgtttaggaatttaatgatgtgtattgctgcagattcaatgtaagttcccgatacagataaagatggccaaagctgtaattttttcatccatttcttgaatgatgtatgctaaaattaaagtaatcctaatgttaataataacttttagtgaatgcttgctgtgtgtcaaaaagtatgctagtcactttatatatattggtttatttcatcctttcaaaaacactctttgaaaagtactcttattattcttagtttgcagagaagaaaactgaaggctagagaagttcagaatcttcttttgaaagtagtagagttgtgatgcgaatgcatagcaattactcttgtagatgacctcacaggcttcctcttccaattgtctacgtggctaaaacaaagcaagaaaaccccataagaatctgaaaaagactcatgtaattattaattgacaaataagattatattacattactgataaaccaacaggtagaaaatgaaagcaatgaaatagtatactgcgaaaaaaaatttcatattatattctttgatgaaaaaataaaacaataattgcaaactgcatttcatttttaatgaaacgacaatgtttaattcttctaaaaggtagggagcaaataaaatggttatctggtctttacatcgaatgtgtcatcactactaagtgatattagctggcttattacttaaaattttcttttaggaaaaaagtgtgaaaatagacaggaggagacattaaatggctaaagcaacacccccttgctccgtaagttctttctgagtctgtgtgcctaagattaacaagagagcctgtgagcctcacaaggcaatcacaaagctatgtctacagccttggagagctgtgattacagcagccagcctcctttgcagcacctcagtgatgactacactaactctcactactgagcaacaatgaaatgtttcaaacccaaccaccaacactgttataactcttaaaatttgagccagtcaccatacctgaacgtaaaaagaaaattaccaaaaatgcttgataccaaaaagcaattaatgattcataattgctaatctttattgacagtctcttctagttcttatctacatatattttaattgtctacataatgtaaattaaattttaaattctgatttgtaaacttaatattgcataaatatttatcaatgttgttaaacatcttttaataattattttaacttctttatattatttcattaatttccatctttatgtccttgctggtctgacatttagaaaaaactcctccttttatttagaaaaaaagaatggtgaggccgggcgcggtggctcatacctgtaatcccagcactttgggaggccgaggcaggcagatcacgagatcaggagtttgagaccggcctgaccaacatggtgaaaccctgtctctactaaaaatacaaaaactagcctggcgtggtgctgcatgcctgtagtcccagctacttgggaggctgaggcaggggaatcgcttgaacccgggaggcggaggttgcagtgagccaagatcacgccactgcactccagcctgggtgacagagcaagactctgtctcaaaaatacataaataaggagaataaatggggacaataacaacctattcacagaacagaaataaaaccggagatgtcatgtggaaaaagcttatcttgaaagcgtggtcagagtggaaagaaacagcaacaggagagtcttgatttggtgaaaaaacagaatgcagatggcatagagtatcaacaattaattagcaggccatcaagagacggccataacatattggtaattgttttctttcacccttaattttttctaaaacaaaaacatgaagttagaaagtagttaattttgttagccacatggcttcatggtttaattttatcttctctatgggcctggtacaacaataaagttcttttgagatagaaagacagatgttaggcaaaaacatacaagattttcattctaatcaaaatctttgccaataggctatgacagaatcctatgagagatgatgccatttagaactttcacaagaggcaaaaatagtatgccattggcacctaaaactgccaacagtgatcatcataggatttatttcatttggcggattcttggttgagttcataacctgttccctaggcttttaagattggtccaaacttggcaatggattctttggaaaaattatttcttgatcgttttaaactttcttttccagtgtcaagagagattttcccaggctccgagttttcatttattttttcccctgtcagtttttgaaagagaaatcccctttttgtcggctttgtgattgcttttgtgtcaaattcagcgtaaaagcttttcaaacgtgacagcattagctgttttgtgcttggctgagctaagagtacatgaattcaatagagaagtgaaatcttgtttgagcctggctgatttggctatataatattgaaaactatctgaagcaagaaattcaatacttttcaaattattgaataaacatttctaaggctgcaaaatctctgtgtttttgaaggcattctttaggaaacttgaaacacagacattctataatcacataattaattttaaaagttgaacttattgtatgtagtaactaaggcagctatttgagtgtctcaaattattttactaaaaagggagacatttttcaaatatggaagtagtgccttacatttttagttatctgtggaaggatcgatggcatcatatatctcatccaccataaaaatatgtacggtagtggaaactgaatttttcttttatatattttgtgtattttttggagttgtacaaaattaaatcagcaaattgacccacactagtagtttgaggtttgggtttctggtacaataatgaaaagcattattagaaatcttcttgccaggacctaccatttcttcatgtattttctttattcccttttgttctcccctaaagcttctatgtgattaaagagaaaagatcaataacccaatagtacttttccttctaaagtatgcatgaaactcttaaagttctcaaagcatacaaacagagtgctctctacattgctgatagaacacaggtagtaatgggctagtttccccaggtaactattatattatataaatatttaatgcagagtcaccaagccttgaataactttatgctttgattgtaccatattttctctagtttgcttttcacaatttaacttatcccgtgcttgaaaatataatgtggtaactgtgtaaatctgctcctcaaaaaattttcgaaatcatcttttcttttttcttttctttctttttttcctttttttgagatggagtctcactctgtcacccaggctggagtgcagtggcatgatcttggcttagtgcaacctccacctcctgtgatcaagtgagtctctcagcatcccaagtagatggaactacaggcacattccaccacgcccaactatttctcgtgtttttagtagagacagggtttcactatgttggccaggctggtctcaaactcctgacctcgagtgttccgcccacttcagcctcccaaagtgctgggatacaggcgtgagccaacatgcctggccccacatcgccttttctgaaccctgggaattaaccaaaggctggcaacaatttttgaaatgctgactctcaataaaaatggcaaagtttgaggttttttaagttggcctttcccgtcactttctcccagctccacagtagccttgaaaatcagtagccttgcaaccataatagctgtgaaaactagcagccttttagccaccagagagtgtagaccaggattggaattcttcaaaaaggccaattttattccaagaaccttgccactgtttgacctatcttgcagctccctggaataaacctatatacatggccttgcctttatttggcccgacttagagataactttctaggaaaagccctagctccagggtgttggtccaaaccaattagcagcaattctttaacataacaggttcctaaggctgtgatgctagttgagataaacataggtctggagaaaaacttccagtgaagctctggagaatgaggtgtccataggggattttggcaacctctgacatgttcttgcgggatctagaagcccatgtgcttgtcttaacaaatagagagtatcaataaagagatagaaattgtaaataagaactcagtggaatatctggagttggaaagcacaataactaaaattaaattttcacttgacgtcagattcaagctgcaaaagaaagaatcagcaaacttgaaaataggtaaatgggataatccaatccaaagaaaagaaagaaaaaatattaaggaaatacagaaagcaaaaactgactgaactgaaagaagaattaggtaattcaacaaaaatagttggagacttcaacatctcacttttaataacaggtaaaagaactaggcaaattaacaaggaaatagacacttgaaaaagactataaagactataaacttacaagacctaacagatatctatacagcgtttcatccaataatagcagaatactcattcttttcaactgtacacgaaatattctctagggtaggccatatgctaggtcataaaataagtctcactacattcaaagggattaaaatcatacaatgcagattttatgaccataatggagtacaattaaaaatcagtaacagatgtaaatttgggagttcataaatatgagaaaattatacaacacactcttaaatagccaatgggacaaagaagaaataagaaaatacaaaaatatcttgagataaatggaaataaaaatacaatataccaaaacttatgggaggaggctgaagcagtgcttagagtaaaatgtataactataaatacctatatttaaaaaggaaaaagatctgaaatcagtagcctaagcttctaccttaagaaactagaaaaagaagagaaaagtaaatctacagtaagcagcaggaagtaataacaattagtgtgaaaaaaatcagatagaggaagaaaatataatagaaaaaatcaacaaaaccaaaatctagaaatttagttatttgaaaaggtcaacaaaattgacaaagttttagctgattggttaggaaagaaatggtcaaattactaatattagagaaaaagagggtgcattactaccaacattacagaaataaaaagaagtaaaagaggatattatgaacaactaaacaaatagataacctggatagacctataacaagaaattgaattggtattaaaaacttctcccaatgaaaggctcaggcccagaagtcttcccccgatgaattctaccaaacatataaacaactcttccaaaaaatagaagagaaaggaacacttcctaaccagacaaagatatcacaagaaaacaagctacagagcaatatgccttatgaatatagacttgaaacgcctcaaaaaattatcaaacctaatacaacaacatattaacatgattgctaccataaccaggtaagatttatcacaggaatgtaaggttggtttaacatccaaaatttaatcaatgtattataccatatcaatagaataaaggacaaaaatcgtatggtcatcacaataaatatagaaaattcatgtgacaaagtacaaaaccctttcaagcttgaaaaataaagaacacttaacaaatgaagaatagaaggtattggccaggtgtggtggctcacgcctgtaatcccagcactttgggaggccgaggcagttggatcacgaggtcaggagattgagaccatcctggctaacacggtaaaaccccgtctctgctaaaaatacaaaaaattagctgggcacggtggcgggcgcctgtagtcccagctactcaggaggctgaggcaggagaatggcgcgaaccctggaggcagagtttgcagtgagccgagacagcagcactgcagtccggcctgggcgaaagagcgagactccgtctaaaaaaaaaaaaaaaaagaaggttttgtggattgaatagtgtcccccgctcccaaaagacatactaaaagcctgagcccaggtatctgcaaatgtgaccttatgtagaaatagagtctttgcagatgcagtcaagttaagatggtatttttataagaagaggaaaagaggcatacacagagagaagaatgccacataaaggcactgaccacgggaaaaacaccatgtgatgttacagttagagattaaagtgctacagttgcaagacaagtaaaactaatgattaacggccatcattagaagcaaggaagaggcaaggaaaaattctcccctacaggtttcagcaggagtatgggcctgctggaatcttgattttggatctagcctccagaagtctgagacaatgagttttgtctacccagctacgcaaattgtgacacttaattacagaagcccgaggaaacgaatacagaagaggatttcctcaacctgataaaaggcagctacaaaaattccacagctaatgttattgtgaaacactgaatgctttcccctaagatcaggaaatagtgaaggatgcctggtctcaccacttctattcagtattgtactggaagttcaggccagggaaattaggcaagaaaaataaataaaagacatccagattagaaaggaataagtaaaattatctctacttgcagacaacatgaccttgtaattagaaaattttgaagaatctatgaaaaaatattagaaataataaaataattcagcaaatttgtaggatacaagatcaatatacaaaatgaattattttatacattaaaaatgaataatctaaaagtgaaattaagaaaatatttacaatggcatcaaaaaatgttaaaaacttaggaataaaagagatgcaaggcttgtatactgaagaatacaaagcagtgttgaaagaaattaaagataaaaaaatagaaaaatatcacatgttctcagatcaaaagacttaatattattaagatatcaatatccccccaattgatctacagactctatggaatcattatcaaaatcacaactggcttttttttttttttcagaaattgacaagtggatcctaccatttctattgaaatgcaagggatgtagaatagtcaaaacaaccttgaaaaaagaacaacattggaggagttaactttccaatttcaaaaactactacaaagctacaattattaagtcaatgtggtactagaatgtgaatagacatatagatcaatgaaatagaattgaaagttcaaaagtaaacctttgcatttatggtcaactgatttttgacaagggtaccaagagaattcaatggaaaaagaatagtctttcacaacctggtgctagaataactggatatacacatgaaaaataatgaaatttggccccacctcacaccatacacaaaaattagcttaaatgtatcataaaagaaaacaaataatctgattaaaatgggcaaaacacttaaacatttctcaaaagaagatgtacaaatagctaacgggtttgtgaaaaatgctcaacatcactaatcattggggaaatgcatattacaatcgcagtgagatgtcaccttacacctgttagaatggctgttataaaaagagaagaatgataacaagtgttgatcaaggatatggaaaaaaggtaacacttgtatatcattggtgggaatgtatattagtacaaccattatggagaacagtatggtagctcctcaaaaaactgaaaacagaattaccataggatccagcaatcccacttccgggtatatatccaaaagaatttaaaccagtatgtcaaagagatatcttcactcctgtgtttattgcagcattagtcacaaaagccatgatatggaatcaacctaagtttccatcagtggatgaatggataaagaaaatgtggtacatatacacaatggagtattattcagccttaaataaagaatatccttttgtttatgacagcgtggatgaacctggaggacattatactaaatgaaataagccaggcacagaaagtcaaatactgcgtgatctcacttatgtgtggaatctaaaaaagtcaaactcattgaagtagagagtagaatggtggttaccagaggctgtggatttaggggtggaaaatggggagatgttgatcaaaaggggttaaaaactttagtcaggaggaataagtttttgagactttatgacacaacctggtgaccatagttaataatattatattgtatatttcaaaattgctaaaataacagattttaaatgttcttgctataaaatatgataaatatatgcagtgatagatacgttaaattgctcgatataatcattccacagtgtatacatatatcagaacatacatgtaccccataaatgtatataattatttgtcaaagcaaaataaaattaaaaataaaatgttttaaaacttttgtaaaataaactttataataataatatatttttaatgaatcatagagctaaatatattaataagaactaaaactttaaaactcttctaagaaaatgtaggaatacaatggattatgcagtgttttcttagatatgacaccaaaagcaaaagtaaccgaaaaatacacaatttggactttaacaaaattaaaacttttgtactgcaagcaatattgtaaagaaagggaaaagacaatcctcagaatgggtaaaaatatttgtaaatcatatatttgataagatacttgtatcaagaatatataaaaactcataattcaacaacaaaaaggataaatgacttaattacaagtgaagaaacagtttgaataggcatttctccaaagtagatgtatagatctccataagcacatgaaaagatggttaacatcattgattgtttaaaaaatgcaaatgaaaaccacaaggagatagtactttttacccactaggatggctaatacaaaaaatacagacaataacaagtgttgagaagatgaagaatgcttggaattttcacattactggtggaaatgtaaaatggtgaaacaactttgaaaacagtttggaagttcctggaaatatttttttaatttttaatttttgtgggtacacagtaggtatatatatttatgggatacaggaaatattttgatataggcatacaatgtgtaacagtcacattggggtacctggcctatccctcacctcaagcaattatcttttctgttacaaacgacaatctaataataatcagttatttttaaattcacaataaattttttgactgtagtcatcctcttgtgctatcaaatactagatcttattcattctatcaaactatatttttgtattataaatttcactacccattagccatccccccctttccccctaccactacccttcccagtctcctggaaatattaaacatgaagctaccatatgacaaaaccattctactcccaggtgtatgctgaacagaaataaaaatacatatgtacacagaaaacctttatacagatgttcatagcagcattatttataatagccaaaaagtagaaccaacccaaatgtccatcagctaatgaataaattttaaaatgtcctctacatccaaaaatggaatattatttagcaataaaaagaaatgaaatactgatatgcactgtaacatgagtgaacctcaaaaatatgctaagtgatggaatccagtcacaaaagaccccaaattgtatcaatacattcatataaaacatccagtaaagactgaaggaggaggagaatagacaatagaaagggactgttaattggtatgggtttcattgggggcaaataaaatgttctcaaattagatcataataatggttgcacaaccctgaatacattaagaaccagaaaattatgcactttaagtgggagaattttatggtatgttaaaaagtatatctgcatgtcattgactacagatcttttcttattttttcaagttttatgaacacagttttagaaacatagtctccatttttctctttcatgaagctgcttgccagctatagaaatgaaaaaatagccatgtctgtggaacataactgctacctagatgggagcctccatcacacaatggatagggagctattttcttttatggtcaagataggcaggttctgtcctatagaatatattctgagatgttacctgtagttcagaaaaacagggatattgttgttctaaacatttcctcaacatttatgtggcttcctatttattaataagagaacctgttctttatgtgtcattatactagtttattctagccctggtcctggtccaggactgtctggaggtattagaattgccctactctatgtgaaataaggtcatatctgaataggtatgtcagtcagcataggctaagctacagtaataagcaacctcaaatctagaggcttaatagtctatattttactcatgttacatgttcgttgtagactgatgagagcattctacttagcttagtcactcggggaccatggctgatggtatctccatcttggtacattctttcatgatcatagaggcaaggaacatggttcttgagccttctgcctggaagtgaccagtagacaaaaccagtcacatggccattcctgagttcaatgggaatgccgatgtataatcttctggcgtgaaaaggcactggatatttgagaacaataatgcagtctaccacaatatgctcatggggtctgaaaaggagctgaaaaaacgccattttctggggttctgtcctctggcattgtttctggaatcgtttccacccatccatttctacaccctctcaactgacttttctcagatgcctggggtagctgggtgatttgttaattacagtattgcttaagccttttaataaagtcagcaaattaaagagagagcccagataaagagaatgctttcaaaaatgtcataatgaaattaaggtaacgaagcacttggagacctctcctcccttctttttgtatgaaacttattccaaagcagctggaagagaaatggggcctgaaagtaaagaggggaaaaatatattgtatgccattagtttaattataaaaattcattacatgaagccatgtaagacagaaaataatggaactctaatgggttggccgataacacatttactagtctgctctcagcttgtagtcattgttgaaaggacagaaaagtaacgacgttggtatgtagtcttcaaagctattgtaaagattaatcattttcagtaagccggaaaatgagggccattttcttaaatagtatgccctgtatagagtgttaccttctgaaacagagttgtttggtaatgtcagaggtttaatagatgagtcttgaagttaatggtgagaggctttacttttgaaatggctttcttacagctattttaacatttctattataaatccataaagaggttttataggtcgttttaattcacacaaggagggaagaaattgtgcttctcttttcccaataaggatttatagaacattaattcattcttgggaccaaattgtttagtgattttcaaaaataaactatgtatttttctgctgtctttttttcagaaatgccttactttattatacataataattttccagtcatgctataatcatcaagattgttttatattcttcaaagctcagttaaaataaacccagtccttttccttaaatttctttatatggatgcataacttctttaactgaattgaaatgaaacctgaattgagagtccagaaacctgcatttttatgatgactctttcactgactagctatgtcaccttgaacaagtcacttaacctttcagagcatttatattctcatgtggacaattatggaattgctcaaaaaggaagaagatatcaaaagatgaaagtgaatatgtaggtaggggtcatatattcgagggccttgtaatccaaagagagaggttaggactttgtcttgcaggtaatagcaaaccattgaaaggttttacacagaggagaaatgaggttctatttgcattacaaaaagatcatttacgcagttgtatgtaggtggaagggtggtttgagagtggagggagggagccaataaaaaagattattttagtacctgagcaagagatgatagggacgtaaattaaggtagtgtcaatggaagtagaagatttggataaaagttaaaaaaaaaaaaaaaaaaacttatgatacaactacccagggagtatgttccctgcctcctgctccagttgaggaccaacatatcagattgatccagagacagaattttggagaacattaatatttaaaggacaggcaaaaaaaaaaaaaaaaaagcttgaacactcagagaatacagaggcgaccaaaagagtggaagccaagaaagcagagaacttcgagaagagaatagtcagcagcaccagttgctgcaaataaatcaagtaaataagaacttaaatctttccataggcattggcttttggtaactgaatcagttaactattttcacaaatgtgagtggcatatagcaataagcccatattgcctttcatgaattttcagcttgggtggggtggcacttcttcatgttgcaggttgattggggtcgctctgctccatatgtcactcattctcctcctgagatgagtaggctagtccagagcatgtttgtcttaaggtaatggtgaagtgcaaaagggatagccacactgcataaatacatttcaagcctctgcttgtgttacttctagtaatatcccactgggattaggcaaagcaaggcgcatgaccaagctcaatgtcaagggcatgctgtctttcgtaggaagaatttcagagttacttagcaaagggcatggatacagggagaggtaaagaattggggccagtaattcaatttgccatagtgacttctgtcagaatagttttagtggaacgatgatggcagaagcctgattttcatgaattggagagtggcacgaatgtagtcaagttgagataatgagtgaatatctgccttctaaagagtgtgactgtgaaaggaaagaaaatgatagagtgcagattattgttgttgttgttgtttaaagatgagagagacactcatgtttgaagtctctagagaaggtccccgcagagaggcaagaagttggaacacacaaagagagagggagtatgtggaggaggatcccagaatagatgggtgcccagatggtgaaatcaacttccaatagcagaaaagtcgcctcttcctctgagactagagagaaggatgcaagatgtaaagtctgatatttcatgaaatgtatgtttgatatattaaatttccccctgtggaattgtaggtaggatcatttactgtgagatttctttcagttcgtgttgtcaggaattagtctgtaaaccacattcgatatttcaaacagaggaaattcaatacagaggactggctcctccataggaatgaaggagctgacaaacccaacagaggacagtgaggcaacccagagtttagcaacttcaggaaactattaccacctcaagggctggggaaccgacaagttttaccaaagcccagaaaccagaaccatcgggtgctaattcacccaatgtaaggtctgcacagcaggtaatggaattacagagggagcagccgtccagtgggaaacggagacaaaggagatactgccaagacagagagagaagggggataattatcttgtttcaccctttctcatgctcttctgtctcccactagtgtgtctcatgacttaacctagttagaagccagctagcaagaaatcccaggaaattctgacctcctatgggagttagtacatctcaatactgagtggagtaggaaatgggtagagaatggatctaagagcaaacgacctcttggtggttagctaacagagttaaatttttccatgaatcccttggttcatgaatgtaaatacaggatccaaggaaaaataacaaatccaacatgtagaactttttgttcataagcatattaggatcctgttttacaattttccgagcaattgcttgattttgacacttcaggacaagccggaggcatggtcagagcaagtaaccccatcctagtttacagatgacaaaactgggacttacaaggttaatgacttccttaagatcaaactgcagaacaatggacaagcaaaacttcctgggaagatgtcctttcgttactctgcactgcctttcttgaagttcctttgagacacagtcattaaaaatttaagtaatagttcacccggaacaaacatttattttacttgtaggtgaatatcacaaaacacattttaaaaggaaatttaaccaatattcaaccttaaaattttaatgatagagctatgcacttgcttttatcttccaagttaaagggagaattttagagttgcagcatttctagacaatgtccataaaacagcgagctacttgctttgcattcagaaggggctcacactgtggggaatatagtttgactcattaaaattagtagtagatgtgctagcagtagtaatgatgatgatgatgctgatgctgatgatgattaatatttatttaatccttcgggcacgccaggcacctttgtaaatgttctccctgaattctctaagttaacccacctaatcatatttccacataaatactgttaatattcccatttagcaaaggaggaaactgaggcacagaaaagataattaactctcccatttgccactaagcgatcacgccaggattcaaacccagcaggctcattgtattgctcaggcttttagctactctttctcttcctcctctcttttctaccatgtagggtcaatatcactaaaataagttcttacacataaaagaaatgagagaagacaaacaattaaagtagaaaaaaatactcaaaattcttgaaattaattcaggttgtctcatagtccacaatcactttttctacctaagatactgtgaatatatatcaagcacatagtgcagtagcagcataatgggtttgaatgtgaaacatttctttcctggttggggaaacaatcttttggggatttagcattttatattcttcatagaaaacacacacacatacacacacacacacatacacacacacacatatacaaaggcaatctttttttataagctagtgctcacagtattttaaatttcttcacacaccatgatcaccacacaagcaattccctgtggtgtacaccattgtcaatggaattcagaaagagaaaagggtgtgtgtgaagtctgttgtatttttgaatttacactccttctgaggtctggagttatcccagtagtaaatttcacagcagtaggcaaagctggtcaaggtcatggttcctagtgtgaatgacacttgggtaaaacccaaggtgggcgggcagaatattaccgtaggagaaagggaaaacattctgtgtggggaatgtctttaagaagggagaaaaaaaaaaaaggctacctttgagaacctttgtgtttatataagggcctgagccccctcaatgtcagtcaaggtcagtgggagttttactttttaatcctacatcctcacaaaacctgggcagtattcagtgagggttagcactcagtcaagatttccttaggtataacagtcctaactttcgctgtgaatacaattttgcagaaaaatatatggcacgcgtatttctacctttcaagcattaaagtacatcaaaaagttctggtttgacgtcaagcctcactctttactaccttgtttagtaggaaatctgtcatttaactctagcttactatttctttcagagattttggaaaattctaggatatgttataatttataattttaggcatttttatgatctattgattatgtttttagattcattggcaccttctgcattttatgttttttaattttaacagctttattgaagtgtaattgatatacaaaaactgcataaaattatatgggctagaacatgtgcatatacccatgaaaccatccaaatggtataacctcttatatctagacttttcaaacaggaacctatgagtgatgggtggcttccaaggttatttaacttgcttgagtaaaataaatgattttaattatatatttactaaaaattttgtttttattttgtattcctgagcttttacatatatgctctgatactggtccatcataagtattttattaacaattcagtgttttataaaaggaattcatttgaaaaaaaggtaaccaagttattggtctcagttttgtggatgttcatgctattaattagcaatttaatagatgagagataataagctcttcttttaaaatgcaaatagcaccctctggatactaagggccaattacatgttctttcgtatcttggaatacatttcttttatcactttaggtttggcttaagtgaggaggagaaagaaagaagtggtaattttgtaccctaggatatttctagaaaaggcaagcctttggcagaagttccctcagaagggctttcaaatagtgcgaggatctgaaaagtggagaatagaaactgtaatgcttgataaaaggagtatggaagaaaaggcaggcattccacgcggataaatgttaattgttttgtaatagcagcaactatgctctgtgcctttagacactgtcctctgctttcatagcaaaagtcagtgatattggcattagcttcttgataatagtttggtaatctgggtctatttgctatatgcagtaaatactattacttggtttgattctaggatgttttagttaactgagaaattacattatatatagattgtatatgttcaataggagttcaccaaacacgctgaaattatgctaagaacactgtttgatttttattctgtaaatatcatactaacgcaaaagaacaaatattaaaacaaaaatgatttttctcctcagaagcattattttcaatttcttccatttcgtgttcagctcatgattatgtattcttagagataaacacagtgtagttaaaaattgtgttctgttttttacacaagaaaattgtgctctttttacagtgattactgtgcacatttgctacatattggaccattggaatgatgtattatgttcttttaatgtccctgcattaaacatcgacattgtttctctttttttttttttttttttttttttttttccgagatggagtctcactctgtcgcccaggctggagtgcagtggcgtgatcttggctcactgcaacttccatctcctgggttcaagcaattctctgcctcagcctcccgagtagctgggattacaggagcctaccagcacacccggctaatttttatatttttagtagagacggtgtttcaccatcttggccagactggtcttgaactcctgacctcgtgatccacccgccttggcctccctaagtgctgggattacaggcatgagccaccgcacccggcctgtttctcatttttttactgctttggttaatgaagattttaagtcatatagtatattgatcttcttttgaagattttatcaggataaagtaccaaaagtgagattattgagtcaatgggaataagcatttgtatgtcacttggtatctattgccaaattgtcctaatagataacggtccccagcagtaatacgtgaatgtgctagttttactggtcttttcagctttggattttattttttgttaatttaattggtgtccaattgtaccttttcaatttaatactctattttttattacttgaaagttaacttttttctttttaaataaaatcatcccactctttctcttgtttgaactacctgttcctattcctgtgtccatttatcaatgacttaacccatcctattgaatttgatataactatcttaacaattagtattatcttaatgcttagaagcctcctctctgcacttgcagaaatgtttaatagaaatttcaggttgatatgcttcgagataaaacctaccattaattgacttctttctttgaaatatgtttcaagtgatgagatagcaagtttgaaaacactgaattgccaaagacaaacaacgaagaaaatgtaggtgatttggtttagtaagattcttatattttgactttttttctaattttaaagtaaggtattctaaaagtattttgatccttcaaaaaattcgtgactagaataacagtactattcttttgttgttcaatattttctgtatgcaggtttagttgaacgccagtagatggcactaattacataaacaattcaacaagttaatgaagagggaaagaaatgtatgaggtttttttcgttcaaatgttgttatatgtcacatattcaacaattatatatgagcttatttttgtagtttttttctcttgtgataaaaacaattaagcccactttattgccaattaattgctactaagttgaaatacttgatactggttattgctcaagatgctgcatttgaaaagtttgtcctgaaaggtgggttaccttatactgtcatgattgactaaatcatatggtaggttaaaagcaatctaatatatgtattctgacctgaggattcagaagctgtttacgaagtattttaagacactccaactagagatttcataaaaaaaactgacattcattctctttctcataaaaatctatagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaaggtatgaattacattatttctaaaactactgttggctgtaataatggggtggtgaaactggatggaccatgaggatttgtttttccaatccagctaaactggagcttgggagggttcaagacgataaataccaactaaactcacggacttggctcagacttctattttaaaaacgaggaacataagatctcatttgcccgctgtcacaaaagtagtgacataaccaagagattaaacaaaaagcaaaatactgatttatagctagaagagccatttatcagtctactttgataactctatccaaaggaatatctttctatctcatcatggcgcacactgccttacctgttatctgataaataagtcactttgggattcatgatagagttatagctgtacatggtctcatcctagtatctcactccacacacccaatgggaaaatttgtggagggcaatatgactcgtcacttcatttcccattatatatgaatggaaattaacagcgcttatagacagtatctcctcaaactaagccttgtatccttattatacctctcttgatctctagtgcttttttcactagcatttattccaatcataaataaaaatataaattatgtaactaattgttaaatatttgtcctttaaattaatctaaatgccatgagggcagagattttgtctttctcatttgatacatccccaggtcctgaaccacgtgatataatagggagctagtaaatgttttttgaatgatgactccctttgcagaatgtacaattaccttgtgcaagctgaaaaaatagcacctgtacaatatgaggaagaccacggtgaaaaataattgagttccaaaatatgacatcaattactgaaaaaataagctcggtgatttttaacaagaagtaaaagtcaccactggggccaaaacagattttgaactaagagtaggaagtcttaggagaaatgagataatgatatatggaaattaagcggccaactaaattttgaaactgagctagacattagagagtaaaaactcctgtgaagctgaatttaagctggtcaccctggggaatagagcaactctaatcctgaattccagacagtaggtgtatagatggaaaagaccatggaaaagaagattcaacctaaagttgggaagttttaattggagccctatgaaaaagaccctggtggagaaagggcaaacttgaatatggagctgatatttggaaaaattctcatagtaactactttttctcaatggcaaggcttggactttcttctcaaaatacagatcttatatgtgttcaattaaacagggacagattaggttcaggaagaattattcacatggaatcaattggtatcagagagtcaaccattagatcttagtgggaaatatctgcttctcaaagagaagtcttttggggaaagcaaattaaagtcagagattaatttgatgagtttaggtaatataaactaaggggccaagaaaaaagcttgctcatggtatgaaactagagcttgaggacactgatctagtctatctatactactctttctgacagacccctctcttcattctcatgctccttgatggcccaagccactctctcagttttttaaaaaattgttttatcaaggtctctggattcttcatgggaatgacttccagtttatattttttggcttggttccaaaaagctatcagctaaggaatgcatatacttacttcccctatgggtaaagtaaatgagaattttagaagccaactcacatttttagcctgtacagaatctgcaattcaccaagctacttctgactcatgtctataaagttcttccctgttcttttctcacttcacatgtactctttgcaagaattcatccacttgtgtagtttcagtctgttgatgactacccatctataattccagctgagaatgatcttttgagttttagacatgtagatcctgctgctttctttcgatgttaatgtcccacaggaacttcacattgaagaggtccaaagctaaactcatctttgccttcttccaatctctttctccaaatgcaacctacttctgttgtccttgtcttagtccttttcgtgcttccgtaacaaaataccacagactgggtaatttataatgaacagggatttgttggctcatagttctggaggctgcgaagtccaagatcaaggggctggaatctggtaagggccttcttgttgtgtcatgattccatgatggaaggtggaagaccaaaagagagaaaaaatggggccaaacttgtccttatatgaaactcactcccacaataatgatgctaatccgttcatgaaggcagagccttcatgtcctaatcacctcttcaaggtcacatttactactgttgcaatggcaattaaattttaccataagtttgggaagggaaaaacattaaaccatagcattctgcccccttttccccaaaattcttgttcttctcaaagacaaaatacattcatttcatccccaaagccccaaaaatcttatttcagcataaactcaaaagtgcaatctaatataaattagatatgggtgagactcaaggcacaattcatcgtgaggcaaattcccttccatctctgagcctgcaaaatcgaatcaagttcatcccctcaccccctacccttcccagcatcaggtaaccaccaatcacagaaagttttactgatagtcctgctctagatcatctttgtctatgttcactttagctatttatcctagtgttccattattggaatactaagcatgtgggaattatttatattctactgttcaaggtcctcaccaaggtctgattgcaaaaattcaaaaaattgcaaccttaggcataaatgggttaagcagtttagggtacatttataataattatttactgtgctacttcaaaaatcttattgcctctatttataaataaaaagtgttgtctctacacagtggcttgttgtaatgcatttacttgtttctgcctgattttttctatttatacattttcttttttatttttatttttattttttcacttttaagttcaggggtacatgtgcaggtttgttacataggtaaacttgtgtcatgggggtctgttgtacagattatttcatcacctaggtattaatcctggtacccgttagttgactttcctgatcctctcgctcctcccaccctccacactctaatagtccctagcatgtgttgttcccctctacgtgtccatgtgttctcatcatttagctcccacttataaatgagaacatggggtatttggttttttgttcctgtattagtttgataaggacaatggcctccagatccatctatgtccctgcaaaggacatgatctcattctttttttatggctacgtagtattccatggtatttgtgttggtctcaaaaactacaactatgacaggatggcattttcacttttgttgttatattaaactcatcttaaaaaggaaagattaataatgtcaatatttgggttatggagaaaaagtatctcatatctttgaaaaagttctgtaactatagctttttaggtaggagggattctgtggaaagttttctgattacatcatttctcacagttcaggttagacaccattttactatgaaacactaatgcattgcctgcactgagactttcagtcacatggagaaacctaggcaaaatttttgtacacttggaagaatatttaaattagtaataaaatctttagttttaaactgttgaatgttaaataagatataaaatgtacttgaaagaaatttgctttgatatcagacactgccatgttgcagtttcaagacataataaaaaagtaaactaatgtttatattttgctgtttaagtttattaatacatcagatgagtcttcaaattctacagtggcttttgatatgatcatttttacttgccattttatatagaataaatataaataggcatttatgcttaaaaggaactaatctatctatggaaaaaagagaaggctgcttctcaactaaattgtacagtttagaaacccagatctgaacatagattattgttgtgacctatgtaggaaaatatgttgttttccttatcgtagtccttacagagtccatgataacatataaagccagaaatgtgagcctctgcaagttcatttctttgtcttcaatctctgtgaatagatatgagtttgtgaataagataatattagatgtgatattacaaattattgtgagaagcctctaaggattagatttcaaggactgccatctggctgatgactttatgatgacactgtcatgagatttcatttccttatttctgttccaggatcactctttaaacaagaaataagcattaactctgaattgtctgcttgtagctgtatgagggcttccacaactgccaactagccaggtacaaactcatcaagcagaggagatggtccttgcatcagagggttaaacatgcctagaagttccttagctaagctcccagatactaaaaaatccctctaggttctaagaaagattcagcatgtacatgtgtgtacatgtatgtgtgtacatatatacatatacgtgtatatgcatatgcatgcatatacatacaaacacattttcttccataacatctcagtattctctgttctttataatactgttttgtattttaatgatcaaaattaatagttgatcatctgaaaacattttgacctgttttctccgtctttgacaaccttgaaggcacttgtaagtcactctttgcttctctattcctaggtcctttctcatcttcattgcaacaagaaaagagaaaacaattgagccctattttgtgtgtagcaaggagctactctagttaaacactagatctcttttacattctccaacatgttgttttagtaattattctactttcctttttttgggatattcaatttcttctttctttttgctcctcccctttagcaggccaacatactcaagtctccctcatcctaagagaacttttttagtatatcattttttttctatccagctgtacttgcttctgcttactatatcatttttaagcagtagttggcattactgtttcctgttctttagctactagttgtactttgacccactccagtctcacttccccagcaccaccactttatgaaaacaaggacttactaagatcatcagtgactttgtaatagctaattagtgtattttaattcgtccatcttcttgactatattttaacattgatcctgttggtcaactctgctaatcaaaactttatcctccttggttcccagaacaatattatcttgaatatctcatttctctaatcatataataattgtgaggtgcttggcacaatgcctagtgcgtagtaagaactcagtaaaatatcatctgccatcgacaccataaaaattaatttacttactcaacaaatacttttgtatgaagtttgtgctaggtaggcccagtaattggtacttggtatagagcaatgaaaagccctaccctcataaagcttatattcttggaagcagaagttggaagacagacattgacaaataaaaattaaatacatgatgtgtcagatggtcatacacacagtgtggaagaacaaagaggaaaacaagtggagagagagagggaggtggaagaggagtgctgccatgaaaatgtggtaatcaaaaaaggtcttactgaaaaggtggcatttaagcaaattctaaaagacctgaggatgtgggccatatgtataattgggggggaaaaagtagtccaggagagtcctaataagttaaaatgccccaaagcaggaatattcttggcatgttgaaggaaccttaaaagggagatcagttaggcagaaaaggatcaagcgagcaggaaggtagttgacaataaatttagaggggtaactggcatctgattatattggccttttaggcctgtggactttagcttttaatctgaatgagatgggagttattggagggttttgaatggaggagtgacatgttttgtcttatctggctcctctgttacaatagactaaacagaagtagtgagaccattaggaaactgttgtcataattcagtcaagagatgactgtggctgggatcagaatgggagaggtgaatgtggtgaggagtggttggattctactatattttgggtacagagcacaacagattttataatggaataaatttaggtgtgagagaaagagtcaagaagactcaagaatttttagcctgagcaacggaaagatggggtcatcatttactgagatggggaaggctccaggagtaacatattttgggaggaagatgtggatatgttacatttgaaatgcctattatacatctaggagatgtgtggagtagatagctggatatatgaatcttaagttatggggagtagctcaagatacaaagttgggagttgtaacaatgatcagtgcaagttctctgtcttcaatgcaattttaaatgttgatgttccattcttaattgtctctcttctttctctctgcacattttgagtagctttgtctgttggcttcagttaacattaagactcctcagtgtcaacttccatcttacactcttctcctgatctccagaactgtactttctgccacctaacctacattaccacctggatatgctacaggctgcaaaatgtgtcaagtagaatgcattatcttgcccctaaaagaaagttaaattttctgtgttttcagtgtagtgtaattgtctaacttaattgtctctaaaactggaaacctaagaattaccttctacctttctcttgatctctctttcccaatctactgacacatgtattaaactggcttccaaattctgtgaattctacttcaaaaattgctctagaaacaattccctctctttatccctattgtcacctcatcctaaagcctcttcatcctttgtagatttctgggagattgtaaccaacttttctctattctgccagttatcaagtctttacgctcatttgacattcacaacagccttggatctgtcttccttgaaatgaatcttcttgcttccctttgattccagtgctttttttttaccctcctgagacttgatgcatgatatttacatgtatgacatgtttccaaaagcattctcaaatttttctgaaagtaaaaacaaatgaaaaagtaaaacattttcctgggaagaaaagcaaatagtgttatacatttttgcttgttcatttgtttgtttatttaggagagggacaagcattagaacttcataagagtcttatatgctgtatctacaaataccgtcccttggcaatataattttagagttccttttctggaactacttaaggactgttttatgatcctcagcagactgttatattattttatagccataccttttatttgctgagtaattgtactcaataattgtttgtaattgaatgaaacaattcatcagatgttgggcactgaatggctttggattatttccaaaaatttaaaggataaagatttgctgccttcaaagctatgtacaaaaatatgatagaatgctagcgggatatttgtttaaaatacaacctttattacattggggcctgctcataatatatatgtggcacattttatttaaaatattaaagttcctggtgggacatgtccccataatcccagcactttgggaggccgaggtgggggtgggaggatcactagaggccaagagtttgagaccagcctgggcaacatagtgagataccatttctacaaaacataaaaaaaaaaaaaaaaaagccaagtttgtagtcccagctacttgggaagctgaggcaagaggatttcttgaacctaggagttcagttcaaggctgcagtgagctatgatcatgccagtgtactccagcctgggtgacgtagtgagactccatctcttaaaattaaattaaatttaaagctacaaatgaccccaaagccaccagttcaaccctctcaattttgaataccctattttaaattcctcttatgcgaaatgtaccttgtagtccattttaaggactgagaggatttggtatgttaaaaaattcaatccattatcaactcctttaggtacacttagcagtatgaaaatgtgtctttcggctcttcaggagagagtcatatgtatagttacaagacaatcccatttttatattgctgagacccaaatcttcccaactgattatgaagcataagaactcttcggaggtttaagtgagctgagattgtgccactgcactacagcctgggcgacagagcaagactttgtctcaaaaaaaaaaaaaaattctctgcattctacagtagggtaatataacatctatgatgtgaaatcttggggctccgggccagagagtgtcatgatccatatggatctaaaaggttcatagtggtaacagcctgcttcattttatgtcatctcctttcaagtaattagaatgtttctagcttgcagggattgcacacaaagggagacatttggaaccatgtcattggtgatttactggtgtggaaaattacctggtgatgtagccaagtagccattttcattctaacccagtcctacagtcctgaactgggctgaaccaacgcaccaaaatatatgcttagaaatgctcctatgtatcagttttcccaggaaaaacaatagtattatcgaaaacttaccattgtttcctaataaaaaattataggataccaacagactgttttttgttcataaatttaatattacagtatcaaatattaaagcaaatgggagaaagtttttcttatttggtttaattgaaccattaatgttagctacaatacccatcatgttacttttcaattatatttatattttcattttatttctatctgtatcattctcagaaagacttctttaaaacattcaataaaaatagaatttaggtagatttatttttagaaagttgagtttttttaataaatgaatataatcatcacttgacttaatttttttctgcacaattctagaaatcttatagttttgggatcctttggctttattcagtatgtaacagggatctgtttcctttctctaaatcattaattcaaatgatttcttatattaaaaatgtttggacatataggtattaatgagttttatgaaatctaatctttccaatttccccctaaaaagggatgtcatttaatcagttctaggttgtgatcaatagcagatttttttttttttttttttttttttttttttttttttttttttttttgcagctccctttcaccccgtagggaaacctgatatcatccttgactaattgcagcaaagagcctggctcaggtcctttgtcttataccgagtgtttatagattcttgagcccagcagaatctgaactcctggctactgctacctacttcccagcccaggccccaaaagccctatgtctgcagccccgtgcaccactgtgtgtttttgtggcatttctgaaacacagagctacttaacttgtttctaagcccagattgtgcctttttgattttctattttggtattttatctaccatttttctgtgtttggatgtttcttctatattttgaaataacttctttcctttagtacaagtgattcttattgtagaaactatcaaaaatttacaaataaagaatcattctcaacattcttagcaattccttctatcatatttttgcaaatatatttttgcctatttttattttacttactccctgtttattaacagttaaaagcattttcagatagttttattttttcatttaaaaaaatcttaccacatttttattaggaaggaaatggacaggtgtttatcttttcaataaaaaacatgggggaaataatttcttgaagtacatagtgacattcttccagccaatgttttatgctgtggtcattccgtctgtcatcagtattcatagaaagagatgaaaattatttaaattaactaggaaatcaattccccattcaaagcagtagttgtgtgtttcaaatatcttctaatagtcagtttcacacttagctttatcaaattcctaattatgatactcattacatcactctgtgtccagtcagtgtgtttatgccacagagcaattaaagcaaatcaggtgaaccaaattcaatcacctttgtagataataacctacgttgcttaaacttatggccgctcatacaattactgatggattgcctttttcttttatattgccagtattttaaatgtcctagtgaagttggggtagctgttgaacttcaactttatcacaacctcttttttaaaatgtgtaaacgaaaaaaccctccatgaaatgaccaaatacagttttcatgctgggacaaattagatgaataataatcataaattcataatgattatttatgattttatgtttttatagtgagatatgttttgttgaaatgtgttatataagtgatacttaagtttcctattaaaatagaaatgctaaaatggcattgttctctttagctgtgagtctagcttttgacctctgcttaaacggaactgttgttccatcccaaatctgcaactctgaggcctatgctcccttcactgctgtctaatggatacctatcaatttggaaggaggtttcaggcagctattcccggtaatctaatctcagctctgtccttttcaatattttcatcagtggcttggatgaagacatagataacattcttatcaaatcaatgccacaaagcagggagaaatagcaaatatagcagacaagagtatcaggagccaaaaagttttcaacaagttggactggtaggctgaatactgaaagatgtaatgtaaatgcaaggtgctacatgtgggttcaaaagaaacatgaaacaaaaaacccatctaacttagactgggctccctggaaatagactaagatagagagttgtgtgcataaggtttgttgaggagtgttcccatgagatacatgtgtaaggttgtaagataggcaagattgcacagacgaagaagtgcagtgaagcctgcagtgcgttgcggcctcatcagattttcaggggagttctggaaattgcatggccctttagagacacgctgaattgaagcaagggatctggacctttgaacccaatactagagagttaatggtcctgggtcaccccatgggaaagagcagactggagtaagattgttacctacagctgaaggcaatttccagggagggaggcagctgtgagctgttagtagtcaatattccaaccagctagggcatgaggtcttggcagagcaacagtgtacccaagaccgcagtgttacccaaagtatggtcctctgactggcagcattggtatcacctatgagctcactagaaatttaaatttgtaggtcctaccccatccaactaaatcagaatctctggggatgggacttggggaacttttaacaagctttcaggcctccaagttatttctatgcatattaaaatttgagaaccactgcctacaccaaccaaaaacattccaaatatggagataacatagagtttttagcaacaataatctccttctgtttcacttctctctttacacacacacacacacacacacacacacaacacacaacacacaatgtgatagaacagtgggaaaggaaagccaaaggggatcttaggccgaataaatttaagcatataacctagtcctaagaacgtatatttcagcttaatagagagaggaatattgttataaagctgtccaaagatggaacaggctgccttgtaaagttgtagaagtattcaggaacaggttggtgataccttggtggttgtatggtataacatcctgatcttcacatactcatcatctagagtgggagttttctttttccaaatggggttttggcagaactagttccactgtatcttaataagtaataactcaagaaagggttctatggatgaaaaaatgattaggtaatatcaagttaaatcaaagcgaacagacttctttcccataggagtaatcagacccttattacagtgcatgcttggtgaatcaacaaagtatgtgtatttatgaaagtatggggggaagggataatctatacagtatgcatcccttctaaaagtttgaccatgaaaacaatttctcaagaatcttatacaacactacagtatctggtccaatactatgcatagaacatgcactcagtaagtgtttgtaagatagatagcatagcatataggccaggccactgaagggaaatcatctcaccgtgagttacctgaatagtattctctagtgccattagctcaattcttcacgtaggcataagcctatacatttgccatgctaaccaagggaatttgtgttacgtgaattttgactctattcagacatttttttctatgactcctccaaggctgttattcttacctcatattctggtagaagtttaaggacttttttctgggaatattgattaattagctagctagctagagacagagagaggatagagattgattctctggcagagcctatttgaatcatattgaatctttttttttcctgagacttcccacaaggaggatggaggagaaattttttagaaatccaccgaagtaatcagggatatcttcagtaaaagaagctatacttaataaagtctctattttagcagatggcaatcaacaatagaggcaatagacaatagagtctattaaaattgctgggatctgctaataacgtttttcttttccctgaaacaaatgccattaaccctccttgacactctgtcttcatcaacattctaatagaatggaagtaactcataattttgaggatttttttcccacacaaaacctataaaccacaccacgctagtgattacttttagcctagttgctaggttgctgctggtaacagtaaaacttatcctgacaggtaggcaattccagaagcccagccaagcacttggtgtgtgtgagtaaacccccatacacttctcatgtagagtaaccctggccaacccataactcttagcaactattcctggtggacggacctggtctactctaagaagaggccaaggttctttaatagtgcagttgcaagaaccagaattgaaagtcaaagttctagcaagattttgcagactccttggcaaaccagtggcttgggactcattcttgacttcaagcccttaattgataatggtaggacagcttgcttgcgctgggttctgctccctgggatatgcactgtttgccaaatgagtagcaggtggacagacatctttacaatttgctgtcccatattctaaatgaacgtgacattctataggtctgagttaacctatgaagtcaccaatttcaatatcaaaatatttatgacagagaaaaggatactgaggcacagagagtctgtgactttcctaagctcaaaacaccagtttgtgttaattctgacacagaaattcttgtatttgctatcagtctcctttttctgtgtgtgtgtgtgtttttacattgcagcatcacctatatgatgttaggttctgtaactttttgagaattttctcacatacagtgatgtgttactttttgatatttcaaatagttctagtaagtcttttctacttttattagcgtattaacatactggctctaagagggcatctcaccacatctttgccattcttcctggaaaggcaagtttctctccatcttcttttttgtattccaaagttttgccaaagtttgcttttgaaaatgggttacctggcagagctttattattctaactttgaaagtacaagtcagaatcagacagtggcagttatatatgcactactgtgattactatataatgaaagtatctatggtgaaaatactgatactgacatatatttgccattttctaattaagtgcttcagtaaaaattaagcactcactctttgccagatactgcaatagatattgagcacattgaacaaaattctccatatacatatatatgagtccacattctatgaaagtataatgtttttctgagaaaaggcataatattctattaatatcagcttttgcttcttccaccatatattgaaagaattctgaatactgttataatttaatgggagaatctagagaattctgtatttgctttcactgcattgatgaactaagatttttaaaaaatgtattcttcatagaactacttttccatatttacctaatattattcttatatcatttgagcacatatttcactaacaaaacaaatgtgcaatgttattagttctaacatcaaaattacactgatactttaatttttatcctattatttttcatgcagattaaaataattatagctacatcacatgttgcaagttttaagagctactttaaaaatatatgcttcaggaaagacatgattagatggggaaatggatgatgttcatattttcaaatgaaaagttttaaaaaagtgcctatcacaaacactaaatttttacataaattatcaactactaatatatctacaagaaataccatttttccctacaaaaactcttaacaataattgttaaacttagtcctggaacctgctaatataatcggacaaatgttgtcaataagaaggtgaaaaagaaagcatatatagtttatcaaactataaaatatagtttatcaaaaccaatttttcctattgacatttattcaggaaggaaaatggatgagtgaaatgaacaatggtctctaagagaggtgggagatagcaataaattcagaccacgtttcctgtcattacagcagggaagtaaaagagctacagtcaactctcgaaagtacttgggggaactaatgattccctgtagacctgtgatgtttttgaaatttaattcaacaatttgatatacaccgcaaagcgaacagatagtcagatcaaaatcggaagaacgattgtctgaatggcatccatttttcctagatgtgctgtcccatcctgtgtcaattaaactttcaggtgatcttcaaacatatttccaagtaaaaggtattgcagttatcctataaactggcctcttccccagcactgcttttgctgtggtcaactttatttctttgggctcacaaaactgatagagcaaaataaggaaaacggaacattggattaaaataaattaattcccattctgtgactcactaaaaaaaaaatgataactatgcttctgtgagcattaataaggaaatgaataaggaaatgaccaaattgttcagtggacaacttgtatgggatttttaagtattgtgtcatcatcaatgttgtcaattagcatatactttgaaatcaactaaagcaaatcagttgactaatcattaagggtctttttaaatgacaacatctaaacagcaaatgttttattttggaaaatcatgacagcacaagaatgagccagatgttttacaacatgatatccataatttaaagtatgtagtagtcactcaaaggatttctatttcagtttccttatgatttggctaagctagaatttggaaaaacactttaaggtaatgtgagaaacagcaaaattcaacatgtggattttttcactaaagcttatttctgattattttttacaaactttactaggtatatgttaacttcatgacacttatagcagtggaccgtagttttaataaaatgtgaatgtatactcttttctcaataatattaaagaatgttgactttcgtgaggatatttttatttttctcaacattaagaactgtcaaagatttaattctacaacagaagacgtgaattttgttttctaaaggagaacagaatctatagaagaagtgttgctcatagtactcagattgttgaccaatcttaaaggagaaaccgtcaattaatttaccgagaagtaataacattatctttttcttcaattatgcacatccacaaagatttggggcaaaatccacttaaatgatattatacataatagatgagtattcatatgttgtaagagtcctggcttctttcctgcaaaatgattaaaacttggatcagaaaccaattaaaaatccattctaattcccaaatgtatgtaactgtactataagaaaaataaatatttcttcttgagggatatccattagttaaggatattcataacatggtgtcttgtaggaaatgttaatctttgggtgaatagggatgtttgggaataacaagactcaaagagatgttgcacttactcacttttctctgagttgttatttctgtcatttccccagtgcgcctgtcctcaactttgcctctctccttattcctttttttttttttttttttttgagacggagtctcgctctcttgcccaggctgtagtgcagtggtgcgatcttggctcactgcaacctctccctcctgggttcaagcaattctctgtctcagcctcccgagtggctgggattacaggcacccaccaccacgccctgctaattttttttgtatttttagtagagacagggtttcaccatcttggccaggctggtcttgaactcctgacctcgtgatccacccaccttggcctcccaaagtgctgggattacaggcgtgagccaccatggccgatccctccttatttctttttatctctacctctgcctcaatggtatttctctattactgttagcatttgctttctgtgagctcttgcacactgtcagcttatatacatgttcctgttcacatgttttcctgtccccagtggttacaacatgtcttctatctcagcccactctagaattgtcttacttttccaggtctcctgctcctcagtatttttcccacttttctagattcatgttttcccatctgcatatttctcttccatgtctgcactgtcatccgcttagaagacagcgcataaggacactgttatctgagcaaatcttcagcacagccaccatgaagcatggttaccttgtcactttccatttttcccatagtgtgtgcaaactgccctgatctgcatagaaaggtatcataattgaggaaacaaaatgcacaaaaatgtccttggttattccacccctcagaaatataggagagaagtaatttacagaattacacagaataacgctatgtcacatggacatggagttatcgggttagcatataattggaaaatatttcctaggaccttgacatttactcactttttgttttcaaattacatgtccctatctattagttgcaaattattttaatgcaccgtttaccaaagaaaggctgtttcttctgaaagctttcatttgacaagtaacttgtaaaaatattcacattgtgtatctgttttccccttctagtccaaactctagttatcttaaactttgcgcagttataaaaaatcataacaaaaaaagcttcctcgttgtcattcttgtcaaaacaggtttaccagacttaggtaaacttaaaatagttagtgtaaaagttaaaaagctgatttgctccttccagcgtgtttgttgcctttttgccacagcaaaattgtaaatgtaaacgtattccctaggagatgagctgggctgcaattttcagctaattgggagaagcagccctgagttgagcactgtcaggctgatttgagtcttaagatatgatgatgattattgtgtcaaatgtaatcaagaacgtgggctctgaactgactcaagggctggctgtttttaattcaggttcgtatatgaagtagacctccggttcaccgatagtcacagctggttgtagaagagagcaatttttaaaatgctatttcattctctatggagctctagggatcagagattggatgcacagggaggggacacatcctcattctctcctgaaaaattctattaattttcagtataataaactttctcttgagattccccagtggctctgtatcggtggttttcaaacttctcagacccaatgccacccctcttttcttttttaaataacaaatactttgtaataccttctttacgattataagccaaaatatgtagacaacataccctacttatacaggcaatagtttaaatgatgccgtaactctattttaaagagaaataagagtcatttataataaaataatatgtgttgtagtatgcagttattcaggcaggatcacactggaacacaagtgaagtttttagatcacgagactatcaatgcagtataaacaaatgcagaatgacaccattgtgttgtatggagactcaaataccatgaggggcattggtcatccatagcgtaattttccaaaatgctgaacaactcttggcaaaattcctaacaccatgaaataaattttttcttggatcgttatggcagttagttgcatggctgaaaaattcaatgtcttaaaatcatgaggaaaatatcttatgtttacgtgtaaaattgagttacgttccaggtttaggtgtttataaacagggtttccacatacatgcatgtccagtgggatattccaaagtgctgtcagacttgggagagttctttgttgtataagaagtctaccatcttcattccctctccacagaatgctattatagtaacactcttcaatcactgtgatagtcaaatgtcctccctcaatttctaggatgcctcttttttttgtggtctgtataatttggttaaatatctttccagacaaatactgatttgtgaattaatgaaatagcagtattttcggagcacctaacctatttctgagtgatacagttgccatttttacaagactaaatgaaattaccatttcagacctgccagattgtctagcccagtcttttacaattctgtgattatcactgcaattataatctattttcaccacttgaatggcatgatctctataaaagggtggtgataacactcatctattctccttcccctcacatagctatatcaatcgccccctaaccagttgttgataaatgcagttgaattttatgtaaaaattataagagatattattgtagctgtccaagacatttaaaatgctaaatgcaacttacgtggaggctataagagaaatatgaacccatttattgaagagattagctaatttagtaaaacaacacagatatacctgcatacagggataaatccctattgtctaaattattgagataaaataatgttttacaatgaaaaacttttagacaagtaggtaagtaaaatgcagcagtctatttgcatttcatctgggcatttgacaaagtctttcgttatactcttgtgaataagttggagaaatactggctagatgcaagataaattggatggcttagaagccacttcatgattttacgcaaaggatgtcgattaatagaccagtgtcaggtggtgatggaagatctctggtgctatgtcacaagcttctgttctcaaccctgacacactggatgtttttgacagaacatgagtagaactacagagaggaggcccatcaaacttatgggtgataaaaagcagggagggcaggagtattttgggtgacagaagccaaatgggtgtctggacaggatgcgttttaaggcacttttggtacttgatgtctgaagaccaggatcaaacttataggcaatctgaacatttgccaaaataacaggttaattttgacagaagttattatttgtatgctgtctatttctttaatacacctagaaagtattgaaataacattttttgcagacactcattttgaaaattcagaaaaaaaattgttaactttcgtggaagagtaacagaaactcagtcattgacagctaaatacaatgtgttgcccagtaaaatagtccaccccttcactttcatggctaatataaaatttgatgaaagatacaaattccaaagattgaatatctgtacatttgcaaagcaaaacacaattttgggcacagaattgctcattctcatttttaaacatcttggttataactgaacaatagttttttataacaaagataatattttcaaattattatgaggttcaactgaaataatttatgtgaaagcaatgtctaaactctaaaattctatataaatataaattattattcaataaattcacatcaagaaaattttaagttttttaagaacaagagcctatggccttgtttttagaagctgtataccttatcggtagtaggtttattgactttaattaaatttattgagtatctattaaattgccaggaactgtggtgtgaatctttgccctcaaataatttacagtaagttgtggttgatgaatggtgatgacgatgatgaatatccagactatagtaagtggtatattcataagtcagaggattcttaaaaccagatgcaccctcagattcattcctttcatgttgtacttctaattgaaaaaaataaatcctaaattatgactgttctttataaattttaattgatcttataaaaggccatcaatacatttcaaagtatctaggtcttttaaatgcaatttttcaccctggtaattaaaagtacgaaagcaagaaactttaaatctttattttgataagttttaattagctcaagctacttgtaatcccacatcttgtcttgtaaatcatatctgagccattaaaataggtttacaattagaagggcaattcttttagaatctacttaaactaagtcacttcgacaaattaattcatcgttcagttggttttattaaaatgtatttatttcactgtaaaatgtctagtaaagcaatgtatgaagtattttattttcatgttagaaattttatgtaaaagatatcccaaaatacatagacattcagatactctctgtatcattaaccaacatttactaacttatcatttagagaaggccaaaattgtatgtactataactttgtataatttcataagaattaaaatattcgattaatgcctgtaatgccttctttctaaatcaaatcctcaagcttacctcgagttcaaagttcagtatttattgtaacacatctcatagatgacggatgaagatggtaagcaaaggaataataatttcttttctcttttcacacatatatacacacataccccataatcctaattcatataataataacagaaaacaaagggcttttgagaatagtgacatattaatatccattatatttacttcacagggagactggcaagtctaccttgagaggtaatgtcttatagtacagtggactagattgtttcaagatttgtcatttattttggcaactcacccagcttccctgaaagttaagttcctcatctataaactgttcatgataattacaacctgcctcattagcctcatcaagctatttaaaatatgaaaggaggtgctatctgtggatcctgtcaaaggagcttgaaaactgcagaacattattttagtgtaaaatactataacaatacatgttgaatataaaatggctttttcttaacttttattttaagttcaggagcacgtgtgcaggtttgttatataggtaaactcatgtcatgggggtttgttgtaccgattattttgttacccaggtattaagcgtagtacacattagatatttttcttgatcctctccctcctcccaccctccccactccagtaggcttccacgtctgttgttcctctctgtgtccatgtgttctcatcatttagctcccactaataagtgagaacatgcagtatttggttttctgttcctgcattagtttgctaaggacaatggcctgcagctccatccatgatctctgaagaatctccacactggttttcacaatgactgaaataacatacactataaccaacagtttataagcaatgctttttctccagaacctgttatttttgactatttagtgatagccattctgactggtatgtgatggtatctccttgtggttttgatttgcatttctccaatgatcagtgatgttgagctttttttcatatgcttgttggtcgcatgtatgttttcttttaaaaagtgtctgttcatgtgctttgctaaaagggccctttcaaatgtgtattattaaccacaagagagtactgagtaagagactaggtaataaaagtcacaaatatttcgatatcataattcagaatttagatcagcggttatgaaattgttcgtatttccaaattccactgacaggactctactataagtttatttcatctgttgatatgtttttagccacttctttcttttaaagtgaatctgttgtgtgtttgccatttgatattagaaaactgaacctgcctgctttgctgtcttctgaatattatgtatcaacaactaacaagctacagttagttgttttgttctgtttttctctaagttattgtggatgaggatatatataactgcacagtcttatcaggtttgtaagagatgatcttaggctcatcttttaaattggtttttatactattttaaacaaatccttttaggagagaagaaaagctgcttagtctatcaacattaggaaatatatctttaaagagtttatcactgcaagtaaccaaagccaacttaaaaattcgcattatacaaatcattgagaatttatttagaacagaaatgtgtccaactataggtcaacaccaattttaagtgtgtaattatctgggaagtagtgttaactgcatttttttctaaagatcccttacagttgtataaatgcccaaaaggatattttgagtctctgtatattaaccaaaccaaatgtaattcattactcccaacattatatttcaacctctccaaatagtaccttttcgtattgtatcagcagaaaaatataaaatgcagatcttaaagagtatcaatctctttaaaaattcaagaaagaaaaaaatatgtgtgtatagagacgtgtatttcatctgctcataacactgtgtacatttctttatcaactaatttttttcagtgatttatgagttgaaatacaaatcaaatgaaacgggtaatgcaaagtaaagtagaaaacacattttctactgctgtctcctaatgcaggtcttttcaggaaagtactaatggttttagggaaagtgtataattatggttgtttccctaatgataaattcgcaaatctctattttaaaaacattcataaggttaaaaaaatgagagatgaaatgtgtctttcaaaattccttacgtgattgataatgcctatactctcttactatctaaagtctaggtgatatgtatattttttttaaaaaataaaatgtctgtatcagtgaaggaagtttacacagatagcttcaaagctgtggtttatctttggaggattaatctatttctcatgccagtgtgttgctactgcacatgttaaaaagtcatcctgtggtgtctggggtgacaaaagatgggaatgagttttctgagaactaatcagcaatactttgggaacatttaggtcatggtttccaattaactctggagagtttgagtaatttagtaccagacctcaagagagaggggatgaaaacctcgttaattcatatgttggtgaacggcaaaccagcaaatttgcattaaaaatggatttttattttaaagcaaagagcagccagatcttttctgcaatagtttgggtaggagaatatctttgtatgtatgtgttcccttatgtgtaggtatttgtatgtttcaacgaccctgcatatggcaataacagaaaattaaatttgtgctctaaaatgaagaccaggattcagtgacataatcttccttgtgcctttctttcttttagtacaatgaatatatcagagaggagtgtattccaatatctgtcttcagagttacaaaaacttcttttctagaatgcaagacttgggctatacccccagctctgccacttaacttgtatacaaccttgggaacatcattacaattctctcagaatcaatctctccagccctaaaatgaaaccagcaaaagcctgtactgtatatctaaaaggttttttatttttatgaaaattagttaggcaaacttttgttaagcatccatcactctattttgagataaagccttgctggatgatctccacctcttttgatggaaagagtaaaacatgtttaagatacatttatcacttgtttggcaaattgagatagaagtttatgaaagcagattgatatatgttacatttgagctactgggaaggactccagatggtttatagccttaattacattgtaactctagttaaatgtttacctatctgtaccctctgttaaacttgaatatgttaaataccaaagtccatgtattattggattttctgtcaccatcatcaggcacagatcctggtacacaataggtacggaatggatgcatggatgaattattgaattagatgttggtaggcatgtggaaataagaatgaggttcagaattaaagataatctgtatcgagtgtaaagccattggcagagaatgaaatatccagctgagtatacatagaaaaagaaggtaggtagaaaaatggaaaatatcttatgaagtgatgatagaataactctgaatatgtttgaaaacatataaagagttatgtggatgttagctttaaaaattatcttccatgctgtacattagatctgccattcttcatgctgtggatgaaaagcaagcatcagaagttaaattaaaatgatgtcatatattcctcgccttacagtttcataacagaggagaaaagagaaacattctctcattgccaccacccttctccagtcatatttctaggtagatgttgcccaaaaacagataaaaccacagagttggttttgctaggaatggactactaatccaggcaatgttgacagcttttgcttctcattagtgcacgttactaatagaattgctagagattaaaaggaatcctttctacaaagtgctgtatatccataggtgacaaaattctagcttcccctcacaagtacaatataaagttatgttttaaaatcaaaatgcaatttactagcaaactagtaggaactgttatggttacaggaaatttgaatttcagattaactctggttctatgagtagcggttgatatggcaagaatcattttgatcttacatccaggtgctactaaggtctctctgacctatatctcaccaaaaaaaggaacaaaataatgatcctttaatctttctcctaaaatatcataggaaatgatagtggctaaattgcaaataaactaggaaggaaagattcagagtattttatgtgattactctataacaatgccaggccatagtgaaagtgttatttagcagaagactgagttctttgaatgttcctaatttatcacattttaaaaataacctgggcaaaataacctttcatatcagattgagcctttttctaaaaatactcaatatgtttctgtaattatacctacacacttacaattccacagtataatgcaccgataaagtatttttcatccatatatctaatagtagaatggtgtgtatacaataattaagctctttaggcttaccccggaaagcaacaagtttcccttcctttttcctttttatgtattatgttggccataagaaattgatgatattcaactcaatgcagtcttagagatttattcagaaataccatggtgtgtgtgtgtggcgggagtagggttctaatgacaggtcagaacttacttatttgatttcttcattgataatcaggtcttaaaaagaaaatgggtatgctgaaaacatgccttctgtgattctttaccttcatgtgcagttgtctctggataaacactttctttggcacgtatagggttgcactaagctttatagctccaacactccgccccttcagtagattcttgcttgtaactgatgataatgcaaacctgtattatctataggtctccttaaagggcaaccaaaagttcagtagcaattcaggcacaattactgcatgtgagaatcctccatcttgttccctttggagaccacatatatttcttaggcaagtatatttttaaaatccttgttcagcatgacaattcaggaggtcaagttctcccagaaagcagattctgagaaagtgattagcatgaaggaattttattggagagtgctctcaggattaacacctgtgagcggaggaaaggaaagggagcaggattgggcagaaggagaagctgggctaccatacagtcacaactacaacacaatcaaccctccgcctctccttcctagccttccccaggaggatctctgaagtctgaaggtagaatagcccttcagaattgtcctgagttgcagcaagggacccaggattttataccccacaactctcccatcaaccaatacgtgcagcccgtctcggggacatagtgggtaactttgggctaggcacctctctttagctgagtccagctctcagacaggaataacagctgaggactgtcagccagtagcactaccagcagctggggtcagaagtatttcagtcctgaaaaggggtccgggcagcccagcttagcatctactatgccagtcgttctcaaatctggttcctggcaactgtgattctcaagctttagcatatattggaaggcttgttaaaacacagcttgccggattttacccacagagtctctgattcagtagagctaggctgaggcctgggaatttgcatttctaataacttctcagacgttgctggtgctgctggtccatggactatgagaacactgtttcatgctgcccttatttacatactgagaatggtacacagtgctcttatgaatagaatgaaaaccttttgaaatcacattattccttactccatcaaattctcagctatttttgtgcaccataaagctggaatagctgattataaaactttgttatgtaaaaaagtacttaaccaatacagtagattctgtttgcaaagcattattacagtttctaatatctggtcattgttacttgtaaaattcagccaaattttctccagggcctgtagtttgataacttggacaaaggaatttaaaaaaaaatctaattcaagacctttggttttttttctgaacatatcttttttttctttatgattcttatttttacattttacttatcatataagccacttaaacccatatggttccggaaaatttaaaactatatgatacatttagagcatgttgaatgcacagatatggaaattaagtattcttgactcattctagactagacctggcacaattaaaatttagggattcaacgtacacacacatagattccgagagaaatgttgaagccgtaaaacccccacacaagcaggaaacaacagtcttacctattattcaagaggcacgtaaaggagctcatttgaggagattttctgctgttattgccatcgaatttttaacgtattttccaaattagaaaatattcagcctgatgttgtcaatatttcagaccacaagggtatcatttaggaaaatggtttcttactgtcctgaaagagttactgttcttccctaagggcctaatttacaaagcagcaaacttgctggtaggatttggctgaaaatcacattgtctcggtagaactctttcatctgatttatgtgcattgcattttgcaaataactcttggaaagttatttactagttactttctctggaagcagagggtaagcggcatttctagtttaaggatagaggagctaagatgcatcaagcgcagctcatcatgaagctgatgctgataaaatgcacaatattacattctctaagtttcactctgccatgggagaatttcatatttttaaattttgtttgaaattggactacattagaaaatatgtcaaatgtctaaccctgcatttatattctggaatgtgacagcttatttctgttccaaattttgcactggagatggagtaagtcttaatgcaaactgcatgaaactgccacttttataggtcacacccagtcaattgtcagcagttacacatggttcaaactgtaaggtgtatgcccaattgtagcattgagattcgtggagttgttgcagtggttctgaatttttcaagcatgatacataaaaagataaatgactcttttgatatttctccttgcattgatagtttgcctgaaaactagataagcagggagccggcagtccacgttagcccttgaactacatgaggtttaatttatttgcccaaccagaaccctacactacctttcagctgtgcagtattaaagtttatttaggagttgataaatagcttagtgcaatgcttccttttttccagtagctacatcctcataaacctattctaccctccaccagttaatgcagacagaagatttttatccagtatgagcactgaaactccactgtggaagactgtgtgctcagcaaaaacctcacccatgatgaataaacagctcttccgggggctttgctgccgctggctcggcaggagttgtttattgcctggtttgcacatcccatgataaagttgctgctgaaataaattgcagttttgcataattattgacaatcacatcttaacaagcaatgtgtatcatattcaagtgttcaattttttaaaatccatttttagcttatgtttaatcccagaaagtgtttgtgtagtaatagaaggcaaataagacatttaaatagagtactaatttcctcattgcagacaaagtttacctgaatctttttccataggactgttactgcctaaggcaattttcctttctaagctattattatatagatatttgctgagggcatatgtgtgtgtatccacaatacatgcattttatatatatatatatatatatatatatgatcaaaaatatgaatacatttttagagtttttgtcatgaaagagtttgtttcatctttttaaaatattacaggaatggggaaatgggatatgggtagaaggaactaatgtttttgagtaactgtaatgtataactgtataacgtggggcactcaacttcacaggaattttttattttaattctcatcacagcaatagatattgcagatgagaaactgagaatcagagagggaacttgccatatcacgtaagtggtaaagaacactgggaattgaactcagatctgcctagtttttaaaactctactctttttcattacacataacatttttattttggaaaatgttctcagttgtatgatcaagtagttaaatatgaaactaacacaataattataactgatgtcatgcaaaatgatagtttgcacaaaatgatagtttctatgaaatgttatttctttacttgttaagtctttcttcctttgccctccaatccccttctttttgtcttttcctctagtcttttccttttgattctaggtttgtattttcttgacttttctccttgcatatcaaatccttgttttctgcctcagagcagcatcaaagacaagcatggtacagggattttagggttttaactataaaggtttgtctcaaatttggcagtatattaaaaataagctttcaaaattgaccaacaaaaactacaaaattgaaaaaaaggtactttgaactttcacatgttcaaatatatgtatatatatttcacatatatatatgaaacctcctctgtggagaggggtttatagaaatctgtaattgtcattcttgcatgccttcccccatacaaacgcctttaagttaaataaaaatgaaagtaaatagactgcacaatattatagttgttgcttaaaggaagagctgtagcaacaactcaccccattgttggtatattacaatttagttcctccatctttctctttttatggagttcactaggtgcaccattctgatatttaataattgcatctgaacatttggtcctttgcagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagtaagtcaggcatttccgctttagcactcttgtggatccaattgaacaattctcagcatttgtacttgtaactgacaagccagggacaaaacaaaatagttgcttttatacagcctgatgtatttcggtatttggacaaggaggagagaggcagagggagaaggaaacatcatttataattccacttaacaccctcgtcttagaaaaagtacatgctctgaccaggaaaacatttgcatataaaaccagagcttcggtcaaggagaaactttgctcagagaaataacttagggattggtttattaaattttaaaagttgacatttttgagtgtttatttaatattttacagggaaagcatctgtatgaattgtctgttttatttagcgttgctaactgaatcagtttcccttcattactttcaaatatgttttgaaatgttaatctggcattttgtagctttcttcctaacatgatctgtgaaaataagaatgagatggctgaatttgtcgtagttaatgatcaaacaattttcagacaattgtttttcctagaaacaaaaattatttccataaagttccatatgcataaacagtgaaaacagaacgtggggtagttttgtttaaatgaagtcttggtgagaatcatattctgtagtacaaggaggctcttaaagtttattctcaatacctgatataattttcctgaactattatggagttttgttatgtatagttggtttttctgacttgatataataactttactagtctctcaaatacaatttggatataaatcattataataagatgattgattttttagactaactttattttttgatatttttaaactattatgaaaaactattatgaaactattatgatatttttaaactattatgaaaagtatattctagtttgaataattccagaatcaaatcataataagcagaagttcttctcctctccctcctatcgttctccttctcctgtttttcttttttgatatgatagttgatctactttgctgctctgttgcatagagtacgtaacagtggcaatgtatggctcctgaatttatcgttcttgcttcatcatcctgctttgaccccactttctcctccaaaatgcgtgttgagttagtttgatcatttggaggtaatttgtttggaacagtatcagactttatagatatctcccatggcttgtgatagaatataagggcaatgcaaatgtagagttttttgctcactcttcgatgtatggttagacaatgtaccactgtaatatatttggcttaggctatttcataaataaaattttattataaaatattataaatgctgataaagctactccagaattttaatagatatgtgggtttcccggccagatgcggtggctcatgcctgtaaccccagcactttgggaggccgaggtgggtggatcacctgaagtcaggagttcgagaccagcctggccaacatggcgaaaccccatctctactaaaaatacaaaaattagctgggtatggtgacctgcgcctgtaatcctagctacttgggaggctgaggtgggagaatcgcttgaacccaggaggcagaggttgcagtgagccgaggtggcgccactgcactccagcctgggtgacaaagtgagacttcatctcaaaacaaataaataaataaataaaaatacatgggtttacattttacccatcagctatggtaggtaaataataagctttgattaagtctattttagtctatttttagcagattactttgaaaaataaagaataacccaatgactaaaaaattattttatgtcagggatttaataaaacatatctttaaatctagttgagggcaaaaatacgtctattttctactatacaatttgtatttatatctgctgtattatataatgaaaatttatctctatttctaatctcaagaaactgcaagcttctgaatcattaaagggaagattcaccatgtgtcctaactatatttactatggaagcatggaaaataaatattttatgtttagatttctgatctctctttcaaaagcagttggaaattatgctgagaaaatgtcttagcttatcccatgttactcaagaaaatgtatttattcgtttttgtccagtggcttaaccaaaccacagtttatttgttgctcacataaagtccagtgtcgatcaggctactcttttccatctttgagctaaggcacatattacacataactttcagtgtacccgaggtagaaaaagagagagcttgggaataaggcaggggctttttactgtctcaaccccaaagtgataaactacatttattctcaaaatccagataaaactcccatagagcctctgaaaacctcaacatttgcgtcttaactataataaggttaactaagattccaaaattattttaaaacagagacagtttccctcttccctggcagctaatattgtattttctataaatccacttgcccaaggtttaaactacattttatggattgaaatgacatttatagccaactcctgatttttagttagatggttggataatgatcttttgatgaaagactcggagatgtcatggtaaaacggtgaactactgaaactattgattattgttaatggcacatttcagctgattgaattgagtcaagaaactggtgttgaagagcaacaaatggaaatgccgagcttgaaaataaataaagcagcataccttaagagattacatgcaatttcagtatttcagctaaatggaagtgtttgctttttttcctctatgaatttttattttgaacaaaaggaattttctataatatgtaggtaggagaaaagtgaaatggcatgctttttcacttcatttgaagaagctggtagcattgtattcatagattcatgctgtatagcaatcatagttctcatatattaaaaaaaaaggaaatttgaaatgcctagccaaagcaacagctctgccaacagattttgatatatctgtctaccccaaaagtagtgatgatttacttcatacaaatgctagtgaatgaagagagagggtgaaaaccttcacaaaatgtgtttttctctaagactgtcaatccgtttttctatatatggagactccagctcttgctagactacctatcactttcgtctatcagccacttcgtaagatatttattctctcagcaataatcataattcatagattctttaaacatacatgtaatataaagcatatacattctgaatggaattaacatgattaattcttctctgaaagacattagaatttcctcccgtattataaaaaggtgtaactcactttccttactaaaatcaagaactttaccgtcgtccttgtacttcaggataagggggtgtttcttataaatattgttatttctgatatgctaactggaatttttaagcaaatgtatttttatagaacgccatacaaagcctttaggggtgaaagtttcaggatttttaaattgcagatttatcctttaaataaaaaaactatattcgtaattgaatcggattatttctctatccaaaacattttctgctttgggcctaagaagagttgacaaagctgttcatggttcaaagtactaccataaaaccctgggtaactaactgaaaatggaaagactctgtctttctgaatatttcacaagagtttcacaaatattaagtggttctctaagtacccctgagagatcattgtaatattagcttgtaaagacaatgtgggggtgtgggtatgtggtgacctttatgatgttcataaaggtggtgtaattaacatatttttctcagcaagacaaactaaggagcaataaatatatgagataccttcatctgtgatctgggtcatgtctcaggccatatctttcaaatcactcccttccctaatctcgtgttttacctacgtctcctctcaatccccccattataaaaattgtcttctgatgaataaaacatttccagagagacaagtttcataaagtttgaattgtacatctgagtacacctatgaattaagatatctttgatttctaatatgttattaaaattgggtgtggtggctcacgcctgtaatcccagcactttgggaggcagaggcgggcggatcacgaggtcaagagatcgagaccatcctggccacaaggtgaaacccccgtctctactaaaaatacaaaaattagccgggtgtggtggagtacgcctgtagtcccagctactcaggaggctgaggcaggagaattgcttgaacccaggaggtggaggttgcagtgagccgagatggcgccactgcactccagcctggtgaaagagcagactctgtctcaaaaaaataaattaaaataaaataaaataaaattggagaagtttctcaccaaaattttggcgcacggattaattctgaagaaagaagaaagaatgcaatcttagtagcacaattagtaccttgaataaattggagtatcgtatttcttggactatctgagaatgcagaggcaatttaaggatccctaattctaaggagaagaaacctttagtgtattccttcctgttgctttagtttgaattgagttttatatgtattttttaatctttctattttgattgttgtctaaagagtgtgaaagtgaattttgatatttttattttgcctggcgatgaatgccttctgctctggatatttaaaaattatatacacatatatgtgtgtgtgtgtgtgtgtgtgtgtgtgtatatatatatatatatatatatatatatataaaatttttctgagaacttttattaattcagcgtatctttgctaaacacctgccatgtgtcgtggtgttaggtctggtgatacaaacatgttcagagagatgattttctttcttttttggggggtgggtaagggaaagaaggcttatacaacagaatcttatttctcacagttctggaggctgggattccaagatcagggcctggtgagggcccctcttcctggtttgcagatggcttccttctctctgtgtcctaacatagcaaagagagacagagctctgatgacacttcctcttgttataagggaactaattccatcataagggccccaagaaaggtgcttttcaaaaacagttcagtaaaagtactgggttgtataatcactttaatgagtatcaatccatatttttaagatagaaatgaatgaaattagtaaaatagaatagaaataaggagtccatcacttttaagtaagtttcaatattgttcgtaaaactttggttcggtggtttgtgtgtgtgtgtatttgtgtgtgtgtgtgtgtgtgtctgtcggtgtggaaatactggatcactttgtaacatatattcaaaagcctctgtattttaacattatttctgcctttgagaggttcacattccagaggtgaagacatacatcctaagacaaaattataatagcattatgagaattacagtagagagctggacagggtctagcaaaaacagaagactaggctaaaccttccaaagaggccaggaaactcacctagaacggtggattttaaccttgcttatgcactgggggagattttaaaaatatctctgcccacaatagataccaactgaattgagcatagcatgtcctacccatgaatctattgtccagtgagaacctctgtttagagaaagtcaccttagaagaattgttaggagttatttaggttcatggggttgaaaagagcattcgtgatagaggaaacaccatatccaaaggcttagtcagtgtggtagtgtgagaatctgaaggaacttggctggggtatggttgctacaagaaatgaaattagatcaactggggctaaattatgtggaaagacagcatgatgtagcagctagagtatggaccttgtaagcaggaagaccccttatttagcacttactagcttattgtctgacctctgagtcccaattttactcttctatacaatgagtacatcacaggattttatcaggtttaaatgataagatatatgtaaaatgcataccagagaggcagactattggactcgaagggctcagtaagtgtaagctggctctctctgccccttgccacctatttttcagactctggacttttatcactttaagtcatagcctagttctaagcaaggaaatggactaatcagacatgtttttaaaagatcattctggtagtggttaggagaatgaattggaaagatatgagacccatgcagggacaacagttaggacattatttctgtaataagccaagcaagaattgatgatcaaagtggtgaggttgaacaaacaaaacagatacgtgagctatttggagataaaatcaacactgtcatatgttttgtgggaggtggaggtgagcagaaaatgtgaggtaaaatgagaaatcagtgcctgcttaccacttggcatgattgactgaaggtagtgtcttcactcaatcatgagttgcagaattcaagatggcaaacagttgtgaggagcaaagtcaagaacgtgtttgattttgaggtatctgtaagtgaaaaatcagaggtgaaaaccttacctctcttgaagcagttgtgaatgtaaatctaaggtttggaaaaagatctgggttaaagatttaaaattgaaggacatcaacatggaagccatagaaataaattatattacacacaaatttatgtcgttatttgaatttctccatggtccactcagaaatatatctaaatgtcaccaaaatgttacttactgtagtacagaattggtattaagtgatactattgtccatgttattcaaaaagacagttatagggaccctcttaataaactaattgtgaaaaaggcaaagaattagcaaagctttggcataaaattcatatcatgggccaggcgtggtggctcatgcatataatcccagcactttgggaggctgaggtgggcagatcacctgaggtcgggagttcgagaccagcctgaccaacatggcgaaaccccgtctctactaaaaatacaaaaattagccaggtgtggtggcacacgcctgtaatcccaactactcgggaggcagaggcaggagaatcgcttgaacgtaggaggcagaggatgcagtgagctgagatcgtgccattgcactccagcctgggtgacacagtgagactccatctcaaaaaaaaaaaaaaaaaattatgtcatggaaaaagtaaaagtctttgcataatgtatccaagatcatgaaaaactcttttcaataagataattagttccttttcttatataaacatggaaattttcatttttccttttattctcatattgatactataaaaaccccatcctcattcacaatactactgtctctaccctcgatagataccagttcaattgaacgtagcatgttctacccatgaatctattgttcagtgagaacctctgactataatgctcaggaatactcaagactcacatgattgtcttcttgctatatttagttactttattattttccattttgggaccctgaattcctgtagatctcagagaaaatccgaaatgaaataatgaaaataattaaaagtttagaaaagggagtcaatggggacaaatgttcaggactggtcttttatctcctgcaggaagaaagactgaatgcagaaaattagaatccatttttcatccagtcaccccaatttaatgcaatatgagtttagctatttgattttaagtgttgtaccgttttggaccatgttaccatggtaacatgaaccatgtctcattcatacgtaaacatgttaattgtattaaaacctttaaaacctacttctggatgttgccattacattaaacaattatctagaatgatacaaagtaatgactaaattgaataactttgtaaattaactattggattttgtaattttatatctataaaccaaaagaaaagcccacattggtaagaagacactgtgcatactgaaaagtcaattttgttagcctccaataaccattgtgttttattcctcgcagagcttttgtgaggatcttataagggaataaatatgaaagcactttgaaaaagctttcaagtgaaaggtccttattaattttatgaattaccattaaacaaaagtcaaactgaagatgtaaatctaataggatgctcttaaaagtcaatggatcaaagttatattaattaataaagaataataactaaatattttatgtttcataattggcaaagtatctttactgtcattttctaatttgatccttagtgaaaacctgtgatgttggtactcctattatttccattttcatttgagaagaataaaattggagaggttaagtaatttatctattgctacttgttaaaataactactaaattttattactcccagttaggagggcaattatataaactaaaagcttgtcacaataaatgtttacttttctgggattaaagtcatcatgtatttttcaattattaaggggggtaataataataatagctacctttttaaaatagttactatgtgccaaggtgtgtactaagtgctttgcttgcatgatgtaataccatcgtatatttagtacagaggaaaaactgagaggctgggtaacttctactaaggtaacacacaagtactggttgagtatcccttatccaaaacacttgggaccacaagtgttatggatatcaatttttttctgattctttttttggatttcagattttttcagattttggattacttgctttataattatgggttaagcatcccaaaccccaaaattcaaaattggaaatactccaatgagcatttactttgagaatcatgtcggcgctcaaaaattttcagcttttagagttttttggattttggattttcagatttgggatgctcaacccgaatatatagaaaagtcagcatttgaacctaagtttgactttctgatcttctaccaactctactgtcctacccattactctacattgactcagcattacagggaaagacccaagatcaccaaaagcaagcttcaaatcactcatctaatagaaattagtggaaatatttctacttcctaaacatccatctttcctttacattttaaagtcaagtttctacatctgcctcccaactgaaacacttctctatgaaatcaccataactaccaaatgcaaatatttttatcaagtcctcattgccctagaaatctactcatattttgttattactgctcactacagcctactgaaaaatgtctcaccttttgacttgccagggtgatatattatactaattgtctccttgtctctctaagcactcattccttcctctttctttcttctttttttttttttcacttttattttaagctctaggggcacatgtgcaggtttgttacatgggtaaattgcatgtcatgggagtttggtgaacagattattttgtcacccagataataagcatggtacctgataggtagtttctcagtcttcaccatcctcccaccctccaccctagagtagatcctggtttctgttgttcccttctttgtgttcatatgtactcagtgtttagctccacttataagtgagaatatatggtatttggttttctgttcctatgttatttcacctaggataatggcctccagctccatccatgttgctgcaaagaacataatctcattcttttttctggctgcacagtattccctggtgtatatgtaccacattttctatatctgatctaccattgatgggcatttaggttgattccatgtctttggtattgggaatagtgcagcaatgaacatacagctgcatgtgtctttatggtagaatgatttatattcctttgggtatatacccagtaatggcattgctgggttgaacggtagttcagttttgagttcttagaggtatttccaaactgctttccacagtggctgaactaatttacattcccaccaacagggtataagcattcccctttcttcacaacctcaccagcatctggtattttttgactttttttttttttttttttttttttttgagacgaagtctcgctcttgtcccccaggctggagtgcaatggcgcaatcttggctcactgcaacctccacctcccgggttcaagtgattctcctgcctcagcctcccaagtagctgggattagaggcgccttccaccatgcctggctaattttttatttttagtacagacagggtttcaccaggttggccaggctggtcgcaaactcctgacctcaggtgatgcgcccgccccggcctcccaaaacgctgagattacaggtgtgagccaccacaccaagcccacagtatcaattctatgcattcttttctgatttcattaatctcattatcttcatttgatatttagtcaatagttactgtcagttatgtgttagttattatactagaaacagtcttttctccatctcctttaatccaatgatttgaacatttttattcctttccaatgtctgtcccacatttcttactgtatgtaggacatttcttactcaaatgtctcacaaatgacataaattcagtatgacccaaataggccattttttataccaagtcttatttcctatcctgctgttcatcccggtaccatcttttcagtcagagagttcagatcatatagtcatttctaaatctcccacttacttgcctcactttcaagttcatttttaaggtctgtagattctgcctccctaattctttatgaccattcctttctcactagccccttacctccactctcattcacactcttactattttttaccctcctccactcattcctgcccaccagtggctccaatccaacttgcagatttccatttaaattaagcttcctaaaacatagcttaggttgtaactacaatgcaaattccatgagagcaaagatttcatctgctttattcacttgtatatatccattgtccaagactgtgtgtgtcacatgaaaagtgttcaataagtatttgtcagtgaacgaaaataatatatgactcccctcttcaaacaccttttttgacttcaaagcccttcagaatattctacagactccttcacctggctctccacaattgcccctgagtctcgtttccaatcttatttcttattttacctctcaatgcaccttcaactcctactaaaatgaacagctagccagcttacttctgtgtctttcgatgatcttgttttttgtcttgagattcctttttttcatctaagcttacccaaacattacctacttttcaaggaaagccattttcgaatcttccctttttccctgagcccccaagctggaagacatcttgtctccatctcaattcctataggcatttctctgcactttaaatgacgtttagtacttctgacattgcattagagagaggctggggtggatagtgtttcatagtgtgaactttgaagcccgactgcctgagtttaaatcgtgattctggggcttactgaccatagacgcatttctgaattgctctcagattatggagcataaatcaaaagtaatgacagctacctcttcaggttgttgtgagggtgatgcgaattaatgtactgaagtgcatggaacagtttctggcacacggtaagcacccaataaacatagctaatattatgttattactattttcaggcttatttttatgtatacatatagtatgtaattttatgtcaatatgtataaatagactttggtattgtttatttcactatcaccttgagagcacaattctcatttgatttgtgtgagaaactacttagaaagaaatagacgtgtgaatgaaactatgcttgaaatattggttactgtgagtgttgaaaatccattttgtttaaagaaagcttcaattgttaatcttccataaattttagttcttaagcgttcatattgactcgttttggaaaagctctttaaagtcttgggatataaacaaggctgaataccctcattcatgataacaaacatattatactgaaaattgtaagagagatattttatctttcataatgccctccttgggaaaatacattgacttggcccttctctttcaatcagacaccaaagttgagattgcctgaaacacagtttggtaaaaggagtttctttttcccaaacatcctgagtaacacaggaaatcacaccaatgactgatagataacgttaataaaattaataaagttgttttaaatgcataccatggggcagtggcaatgaaaacattgagaaggctgggactatttgccaactttctttgatctccattagaacctggacaagatccacataatttcagaacttcttctccaaacaagaattgaaaaggtcaggaaaagtttgaccacagaaaaatgtcaaagaattttgtgtcactttctcctcctcccttcctctaaccttgaataattttttagggttattggtctttgggagcagactttctagaccaaaacaaaaaaaatgatattcctctatgtgataggtaacaatcactacccatcctactggaaaattctcaaagtgtaaattgaggggataaaaaaagaatcttaagtcctttaaattatttttaagatgaactacattagtgcctctcttgtgcctttcataattctgataataaaacattccaggtattagtcaaagattaatggtattgaaaataatttaggttatcagcatgtgattttcattccacatgaggtccttttgcagtttacatggttttctaaattatattaaaataaaatgtcagaaagttcacatttttttcatgtttaacagcatcaatctttaaagaaaagttattgcacaaaggtctgtgcataaatcagccattctccgaagaggtaaaagaagtcattacgcctggttatgagagagagtttcatgaatgtaagagacataaatcatttcccactggagatcatattagtctagatggaagaatgtctgtttcttgatagtgagaaagcaacaaattacttttgtttgctcctgagtctgtggttgtccttgagaggtctgttagcatgttgactattgactattcaatattagcattataataacttacaatgatctgagtcacataaatataatctttcagttctctaaagattttactttttcctctctaatatctattcacctccaacacctttgcaaatatattattctctgggagttacaaagaaagttattctctgcaggaagcagcatttcagttgctctcaggagccaaccacatttcacctcaattctttgctcccaattcaacaattcaatattggattaaattcaaggctgtgaccccaaatagaatgagacctggatatttatgaaccacttgaccaggcattcttcccatgatttactccataaatcctttttagtttttgcagtagctttacaaatatttggaaaatggctgtgcaatgcagttttaaaaagtgcaatgagtagaggtagcttcttcacctggtatggtaaattgttgattctcttttggagtggaaaacaagtgttcttatttggatgcaaccattgcattgattagacaaccctaaattcatctttcatccatgacctgaaagaaattttgaaattcatgcaatatatacccgtagtggaaaatgtactttttgaatggattcctgaatgtgacttttaagaagagctattaagaagtgggatcttctacagaacagtaaacaggcatgaaaatatacaagttgataagatatggaactaccccaaaagaggaattaatagtggtggggcttggggcaggaggacagagagacctagccaaggaaggaagggctatattataatagagtacaaagtcctttagtcatccaagagaaggggcaccttctgcatcccttatgagtaagatcagagaaggtattctagttaacttttgctacataacaagccagcccaaaacttcatggcttcagtaaaaattacttgttttgttcatgaatctacagtttgctcaaggttcaatggggcttgcttatccctgtttcagttgatatcagttggggtagattgcctgatgctggaggattcacttccaagagggctcactcacatgcctggaaaataggtgctgactgtcagtttttcttcatgtggacctctccatggagcagtttgggctttttcacagtgtaagagttgggtcccaagagcaattatcctaagggacaagaaattaaagctgcaagcttctcaaggcctgccctaaaagcaagaatggttttgcttctcccatattctatttgtcaatcagtgacagagctctgattcaaggggatgagaacataaactccacctttccatggagaagtatcaaaaagttttgatgccatttaattaaagctgccatacaaagtttcttataaatgacactgagctgaatgaatactaaacagcaagtagtcattatcccagtcaagagaagttatctttgctcagaataccctttctctccttgtctacctggaaaattcaactcttggccaaagccctacctcttctcgaaagcattaccaggccttgcctctaagtgtacaattggagatacaccagtatactgatgtttttaaaactttaaacttttttctacaataaaacataaattaaataacttcccttctgacttaaaagctgcaaaatgctcatgacagtaactatataaattaaaattaaatcttaagcacgataaatacctctcgaatagcaacatagatgcttacttctttatttcacttctttatttgcttttctttgtctatagtttgccccaaaggtattttaataatatcgggttccatgtataccagtgtgtaccaattaatatttagaatatacctgttaataacctcatttgcatagccctactaatctgagcacagcgcagccttaagaaagtcttagtttttctcagtttagttcatctctcttctcttctcctcctgtctctcttatttcctatttctttttcttttcaagtgactttcaactaagtagaaaatgcatttcacatcactatgccggcctccaggctctgtctatttcattcacccaggaatgccctttctgaatgctttctctcatttagcagctatctattgaagttggacaaatgatagaaattcatttcttaaagagccagaacatcatcttgaacaagaagttaaaagaattcagcaaatcaaaagatgagctaatatgggtgaatcttagaggcattatgctaagtgaaataaaccagacacaaaatgaaaaatattgtatgattccactggtatgagctacctacaacagtcaaatttatacagacgtaaagttgaaggatgttaccaggagctggaggaagaagagaatgagggcttattgtttaatgagtacctgagtttcagtttgggatgatgaaaacattctagagatggatagtggtgatggttcaacgataataataatataatattaatgtacttaatagtactcaactgtatacttaaaaatggtcaagaaaatggtaccccgttatcctgatgtgattattacacattgtaggcctatatcaaaatatctcatgtaccccgtaaatatatgcacctactatgtacccataaaaaaaatttaaaggctaaatggccaggcattgtgggtcacttctgtaatcccagaactgtgggaggctaaagcaggaggatcacttgagctcaggagttcaagaccagcctgggcaacatggcaaggccccatctctacaaagaattcaaaaattaactgggtgtgggagctcatgcttgtagtcccagacacactggaggctgaggcaggaggattccttgaacccaggaactggaggaagcagtgaatgacactgtaccccagcatggtcaagatcccaaatcaaaaagaaatgattaaaatgatcaattttatgttgtgtatattttgccacaatacaaaaatggggaaaagcctattcgcttttaagtatccttaaaaaggcacagcttcttcagctaacagactctaaaactttttttaatagaagtattaaggtatttagagagtgcaaaatatcttattttaagtcaagaagttagggtcctgttcctaaacactagcctctgtaatcctggggaagtcagtgctgttggagatctcaggttgatcttctgaaaaatgatggatctaggtaaaagatatgtttctccaggtttacataccacggacaccatctttacttggaaactttattaaaaatgcattgtgtcagaagctctctggggatgggtcgtggaatctgcatatgtaaagagcccctaggtagttcttgtgcccacttaaatttgagaaccactagaccagatgttttgcttatggccctttcagctctgaaatttgaaaaaaaaaaaaatgattctgcaagacagagtctctgtgcttttgcaggataaagaaatgaagaaaataatacttcctgcttgtgttggagcatttttttcatttggtatccccatctccagtggctagccaatcaagaatagtattgtttattcttcccactgttttgaagatacaaaaggaaaagctaagccagatgacacctaaaggcttccattaccattttcatgtttttccctttgcataaaaactgtccatgcctccatcagagccatgatcactagtacaatgttacactctaatgactcatgacattaaattatatcttagcctaatatgaccaaattacaatatcagaataaaaatttcttttttcaggttgaatcccataacttaatccaattataatactggctgaatttttcacaattatgtctcagtcttgatttagggaatcttctctttatcataaaaatgcattttgttaaacatgtttcattataatcaatttctcaaaagtaaagttaatcaagagaaggaaaaaaggttttgttttgatttgatttggaatgtgtatgtgtgtttactgtattgaaatagattctgtctgaaagactgtatataagataaaaagtacagaagagtagtcagagagttattacccacccctgactgatggtgaatagattatctaagtatcccgtaaaaggcacaactccttcaggtatattttacaaattaattagtaactttctagccaaatttgtgtcttaaagacaccagctagaacttggttagttctagcaaagaagattattttattctgaaacaggtttttgttgtcgttttacttatttgaacttttttcttgaatatgtatttctttgcacataaaatatattgacttatgaatgtgattaaaatggaaaataattagttgattttagagagacagagagaggagaagagaagtgtgaaggagagagggaggatagaaaggagagagggagaacaggaaggacagagggagaatgggaaggagagggagagagagagacagagagagaggaatggagtgggtaataagcaagagaaaaatgccaatcatatgctttgctagtgtgtaaagtctgataacccaagggagagaggactactctggcctagtgaaacaaaggaaagagaaatatggtagaatattctcctggtgcttcaccaaatgtgacaccagaagtctgacagaagtcatgtcagcatttgagctccataaaactcaggctatcgacctaccatgtgagagtctcaaaatgagtttaggtaggggcagaggagttgaaatccagtaacatatgcaacagtgatcacaccaggattgcacatagaaagcaaattagtcctctaatagagacgccaatttgaaattcaccctctgagcaggtttttaagcacactcttcttttacttttctatttacaaaaatggaacaccaccagaaaaacaagaatttgaaagacgagatgagaaaagtaagttgtaattggaaacagacagaatgtgtacacaaacacacacacacacgcacacacacgtgcatgcacaggtgatgagagagtagtttgcctacatggtgtatctgactaagaagactttttgctctggttgtcttacaggaagtgactaaatctcatgatgtgaaatattttcttgcatattgtattggaaaagaaaataattttcccaaactccttaggggcagtgttgtcttataattcccatatagtatatgctcttcaagtaagtaactccagagttgagtaagacaagactcgtgactcagatggcatgctctgctccctagactagacattgcatcagtctgcctatactcacatccgctgttaaaggattgcctccagtaaaatatgtcttttaattccttatacaagaatctggaaaaaaaaagtaagattctctatttcttaaatttagcagcaggttaatcactgataacaataaaaatacataacaatcatctagcacgggtaaatattgtggcaaaaattacaccctgaagaattcagtcaaagatataagtaagtacacatcattgtcatgttccacaatatatcatctgctttaaagaaactgttatgtagctgtagtagatttaatcattaatcccatttcttctccaccttctgcaatcacaaccttaacaatgcctccttatgagtggaatgtacttcccaacccctagtcttaggggttggccatgtgatttgctttagcaaatggtaaatgagcaggagtgagaggtgacagttttcagcctaggccttaagagatctatacattcctgtttgtgcttctgctatcattctgagaacacgtccatctaggctgctggtctcaggaaaacgataaaagacatgaacagcagggctgcactagccattcacatccaggaaaagaaatgattgttgcataaagccattgagctttattctacattactgtgacaatagctaattgaaatagtaaatatactttggtttttcctaaatgcatattgaaaattaataatattagccatctgtatgataaaaatataaagcctatgttttattttttaatggttcactgccctaaataaatttccaaaaagtagatgttcccttgtctagtgatgtcattatattttatttatacatcataaacacactgtttatttctgctcatttttttgtaagtaacatgtgttaccgccaatcttgagatgatacacacacttctgtactaaattttggaaaacatattagctacccactccttatatcaaaatattgcctaataatgtgttttgttttaatccttcatgaatttccaggagaactgaactgatacttgggtttgtgagatatatgaaaatagtgaacatgaacttctggtttaacccttgtgatgataatggaatcatagctctgttaattactcttgtggtttgtcttcctagagataatcatgtacaaaattcctttccaatttgttatataatattagaaatacttccaaaattggcatggatttattgttatcatttgttggcacaatcattaaaacgaaacccataaagctagataattaaatgtttacaaagctatagtactcaaaacaaaaacactgtgaaaagagattttttaaataatagtttttgcatgccttttgaataattggattattctgaatttcttcatgtttagtccctgaatctaagtcataccgtctacataaaaatagatgtcagctgaagaaaaccaggcaatggatttgtcttgacgacaatctttttatatgttcagacttcatttaacattagacttgtctgtatttgaaattggtatttctttacatttctgaatttagggaaatggcacaagagaataacattaatttcctctgcattttggcctaatcaaatttgagcctttcaagagacacagccaagtcaattcaaagagacatatgaaaagactactgttaatgtatctttaaaatgaattagcggcatgaactgttgctaggtgagttaggtatagttgtagtttttagtaaccctaagagaagatgcagtgcattctaaaatgtcacaaggagtttgattgctcaaaattctgggagattggctctctgcaaggcttcttgatgtcattgttcctagaggaatgttgttccagtacctatagcgattgcagccataactatttatgtgtcattgtagccattgttattactacatgcttcacatacctctactgaggtctaaagaattagtggacttcatattctggagagaacacttgaagaaccaaacagaagtttgatgtgaatctgcatatccaccattattgttcataggttctcaggattagttgagtgatgccttaaagaaagaaagtcagatgataggtcttcctgctgcccgcaccacatcatgagtgttattcctatagaggaggagtaaagagtgggaagaaaatgaaatctgtcaatactgtgaatatataaataataaaagtagcagtaggactgattaattctgaatcatctttatgaaatgactggagccgtgaaaatgctcagtctgcacagctgattgagaaatgtatgcaatctgttgatcggaatttatttgtgaatgctctcttccagagatttatataccagagttcttaaaacgaattttgtccccatgaaaagaaaactacagatctgtaagactgcaatttaaaatggaagaaaacatgttcccacttgaagaacaactttcaaacaaacaactgatacaaaaaagtcaaaagctgttttgttttatataatagtttcagaatacttccagtcaatatataccttggtttggtgaaaaaataaaaagctaaatccttagatcattaactagaaatttttgtaaaataaataaaagccgtgggttttagtgcagtgatcccatgaagaggaatatattcaccattggtctcttaatctcagatagaatgtacatgttactttattttataacgaaagcaactgtgttgtgatattatgtataatattataacaggagaagtcctcttagctaactcagtaatcaataacattgtacgttgtgtgttattgtaaccaaaaactatgacagaaccccatttcataagatcagtttatccacctatatgatttatatttgaatattcatttcagtacttatgttgcttaaacaaagctactgtattagtccattttcatactgctataaagaactgcccgagactgggtaatttctaaaggaaagaggtttaattgactcacagttccacatggctgggtaggcctcaggaaacttacaatcatggcagaaggtgaaggggaagcaagcatcttcttcacaaggccgcaggaaggagaagcgcccagcgaagtaggaagagccccttataaaaccatcagatcccgctatcatgagaacagcatgggagaaactgcccttatgattccattacctccacctggtctctcccttgacacgtggggattatggaggttatggggattacaatttaagatgagattgtggggtggggacacagccaagccataccaaaaactctgttttttgtttttgtttaatggaaatgatttagaactttattttctgatgtttctttttcataaaaccacgacaccaaaatctacttttcactgctccattcaactagtagagaatatctaatctcttctcaagtatttctttctcaattatggtggttttagctaagaacagcttatggcatgcttttctaaataatattagaacacataaattatctgtacctggtattaccacattcattgctcattttaagatctcaattgatacattcaattcatatatatttaaaattgattcatttagagcaagagatacaggcattttaatgtattacactgctactaaagcttagcaaattattcttttttgtgcccacaaattatcatccattcatgtcctaaaaataaaattgaatttattatactttcccatttatccaaaaaaaaggttttttttaacaattgatgcagatacacattttcaagctaaaaatatgtgtgaaagtggcctctttctcatagtatttattttaggagtctagcaataatttttcttaggttatcagcacatgtcttagcctgaattatttgaattcagtctgtgtcttcaagttcagatggttatgtgatcttgttaagatctcaaagtagtgggaatgatggagtatacaacaacctcattgttttttatggcaactgtcatttactgaaggacataaggctagcagaacatggtcagagaaggaatcaaagtttggtcagccaactctgctccacagctacaagctgctagacaggcataaatttttccaaacctacacaaagggacttagggcccttggctgagagcgacattctaaccacttccttatttatggctggtggggtttgtacattttctcatttctgtataacatttcttgactgtaataagcaatgtattcattctgctttaccactttcactaaccttaacctcaatatatactcaattaagcaattgaaaacagcagttttaatcttttgacataaatgatttcctccgaagcaaaatgctggaaatcccctcaaatgcaccttttattgatgaatacctataagcaccacctacagtcgctggaggctgacaggaaccaaacttgatgataaccactgagctgagaattttcaactcactctttttccctgtatggttcttctagctgcattatttcccactatttaaagctacagctggtgaactattcaaatatttaaactttggagaagaaaatatcaacttatcacaaccctctttttatattctaaattcatatacctgtttggtacttaaaggaaaaatatgctgaggaacaggctggtcataagactgtatagaacgtgcatcttccatcctattgaggtgactcctagacaatgggaaaaatgccttcactcgacttgctcattaaatgtgaccgtagctgctaatcttttggcgctgtctcgaactttaattagatgtgctcttctcttgaaggttggaactacagtatccagagaccatagaatcacagagttgaaaacaaaatcttggaaatcattgaatccacttatcagatgagaaaaaaaaaataagcccatggagatagccattttaaaacatatcattctatttagcctccaatgtaaaacaatgagttactatgtttcaataatgttgatgttaagaaattatttgatagcttcctcacttggtctcctatattcctccaaggttactagttaggaagactgtcattcaaatttggagactacataagaagcagaaaaagcatataaagaggcacatgaaattggaacttttctggtaaaatcttctttcttaaactctcctcaaataagctgttggtggcaggaggtgaaagacagcctccaccctttagcacagtccgtacttgtcagcatttcccaggaagggtgatgtctggaaatgatagagattgtggaagcacattgcattatgggtcaagaatgcgaaggtcaaggagtggagtcttcctttacgaagtagtgttaactgcttggcgtggcattgttgtaaacagaagccaccaggaaggatcatccttaggagggaacctgtagatatgactgaaaacaagagagatccagttttaccactctggaaacataggtaatagaaagcccaaaaggtaccttatcacttgtttgttcctttctgtacaaaaggacttaaatcctttctgagcaagaaagatatttgagaatccaattttgttttaaacttgagcttagcattttggaactattccaaagaccacagaattcacagtcattagcataccacagcagactcttttcaaatattgcaaaccagaacagtctgcttgaaaacctggaaatacgacctagtgggttcaacttgactttttttatttctaacccttacccctaggcaattattgataactcattctggtacctggtatgtatatggactttgttagaagaatttgacaactttctaatcatctgttttttttcttttgcttgatagacatacatttagtagaactttactggattgtattgattataaaccacatttcagttcatatcagtccattttgctgcacaataaacaaccaaaaaaatttaattcagtggctaataacaacaatattgatttattcatggagctgcagtttggtagggtttggccaatcatggctggaaatggtttagctatgcttatctctaggccgtcggttctgttcgggtctataccacatattttcttctgagactcaagctgaagggacatcagctactcggggtatgacagagtagcacaaggcaatgacagaagcacaaacaacacttttcaaaatctctcctcttgtcacatttgtttatagcccattagacaaaacatgtcttgtggccaagcccaaagtcaaggggtaggaaaatactttccacctatgtgaggccatggctggagcgtgaatgtatgatactactagggatgtgaaaggattgaggccaataattcaatcttctattggagacaagctcaacgagttagttaaaatggaaggctaatatttactaactttgcaacccaaggaagagaaagcaggatctctctgacgatgacggaatttcataccctcatctttgaagttatactaaagcttaggaacaaccgtcagataggactgaattgctcccccttccagattcagcatgtgaagtatgcagcatcttattatagcagtagccaaaacagccgttttcttcaatttgggaatacaatgtaggtgtgttaattttcaattaagagttctaaacttattatctgcttggtagctcttccatgtgacagtcattccatctgactcttcatgttggcttttgaactaaattttaaaggaaccgccaaaatttaagggccatgtactttttataacctgtttgtggtctgggtaagaaaataaaaattatacaactgttctttttgaccagccacaagcatgtaatgaaaatgactgttttggctagcagatgtattagaagctttcaaggtgtttaaaaaaaaaaaaaaaaactggagaaaggagccagtgaattgacctcaaacaaaacaagaacaaataaacaaaacacttgtctgcacttccaaggaagggtgatatctagaaaagatagagatgatggaagcaccttgcattatgggtcacaaacgtgaaggtcaaggggtggcgtcttcctttatgaagtagtattaactgcttggcagggcattgttgtaaaaagaatccaccagaagtgaaacaagcagcactaaaagttaaaagatttatgtgtaaacctcatctaaggcaacagaagccatttctataaaatagtataggaccttttattatatatggtcctagagtatattaaaataagtctgtttgggtccatttgcagctcatttgaagatttttataggaaaaacatcctcaaaaatatcatactacagtgccttgatgcttttttctttttataaggtactgccagcccaaatagtaagaaaccgatatgatttttgtccatgtgaggtgtttaattgcttcccaaaatatggttattgtgtagatgtcactaacgaaatatataaagagcagtatttgggaaaatttattttaataccacctttttccttttttaccctaaaagtatttatttttttcgtagcatacactctgtgtctcagtatcattgtttttcataaaaacataaattcttaacagaaaatttcctgcaagctcccctaagcttgaagagacaaaggagatttgtaatgtagctcagccccaatcagggtaaaagaatgcagggctgactttatacttataactcagaaaaaggttatgcttcccgtctcttcacagagctagtctcttaattgattccgaactaggaacatgtacaagtggcccacgatctggaacagactggcggataatggaatattgagaccttgtctatggtcagccatattaacactggataagtctgataacactgtgattacatatgtatcaatatagtatgctgttaatatattaaaaacttatttacaacatgattattggacaactgttacagtacagccacatcaatcctatatcaagttagaccatgtcaactggttttgtgttgagacacctgtgtatggacatagtctgaacttttcatagtttgtgctaaatgatagcaatcaacatcggtatggcacttacagtttactgataactttcatgcccattaacatagtaccgcaataactctgtgaagtgctgaatttgtgtcctgtttcatgattgtatttgtgttgatatctcagtcagtcagagtcccaacaagaaacagatggcacattcagattagggtaagttgaggagtctttatttacaaggcactacatactcaggattgggcagggtgtagggaaatctcacaagatagcacaagactctaggactagcagcagcagagctgtcacctctcctagacctgaagccgttgttggggagagaggtttctcagagcccagaaaaaaagaaaaaaaaaaaaaacatcatgcagattttaatgccttgggaggagcagtggctttctcttaaggacagaatttgcctcgaaatgatactcagggaaaaagagatgaagggaatcaatactctgacccaagactctcccttctctgcagtggtttgctagtcctctccttggtcaaacccaaacagaaaaccatagggcataggagtctaatgatgtaatccaagtcagccccctggaaggtggaaaaagaagggaaaatggatctggatctggagggataccaaaaaaaaaaaaaaaaaaaaaaaaccatagttggcatgcttgtttattgatattttcttgcatgatataagaatccagataaatatagtaagaggtctattttactaacaattttaggcacctaataataatactccttctttgaatgtataacctctagaattggttcagaaatgtaactgtgccgttacaatttctattagtattcaacagtagattcatatccattcatctatgactggagtatctgccatttgctggttagttactgtgtaaggtactttgtaaggtatagaaatacacttggggtgcgatggctcatgcctgtaatcccaaggatttgggaagctgaggcaggcagatcacttgagtccaggagtttgagatcagcctgggcaacatggtgaaaccccatctctacaaaaaatgcaaaaagagtacctgcgcatggtggcatgtgcctgtagtcccagctactcgggagcctgaggtagaaggatcacgtgaacccaggaagtcgaggctgcagtgagccataatggcacaactgcactccagcctggatgacagagtgagaccctatcaaaaaaaaataagaaataaatttgagctcagtgacctacattctagtgcagaaaaaaatgaccatagttgattatgagattttaaagcaataaaccacatgagacatactaatgagctcataagatcattcagaaattgtttattatgaacacatagtactttcagtgtggcattaaacagagatcactgtccttaaacaagttaaaagcagaatcaaatcatctgcaaattaacacaccactaaactttaagcttcttgagtgattctgtaatttttaaaatgtcttcagcatttcagtgtcaagatagtgcaaactcagtaaaagcttgtggaattgcattaaacaaaaccaaaataaatagattttattaaaactatatacaattgtctttctaatcatatcctctccatgaatagggaagaaataattttaggaatttaaatatcttctatcttaatagttcctcttatttccctcttaagcaatgttcactccttcaaaaatatttattgagcatctaatatgtacttaacactgtgccaggtgctgtgaagaatgccaaggaaatagaatgaacttctaattctttggagttccaattaaataacctaaagttaaattggtttcggagagaacattatgccttcgagactgtaggcttctcttgattagaaagtcttaaacattttaagtaactaaacagattaaggagaattcaaggatgcctctcactagtaaatttggattagtctggcaaacttcagaccttaaatgcaagatttttaataattaaaagaagagagaaaatgataattacatttctagagtctatgtttaccattcagccttcttaatcatttcctaagtatatctggtgatcaggattttataactccagaaaatctttctatacatcgcataaatctcttcttttaaaaagctcttcaattttgtattttgttaaaacttaaaagcctccatgaaaaatgagacaaaagtcagtgagaggctgtagcaataaaaatcagatgtgattttcttttgaataacatctgtttttacagtcctttcatgttaaactttataagaatttattataaacagctttattgacagttcaatcctatttctaaaaggatttattttcccccaatggtaagagttttcttttcttaaacctaactagttgcagatatttcagatactacatttctcattgtgtaaggtaaagtttctgaccacctgaatatgacttgtagctcctgagaacaatttgtttagtaccgatatcatgcagtgacattggtacaaaggaattttctttatttcactgtactgttttcagttttattctatagttgttaaataagaccattaaatatttttattagtcttatttcctgtttaactaggtgggtttttgatctctgttcagtaaagcattgtgctcttcagagcaagcaattgaaaagcaaatagtgagtatttctactgtaaaagtttaacattaaaagatatacacacagccaggcaaggtggctcacgactgtaatcccagcaatttgggaggctaaggcaggagaatcgcttgagcccaggagttcgagaccagtctgggaaccatagcaagactccgtctctaccaaaaaaattttttaaaaaatagttggatgtggtggaacacctctgtaatcccagctactcaggacgctgaggcaggaggattgcttgagcctgggaggtcaaggctgcaaggctgcagggagctgtgactatgctactgtactccagtctaggtgacagaatgagaccctctctctctcaattaaaaaaaaaaaaacaagatacacacacatatatttgcgtaggtaactctaatttcatttcaagtatgttatgtaacaaccatttgtgtagtgcttgtaacagtcaatatgtaaatactgactcatcttctttgacaattctacctagatacttattagagtcccccttagtcattgaaaggaaggttaaaatcaaaagacgttgtttgccaaagtaatgaaagaaaacttataaacacaatgtatcatgtctggggctgaactaaaacccttctgatatgtggtattaacagatcatctttcatgacagtaccagttattagaaataaaatgattggagttattattaatactaacaatagtggtattcttaaaatgacttccttatttatcttcacctttatacattctactactgcttcaagacccatcttgaattcttcttccacagaacattctgcattaatttcagccaacattgatttctctttttaaaatttgtcttgcacagtgaattagaaaaccaggaattggaaaaccagaaaagcttattaagtaagaagcagagaggagagagtttcaacaaagggccattctaaagtggtctactgcggacaccatactgattatagttggtgattaaatcttatctttccaactgattataaactcctccagggcatactcttatattccacaagatgcttatctgggtgcagagcatgcatgcagttggtatttgctgatttatcaactaactaaatcttaacatattattattaacaatttaaaataaagttaaatgtatcactctccacccctcaaagccatttctgttctttgttttcatagcaccattattatttcctgcatagtattttttaaaaaccgtatttttaaaatttatatatttgtttatttgggtatacttcactagattgtaagcgtcacaaaagcagaactattataaccccagccactaacacaatgcctaacaaatagtaggttctcaatatttgttgaatgaatgacctacagatattacttcattatgaaagattttgctaagttgttttacatctattttatccaaaactaaagttcttgaggcaaagcctagaatatcttctatgttctcacaatgctctgaatcagtgcttctcttaatatgcatagcaattgcctggagagcttgttaaaacatagattacttagccccaaccccagagatgctgattcagtaggtcccaggtgatgctgctgctgtcagtctctggcgcacactttgagtagtagggctctaggatgttatatgtacagacacatgctgaatagtgggctatgtgcttacttgctggctaaataataaatgttctcactgagtcatagaactttgaaatttgcaaggacttttgctattatctagtctatggatagcaaataacctgataccgtgctatagtgcttgactgcatttaacctgcagaatcctcatgagcagcccagcaccatcactccaagtgaaactactctcttcttgaggttgtccaattctatcaattaaagatgaaaaccaggttctgagagttgaaatctctggacttcaaaggtccaacagcccaggtcttctcaattctcgttagtgtttcagcagctgaatacaaatttattaagctgtatcagagtagtatctgtcaaattggagtgtccataatatgcttaaacagagaactccattccaataacatgaactttccttatgctttattcatcatcgcttgaaattttgaattttgcccaaagaagtttataccagtacatgttaaattacatcatagccttctttgtataaatcttagagtagtttactgaagtacatcgcaaagttttgttgtttcttaggtgattttaattatgtatgtttactttcagtaatgcatcttttctccttcatcaatattatgttatgctagctgtaagtacaaaataattgagaacaaattatgacaaattgaaccaagccacaaaaaaaggagaaaccaaatacttttgtgatttgagcttttttcagtccttgaaactttaagaatatctgtctttattaacttttgctttttgctgatggtttctctcattttattatagcttatagcattgtaaattaatttaacatgaaaggataaaaacgttgcttttgaaatgtttctcattaaattatgaaaaaatattacactaaataaaagaaaggaatgcctctggtaccagcttctgtttgctcaattattgcagtacccaaagtgaattattacacagttaactcagaggcaatattattgtcattatattataaaatagatgagttgcaatcttcaaaaaaaaaaaacagcataggtcctttgaaagtgaaataccttttttccttgtgcttcatttaaatatatactgaccccagttttgtttttgtttttcctttttagagttcttgctaatgatgggcccaaagttatattaagaactgcaaagtaaatttcaaccaattactttattcaggggagtcattaaattgaggtacctctgaaattttggaaggaatgtactgccaattagccgaaagcactactcaatgtcctttctatggttataatctctctagtgtatttttaattgaagacaacctctatagaggaggtgagaagttgctatttattggtacttgttaggatggaatcaagggtgtggaagatattcatctatttctctctccagctcccccacacaaaaagaatggtgcttaatccatctgaagcatttggggagcgagggtaaagatgtaatatttaccatgagccgaaacagatcttcagaagtggaaaatggaagcatattgaagtccctcaactaaacagactttcttccatatggaattcaatgcattaatgttttcaaattctatagcttcaaattcttaatattttcaaattatgtgagcttatgtcaaaacatttaagtgagcttttaacaatgaggcaaatatttgaatcatttgtctacataacaaatactactataaagcatattaaatgttataaaaatcctaatatactaatgtaagctattataaagtacaaataattaaacaatatttatatgatcaatgttttataatacgataaacacattaaataattaaaaactcttccaccgtgcaaaaatgactaaataaattgttaatttctaaggctttttgagattactgtgaaagggggtatagtttcaggaaaggtgaaacttcccttcaatgtgtaaaccattaaagaacataataacctactgagtgtgggtctcaatgatatgccctggaaagtatgggcaactactccacacccaattttgtctttatatgataaggcacagcaaataattataatgcaatggataaatggtaaatcccaccaaagattaaccaatcagagcaggatgaaaattctgagtttggaaatctattggaagatttacagattagattaaagtgcccagtaaccaaactatcaaaattatatggcttcagttaattaatgatttccaaggtttttagtatactgtattacaaaacacattaagcatcttaagcattcaaacaacatttttttgatgattcagaaagcatcacaaattgttatatcagctgataataacttaggtacatatcaattaaacttgtattatagacacgcagaattcttcagaccagaagtcgaaagggcttctctagtttgtttatgctaagttgtttagagatgacataactctgagctaatttgtctattgcaatggttctcaaaatggggggcgggggatatttttacctccaccaagtggacatttagcaatatctggaggcatttttaattattattactggattggagatacaactgaagtctagtgggtagaggccagatatggtataaaatatcctacaatgcataggatagccctccacaaggaattatttaggccaaaatgtcagtagtataaaaattgagaaatgctagtctaatatagtgtttactcacctttcctgaaactatgtcccctttcacagtaatctcaaaaagctttagaaattaaaaaatcgtttagtcatttttgcatggtggaagagcttttaattatttagtgtgttttatcttatgaaatgttgataatataaatattgtttaattatttgaactttataagagcttatattagtatattaattaggattttatttaacatttaatatgctttacaataatattcattatatagacaaacgttttatttttttcactttaacaatgatttttaactctaattacataagaaaaagtatgagttaacaattttttaaattacatgcttggtttgagggccaaatacacatgaaaatgtggactaaaatttaaaatcaaataaaatctataaagtcgaggaaaaagctacttttatgacgaggcatggggaattcttcatagtttttgggttttatcagaagttagctattttttttctttttgctctgtaaacaatcagataagagaggctcaaatgacattttcaagtacatcttaacaaaatacactttgagcatcaattgagtaaagtttcattcttttgaaactttggttttcacaagatttcctgagagttttattttattggtgttctgtgggacttgggcatcataattcttacaaactactcagctcaatctaatgtgcagcgaagctctgggaacttttgttttgtctagtatccagttggaagattctatagctacagagcttgggtttaaaccccctccaagtctttaccagctacctttatgaccctggcaaattacttaaactgtgtgccaccattttctcctctgtaatacggaggcaataaaaatttccacttttagattttctatatgcggtttacaaattgacttactctgaagatcatctggagtaaaatctggagaaatatgatcccttataacttcttcaaccctttatatatttcaacatgagtaaccaatgctctaaatatggatataaattataagaataaaaaatctaggactattataatggtctaaactctcttcatagctaaaagtgttgagtaattaaaccagttgagcagctaaatcatgtacacacttctttgatccctcccacgatcatgtatttggcattgtaatgaaaagatatgtttattttcgagaatagacataactacctttaataatatgatcacccagaaatttttacaaacccctggaaaatttcatgaatatcaggctgtgctcataaaaccttagagatgagatcacaatagactgggtcaacatatagtaatgagcaggattaataaaacctcagatgggcatttacaaatgagtcaaaaccatgagtataattaaataattgtagcaaaaaaagagccttgggtaatcctttcagcaaacgtaatcgaagtgattgcatttagaagacaaatatttaatttggtgactagaaggtcttttattattccattatgtctttgtgtgtgtgtgtgtgtgagacacttttcaaggtcaatttttacttataaattgtctctaattaaaaattgacttggttattaaatcattgaaaattggccatcatcaaattcctcattaaaatatttctatgtgccatatatatatatatatatatatagaatatatatgtagaatatatgtatacatttatttttactttttttttactgtgcctactagagaaatttaaactacatatatgtagaatatatgtatgttttaactagacatactgttaagtacactatacctaatatttggcaatattaataccatctcattgagaaacctggaatatatgcacattttggatgtctattatatgttgggcactggactagtcattgataatacagagattagtaagactcaggttgacttcagccatgttgtcaggaagcacacactctagtttgggacagcgaggagaaattcaataagagaaatatatataaggcataatgctctaggagaatatgcagtggataactgcccaataggaccaggcaaggctttttagaggaggaggtggcatttgagtcaagtgttaaaggctgaatggaaattcactggttgagataaactccttaggaggaactactttaatagaacttgccgttagtcctgaaataaatggtgtgcaaaatcattaccatctgtcaattcactcagtctactttgctcttaacttcagaaaaaaatcagaaatacaattaaaacatttgagcctattttactgtcttttaaaatgagttaattcaaagaggaaattaaatataatgagagagaatctcccccgaggattgggggctggggaaatgctattgattctttgcttgtgtttattttctctcaaaaatacattatgcataaacttgatgatcaaaaattcagattattacatttctaaattggcaatgcaatttattgcatcatacatcaatcacaaaaatgctcatcttgctgactttcataaacttctaaatgaacaaaaatgcaaaaatagtttatactatattacactatagtagatttgttaaactaaaccagaacaatggtccatgaaaaataggcctctgactccaaacgctcacaccacaggatctctctgagatttttgtgtcatttcaagtcagagaaaattgtctaataaattgttggcttgtaacaatgaaaactaagatatctgtggggctattcttgttctcttcattttactacagcagctctgcccagtagaaataaaatgtgagccacatatgtaatttaaatttctctagtaggcacactgaaaaaataaaaataaagaagtgaaattaatttcaacagtatgttgtatataacccaatatacccaaaacattgtcattttaacatgtaattgttacaaaagttattaattagattttttccgttaagtatttaaaatctggtaagttttactcttacagcgcaactcagttcagatcagccacatttcaagtgctcagtagccatatgtgtctagtggttaccatattagaaagtagtttgagagatccacattaaaccaaaaggaaaagaacttccggcccttcactgatgagtcactcttcactgctaaccttggaagcattcccaaatgtagtctacagagtttaaatagtctatcttaacatctctcagggcttcagtcttaatgccatagtatttttaaagaatggtggatattcttttttacagaacactctgtaagagcaattagaagtttatgatgcacgtaatgcaaaatacaggtcatttcccaagcctattttaaaagcgcaaaaactgtagtcatttatcacccctgagaatgttgtcttaaatgtcttggtttggatattggtgatgtgagaactttgtgataagaaagtagtctttaagaataagatatcagactaaaattcatatctagaatgaaagtcttgtttttaatggaagattaagagcaagtctgattcagatcatgcatggggtacactagtctaggaaaacactagtctgaaaatatactaaaagttacttcgcaacttaacaagaaaatgtcttgtgggtgatgtcgttcttgatttttaggcaaacctacctacctttgcaaagcagctgggacctttttgcattggaagaatcatttggagcacaaacaaaattagattatcaacactttggaaaacaactacgaatgagcaatcagaaacctgaccttaagattacttgtgaattgtgaatcagcaaaataaactcgattgttcattgctaagtgtatttcaattatcaagggccttctagattataagtagtcttttttttttacttagtttacaattaagatgtgtggtatttgaaatacatttgccacagggagaaatataaattataattaatttcctaggctaattcaatttatgacatacctatatacattatctgtcatctataatttttcccttattgtttacttcccactggaagaatgaaaatggaatattattacatggcacatggcttgatacttttacaaactctgacaattatgtatttattttgggaggcattgagtttatttgttttatttatataaatttatgaggtacaagtataattttgttacatgcatagattgtgtaatggtcacgtcaggccttttagggtatccatcaccttaataagatgcattgtacccattaagtaatttctcactctcataaaattctaattatgtgaatttaatttaatctatttaatgtgttttaggcaaatatagccggtactataaacagttgattttaagatatcattgcttacattgagactaagtaaaacaaaatgggtcaataaatgtcaatctagataacaatgtcaactaaataagaggtcaaacatggcagtatttttgaaggtgatctgtgaaagtgattatagcgtttacactcatggaaaatgccttcagagtttcaactaagaatgccaacagctcattcctttatcctgatgcatattgtcttccttctcacccccagttccttcttcccctaacccctacccgctttcctttgctgattttgacagaaataggacccccaataagtcagggagatagcaggaaatgggataggatagaacccggaatgatagaatagctgagcctgaaggcatgaagaaaggctcctcctgacatctaaatggagacctaagagatgggttggtcaggtagggggaaggaaacatgaggagtattctctaagccaggcaacatactgtgcacaagtctgaagtcatgggaaagtgattttgagaggattgctgcttggtaaacctagagtttgaattgggagagatgaagctagaaagttagtaagggtcagattttttttttttttacttgcatgacaatggtaaaaaccactaaaggttctgtgttaagcagaggagtgacttcatttaaaaaggtaaattggattgaaatgaagggcataaactgaggcaaaaatatccttcgttaagttattgaagcccagttgaacacactggtggcttaaactggagtattggtataagtgggggaaagaggttaatagattccaagttgaaaaaaaaaaaaaaaaacatagactttgctatctagtaatggattaatatacaaaaggaaaaagtaaagtttctactttttggacagctagaaaccttcaccgaagtagggaacccaagacttagattatgttgggaggggcagggtattttagttgcacagggatttgctttacagaaatgactgaatgacaatatagagagatcaattccattaaaagaagtttgattactcacagttctcaagggaagagtacatactacgccatgcaaagccatgcaggaaaaaagttccagagtcggtcagcaggcagaaaaggaaagcacagcccaaaccctttattgtggtttccaaggaaaagaaatgagtgaggtagaataggcaagtctgagcaagtttaggactggatagttcaaataatttccaaaatttcctggctgtaaaagtggtctctggttgtctggtaccaagccctagggtgaggggaaaaagttagggtgggggaaatattggtttggtgtaacaacagttagatgaagaaggtagttggggatacggactttggattagttggtttgtataacgaaaagcaatccaacaaatccacaagggagcaagtttacaagttatttgctatctttaggaattagctagccctgggaggggcagtctctccctggccttccaaggacctcaagatgttcaagcatccataaaatatggaaattttttaaaaacattataaatacacagagtaaacgctgggcatgatataggacagtggttctcaaactttagctccactggaatctcctggaaaacttgttaatatgcagatgaccgttttacccttaagcttctaattggggaggtctggggagggcacagataatttgcatttctacaaagttcttccatgattttgatgccgctggtgagggaccaggctttgagaacactgatttaggacgtgtcctgtttagggaatatccaaaaggcggacaagttcagggaatattcttgggcagttggctgtgtgagtctgaaattcaggatagaatattaagctgaaataaagatttgggagcttatctacagtcaaatgataattgaaatactgagagtacggggggagagaggtccatgtaccaagaaaagtgaaaatgactaatcccaagcctcgctgaccattgagaatggagctaagtgagaggagttaacaaagctgacccagaaaaagtcataagggccttaggaggccaaggaaaaaaaatacattcactgccaacgagaggcacttacgaatggcttgactggctttgccagcatgcatgaactgcttcataattatttgtattgattacagtaacagatacatattttaacaagcaacttaagtaatacaactgatttttaattatcttgtttaaattgataaaggttgtatatattcatggtgtacaacatgatgttttgatatacccatacattgtggaatggctaaatcaagccaattatcgtatgcattacctcacatacactttatttgtggtgagaacacttagagtatactcttagcaagtatcaagtatataatacattgctgttaactatagtatccatgttgtacaataggtctcttgaacatactcctcctgtctaattgaaattgtgtttccttcgaacaactgatttttttaaataaaaaacttaatacctgtaagttagaattcttaatggtcaccttaggagcctatacaattattcctacgttgttgttactattctgtgtctttttcttttttaacatctttaaaggtatcaaatttttatattttgaaagtagaatttattttttgtcagtctaaaatatttttatgttgaacaaaatgcatgaatggtaaacctagatgcaatcaatttttcaaataaaaaaagtagatacccatgaacatttcttttgtaattgcaaactgtcttgaaaggcagtttcaaaaagagtttagttcctaaattgtaccattactcactgcgttaaaatgcaacattcatttgagcgtataaccttttgatcaatttgtttttgatgtcttgttccctgagagttgtctcaaatagatacatataaatatacacatatctcagattggctctgagaaatgtcttgattcaaacgttcttgattctaagattcatggtacataggaactgtatggtgacaaccttgtcagcctatctttagagtagctttggattctattcagaacatttcccaaagctattctgctatcaagaatataaacaggaatagtcaagggaagctttttaaagggcaacattttcatgtaggcatttttctcacattgaaaactagtttactaaatgcagtgtattaccttctcattacaagaagtctttcacattagtataaatgcatatggcagttgtgccagaaataaattgcctctcaaactagcacatggaaagaagaattctgagatttagcacatatgtagcttttaaatagtatactctgtttcaaacattatgtgttagtccacgttctcttcagccattttcagttgcatttttactttatattcctttgtatatttatctttgctaatcattgtcctgagattcctttagctcttgaattctacgtttttaattaatagaaaactttctttttatttttcccccgacatagttgttttctagaaagaaacagttataggttataaatccaacactttagggccgacttgaacatgcatcaaagctactagaggacttgtagaaatacagattgaatggtcccatgcctagagttttacattcagttacagatagggtaggacctgagaattcacattgctcacaaatttccagttgattttgatggcattggtctagagaccaaaccctgagaaccattaaaaaacaaacaaacaaaaacaaacaaaccaaaaaaaaaactatatacagagattttcttcattggcttttgccactgaagacatttagatgaagagactccacaaagtgtaatcatttagttatgagaggggcctgataatttgcatttctatcaaattcccaggggatactattgttgctgattgagaaccacacttggtgaaacactaattaaaataccattaaaaagcaaaaacaatttaggccagcaaaacctcctaaagaatgaggcctaaagacttattttgttttatttttgccagaagcttcttatgggcaaaattatcaccaacagagctgaggttcaaacttgtgttcatagcaagcaaaagggataatttggaaaaaaagctgaggttagctttgtggttggtttgggagtgggaatgagtagggaggaagaaatttaaaaaaaaaaaaaaaaggaagaagccaaatattaaattgttcacagggcgaaaaaagagaaaaggagtaactagaaatatcttagactggttcggcaagtcgggtccctcgcagctaacagtggtcccaccctctggagtttatatgtttacattctttttttttttttttttttttttgagacagggtctcactctgttgcctaggctggagtgcaatggtatgatcacagctcactgcaacctccacctcctgggctcgggtgatccccccaacctcagcctcccaagtagcagagactacaggcaagtgccaccatgtccagctaattttttgtatttttttgcagagatggggtttcaccagttgcctaggctggtctcaatctcctaggctcaagtgatctgcccacctcagcctcccaaagtgctgggattacaggtgtgagccaccgcgcctcattggagtttgcattctagttgggaaaatagccaataaatttgtgacttattttcctttaaaaaaaaaacttattctggctattgtgtgactataggatatggaaggtgcaagagtatgaggctaacaccctgttctaaattccgtctcctctgagccttgttctgtcaagaatctcctccttctatactttttaagtcaccttcctactgatcctttgctgtcagcttaccactctggtacccttcattttaacaaacaaacaattgtccaagcttaccggtgctgctccttcacccctccacctgtacctagtgtcaattctctccctcttctgatggccaaactttgtgaaactgtagcacagctccatatgtgttcctgcaaaggacatgatctcattcctttttatggctgcagagtattccacagtgtatatgtaccacattttctttatccagtctatcactgatgggcatttgggttgattccatgtctttgctattgtgaatagtgctgcagtgaacatacgtgtgcatgtatctttaaaatagaatggtttatattcctttgggtatataaccaataatgggattgctgggtcaaatggtatttctggttctagatctttgaggagctggaagccattatcctcagcaaactaacacaggaacagaaaagcaaatatcacatgttctcacttaaaagtgggagctgaacaatgagaacacatggactcatggaggggaacaacacacactgaggcctgtcggggggtggggcgaggggagggagagcattgggaaaaatagctaatgcatgctgggcttaatatctaggtgatgggcaatagcaaagacttggaaccaacccaaatgtccaacaatgatagactggattgagaaaatgtggcacatatacaccatggaatactatgcagccataaaaaaggatgagttcatgtcctttgtagggacatggatgaagctggaaaccatcattctcagcaaactatggcaaggacaaaaaaccaaacaccacatgttctcactcacaggtgggaattgaacaatgagaacacatggacacaggaaggggaacatcacacaccagggcctgttgtggggtcgggggaggggggagggatagcatttggagatacacctaatgttaactgacgagttactgggtgcagcacaccaacatggcacatgtatacatatgtaactaaccttcacgttgtgcatatggaccctaaaacttaaagtataataataaaatatatatatatatatctctaggtgatgggttaataggtgcagcaaaccaccatggcacatgtttacctatgtaacaaacctgcacatcctgcacatgtaccacggaacttaaaataaaaattaatcatagaactttaaaaaaagaaaagaaaatgtagcagagctgcctagctcaccttctttacccacagctcacttttcagtccatttatctggctattactcctaccgtgccaggcaaactgctctcactaagaaaatcaatagcctaccccctgccaaattgcctgactcagcttctccttgtaattttctcctttagttctctaacaccctcttccccaggttttcacctgacctgtctccataggacatttgagtctctttcctgatgattcatcctcagcctcttccataataagtatggctgctccccagatcctaccctcagcacttcttcactttccatgccacatctcttctgtgatctcatcttcatccacggctctaattagtatctataagcagatgactctcaaagcatatgctgcctatgtacccctcttggccattctacattgacatctgcaactccccagtgaacttctatatttagaccacaggactggtacctgctgataagcacaggtagggtgtactgagtagtgttttctctatttggttgggcttttgctaaagcagttgtcaaatattttgagtcttactcatggccacagacattttaacattagcatgtcccaaactgaaatcccctactgcctctattctctatttcagaagatggcaccaccatctacccaattatttaagctagaaacttctgattctggtgagacttctctcttttatgcatatgtctacactgacacaaaagactgcaaattttacctcctaagtctgtcttaaagcagatttttctctatgattctctatggtttcaggcccttatcactgtgaagtcaagcatacctgattcgaatcttgtcaccgttggcaaatttttaaatctcttctagcctcagtttcctcataaagttttctgtttcttagggtgactaaagggcttaaatgagattaccatacagagagtaaggtacataaaatgcaattaataaagaatagtcactataactgctgatgatgatgctattactattcgtatcctagaaaactccggtaacttgttcactggtctttctgcatctagcatcacttcctcagccagagttatcttctgacatgaaggctgatgccgtcacccccatactcatgtttgaaattcttcaatacctttaagataaattcccacctccttggtgtagcatgcaaggtcacacatgacataatctctccaaggccccatttcttccactctccttgagtgatatatgtggcagaaaatttaaggctgcctggatattatccaccttacgtcccaatacttccatctgccgcaaagaccttctacccaacttcccatcctcaacgaattcttattctttctttaaaaataacctcaaacttcagactagacctctggtccatagggcattacaaatctctcagtaagttgtacaggatgaacacgccccctaaaactttgtttcagatatttcaatttttattttattttattattattatactttaagttttagggtacatgtgcacaatgtgcaggttagttacatatgtatacatgtgccagatatttcagtgttaaaggtttaataatcacatttacagaaaaggaattagctacaaaatggtggcactggtatacaagtatgtaaagatacagtgcttacaatttaggattattgttgtcgatgttttaatattaaaatggctaatcatacagcaaagtcgaaagaaatttacggtcaacatctgtatacccagcacctatactttgccattgaaattttactatacttgatttattacatattcatctatccatccctctttctgtgatcaatttttaatattctaatactcttacccttaaataataagttatcttttcaaaaaataatgtgtttttacatagatgaagcaaaataaacttgcccttgataaaacaatatgcactgtagtgccttctaattcagtgcattgaagtatccattaacaatataaccagagaatataaaacatgtttattaatattccactgtacctgattagatatagaccattaggaagagttattataattaagaatctaggtttgtcaatatagaaaaaaacctgtgttttttatcccactggaatgtcttgtgaggaatattgttcccctttttctaaaatttaactttgacctttattttgttaatgcaccatgggttaagccacactacgacatgtgctaaatagacctggaagttttcaaactaggtttttaaagtgtatttgacattaaatcttcataacaccttattgattaatttaaatccattaccatggtaaggaaaattcgcagacaggcaggtgaaaattaaaatagaaacaaaacaacatggtaagcaatccttccccccaagccaatcagcatgtagtcagtgtgtccttttaaattagcaaggcgcagcttcccataaagtcccagcttgattttatatgctgcaatagtattgctaaaataaaggagaaggcaacttttctctataatttttttctagaagttttcacgcagcttagtatactgcaatgaccacattactcagttccagaattagcagcattccattgtgaatgacttaattcacattgtgattactcatttaacaacattcttgagggtttacaatgtgcaaagcattacattaagtcgtgtgtggcagaggttctcaaatgcagatgatctgtgaagaagatttcctcaataagcagagaaatgagaactataaggacagaaagagagagagagagaaagagaaattatttaagcttgtagcttgtcatcctcctttcttaggacagcctaccatttaggctgagactatgtctttctgattatttcttgtggttgaaataccccttccttaacaatatgatggtaacagtggatggtaaatcttgttttgttttaatagtttacctggcaaaagtatcattttatgtctgtatcagttatatataatagtatatcagtccattaccaaaccgcctcaaaactcagtagcttaaaacagtaggtacttcttgagttcactaatttgtgggctgatggtttacattgggtagtttatctgctctgactgggctcccttgggaatctggagggtagctgagagcttaagtgtctgaaagtggctgggtcaacacagctctatcgctcacatcttgaacatccctccagcaggctaaccagcccgagcaagtcctttttgtgaaggctgaggtgaagagtggaagtgcaaacatgtaaacaatttgttgagcccctgcttccattaagcctgcaatatccgattggctaaagcaagttttatttccccctgtggtaggcagaatcatgggcccctcgaagatgttaatccccagaacctgtgaatatgctgtgctccctggcagtagggaattaatattccagacggaattaaggttgctaagcaggtgactttgagatggggagattttatggactattcagatgggcctaatctaaccacagggttcatataagtgaaaatggaagcaggagagtgggagtcagagagatgaagatagcccctgctggctttgaagatagagaaaggggccattagccaaacaatgttggtagcatctaatgctggaaaaggcagggaaatagattgtcctctaagcttcttcagaaggagtatagccctgccaacactttcattttaatccatgaaacccatttcaaacttctgacttccaaaactataagataatcaatttgtgttgttttaggccagtaagtttatggaaaattgtcacagaagcaataggaaacaaatatacgctccattgttcaatcttttgaataacacatatactattatttacttaatgtttttcttaaaatcagctcattttgttttctgcttttagccttaagtgataattcccacaaaactgtagtctgatgttgcagtgtttttttccttaatacagataaaactaaatgaatattaaaatttaaactataagctgtttatctgtgtaacatggtaaattggctccctaccactactgttcagcaaaccacattttgggaaacagcgatttaggtggttcaaaggagcaagtgattgtgcaagaacaagaatttattagagaaagaagcatttggccaatgggtagaattgttggcagacaaaggtagaagagaaagacaaattattcagtatggctctagcgaactctttgcacttttatcacacaatctgaagcttgctaatcttgacatgtcttaatgttgttggattgctcattaaactggctgaaatgttcacaaagactctcacctgtcttctggcttaagctgagatttatcacacttcttggaaacatcttctggtctccagatctccctcagctaagctatacagtcagtctgttctgtaagaaagcccaaacttctctgcagtgttcctcagtctttttgatatcatgatgaacagattaagttgatgtgttcatcatgatatcaggtaagctggccgaagactctaagctgcctaaccatcccagggctgagagggatcgatatctgaagtacctataacccaatcagggcatgtgccttagcatacccattggaaagccctgttttagagcctttatcagctgtgaacttattgaaggcaatgattttgtcctgttaatcattctattcataattttcaacaagatacgtggttgttgttaataataattgttggttgaaatgaagttaaataaatagcaattgacttttccaaggtgacgcattgcacagatttatttatcttccctttgctgccctggagtaccagttgtatctaccaataagcttcatttataggccagcctcatcttagtttctgaattagtctaagtggctctggtagcgcatcaaaaatcttgctttctgatggtctttgtaatttgaattctgtgacttacagacttggtattcaatatgtcaggaataaacctggggtgtgcccaaatggtttgaaaaatcccagccttcctgatttcctctcttctctttctcccctggccaccctaatagtctgatagtttttgttatttggatactcctaaactcttggcaatttttcttacatctgttctctacaggctgtcacaagtgagtggaggcaggatggcatgggctgcagtggaaagaccaagaaaataagttaaaagccctgggttccagtaaatgctctgtagtgggatttagggcaagtctcttaacttctctcagcatcaatctccgcatctgtgaaataagattaatgacacctgtcttgcctatacttcaaggttgttttgaggttcacatgcattttccaccccatatagcctataaatctctgatgcctacagataacctataatgttctccagtaagtttaatatttccaggattttaaaactcaatgactagcactgctctgatctaacataacatattgtgtcaatatgtgtgggagtctctctggttgatgttaatggaagtttgtatagtttacctaaaatagaataaagctataatattaatatatatcatcgatgtgttttaggtgatttttttcaatataaaggcaattttggttcaaaattaggtagaacatttaatttttactaatttacaaataaaatgataacatcaaaagggccccttcttttaaagataagttgtaactctcacattgatagtaatctgtcatttaggacagggaatccatgtagtttgaaaattcattggcatcatggagctaaaacagtggctttttaaacatgtcgatttcagttttctttgttttacaagtcaagtagtgatattactgggtacatatgaagcatactgattgaccaaaaaatagtaacaaattttgtaaacccttcacttaaccattattcacctttcccagccacataagaatcctttctctttgtccttagattaattgcctttctttaaccttttcaattctaagtccagacaagctgctgtggttctttaaaaggccacacaaaataagtattgtccagtgctaacactctgaaatgtgatattgtaattactaccaagtgaacattaatcactactagattagaatggaattacctgttatattcacattaatagcaaatgagctttccctgattgatgttgttataatgaatacaaaaggaattaatagtgatctggcactcaccaaaagaggggtagtcattaaggacatgccatcaaaaggcgggtaatactttacaaaaaacaagtattaattaaagtaatatcacaacgaatgcctattgaataacttatatccacattacaaagatattatatggttgcgattaatgtgattgcaatacattttgtaaaaattaataatgactaaccctttaaaatatttaggaagcagatatttgtttatatttgctaaatagctatgccaactctttagcttttgtgagtgacttctagcataggaacagtgatggataatatgaagcactatatataataactcatcggccgggcgcggtggctcacgcctgtaatcccagcactttgggaggccgaggcgggcggatcacgaggtcaggagatcgacaccatcctggctaacacggtgaaaccctgtctctactaaaaacacaaaaaattagccgggcgtggtggtgggcgcctgtagtcccactactcaggaggcagagcttgcagtgagccaagattgcaccactgcactccagcctgggtgacagagtgagactctgtcaaaaaaaaacaacctcatatatttttacttgaaaacatacattttgcctttaggatttttacttgttagaatatcctaaaggacctataattgtaaatgtaaaattgactaatttctgggttttaaaaaaaagtatttgaaagctgatctgctgtgaacattgaaccagatgttaagaaaaatgctagtaagaaatgagacttgggagcaaagaagcagaactaaacttttcatatatggtttctatggagtaattgagaacgtacatattaacagggatacaaagtcaggccctctcattcaagatgctttctgtctttaaaaaaaaaaaaaagtaatttttgaaattttctgtggcaacagtcccatagcagaaagcaaagagttttgaattaagtgatcagaatatcattcttataattttactacactgaacattatttagaaaattttgaatgatattaaaaccgctataaaacatacttgcctaccataagacttaggatttaagccagattaaaataaatatttatttagaaggatgtatgtaagaactggtgaaatataaatgaggtctgtatttgagttaatagtattgtgccaatgtcagtttcctagctttgatgataatgtactatgggtatttaaaatgctatcattgggagaagctgggtaaaaggtgcgtgagaagtctctgtactatatttgcaagttttgtggtcttaaaccatttcaaagtaaagttattttagaaaatatctaaatatatattttagaaagtattatctttttctctgtaactagtggctaattagctcagtctgaaagagtatgtagaggtggaactgctaaatatatttctgatctagacttacttgatgatgcttgaattagtaagtgaatgttatgtgccaacatatgctatgatacatataaatatataagattaaatgataggagctaattatttcttggcatgttgcagtgggtccatttaaaactgtttatgtaggaaactactgtaattataaaaatgagcacagcccaacagcccagtatattagttgaaatataaaaggcgttgtgtccaagatttgaaatgccttacaataagcttggcacttacttaccttcacacaaagcagacacattttattgtgattttagtgttccatattatatggtacagtaccaaaggaaaactctaaaatatgtactcaaaatcctgatgtgcccttctttccaaacaggtggcaccacaatgaatataacctttagagttaatatctgaggacaaacccagcagttacaccagcatgatttaggtcctgctgttacaattattattattgtatttatttcacaattaagttgcagagttgagctcgatatagttccagctgtggcttttttttcaactgtctcaatagttcatagatatggccaaatgttcaataatagtgaaagcttatagtccacatattatttctgtagcaccaattttatgtgaaaaaatgatttatctaaatctcagagaatttccataactagttttgttatacatctacaaaactaagttaaaagaacagagcagactttttaaatagctagattggccaaatccacctcattatcatcaagaagatactgaaacaccgtgtttatacaacaagaccaggcattgtaaaagaggaggaaaggtagagacaaaatttatttagccctcaggaatctttcattctgatagtgtaaatttgacaactttagagggacttattaacatgtatcttatatatcttgataccgaatatatattttgtgattgcattagagccatgaaatattacacaggtcatttgaacatagcattttcatagagaaggtgacatttgcaaaagattaggagaaaagtaactacgattagaaaatcgtagttttattttgtctcttgagaatgaattgatgttaattttatgtctgatttggccaaatacgatgtggaatttgctaaagactgaaaaaagaagagacatcaaatagagggttgcaagttaacagaccatgttataattaaatgagggaaaaaaaagtagagttgttaaactcccagagaagtcatttccccttggtttggtgcatttcactttggtggtgaagtaaatgaccatatgggcacttttctagctctgtccgcaggtagcactgggtatttgtggacaaattacctagcttttcatagcactagtttccttgttgatagacttcagaattctaaattccattttacatccttatttctatgtttaacttaaagataatcctttgcagccgggcacagtggctcacacctgtaatcccagcactttgggaggccgaggcaggcggatcacgaggtcaggagatcgagaccatcctggctaacatggtgaaaccccatctctactgaaaatacaaaaaatcagccgggtgttgtggtgggcgcctgtggtcccagctactcaggaggctgaggcaggaggatggcatgaatccgggaggtggagcttgcggtgagccgagatcgagtcactgcactccagcccgggcaacagagccagactctgcctcaaaaaaaaaaaaaaacaaaaaaaaaaacaaacagatcatcctttgcactggaattatcctgcagtggaggatagtaatgaaagtgtagactctgtttctgaacactagctatgtcactttcaaactgtgtgattttccttcaagtttctcaatcactccaggtctggtttctaaatagaggaataggagtagagattaatattgtgaagattaaatgagaaaacttatataaagcacttagtacggtgccctgcatattgtgaaggcttggtatgttgttagtagattcattttattatcattattaataatactgaaccctggctgttgggggaattggttctatcctcctgtctcatagtcaaaataggttaaagggccttctatctcttatttctggtggtgcattataattactaatagtaatgtgcttcatttgtatatgatcctttatagtttacatggcgctgttttatgtaatcttactaaaatttcaaaaataattttaaaaagccagaattcacaagaatgtgactcggagaagaagtagatgtttttctaagtagatctttcagtttaactgattcaaattttctcatgtttcatatacatgattatcatgtcttttgataaacagaatgttaaccagagtacaaccttgtatgaacatatttattcagcttagaaaagatccagaggtacaaaatctagatcccagtgtagaagttagcatacacagtacaatttctagtatgtccataaacaatatgttaaagtattagtttgagccatataggattgccaatatctgagtgttatagagctacaaaattagtaggaaattttgttgctttaacctaatcattaaattagaattgtgtgacttaaagttacaaatggtttccgaatattttgcagtaaaaaagtagtgaggaaaataaatataaatactaaactagacctgggaaatttaaggctataaagaattctagcttacagagagaggagtctttgtttgcaacctcccactagctaaatttaaattatcacaaatttcatcctctcctttacttaacccttgactcatgcaactagtcaaatgtctttttcttgctaattttttctttccatagatcacttatagggagttctggttaaaaatgatgtctctttaaccttcactaaaatgagaataggggaattaaaatgatatttaccacaaagagaaaaaaatctgggaggaaaaacaataaaataaaaaagataaaaaatttaggaatatgcagagaatggaggagttagcatatcttggaaacctgaattccaagtacttagaacttgggaagtcctagaaatgtgaagcaccagctactgcagaaggcagagatgaatgtgaggtaagatagtgagactgtgaagagaaatcattcagtaaaaaatgcattatcaagccaactgccactggtctagtggagtttaatcccactggggaaattctaaatggattgaagacatgtgtttaagagttagttattctttcaaaggggcaagggagctggggtatttatacacaaaatcctgctagtcattggtttaggactgcttccaacgggggaattattttcctagcatttctggcataccaccttggcaagaaaaattattttgtgtccagagtatgtctaaagccattagggaaaaaaaatgtggatcctcatagttgaaagccaggccagtctgcactaaagtggtaaggatgttttcttttagagatacaggtctaagaaagaaatctgaaggtggttacctcttatgcaagaatttaatttgatggattcaaggtgtgttggttaagagaaatggggaagggttgcttctcatgactgcggcacgattctactatactaaatttttcttttattaagcagcattgccttatgcaatgataggaaacatttgttatatgtgaaatcacttttatttttattttttaatctattcctattcttttcatttttttaacttttattttaggtttgtggggtacatgtgaaggtttattacataggcaaaccggtgtcacaggggtccgttttacattttatttcaccaccgaggtattaagccaactactcagtagttatcttttctgctcctctctctcctcccggcatctcttttaaaagaaaataatttttagcaattctttagaataagtcttggccacctaaaggtttccaggactctagttcagggagtatttatctaagtcagtagttcttaacctgatataatttcatccccagagaacatttgacagtatctcaagaaattcttggttgtcacattgggggcggggatactgctgtcatcaagtgggcagaggccagggatgctgctcaacatgttgtaatgcacaagacagccccccacaacaaagaattatttggtccaatatgtcagtagtgccaagtttcagacatcctgctctaaatcaggactgtgatgtgaattctctgcgatgatgaagatattttatatccgtgatgtgcagtactgtagcatatggctactgagcaattgaaatatagctagtgtgactgtacaccaggtgtgatgttccataccgaggaaagaagtagaaataagatatagtctttgaagtcagagctcacaatctagtagcggagacagatttttaaaaattacaatattttaaaaatattgcaatagaacatggtaatgttagaagattaataacatgctaaatttgaggcatcaggactcagacagacaattaaaaattctctgaggtgaatttccacccttagctcagaatactgtaatgtttaaaagctgttttctatacacacacacacacacacacacacacacacacacacacacccctttaaatcttttatcatgtaactcattgcttcttattttacccttttgtcagagaatacatataaaatactggaatctgatgggacattctactttatttaacaatgctattgagtttctcaaaatagtttcctaagaaagtctattaaagtattgattttttcataaaggataatacaaatggcatgagtctgtttaacattttaatcaagcttaaaattagtcttgcatttgaaacaaacttgcccagagaaattgttgagaaacttaagagaaaaacatcataaaaaattgatgggccagccaggctgtgagaatattaaaatccaaatctaaattatggttaaccattgtcacatctttctttgaagcttaagtaactcgatattccctgtaggatacccagtgattcaaagtgacacatatactgtcagctcattttccttcccagcatgctggtacaatttgtatccatagaaatatatggaaaaacctattagtcttgagtgccagaacctaccaaaaggaatctttgtcatctacaaataaattaataacataagataaacaatcctattaagttatactggcccgaaaagggaaaaaagaccagtttatgaattgacaaaagaaggtaaatgagattagccatatagcaaccactcagataataatgtgttttctctgtttagtaaaaaagcatatttgagagaaaattttcccttatagaacaattcttaataatatacatagatactcctttcctgggatgtagagtttaatcctcccctaagcccctccatgaacttggtaacttacttccagataatagaatatggaaaagtaggaataacaatggagaagaaaccaggcaggcaccaagttaactaagtagtcaagtataacatcgccagtgataataatattgatatcatgtctcctgtgatatgatgtcatgaaaaggacatgttatctctctggtattcttccccaaaacctgtaacttcttctaatagggaaaatacttcagtcaaatcttaagagacttctagaatatacctgactagtcctattcaaaagtttcaaggtcatgaagaacaagaagaaactgagagactgtcacagactagaggagaccaaaaagacccaaggaccaaatgcagtaggagattctggattggatcctgaaacagaaaaatgacatgagtggaaaaactggtgaaatctgaataaagtctgtagttttgttaatagtgttgtatcagtgtttgtttaaatgtttagataaatctctcatgcgtacagaagagttatcattaggggaagctgtgtgtcaggcacttagaaaactttcagatacataggtaccttttgtaagtaaaataatgaattaatgggtcattttatgtctgtattttatataaggctacatttctaaagagacaaaattgtgagtcccataaaaatataaaatgaatatgtgtaaaacattttattagatcattaactgatgaaggaattagtaagatgttagttacagttggttcaaaggagagtctgaagaattggcatatatatatacgtatatatacgtatatatacgtatatacatatatatacgtatatacgtatatatacgtatatacatatatgtgtatatatatattttatatatatacacatatatatataaaaaacactctagaatgctgataggaattttataacagatacaatactgatcactaactgtagggcaggaatctattgcgttccatgagaaaattttactggcatctagtgaacaagaatcatttgtgtcaccatcagccctccacaaattgacttttaaacgtacagaattgcaaaatagcataaccaaagtctaaggtacagactcttagataatcagataactcctaaggttttcctaaggaattaaagggaaagagacattctcagattaaggaaaacaaagaatttcttgctagcaaatctgctcttaaagaatgacaaaaagacattctctaaacagaaaggaaattataacgaagtcttgacatttcagaaagaaaatagtagaatgggtaaaaatgagagtaaaataatagactatcctatttaccataagtttgaagtgaaaactttaacaccacctgatgtggttctcaatgtatgtagagaaaatacttaagagttatattttaaaagaagacatacctaagtggaagtaagagtccttctacacgtcacctgaagtcaattccagtagattgcaatgttaatgcgtatcgtaatgcctggaaagaccactaaaaaactatacaaagtgatacgttaagaaaatacaacaaataaattttgatggaatcttaagaaatgttcaaataacccacaagaaggtaagaaaaaagaaagagaagaatgagaaataaagaaaacaaacagaaaccaaataaggtggcagattgaagccctaatatatccataattaccttaaatgcaaatggtctaaatataccaattaaaagagatttagctgagtggattgataaaagctgagcacacaatatgccgtctaaaagaagtttatttcaaatacaacctaggtaggttaaaattaaaagaatcgaaaaagttacattatgcaacaattaatcaaaagaaagcagcagcagtaatgttaatatcagataaagtaggcttcattgcaaagaaaattactagtgacaaacagggacattacataaagattaagtgttaattcactgggaagacataataatcctaaatgtgtttgcacctaacaacagagcttccaaatacatgaagcaaaaatgaatagagctgaaaaaagaaacagacaaatccatatttctagttagggacttcaacactcctctctcttcagttgatagaactactaaatggaaaataagcaagggtaaagagaactgaacaacaccatcaaccaataggatctaattgaagcactcctcccaacagtagcagaatacacattactttaaagctctcatgaaacattcactgatataagccatattctggactccaagcaacttcagcaaatttagagaattcaacttatatgttcccagaacataatgaaaccaagctagaaatcaataagagaaagacaaaagaaaaacctcaaaacacttggaaatgaagcagcacacctttaaatcattttccccaggtcaaggaggaggttgcaaagaaaaattttttaaacacaaagaactaaataaaatgaaaataaaacatcaacatgagtgagattctgaagcaaagggcaagcatatctactgtctatttttaaagattaagcttccttaagctcagggtttctctcctgtgatgcaatccactgtgtgtacaggtgtctcctgaacttctttgggattactctgtgggaactggctcaataaaatgttggttctttgactactgctttgctgtgagtaatctagtctttttctctggcaaaaaaaaataaagtgagatgtcataaaagcagtattgagaataaaatgtatagcattagattatttagttagaagacaggaaaggtctaaaataaataaatgagcctagagacaaaaaccatcaacaaaatattaaataacatgcgtcaaagtttaaaaaaagagtgtcataccataactaactgggatttagtattgaaggctggctcaacatttgaaagttaattagtgtaatctaccatatcaacaaactaaagaagaaaaaatcatatgattatattgattgatgcagaagcatctgacaacacccagcatccattcatgataaaaactatgagaaaactgggaatagaggataacttccacatcttaataaagggtatctacagaaaactacagttaatagcataattttaataatggaaggcttaatgtttccacccatgattgctaattagggaaggatgcccaatttcactactcttttttaacatagttctggaagttccagacactacaataaagcaaggaaaaacaataaagcatgcatattgaaaagtataaaataaaattatttctatttgtggatggcatgactgtgtacgtagaaaatatcaaatattctacaaaaacaaaagcaaaaataaccaaaaatgctcatggagctgagaagagaggttaacaagatccaaaaatacaagatcaacacaccaaagctagtcacatttttatatacagatgctcctcatcttatgatgggcttacatttagataaacccatcataaagtcaaaaaatcataaggcaagccatcacaacttacggattatctatgttggaaatgaagatgtgaaaagtgaaattaaaaacacaacaccatttataattgcttatccaaaaatgaaatacgtaggtataaatctatcatacatgtacaggatcggtatgtagaaaattataaaatgctgatgaaaggcattaaaaacaacctaaataagtggattatatggcatgtttatagactggaagagtcagcatagcaaatatgtcagttcttctcaaatcaatctaaaggtttaatttagtttctatcaaaatcttatcaaggatttctgtacacatagacaagcatactctaaaatctataagaaaagtcacaggccacagaataactaaaacagtcttttaaaaaggtaaataaagtgggagtaacctctctacccaatattatggctaacaatatagtaaggctatcaatacagtatgatgttgctggagggatagactcatagaccaaatgaaacagaatagagaacccaaaaacagacccatgcaaatgtgcccaacagatttttgataaagttgcaaaagcaattcaatagagaaagctcaccttttcaacaaatggtcctgcagaaattggacatccctagagtgggaaaaaaaaagaacttcaacctaaatctcacaccttgtaaaaacttaattcaaaatagatcatggacttaaatgtaaaacataaaactatcaaaatttagggaaaaatgagaaaatcttcaggctctagggctagaattggcattgaaagcatgatccacacacagaaaaaaatcagttggactgcatcaagatttaaaacctttgcactgcaaaagacctgtgagggaggatgaaaagacaagctacagactgatagaaaatattttcaagccatatagccaaaagatggatgtctagaatatataaagaactctcaaaactgcaaggtaaaacaagaaacaaacaatgcaattaggaaatgggcaagacacatcaagaaacgtttcaccaaaaaggatatacagatagcaaataggtgcatgaaaagattatcaaaaacattagccattagagaaatgcaaattaaaattattatatattcctacacatctatcagaatggctaaaacaaagtagttacaacaccagatgctagcaaggatgtggagaaaatggatcattcacatattgctggtggaaatgtaaaatggtacagccactgtagcaaactgtttatcaattttctgtaaaactaaacatgcagctaccatacaacccagcaattgcactcttggacatttatcttacaacctgtacaaaaatattcataccaccattattcattatagccaaaaactggaaagaacccagacggtcaacaatgaatggttgtacaaactacggtacatccatacataccaggcaatactattcagcaataaaatggaatgaaatatttatacatgcaacaacttttagatcaatctccacagaattatgctgagtaaaaacagctcatctgaaaaggttacataatgaatgattctgtttatatagccgtcttgaagtgacagaattaaagaatgaagaacagattggtgattgcaaggagtccgggacaacaggggaaagagagagagagagatggatgtgactccaaaagggcaacacaggaggcatccttgtagtgttggaactgttctttaccttgattgtgtcaatgtcaatatcctggttatgatattgtactatatttttgcaaggttttaccttcagggagacggggtcaggggtatactggttttctctgtattatttctcacaactacatgtgaacatacaattatctcaaaactaaaagtgtaatttcaaaaaacaaataaaacaattcagaaattttaagacttcaacagtcatttatctcatttgttattttactgttgagaaaacaggcacaaagaaactgaagtgacttactttcatgcttcacctaagtctttttttcttttctccatcactcagttaagagcttctgtaatacagaaagtatgtcttgtattcttttaactcccatattacttcaagcaatgttgaacacatgttaacattgtaaaagttgttgtctgagtaaatgggaaagatagaggtctatgtctatatgcaaatactttgtattaacatgtttcagtctgatataactttccacacagaaagtacaaaagaagatctgttcaagttatctgatttaattaagatagtaaaaagaaagctgataatttagggggtcttatttgattgtttttaattttacttattttccactaggtgatcattttgatgattcaaaaatgaaaatttacaaaaaggtataaaataaaaattatttctcctacctctatgcactgtcgaatcaattcccctacccaccaccaatcagtattgtcagctgtttgtatatccttcaggagatatgtacgaatttcaagcgaatatgcataagtttatgttatgtatatgtgtgtgtctgttttctatatatatgcatctttacattaatggtagcatacgatacacattttcttctgaattatgcttctctctcaacaatgtttcttggacattttcctgtatcagtacataaagaatgtatttgtttcctatgactgcaatagtgaaataccacaaactggatgacttaaccaaaagaagtctgttgtcttacagttctggaggatagaagtctgagatcaaggtgtcaggagggttggttccttctgagggctcggaaggagaatctgttccattccattcccctagtttctgatggtttgttggcaatctttggtgctccttgtcctgtagatgtctgccttcattttcacatggcatgccccctgtgtacgtgtctgtctccaacttccccttttaaggacagagtcatattggactcaggcccaaccaaatgacctcattttaagttgattatctctgtaatgaccctatctccaaatagggtcacattctgaggtaccaggggttaggacttcaacatttaaatttggagaaaatttggacagaattcaacccatagcaaagaacttaaccgttagtttaatgactacatattgttccattttgtggatgtatcataatctatttaagcagtgctctgaacattttattggttttcactttcattgttttgccttaatattggtgtctgtttcatagaatagatttatagtattttaggcttatcaagattttatttaaatcttggaatttaaattccctgtaaatttcaagtgccttgaaggcaagatatattgaggaggggagacttttaaagttcatatgaaataataaataatcgcaagtatctcaggaatgcatgaaaaataataaatgtctctgcatcaataataagggagggggcttgccttatccaatattaaacttgctgtaaagctactgtaatccaaatagtatagtattagcacaaaacaagacaagtagatcactgaagcaaaattgagagtccagaagcagatcagattgtttttggaggccgggcatggtggcttacgcctgtaatcccagcactttgggagtctgaggtgggtggattacctgaggagttcaagaccagcctagccaacttggtgaaaccccgtctctactaaaaatacaaaaattagctgggcgtggtggtgggcgcctgtagtcccagctacttgggaggctgaggcaggagaatcgcttgaacccaggaggcggaggttgcagtgagccaagatcgcaccattgtactccagcctgggcaacaagagcgaaactccatctcaaaaaataaataaataaataaataaatagatacaaattgtttttggaaacattatatggcaaatgtgttattttaattcaaggaataaaggtgttttattcaataaatggtgccagcactctttgcaattcctcttagaaaacacagattgcctcctagcttatgcaatgtaagaatacatttcaaatgcattaaagttttaaatgtaaaaacaaaaattcttggaatgaggaagacgttttctaaacaagacacaaaactcaaaagctataaggaaaaaatataccttgttactgcttaaaataacagaagacaaagtcaaaagaaaaacagcaaatagagtagatgtattcgcaacatgtgacataaagagatgcatatacctaatatacaaatttctcctacaaatttgttaattaaattaatattttttaaaattcaaacaacccagtacaaaactggccgaagtataggaatatgcaattcccagaagaggatatccagatagctggaaaaataaaactatgataatatgcttcctcatagtagtaagggataggaaaataaagaaataagacaccatgtctatctaacaaatagacagaaattaagaatgataatttttaatggaagagagcactctcagatattgcagatgaaacgcaaattgctgtggtctttgaggaaagaaatgtggtatgatctacaaaaattttaaatgcacttaccttttgatcagtcactccatttctgagaatcaatactacagaaataaaagtaccagtatgaaaggctgtatgtagaggatgtgtattttggcattgtctatgatggtcaaaaagtagaaatcaagcaaatacccttcagtgtggaaattattgaatatgttatggaattatttgggcatcccagaatgaattattatttagtctagttagagctgtgtctactgtcctgaaagaatggtgatgatatctttcaaaaatcaaaacaagtttcaattaacatattccatttttaaaataaaaaagataaaattaatcttatgggattacataaccatgaaggaggaatggagagatatatactaggttatcagtatttgttaccttggattttcaaaggagaatgaaagaggaacaaataatgtatcaagtttcacaaaaagtgaaaaggtggaatataaatattactgcaaatatataaccattgaatatgtatatggacaaggacgataagataatatagaaaactgaatatgttggttttattatgaggtggttggattgaagatatttttgtctccaaatactgttgttttaatatgttgtgttttacaaagaaacatgggctgagcagacagggaagccctgataagcatagtacctgccatgtggccattcaataaatgatagttattgattattattattagagttgtagtacagtagtgcctaccttaatatatttagattgatgcccagcagcattgagttaacccgcattttaaggacaagtgttatagctattatatactaatggtaaacttgagtctgtaactagcactgttgaaggaggacaacagagtaatatgatgtgtattggcctggggatggaagggtggtgcttaaggcacagcagattttcactccagccaggtttccttaggacctctccaatgaacaggatacctcccttcctgttctttctaccctcccaccccgttttttgctttttcagtttcagcccaaaggggaaggaagtatgatgactgactccccatcagtccctgaggtgaactgggattttgggagagtgtggcagctgcaaatttggcttcctggagataggatttttgccctcaatctggagaaagttcctgaggctacagctgttcaagcttgtgaagtaggaactttgatcccttttttcaaaagttttgtataattagcatccaacttgttagacagtatgtggctcattacaagattgccacaaattcatgctgggccgtgtctaagaacagggcaaagggagcctttggaaagtgttatacagttgaccctcaaacaatgtgagggttaggggcgctgagcccaacacattgaaaaatctaagtagaacttttcactcccccaaaacgtaactactaataggctactgttgacagaagccatactgataacataaagagtgattagcgtatactttgcattgttatatgtaatatatactgtattcttgcaataaagtaagttagagaaaatacgatgttactaagaaaatcataaggaagagaaaaatatatttactattaattaagtggaagtggatcatcatataggtcttcattctcattatcttcacgttaagtaggctgaggaggtggagggagaggaggggttggtcttgctgccaatctaaatgctgggcccagccaatgggtataagttttaagtgtgcacatattggtgaacccttacagatcacggcactgtctgttcgagtgtctattttgaaatgtccctatccgtaatataagttgcaaaggagtttgtgggcccactgaattctaccaccctgatcattgtgaagcccattcagctttgtgaagagcttatcttggtactaccttagccaaggtatgataactcagacataatgtcttttctttcatggttccttttttagtgatcatagattcagttctgtaataattagagatttatgtgtcctattagtaattgcatcattctttaaagacagtgtcaaccttgctatacagtgtgattgaagccttgacataacttgggggtttgttggcattttgaaatcccaggccccacttcaaaactgttgaatcagaatctgcattgtaagaagatccccaaaagatctgcatgcacaagccttgaaagagaagagaagccatctaacattcctcacctaagatttgaagaatttcccacttatgcaagagtaggggtgtgatttctcaggcaggatatctaacagaaaacaacacttatgaagtgtttcctgtaggagctaagcaggtggccagaaaatggcaggctacaaaggagaagaatgactaggaacctgagcaaggagaaagtctcaaagacaaggaagtggctggcagtgtcagggactaccaggcagctgaaaaagctaggtgtgaacactatttcttggagttttcagcaagtaagaggttcatgatgatgcctcaaagaatttacagtggaaccagagccaagaagtcttattgtggtgagttgggaattagggaaagtgttatacagttgaccctcaaacagtgtgagggttcggggcgctgagccctaacctcaagtaagaggttcatgatgatgcaatcaaagaatttacactggaaccagagccaagaagtctttttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccagctaatttttgtatttttagtagagacggggtttcaccgtgttagccaggatggtctcgatctcctgacctcgtgatccgcccgtctcggcctcccaaagtgctgggattacaggcgtgagccaccgcgcccggcagccaagaagtcttatggtggtgagttgagaagtagggaggtggaaataaggaatggagatgaagacatgaaaggaatttgagaaatgaggcaatagctagagaagaatataggaatacacagatccagcaacccagcaagggaagggctagattctgatttcatgagcaaattgcctactaattaaattcacaatatcagaggaaactgttggactcacttactgaataatagctgaaaagtatctttgctttatagagagatcactgtagatgaaagtcatcttccagtggtgagatattcttcagtgtcatctcttcatttttatttctaatttttcttaatttgaattatttcttctgataatgggaatgatgtggtaattttgtctctcctgtaaattattttaaagatttgtacgaactcctttggcaggcttgagtgtgttgtgacagcttggcttagatatgcattgaatgtcattgaattcaaactccttaccaacatagttagatagcccataggcattctacttgaccctttcaaggagatctggagatgcaattgtaggggaaaaaagaagaaaagaattcaagaagcaacaaagtgaaagataatttggcttgcagaagagaggtctttctatcacagtaataataatgccaattatatgtccatatatatatatacgcacacatatatatagtatatatatatacacatataactcagacataattctttcatagttctttcttttgtgcacagattcacttctgttataattacatacttatgtgacctatttgttagtaattgcttcagtttcttaaaagagcatcaccttgctgtgcaaagtgtgattgaagcctcaacatctcttgggagtttttttagaattttgaaatcccaggccccacttcagaactgttgaatcagaatccgccattgtaagacaatccccaagggatctgcacgcacgttgcagcttgagaagcactgcagtatcacacatatacacacatattcaacaccaaagagagagaaagaggtcataagctctcaggtggagactagttccatgtatatatgcatagagagaagaacaaactctaccttccagcaacgtaaaattctactcaatcatgtattcaccaaaaaagaaaaggctttctccatataatgtgtattattcatatattggcactcttcagagctcttcattccaccctaatgttatctttcttagataattcacatgacactttgttatcttccaataatttctgtcattgttataagcgaaattattcaggctttatctaagagagtaaatcaaacagtatgcctctctcattccaattctgcaatattttcattctagaatgtctaaaggagccttgaaagagaggagaagtcacctaaggccagctagaggggatatatagcagggaatggtggcaactccactcctcgtagcccagtggggttttttttttttccaatctgtatttgtatgtgagtatcacgtctatgccgattttatgtgtacatatgtaactcaaatctgttcattgtgctagttagaatcttatttccccctcttctactacactctaccctttctctttcccctcctttggcaaccaagacactgagttattaataagcagattggagcaaacattttgatgcactattgtttgatagatttgttggttcattcaataagcattaattgagcacttgctaagtgttaaacaatgtactaattgctagatttaaggatgaaaatgataaaacccttggcctctagagcctagagtgtagttggggagacaaatgggcaaattagtcacacgacaacatattccttgttaaaacagacagttgtgcataagtctgtatacccagactggagatgactctgtttccaatgttgccctgggaaacctcatgatcagtttaataatgatgtttggggtgagaggatactgagacagtttgcttctagcatagtaattacccatagaagtttggggtctttattcaaaagagtttacaggccacatgagccactgtcttgccttttataggatcacatctaagttccgtgtcatataatggccttggccttcttggctttctctgtgctctttgcctgccaataccctaattattgaagtactgtctcccgcagctcctcaaccatgagctgttcccgatcctcccagcagctatgtttctcctttcttcaaacctctttagctttttatttgtactttatttgtactaaattgtatttagagctttggagaacattcttcatagttgtaattagactgtaaagtcctgagaatgtatttttcatcttcgtagccccctgcagtatctagcagaatgcctttaaacaaatgggcagtaaataaatcccaacaaacttaaattaaatttctccaaattgcatatttaattttatagtggcatttactgataacatacattgaaataaaggccagagcataatcctctctgtttctgaatattatttatttaaatattaactttctaatccaattaggtctttcaatgacactttagatctaaatttatttttgcattgttttaaatgtcatcaaatgattcatctcttgtgttttttaatatttttggaacgaacgtgtgaaaatgagcaagtgtcatcagaatatgatgcttgggtttttttaattcaacatttctttgatcatatatttaaagactttttctcaattcctttctggatgtggcctcacaaatcatttcagaagtcaatccatttcaagatttttttttttttttttgcttttttcacttcacaggaagtcaagttcattctttaaaatgtagcaaatgattaagcaaattcaacgaatgatcttcatcaactccgaggtgtttttcccccttgaaaaatttaagttactattatttttttttctttttttttttttttgatacagagtctcactctgttacccaggctagagtgcagtggtgtgatctcggctcactgcaagctccacctcctgggttcacgccattctcctgcctcagcctcccgagcagctggtaccacaggcgcctgccaccatgtctggctaattttgtgcatttttagtagagatggggtttctccttgttagccaggatggtctcgatctcctgacctcgtgatccacccacctcggcctcccaaagtgctgggattacaggcgtgagccactgcgcccggccaattattattattttttttaaacttcacctatcataaatcttttaaaatttcacctatgataaacttcctctgtcatctggggaattacttaaatgcaatgatggccttcaagtatactaccaggcagcctatccaaatcatgaaacagaaaggctcatagaccaaattaaaatacttgaatcacagagtttattaaaatcacagtgagaagcaaacgggaaagatatgtgctaagttaacacgcttagaatagagtgtaagcagactgtgaagattagagtacttgaattctgcagtacacaacattatatgtcttgtctgtctctgtattgcatcagccttcccaattatggtgtgcttacaaggaccaaagttgacttcccaacaagggagtccaaaatgggtggtgcctgattcagtggcatgtggtttatcagagacacagagacaagaatgcatggccacagctgtaacttgccaaaatagcctgatgactagccatgtaattctcaggcagaagacttacggtgctggaataggtatcacctatggatgcctgaattaagaccttgtgaacattaagtgctcatgtgtatttatttgatcttgaatatttagtgcctcttgtatatttggtctcatgtgtatttagcatattatgaatatttagtacccaggtgcctcatgaatattgggtatcttttggtccttctatccctcactatctatgtttagtacacacatgctctgcttgctaactacttatcttctaattaacacattccaagagccaattatgtgtatctctttccactgagttcttcattcaatgacatcaagttagttgcttgaaatcagctattgtgagagcacttacaccacagaaattggcaaatgctacaattagcgccactgccctcccctagagccagttatttgacatttactagcattccactacttacatggcccttcatgctctcactccgtgtgaccactcaagccttatccctctttactgaactctacaatcaaataaaatatctttgtttcttgcttctggccctccatcaaatggctccctctcctaggaacaatctgtctctcctctatcacctttgtttagctagttaataatcccttttcagacagcacctcataaatagattcctgaacatcccaaaccggatctcctgcaccttcaatgtgctacttcagtacatttgtcttaccctttgccatatggtatttcaattgcccatgaatttgtattcctgtttagatcttaagctttgtgaggtctttttgtacttttttgtacttccgtatacctaccacataataaatatttaatgaaagcattaatgaataagtaagtgaatggagtgagtgaatgagtattcaattatgattcatttgtatcaaagtgataacatatacttacagggaaaaggccagagggggaaaaaataaaaaataataatatattttatgtatgaccttgtgtggggaaaggaacatagggccactgcctggcctgcttcttttatgcaaatcctaatgtaaaatatgatcaacgcctggctgggcagaaatacaaaaacccagtactagtgattctcccaaccagataccagctagtacagatcatagccagatttaactactgtgaagtggttaggttagaggtgacctataaggaaatgacgctaatgatcattagcatcatcttggaagcttaaaaaaatgccccagctgtaccccaagccaatgatatcagacttttgtggggaacccagatatcattgtttttaatctttaatgattccaatttagccaaagttgagtctcaacaaaccaagttcttcttactctcatattctcttcttctcgcatagataagaattaacagccagctcttctacatgtttcttagacacatatattgtttcagtggtaattcgttaacagtgcatatgtcagcaaagcatgactgaaaaaaatatctgctcccacacattctgatcccatcttgacactgcatagctgttggcgaaggcaatttcaacaatgaagaagtgggagaaatgactacattttatgtaaatatgtattcattgaaaatcaaaaggacatatgtaatgatattgtttaagattctaaatgaaggacaatacttaagagtcctctgtagtcaaatttctcagcagtaaaaaaacattgtcttttctttacaactattaaccatatggctgtgaaaatgttattctacaagcctttaagatttgaaatctgactttatgttaatacacagaatttaccacacaatcctgtatgatttctaagtagatttaaagagtagctattgctcaccttttcaacataatggtaatgatggtgcaatgtcaattacatgatactctcatgggcgtgattatatgattgttaacacactgaagtgcttatatagacatagatactgatttttatatgtacatatttaaaacaaacaaggacttaaaatggcctgtaaaagtctttctagtcagtctttctggttttggacagagaacaaataatcccttacagctgttaggttggtgcaaaagtaattgtggtctttgccattgcttttaatggtaaaaaaaacgcaattacttttgcaccaacctaatagttatctacttccatctttaacgggccctacccaagactgcatggtatataagtaagaaatgtaaatgaaaatctcaaatgctagatctgcccaggaggggaccactaatgagagaggaaatgttaacgtcccatatgaactaagctcagcttagcatttacccttcctgctattccgctagagcagtgcttctcaaaagttgacctgtaatggaatcttctgaatgcctttttaaaacgtagctggctgggccccatccccagagtttctgtgtcagttggtctgggatggggcctgagaatttgcatctctaacaagttctcaggggatgttgccggcccttgaatcacaacttaaaaacctctgctctgaagaaagggaaagctctctctgctggatttccccaagcctttttcagattttcaggagacttctgtgcggtagcttgcttccttctttccatactactactactaccactactactactacaaatagcaacctctagcatattttcagtactaaatacccagcactatatatacatcacaaaagtcccttgaggaaggtggtattatcatctccattctgcggataaggaaatagataagaaatttgctgaagatcgcagagccaaatgagactcaaacccatgtaacccatgtctgtttgactttaaagcccggaatcttaatttgttccagacaagctcattatgtgctctgatcttcaccactgaaatgttctgaatatgaggctgagggcagcagtgaggttggaaggagcagcccagaggagcaggcactgtgctggtagaatagtagtatggtggggcctgcactccctaataaaagaaggggacaatgactatttcctccttctccaaggtcgtgctgcctcccatttctctgtctgcctggtaagaagcagctctgggccatgtgtggtggctcacacttgtaatcccagtgctttgggaggctgaggcgggaggatctcttgagcccaggaaattaagaccaaccctagcaatctagtgggacttcatctctaataaaaataaaaaacttagctgggtgtggtggcacacacctataatcccaactactcaggaggctgaggtgggaggattgcttgagcttgggaagtcgaagctgcagtgagccgtggtctcaccactgcactccagcttgggcagcagggtgagaccctgtctccagaaaaacaaaaagcagcagctctgaaaagaggatctagcagtttctatatgcaggagagcatttgcgcaattgttcctggggttgaatctgagaaactcacagtgcacattcagatactatttacaatcttctaggaatagtataaatattgtggccagggcaccttcatattgtgaaacacaaaaagacttcagaccttagattatgtgtcgaaagttaggcaccaatgatttttttttccatttgttcttaagtggcaaatctttacattaacatttttggtacttgtctttagggaaatttcttctctgttctgaatgtatatattgtaattcctcatttacaattttgcctgcaaatgcaagtgagtacagatcatccagttatgaaaatgctctgagatttgagtctagctgtttcagctttaagagccctgacctagactttgaaactgacatggttttatatgtatgtggttggaattaaacccaaagcacatcttttaaaactctgaggaacttctgtgccacagctttcgctcagttggtgagattttactttgaaatttaagggatgagtctagtttatatgcaaagaaatgtagggagctttgcaaacccaatcaaatcctttgtgaacagtgtgtgcatctgtttattttgctgtcattttgagtccatgatcctgtatactgttttgtgggcacatattgagggtaatatcaaataccatgtagaacagatgctgcaggtatcctttccatgtcctcttagctttggggtggtagatgggcacatggaccaagcccaaagtgacagggtattaacaggagcaagactcaaccaataagggagagtagatgggtacaaatctcagctttctctcccctcactgggataattttgagatatattccaaagatcctcagagcatccccaacagcattgagccccagttccccagattagtaatctactcaataaatacctcttttttttttttttttcccgagatggagtctcactctgcaccctggctggagtgcagtggcacaatctcagctcactgcaacctccacctcccgagttcaagtgattctcctgcctcagcctcttgagtagctgggactacaggcatgcgccaccacacccaactaatttttgtatttttagtagagatggggtttcaccatttggccaggctggtctagaactcctgatctcaagtgatccgcccgccttggcctcccaaagtcctgggattacaggcatgagccaccacgcccagcccaataaagaactctggattgtttcttccttttcctctcctcctttcctgttccctacagtgtttcctaggatcacctcagtctgctgtatgggaaacccagactgagtcaccataacagacagaggcattgttactttaggactttagtggatatagttacatgggagagagagactgtgtatgtatatataacctttataatattaaaccatgctatactcaaattatttactggccaagatttccaatataaattggaaataaattggatataaatcaagaacagttaaaattggaaatagttaaaatacaaataaaatagctaaaattgggcaaaatacctgacccaatgctttaatatccgattgcataattaaacgagtaaagaggaaaggaaattattagcaactctatatttaaatgcaactgacatccaaggaagtcatgaagaaaactctttgtgttgataaactgaaggcctcttctagcagacttctgtgtttattgttctgttgctgactattttattccaaacaaatgaacttgcttgtcattataccccacccttccctagtacagggcccccattctttgaaacagtaactcattcagttccaaggagaatatgaaaagggagggtaatatataaaagaactgaaatgaaaagtggcctaagtgtggcacatttccattgtggattccatggcaatggagaattgatggcagagcatggtgagagatgtgaagcatcaattggctgtatctccagggaattcctgaagttcagttgccaccctggagggtggcaaatgctctctctcaccttccttgagttattgcttagatgactcaaaacaaaaaactgatgagctataaatgggctgtattatttgtttttacctgctgagtagttcagatatttcaaaataatctcaaacttaacctatggtgtggtttctgtgttaaacaaaataccgtaacttttagttgaaaatactgtgtaagcccacacaatctcttgttcacagataatcttgttgtcaaacattcatgatgacaaaaactcataaacgattcttttaaatatcaagaataacttatgctgtaagtcataatttcataagcatgaatttatgaatgtgttttgtgtttgcaattttcatttaggttgtcttaaaatcatgcgttttagcttaacttaggagaaatatatcttttgtgacaacataggatattcagagaaacgtgaaaactaggtgatgtgttttatgaaagaaggcataaagtatatcaagcataagaactttgaattctatttgtgttttttgtggctttagaaaagattgttctgggaatagagaattccatttgggaaacctagcacatacacagtagcagagttaaaatactgacttggagggttcatttgaagaattctatagaatttttgcatgttgggaataggtttatattcttaaacattgcactcagggtttctattcaaagcaaaaataactttgcatagaccttggccattctttcacattctaaagtaatccatttttttttttcagggtagttgttctcagtcctgattttctgataattcagatcatctttaatttacaccaaaaacttttagaagagtcagataataatttaacataaaatgtaaatgactgaaatatacattttttaaaggagcagatatggaggggtccaatgtacttaactatttgctctctttgtctccttgcattcacgggaatgtttctatgtagttttctaatttcacacaatttcaataatccataccctcctcatttttatgggccttcatgatactaaaaatgttaccagaaattattttgtgttagtctctttgtttagcacattcatacataagttttaacatttaactggcatatttttaaagtaatacatgttttttttttaaaaaaaatcagttatgtttgtgtgtgtgcatattttcttttgtggccaaatgttgcacgccctagtccttctatttaaacaatgagtttacataacaaatgttacatgataaacatgaagacatttagtttgaaaaaaaatgattttctagtttactcatttaaaaaaagctgaagtaaccgggaagaggagtggcagaacatattagtctttttcataatgccatcattaaacaaagatacttaatttccaggcctggtgcagtggcgcagcctgtaatcccagtactttgggaggctgaggagggcagatcacttgaggtcaggagttcgagaccagctttgccaatatggtgaaaccctgtctcaaaaaaaaaaaaaaaagaaaaagaaaaagctacataatttccaaaatgacttcagtgggacctgaggtgagggaataaaggctctggagtaatttcactctctattcctctcctaattttttttctgttcctttataacaacattttcactacttttgagcttgggagttgaggaatcatgaccagaagaaaaggaaagacgggaaagatgttcaagggtgaggatgcttaagaatgacctggcaagcttatgaaaatgcagttgtctggatcccaccacagagattctgatttagcaggtctgtggcaaggcctgcgattctgcattgctaaccagctcccaggtgatgacactcatgctggcaacctatgaaccattgagtggcactgttccagggggcagggcaatgagaaattgaagtcaaaagccccaagacctggtgctacgaaaatactctggttccttccctctcaactgatttacttgtcggtgtgattttgcaaaaatccctgaacttcttaaatcccagttacctcacctgaaaagtatgagtgttgctccagatctggaggctttcagaccatgcaaatcgaattcaaaccatgcaaaccattcaagtcattctagaaagttctgcaaggtgcctcagaggccaaagggagagatgggaagagggattgaatgggctctttccaaggttccctaacccacttgaatactttcatcttttatctctttcatatattccacttttgagtatggtttcatttagaaaataggattttataccaacagatttaaagaaaaactccaagtctgaaaatgactcatttatttaaaactgtatagaacaaagacatttagtgcacaattccaaaaattctctgatccttccacagcatgcccagtatgctgcaagagtgccagcaaacacatgcttactgctcacaaatgtgaaatttaaccccatgcactaggaggtccctagtgtggggtggttttagctaaccagactaagagagtacagggcaacatcgagcctttctctgcggtcatgtctgattcattaaaaatccagctttccccgaagatatattaattaccttctgtttcagaatttgtttttagagcctaattcttaattatatctccagccattgtgtgatttgaccattttggaactaaaaagttatcctatgaaattccacctccaactattgccacactgttagtttgtctatttcatacaccatgccaatcttagcgtggtgctagcatttcattataaccagctttcatttttaataagaccatgtgtatatgaaattgtagacttcagtctttgtatgaattgaaagctattaatcttcccagggttaggttatgttaaacagattgtaatgttcttctttttattatgttatttaaatccccttcatttcatactgcaccaatacatttctactatcttggaataaattaattccagttacgtgatggaaaattttagtgtaaaaatataacctgcagtataattttttctgtcagaataccaactagaactggtatgtttcattctaattggaaatttgagttatcgctttgatttttaacagtgggaaaggaaaatgaagattgatatctttcaatagccgttcattcattcttcattccttcattcattcacgtattaagaatagtctatgtgctaagaacagaaagagtgttagagatatgaagattaataagaccagatccctgcctgcaggcatttcctattctatgtcatagatagggggctattctgtttagaggtaaagcatgacccacattgcctctgacaagaagcataatgtctgtagcagctaactgctggagacaggaggctagagggctgccctggtaattggtattcaagtcttcaagaaaggaaaccagctattccaaaatcagtgggcaagaggaagttgtaaagttaagtgaaatgactaaaatatgaataactaaaggttggaatctggtagaaggagaggagagcatcggtcagcaccttagtttgggaaggtggtgtggccatagtaggctttatttagaaagaagcaattcttaggtaccagctaggtttcagttccttaaggggagaaaactggcaaaatataggcaggtttccagggtgcaaagccacgttctagcttcagctcaggcaaggccctggggtatgaatcaccaccagagtagcccagccaaaatgactaagggatctaagctggttgctaatgaaagaggttgcagctcaaggcagctctgctgacgcccactggatactgggattacattgatttaacacatggaaaccacttaatatggtatgtggcacaacacaattaagtactcataaatatttgcagataatgctgctgccattgctgtttttgtcgttagaagactcgggaaaatcatctaatacaggaatccatctgttggcggggcttgggcttctaatatttgactggttgatttttgtcgacccaatcttaacaatattatacacagccattacttcaggaaaggcagttgtaaagaatggtataaatttcctgtaacttgactgccacattctagctgagtcacctctatatacctcagtttctttgtatccgcagtgaagattaatgacctcatagggttgttattagaatgaagtgaattactacactggacttatttaggacagtaactcgcacatagtgagtgctcaaggaaatctcagaccctgcctgctagtggagggtccagctcctgatacatttgggggcaggtttaaggagttcattgatttagagctgtaagggctgatctttcaccctgcatgtcttcagcaactgtggctggtaaagtccagagcagtcaaaggctgacaaatccttgttagaaatcacaaatgcccattctcacaacttctgtggtgttttccatcctttccctagaatactttctttttaaggcaaaggaaagaataatcactgcagatagcacacagtatttttttgcaacatattttcaaaaattatgatgagaaaagtgtatcattcctgtgaagaaacagcataaggaaaatgatttgagaaagaaacatggttcttaaactgaaacaagtgtcagaaggaatcccagaaggcagaaggaaatatagtaatcatgatgaagtctagagctcacaccggttaacagaatggcagcagcgatattcatctcacgcctcttccatgctgtccctgagtgagcttctgctgaattgcctggctggtgaggattggtttcagcagcagaaggaatgggctgccagctgaaggctctggttctgatcctgggtagggtcagagaaagcaagatgtgaccatcacttttgaccttggtcttgaatttgattccatggaacaacgatattttacaaacccagttgaaggtttatccctttttctattcaacacagggagagtccttagagccccaggaagacttagccctttttcattctaagagtaaaccacatctaggtttccagagatgaaaagaccaggctctgatcttccttctggaagcccttgcctattcaacaagcatgagtattaaatgctattgccttggaatcataattcagttttcacagtttgggctatgtcagaaccattcttgtcaaccccctgttttctgagaacccgaaacctgcttgtttagaattttagaatctacttgactcttacaggggagaaaagatctcttttctcacccatcgctaggttcatggctgaggcacctataatgaaggacaaatcaacaacataaaagcatgcgaatttatttaatataagtttcacatgacacaggagccttcagaaatgacccaaagaatcagggaaaagtgtgtatttttatgctctgatttgaggaaaagtagatgtccagtatgactggacaaaggggaatggtaataaactggggtgaccacagcaaggcctgtttctgcagaacctcctgtgtccctgtgttttcagaggtaaaaattttcctttccttccagtatagtaagggcacctctggtatgatagtctcatgacctgcttcaggggagaagggggaaggggaaggtgagagtgaccatcctgcttctgctgtcttctcaaataccaagctgccatattgtggattttggagtagcgtaacttgaatccttttttttttttttttttgagacggagtctcaccctgtaacccaggctggagtgcaatggcacaatctcggctcactacaacctccacctcccaagttcaagtgattctcctgcctcagcctcccgagtaactgggattacaggcacatgccaccatgcctggcaaattttttgtatctttagtagagatggggtttcaccatgttagccggactggtcttgaactcctgacctcgtggtccgcccacttcggcctcccaaagtgctgagccaccgcacccagccgcatagcttgaatcttatcaataccttaaccaaatgactctgacagttttcctcttcttatctaaattcttgagggtcacccacacttcccaatgtcttttgaaacttgacctcttttctgctgaattgaggaagatacctgatttctttaacctcaccaaattcctacttcttactgttgttcattgctggctgaaaatttactttggcgagttcaccaagaacatacttatcggttcactgtttatatttgcactcaagataacacttgaggccctgctactcaaagaatttagtgacaactttcttcatcactctcatatcttatctgtcatcaagtctttttttcctcgtaaaaatgcttttagctctttaagtatgtttcatatctataatagctaagataggctaacagctataatatattaaacatccaccaaatggactattaaaatgacttaaacaaaatagaaatgtatttctttctcatgtaaacagtctaaggtgaattcatgttagttggtgttggatgtgtgtgtgggaagggaggggtgacacccacataattattcaagaatacaggccaggccaggtgcagtggctcacacctgtaatcccagcactttgggaggccaaggtgggcggatcacctgaggtcaggagctcgagaccatcctggccaacatgatgaaaccccatctctactaaaaatacaaaaaatagctaggagtggtggtgggcacctgtaatcccagctacttgggaggctgaagcaggagaatcacttgaagccgggaggcggaggttgcagtgagacaagatcatgccactgcactccagcctggcgacagagcaagactctatctaaaaaaaataaaataaaataaaaataaaaaataaaaaataaattaaaaaaaaaacaggccagcaagggtcttccatctgcaatagccaattgccgaggttgccctcctgaagatattcagccagcccaaaggggaatgagctagaggactgcacacggaggcgtcccatgtcctttgactcaaccttctactggctagaactctgccctgtggccacatgtaacagcagaggggctggaaaatgaagtctagctagatacctaaaaagaagcagagaaaggtttcaagagcatttagcaaccatatccaccttattcatgccctgccctctattcgcagtggccccgcagcactgctcaactagcttgctgcattggcctcttatctcttatctattgccttagatccatctaaatgctctgctactcttatgcctggaatatgttttcaagatgtgactaatcctctcacagcttgaaggataaaaggtcaaactgctctggtgaatgcatgatgcctggtcacctctgtagccccatcttccctgacactttcacagacagtattccctttactccaacctgtgggagtattttctaattcacaataatagcaggaaatacaatgtggaccagacacagttctgagcagtatattaactcatgcatttcttacgataactttataaggttgacagtagtagtatccctatttcacagagaaggaaagagatacagataagtaatttacatatgatctcacagatagtaagtggtacagcttgagtgcatatgactcaaagggtagaggttctagattcttaatcactgtattgtactacttctcccaatgttatcgtacatgccattccgtcttcctggaatacccttcgtctttcttcatctaacttccactcaaactttaaggatcaatttaagcatgccttattttaggtagccatggttgacatcagcctaatttaattgctactcatctatgtccccatagcgtcctttgcattcctctatatctctctgctatagcagtaaatgtaccaccattccgtaaaatccttaagggaatgtttagttttatgttcccaatgccagcacaatgtccagaacagtgttgtcccatagaaatgagagccacctatgtaatcttaagtattctagtagccacgttctttaaaagtagaagtgaaactaatattttattgaccctgatatatccaacatattattatttcaatatgtaatcaataaaaagtattaataaaatttgctttttccattctaagtctttgaaatctggcatgtgtctttcaattgcatcccatctcaatttggacaccgtattttcattgaaaatatttggtctcacctgcacacgtatgtttattgcggcactatttacagtagcaaagacttggaaccaacccaaatgtccatcaatgatagaccggattaagaaaatgtggcacatatatatcatggaatactatgcagccataaagaggatgagttcaagtcctttgtagggacgtggatgaagctggaaaccatcattctgagcaaactatcacaaggacagaaaaccaaacaccacatgttcttactcacaggcgggaattgagcaatgagaacacttggacacagggtggggaacatcacacaccagggcctgtcgtggggtggggggaggggggagggatagcgttaggagatatacctaatgtaaatgacgagttaatgggtgcagcacaccaacatggcacatgtatacatatgtaacaaacccgcacgttgtgcacatgtgccctagaacttaaagtataataaaaaaaaaagaaaatatttggtctctatttacatttcataaactttatagttgaaaaaagaagattcacattcctaagttgttccaaacatacacaaaagtttttcaataactgaaccaagagtcaatttttaaatttatatttaaatttaataaaatggaataaaaatttgttaaacttcagtctctccgtctcactagcctgatttcaattgctcggtagctacctacagccagtggctcctgtgttagacagagcagcacagccctagaacacagtagatcctaaatcgatgtttattgaagaaattaatcaatgacagtgtagaaaatttgcagtgattatgtcagaatcaatagttctccacccattttctcccacactctcaaaagggccaagttttatatcaccaaatgatattcctcttacttctttctgagcagaaacagttttggaaattaagatctttttcaaattttccagactcggcattttagcagcgtttctatttgtaccaacaatgcctttctacctattttccttgcttcttaataagttaactttgtgcgaaggtcattttgtaggtcagtgtaatattgtgcattaagggcttctaagttttctggtattataagaactccttggtttccttctacttttcagaatggaaaatcctcagagcaattttcatctaaaagtgctgcatttaggttgtttcacaattccccaaccctgagtcaaatataggttggtgtatgagcagcagtgtctcttggctaatcaagagcgtctccttttgctacgctcagtgttagagaaatggagaaagtcagctgggtttagagattaggtgagagactcaggcatatcctttgataagtcataaatcatttcctgtttagaaaagcacatgtttagacacccataaaatctccaaatgaagggtgttttacttttccttcaaaatctcactgggaaaaggtacttctgactttccaagtgaataaaaataatgactcctgattaccatgtatgtttaaactgatttgcaaagcaagtgaaaaagagtctagtgagtagtgataagcatcttttagacatcagaagatgtactgatttaaaggtccgtatcattttataactagtatctattgagattcaaatggttattactctgtgtgaatctgtcttttctaattgtttttacttattttagaatatcgatttgtgaatattaaattcctaagttttccagcaatccagtgtttgttttggatatccagcctggatgcagaatagctgcagaaagttatcacaaattgatctctatattctgtttccgagtggcaattgtcaaaaatttggggtcatcggctacccctcccacccctaagaagttccttgtacttcctctttcaaaacactcacatcattgttcagtgcctcacttctctactaaaatgtaaccaaccacaaagatagggactatgtctttcctgtttactggtggattctcagtatctagcaccatgaccaatgttaatagacgttgaatcaattccagttgttacctcttcacactgggacaaaagtccttgcaagtattctgctgccatttgtatagattcaagccaaatatgtctcaaaacgatattacagatgatctcttcgttgttcctctgacaatttctttcccccctgcattgcttaacttgattgacaatgacccctactacttataacatgtgccttttaggtagtgcacttggcactacattttatgtgatagttttatgatgctaaagactatttgctgtgatgatgctgtgttctcacatggcatatccagatttatttatgctggtgaccaaaggcaggtagttaaccttgaaaataggttaaaatttgaaaggcagcaaatcttagggctagaatttataatttatctttaaggaatcttgaaaccaggtgtgaaggaagggacgtaggctagaagtacagaaacctgggttctgctccagcactgatgttaagagcaagttgcattgcttttctggaccttaattttctcttctggaaaatgaatagattaactggaacaaggaaggaaaatacgtgaatggcttccgtttctgtctcgtttacccctgaaagacatggctagtcagtcagctctgtatcagagcacttctcaaggcaatgctccaggtagctaccactcactaatgagagttagcacataggtaaaacctctttgtcatctctaggctacttcatgtttaagatactctccagctttaaaattctaataactctattagactgaaatttaagaatacgagaataatcatccctcaccatgaagagagagtctgaggaaaaaataatgagaacgaataacccttctcttttactacaattcaggactgccatgaagagccgtccagattgtgaaacatacaactcatgatgtgaatggtacttctttgtttttctcggtgtacaacttgcacagctgttcatggccctctgcttccacaaattcatttctaaatagctgtacctcagttctttgacttctagtatgtctaatttaatacacatttctagatttacgatatataagaaatatctccatgaaggaaaaatgtaatagcccatgcttttcattataatagaattttatgaaacaatgtcttttaaaaacagaaacatatgtactactacttcgcaggacattagcccttgtatataaatcaataatacaaaaaattcaaattaccaaggattagaaaagactgctgtgggatatcttctggtgcaagcatacagttatttatccatttctttcatgaatatttattgatgttccaaacattaggctagacactagagacacatcaataaataaaggaaataggtttgatctctatcttctttgatctgtagtttagtgggggaggaaggaaattaaacaagtaactactacaggttgaacatccctgatccaaaaacctgaaatccaaatgttccaaattccaaaactgtttgaatgctgacatgacatcacaaatggaaaactccacttctgacctcatgtgacaagtcacagtgaaaatgcaggcacaccacatagagtttattcagcatccccaagggaagaaagatcctctcagcccccgttagctgtgatatatcttttccacccacacccagattccatcatacaagcaaacccacaaaaggtacgaaaaatggcacatgtgcgggctagacgcgacaacggcaggtaccctacaatgtccagcatggggccaaaacctacgtgcattaatcactgtgtttgctggtatattctctggtggtgtcaagatattgttgaaaatgccctaaaggcctgcatgatatccatagggtaatgcaaatattccaaaacctgaaatttgaaatactttcagtcgcaagtattttggatatgagatattcaacctatagatggtaagggtattactatgatagtgctacgggtgtacatcaaggtaattgaccctggcttggcaggatgcagaaggctttcccaaggaagccttacctcagctgagacctgaagagaagcaggagttagacaggtcaagttggggatttggaggaggtggagtcccagcagatggaatactatgcataaaggcctggaagtgagaaagtcatgtcatgttatttcaagggactagaggaagcttagcaaactggaggcaagaagatagcttcagcacactattgaaattgtccaggtgagtaatgatgatagtgtaactaagttgtgatacctaggtatgtgagctgaacctatggagaaatgttctaggctagagaatctttaattggatatttaattatcagtatatacgtaattaaaaccttgcaagggtttgaaatggttcagagtaaagttcgtagatgagaagagggcctaggagtgaacccaggaaaatggcaaagtttcaggggtaaataaagaaaaataagctttcagtggagacagggaaatttgcagttcagtagataggagacagactaggttcgtgtgatgtcacagaatccaagggaagagaggttttcaagaaaaagtaacatttagaggtgtcaaatactacaaaagcatcatgaaagataagaccaaaatatatcctattaatttagcaacaaggaaggtattgacaacctttatgcaagtgatttcagtgttgattatggagaactcagtaattacttggtggtaactaaagaaccaagattgcagtacgttcaggcatgattgagaattgagaaagtgggggagcaagtgtaaaacaattattttaagacttttggctgcgatgggaagagagaaagggccatagtagcagaagatggatgtaggggcaggaagaacacactcttaaaagggtagtgacttacacatgtttaaatggcaatgagaagaagatggtagagagggagaggttgaggatgcaggagaaattagagataatcaatagcacaggtacttgagaaggcagaaagatgaaatttagaaattagcttcagataggaaggaaagtacagcttctattacaacatcaggggagaagggaaggaggatgggcatagctactggtagttttgtaagtttggtgaaaggttaagtaggattgttgtattggatttattttttattgaagtggaagctgcagctaaatgcccagtgatgaggaaggtgttggagtctgagatttaaggtgagtggcaatttgaaatagctgctctaggatcctatttaacagagaaaatgttgagtacacaatcagtgagcagttttaagtccactctattctgtttgcagtttcaagtacctttcattgcttctaagtttatgaaaactggttcacaatcttcttgtgcttcttatttctacctcttttccttctgttttctcacctccccagtttaaacagtcccgaattttttacaattaaatatacagcaactgccatgaaatctactgataaaagatactgcaaaatcagtttgggattgggttcattagcttacttattattatcaatcctaggccactaagcaaccttgcataaaatgcataaaatgaggagattctagtggaggatagttttcaattatctcattaatttcaggccatgtgactagtccaaatagatattataggccaagaagagcctatcttgagattttaactcccaggataggttttctacctgatcaaaagaatctaataactattcaatctcttcttaaatggtttggttttctgtgcaaacagttttacccttttagctgattttctaggtgttaaattaagaaaattctctcagatacttgttcatcatgtactaggatccctgatgtgttcagagttgtccaactttcaaagggctttgcattcagagtacctaatctaaaccctgatatcattcttttataacagaaaaccccggattagactgggacagtgtctgtcatgttcatcactgcatctccctcagtatttgtagaatgaatgaagggacaatggcaaactatagtcctaccatcacacttttggtagtgaggagaactgctgtaacttggaagattggagggggaaaaggtggctaaaacaatcatacagtaaactgggctgctatcaagagaaaccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttagtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagtttttaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggagttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaaatattgattattgccacaatttcagagcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaactcgacctttctctctggctgcccttaacattttttccttcatttcaacttggtgaatctgacaattatgtgtcttggagttgctcttctcgaggagtatctttgtggcgttctctgtatttcctgaatctgaacgttggcctgccttactagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattcgttattctagttatacattcttctaaatttttttcaaagtttttcaaaagcaatggcaacaaaagccaaaattgacaaatgggatctaattaaactcaagagcttctgcacagcaaaagaaactaccatcagagtgaacaggcaacctacaacatgggagaaaatttccgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatccaccatggaatactatgcagccataaaaaatgatgagttcatgtccgttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaaattaaaaaaaaaaaaaaaaaaaaaagagaaaccagtgctctattatctaggtatataccaaggttacccactgcttgactctcattattagccttctttgatgttctctggtacttgatgtctttcataactaatcaatgtattaatgtatccaatcatttactcgataactttattgaaagcaaaagcagttgcataccagctatcaagctggaagtgggagatacagccgcagacaaggcagatatggtcccagcccttaggagctcccagagtagcaggaggtttccccttccagtgtcttctctctgcttttcttcaaaaggaaaaggctgatgtgtataatataccatatctctttgaagttctctgattatggattttaggtttaaaccagttcttcatccatgactttataaattgaaaatccaggattttgctgtgttgttgtgttcttgttttgttttgatgtccctgttttctctagatacagttagaaatgtctaggaagaaatttttggttagtatgggagccccacaaagccatttttttaaacataaaatctgtattacatatcaggtatgaaatacagggggaatgaatcatttctccgtaaaggaaaatttaaagtaaatttcaggaaagtgaattctttcccgtttgcattaccgacagatgcagaaactttaatcgtcatttgctaagagggatatggcagataatacacaatagatgtcgtagcaacattcactcgcattctttttttttttttttaaagaaatctttctttcaagaagctattctaggatctttctcatgacagtgtcctagttcttatctttgctacacacaggctcacaaagtgttttctttgaagggcattttgttattggccctcttttcatttttcttttccgtagcaaacagaaccgaaggtgtttactccccacggtgagagggcacctgggtgcacaaacagtggtgtgaaccactggcctttctctgctttccgttccctgaatgtaagaaacaggtgcagtgatcaattcactgcgtgcagtgaaccccaggcagaaagagaacgtcgtgtcacagaccttttgttacttggagagaatgagcgggaagaaaggctgcctctgctgctactgagacccttttgcccattttattgactgctataggttcatctatcctaatttgtctccggctgtcccagtttatccctgttattcttgtgttactttactttactatattttattttattttattttatttattttagagacagagtcttgctctgtcacccaggctggagtggagtggcatgatcatagctcactgcagcctcaaactcctgagctcaagcaatcctcctccttcagcctactgagtagccaggattatagctgtgcaccactatgcccacctaattttttttttttttgaaatggagtctcgctctgtcacccaagctgcagtgcagtggtgcgatctcggctcactgcaacctccacctcccgggttcaagcgattctcctgcctcagcctcctgagtagctgggattacaggtgcccaccaccatgccctgctaatttttgtatttttagtagagacagagtttcgccatgttggccaggctgttctcaaactcctttaactgtttttttatttttatttttaatttttaaaacatattgtagagataagagtcatgctacattgcccaggctgatctcaaactcctggcttcaagcaatactcctacctcggcctcccaaagcacctggattacaggcatgagccagtgtgcctgaccctgtgtgattattattagcatcctggacactctcaaaagtgttcaggtttggacaatgaactataggatcaccctaattacatgagattaagagtagagaccttgaccaccagaaatggtcaatactcaccatatattttcttcctgatgttagaacctggtacttttgggaaatgaaattgtacatgagatatatgcagaatgggcgaagggagcgaaaagatttaaaaaattaagctcgatttattgagcgcctcgagtgcgctcagtgctgttccaagtgctgacagcagagaggtaagttctgttctccagtgttcacctcacacgtgcaagccaggtttgaaaacacactgtctttccttagtatccctccacccctccatgtgactatacgtatgtatcaagtttgtgatatttcacttctgggcttcttttcatttggaaatttaatgtcagtgtatcatgttttaattaataggacatcatgttatgaaactgttgaatcgaatattttccctaggcatcaaattacttgtcagtggaaatttgacatctagatatgagggacaaaagagatgagaaaaataatagtaaagtgttcctaaaggatgctggtatactgtttaggtattttaatgcactgttacaacctaaagtgtcttgtaaagtatgttctttagaaataaaataaataaaacaagacatctctccataggtacaaatccacttgccttcctcaattcctatccttctgtgatgggaaatctctgctgtgacaaagaaccatgttaagaaaaccataaagttgtattgtttgtagatttttttaatgactaaaggaagatattgcaagtagtagaaacaaatagaggaggtggccctgaaggtcaatataacggagttcactgcagaaaagagaaactactctaggtacgttagacacatatcaaagttttggaaaggctaaagtagcaggttttagacttggcttcgaggacagatttctaaaactatatagaactgatccaataagaaactaccatctccggggtaccactgaagcaatgatttcaagaacatactttgtaaataggaactaggaaccaggaggttgaaatctagacgctaccacttttgaagctgctgttagcaactgcccttctccagccaggaagctggagaaagaactttggaactctgatgtaggaaatctcatgtttctttgactaagctcgccaacagaaatagccaaaaggggcagaaaggtgacctatgcctcacttccactttccagatctctcacaagtatacacatttggcaaaacgttgccagatttagcaaataaaaataatgcatgcaacatacttaacactaaataaaaaaagattgtgtagaaaatttaaatttaactgggtgccttgtattttatctgacaaccctaacttattatatcctaattcataatcagaacactagctgcatggaagtctggcaaatacagtttttaatttccaacctgtccaactggaaggatggtaagtagatttaggtgagccagttcacagtattaaccaaagtagattgcctaccaagaatagctaaagcctttctgcccccagacgcttatgctaccatctgaatatttttactttgcattcttatattcttggaaatcctatcaatctgtgattcagattggtttggtttaactcagcttccccttttttttggagacagggtcataccctgtcacccaggctggagtgcagtggcacaatcatggctcactgcaacttcgacatccctgggctcaggtgatcctccctcccacctcagcctcccaagtggctgggactacaggcacgtgccaccacaccccgctactttttgtattttctgtagaaacagagtttcgccacattgcctaagctggtctcagattcctgggctgaagtgatccacccaccttggcctgacaacgtgctggaattacagatgtgagccaccatgcccagcccctctttttaaaatataaaaatctcccagaatgtgaaagttgtcagtctatactttgggaataagattttcaacagatagaagagaatgaggattaaaacataaggaagtttgggagtagaaaatatgggcaccagaaggtggaaggagagagcagatgcccatttatatatctcctttgttgggtgttggacaaatccaggtcttaaaataggaagtatttcttttccgtacttcttgaatctttcatatcccaaaagatgcatatttcccaaatcatataacccaaagtcatgctatcaaaatgatataaatcatccatggtataggttaaatagctatatatgtatatgctggtctgagacatgtatatgactattgtgtccatggaaatttgagtttggggttctggaccatttatttgcaagtgatttttggttagagaactctttgtaagttggggattgcttttacttattttatgagtaaagatgtcaaaaggatgactgctaaatttgcactgtgttaattcactatttagtgagaagaaatattagactagctatgaaaagtaaaactgcctctccaaaaagtcaaagctgatgaaaaacagtcatacaagcacaatgccgctcttcggaaacatggaaacactttttccttcccaattttccctcagattttctcttccgcatttaaaacacttgggtggttcaagtttctaggctaccactgattgtaacagcaaacagtagcaactggaagcagtgggatgttgggagaagtaatagaggtagctgctacccaagttatcctggaggattttccatggcaatgaaatcaggtagtagaagcttggctaactgagtgtaagcaaacagttctactgagaatggtgttgtcttttcaatccgtttatctgtgatggtgatagtgtgaaacaggggaattttatccaaggtttaaggaaggttatttggttaaaagaggatattgttacagtgaagtcaaactttccattaactttttgctgtaacaacagattgaacgtagcatttcaccgtcaacgagtaaagtgaaatttacagattaacttatgtgcctcttttaaaatatatcagatttctaaattgcttttatttcagaggtatgggaggttcactttctctttgaaagtgtacattatttttctagtgtcttacatctgcctacaaagatgttattttacttgaaagcacagtaactatttgatgagaatttgtcagcatcagtaaattaaagaccctcaaatgatttctactaattatagtttaattccgtacatttaatgatattttaaaacacatgagttatttcataactcccaacatcacaaggataaattttattctacaaacaaaatattgtgctaaatgaaatagttcatttaggcaaagaaaggagcacagaaaattagtggaactctctgctgtaagtaacgtagacattacatggcatattgagtctccatgaatattgtcatgttatgttttaaaaaggtgatcgaacatatggcatttaaaagttccaagtcctcttttaaatgcttcagaatctattatttaatgatcatcttggatctcaaaactgatcttttgaaagattttattcgccccatgtgttaatatgatttccctgtcatatgatatgattatctatcaatacttaaaaccagcagccaagtaaaaaatcagttcatatcatttaatgaatactatgagtcaggatctgggtaggcaagctattttcgggtttgagtagttccaaagcttaaaaatcttatattgattttacagtgaagaagaaatagtcttagctactttggaggtttcaaacattgactactcaaggagtatttccttgctttctcaggcaccaggcagtttttcaggagcaagcattcatccattcagggaattgtaacctgtagtttccacttttctagcaatcacacttaaaaccatgagagtaggccataggacataaggagctcagcttctcagggcaagcacatcctttcagctttcacctgtccgtttgttagtgttcacttccgtgctcaaggagtttcttgttgcctctgagttctaagagacagaacgaagggagaagggtgcagaagtctaacgcatgttcatggacttatctctccaataaagagcttgttttatcttcttttatttatttattttttctaatgaagccattagcctcaaacaaagccatggaatcttatcagagtgaaaccggggtcattccataggctggctgagtgagagctccatggcacgatgatgtatggtcactgcacaacaacgcctttgccacaacacatgtgccttttaattacactttaaatctcatttgaagagatgttatcattatggaaattgctctgtaaatgtgcccaggatgagacccaataaaagtttgctgagaagaattgaagacagaggagatgaatcagcagctaaaacattaccatcagacagaattttcttggctgtaggcaaaacagcccatgcaataacagaaaatcttcattgactcagaggcgtattttccctagattattatggggcactcctgcctgtagcactatcacttctttgataagctgaaggaagcgttctgctctccagctcagcgggcctttttctccccaacctcagagccatcatttgaatttatagttgccaaaatgaataatacagtattgcccttgtgttcctgacttcatgcatgcatgcagagcggggttaaggttctttaaatgaaagattgccttctattcatgcaataaagaacacctctgcttcctttccagggtcatttaaaaataactataccgctgggctatggaaagcacataagaaagattcttagggtaaagtcaaaatgctcttttctctacaacaggcattgtctcatatctttgtgtagcacagctgatttgaagttttcttttaagcacattcttaattatcttttcctttgatcttgaactgtttccctgggctaccagacagagagcctagagccctacctccgctttccccgaggtgcaaactgctccgtccttccacaggcaggcccctggctgaatgcacccttttctccatggttacccacccacctctctgttatttgttacttcccaagtgaatggcaggttaaaatgggaaaaggtcaggttatctgaatgtggttagagtgaaatgaatttcctcattgcacccaagaactgtcctttgacaggtctccttccccaaatcgggtcattttgtacgtaggctcactgggagtaattctaagacaactaaataagtaaaatcacattttggtgccattttccaatgtattcttcttcttgggggttctcctttaaaatggtactggaaggatacgttgtcttcattaatccattgtatgtcccgggggtggaggtggaggtggcagtagcagaagcccgtgaagtaataggtcgtattttgtgtttataaatatttctgcaggtttttgaggagaagatccatcattcttataaaggcattcatgacctccagaagattaagggctgttatgctagaacagtgtttcattcttaaaatggggtctctggactagcagtatcggcatcacttgggaacttctaagaaatgcaaattcttgagttctaccccagacatacagaatcatgatctctcagagtggagcccagcagcctgtgttttaatgagccctctgggtgattctcaagcccactcaagtttgagaaccactgtactaagggaactactgatgcatgatgcaagttcacgctcacaggcacgtgtgaatgacacaaagaacacagacgcctgagagagcaagaaagacaacatagactgtctgactccctgctgggcccttctttaccgcccctatttcaggctaccatgcccatgagtggatgacacgtaccccccgacaaaggtcaacaccactctcccttccacaccctatcactaagtgacaggctaagcctatgttaaactgctcacatctccttggaaattcaacactttaataataggtagcattatcacccccatcttcttctctaagccagaaacccaacttgcctccctatatgttatccttgcattcagtcagtctctaagttgtattcatgatctctcaaaaatatctccctttttctcatcctgtgtctattacctcagtttagatctccatattctcttgcctctaatgttcttgcctctaatgtaccttttcactgccaccaagatgatgttaccaaaaaatcttaaacagattagacatcttcacaggataaagtccaaacccttagcttgatacacaagccccttcacaatccaggccctccttcctgtgcagctatatatatatatatatatatatagagagagagagagagagagagagagagagagagagagaaattttgatcttaccactctgtctctcttcccgccatgggtcttcccctcttccctccggagttacttagctctgatgtgtattcttatctcgtcttatcttcaacttcattcatgtttttcccactgcttcaaatttcactctcccacttctcccctggccagctgctactcatccctcaagaccctgatcaaatatcatcacttgtatgatggcatctgcaaatcttggggggcaaggctaattgttctttgttcccacagggctgtgttccagtttaacatgatcacatgttattttggttcatttatttgcttaagactttttcagaaggctatgggctctttaaaatagagaacttacatcttgtagttttaagagtatttttagtaaaagtttagagtgacccccatctttctgccagcccacaaaaggaaaacatcaaaaagtgaatgtgtaaaaggaagagaactctgacaaaaccaggcagaaaggtttttcagcaagtctttttattttctgttcaggataacattaataattatccacgttggtttctcattctcctgttggtgaatatttttctgctaaatttaaaaccgtatcacaaactcaagcagagatttacaacatttcaacagcttttctacccctgccttagaagggtggatcaaaaacatttgtccatggtaaagcactatggacatgacttagttaacaattctctgtttgggtcaccatgaggcttcttcgtttatactcagggtcagcgacaatgctgatatgcagctacaatttctcatttcttactcagggtgttatgaagcagatttccactgttctttaatcgttattaaaatgtagtccaggtgcagtggctcacgcctataatcccagcactttgggaagctgaggcaggtgggtcacataaggttaggagttcgacaccagcctggccaacatggtgaaaccctgtctctactaaaaataaaaaaactggccgggcatggtggcaggtgcctgtaatcccagctactcaggaggctgaggcaggagaatcgcttgaacccaggagggggacagaggttgcagtgagccgagatcacaccattgcactccagcctgggcgacaagagcaaaactctgtctcaaaaaaaaaaaaaagtcattctcatgtaaaaattcttgtaaaataatctgtaaagtcatcctcttatctgttctagttcttcataagacttatataacatgtcatatgggcatggaaaggcctaagccttcccaaaccttgctcttttggggatgattttccaaatgtacttgttctcagttgaaaagagcattgcggccgggcgcggtggctcaacgcctgtaatcccagcactttgggaggctgaggtgggcagatcacgaggtcaggagatcgagaccatcctggctaacatggtgacaccccgtatctacttaaaatacaaaaaattagccgggcgtggtggcgggcgcctgtagtcccagctacttgggaggctgaggcaggagaatggcgtgaacccgggaggtggagcttgcagtgagccgagatcgcgccactgcactccagcctgggcaacagagcaagactccgtctcaaaaaaaaagaagaagaaaagaacattgcatcatggcacaaggacacaaaaaataccctggacctgcttcagtgagatggtctaagggtctctagcatcttctgaactgaactgaatgctttgggaagaattaatagatacacgatgtatattagttcgtttcacactgctataaagaacttccctgagactggggtaatttatttaaagaaaaagaggtttagttgactcacagttctgtgtggctggggaggcctcaggaaacttataatcatggtggaaagcaaaggggaaggaagcaccttcacaaggcagcaggagagagagagaaagagtgaatgggaagagccccttataaaaccatcaaatctcatgagaactcactcactatcacatgggaaaacagcatgggggaagccacccccatgatccaatcacctcccaccaggttcccccggattacagttctagatgagatttgggtgaggacacaaagccaaaccatatcacaatggaaagctcatgaatgggttctaagaatgaggaaatgtaccttagcattttgcctacttttcctttatgacatttttttcccggcaaatatgccaaatattacctacctttacatcagtgtccacatgcatatcccctgtcttcctccttttcctcatacattaacaaaagagtaactttgttttctccccatcactgttcaccctattgtataagagaagaaaagcaaaataggatgaaagaactatctaggcacacacacaaaagtcacactctccagaagaaagaatttgctctacttggtagtagacagaaattaactcactgaagatcaccagagaatcagatccaattatatcagcaggactttagtttacatcatggtactagaaccttctttaacattcaaaacttatgaatacctagaaatagttttaaggttaatatctctatgctgtgggctaaagagtacccacaaatgaatacagttgtgtctgatgagtgtctgtgattattttggaaattgtcctgctatttaaaatgaaaaaaatagaaatgtcttagattttcctatcattaacctattgtaaacaattacatcagtgtagggttgttttgtggttgcgtgggagtattttgaggtttttagggggtaaagtgggggatagaatgaagttgttgtttgcatttacaaccctaataattaaaacaagccagagggaattacctacatggctgttgtgatttctagtgtatgatcaaaaataattatggcactttgccatatgttcttgctttcttcttagatatgtgttattgggaaaagatgagacttgacatcaactaattgcttttttctaatatacaaccttgaaccacagtgattctctggaggacaaaaaatagcttagtgacaaagagattccagaaataagagcttttcgagcttttaactctctatgtaatatagacaaattgcacagattaatataaccaaatatgtattggtccatgggaagagagttacctatttgaagaataggagtgtattgtgttcatttagaaccattcagaaacatcaatgatattagttctgagttgactaaggataaatttttaaaagcaatacctaattggaaaattattcagttgttgaccattcctatcagtgctctgaaactaaatatctcacagatgccttaatgagttattataattatgttgctgtgatacatgtagcccaagtcagaagtcacttgctttgtatttaatggatggggaagacactggagcttggagggaagagaataaaaataacctagtttcaggaagatctatgctctaaccctgcttctgccacataacaacaactctatgatttgtataagttactttacctctcaaactcgtggtttcctcgataggggataaagaaggcctatttcatagagttggtgtaaaggatttataagggctgtaagtattagttcctgccctgtttcatccccctaccctacccccacccctcatcatggctctgcaaaaacaaatatgtctcagagttggaaagacccatctggtctttctcagataagggtagttttcttcaaacagactgattcctgcacataaaatataatataaaaaaccaaaagtaccttcaacattgtagacttttcatatgtggttgtctctgtgacttaaatgtacaatctagggtttgcatgttaaggtctttcaagattactgttggcactgatctgaaagatgtctcatgcaggaaatgctcacccaattatgagcactgaggctgtatagcaatatcagaaataatattgcagcacagtattttctatggattttagatgcagtattaaaaaaagaaaactcagcctgtctttaagactcgttttctctttcaacaccagaattaaaaggcatgccattcttttttaaagtttatgtgcagagccaaatgaatatcaacattagttctccactgggtccacggcttctttttaaaaatatctgaagcagtgttactctacccactttttctcaggaaattgtgtcctttagaactggcacccatatagtttaggaatgcttgatagggtatattttaggtgggagtcacctgtgcctatatggagctttgatgtcaatgcccttgtcatttggtgtcaatggttttgtcattctaatttatttggccccaaggtgtgtgtgtgtgtgtgtgtgtgtgtgtgtgtgtgtgtgtgtgtgtttgaaacacagcatatgtatttttttcttactccttgagaaatagaactttaaataacatttctatctttaaaatgtacttgtgaatagttatcactttcctgaattctaccttccaaaggtaggacaagagaaggatggaattaaatcacacatgcagctatttttataacttatgagcactcaatgatggtagcatccctcttctttaccttctctctgattctgaagccactgctgttttggttcctgtatggctgggactgcctgtccactagacttcctgccttcactctgaccctgctacatttaccctgaacaccatcctcccaataatcattaccagatgctattttcacaatgttacacctttacacaagaagctacagtggaatattatccttacagaatcagataaaaatctccaggcggcattctaagctctcattggctacactgtaccctttgaacctgaacttcctgagaactacctcttagctcctgcctgtagctctggctcccatcttcatgcagtaggtattcgttttcttttgaacggcctcatatcttctctgctagcaggattggagtcatggcagaaagtgagagggggactagaaggatgcaacattaatgaaacctcacaataggttaggcattgggttaggtacttggttgatctactcacatcatctcatctaatctttgccaaaaccttaaaaggtaggtattatcggccctacttatagacatacaataggtacttaatgcacatttttgtgatgaataaatattcgggaatttttgcattgtgactggatgagaagaaactaggaaaaacaagacgtagatgagaaagatacctctcatcttacttccaacctaggagatcttaaatgaactcatcagttttaaaaggtaatcttaagaatggagtcagagggtcacacaaggagagaaagcatcacgtattaccagagttcgggattgcttaaggcggtttgacagtttcctccgggggtaatccaccctaggccaggcatttttaaagattagattttgaaatgaagctttgcacttgggaatatactgaggcaagaaagcatatcccttctccctgctgagagagcatatcccttctctctgctgttgcagtgcttaagtgtgagaattttcgaatgagatatgaaagcaaagacaacaaaccctgcaggataatagtctctgaggactttaataacagccgtttttaaagcaaagcctgtggactcctaaatccatagctgctcgtttaagatgcaacgcaatgcagtggacctgaaaacatactccttatctacctagagcaaccaggctccaagccaaacagcagtcctcaaattaactcttgtttctcttgggacgacaactctgctgcttttaaaggtgttgcgtggccacatatagaataagaagggaaaaaacagtcacaccctcttgtgagtctgtatccaactgcattttctgatctggttaggaacctccggtggttagattagaatcctgataaggccaagactgtgggtccaatttcttcctatggattcttctcgaaaaacttgttaggaaagatccacttcgggtttttttttttttttttttgcgcttgttttaattcccaatccataatagactgatacttttgtaacatgcaataaaaatgaattattttaaaaattacaaataccagacatacaaaatttaagccgatgctttttatttttagattgctgtacacgtttctaaagatttgctttcaatttctgttcttatgtcttcataatagaatatctgtttctgtgtgtgtatacgtatgagtgtatgcaagtgtgctccaaaagctctactatttagagctcatgtttaatgagtcatgttggataaccagtctaagggagttctactttcatataattgtttttgttttatttttatttaaatcattaacaccttttcaaaacaactgtatcaaataacagtcatttggtcatttgaagcatttacatacactgctttcttcttaaacagattttactgaatgtaaatctgctttccctggctaattcagcatcatcatcctgagcattaactattttgcttcgctataaaacgaggtgatgccttcaagggctactgatgcatggagagctgttagtttccacactgtgtgaccctggtcaattatgcatgcccatggctccttttacacctttctgattctctgtaaggtgtcacttcttcctactctcaatttagccacttaggataatttctttactattttgaattgtatgttcctgaccttctaagttcttagaaatcagaccactttttttcccatcaagctaatttaaattagataaaaattatcagtaaggaggaactaatggccttataattattcatatactaactgctttcagaaaagcttagagataatctgtctataataaaattcttaaggagatttggtcacttattgttattctttctacaccattgtgtttgtttccttacttctcagctatattaaaatggggaagttttcatttgctgagtcctattttagagaccaataattccatttacataggaaaggaaatatgtggatacgattattcatgatgttctagaatagtatcacaaccatctgcttaatggttaataaaatggttaataataaaaagaagggtacagcactaattcttgacatctcccttctttatttttcttctagtaaaacatccataacttttcctattcttccccagttgtattattacttatgaacaccatggatcattctactttttgaatgaaatagtacaaatttaatattcgataatcttgtctttgtacttttctttctaaacttttattctcggtggcttcctaaaggaagactttattctacttggtttaagcagttggtctgcattctacctatttctctcaactctcattgtccattccaatcaggttgtgcaattcattgtccctgctcataaaccaaattcatttcacctttactccattcccatgctattctttttacctggaatattttcttttgttccaatttcccaatcgtatacatccctcaaggctcaagccaagtcctgtaacttcatgaaatctatttctaacatctgatttccacatggattatcttgtaatagtaagccctgcatttgctattatttattaaagatctcttgtgttctagacgctattcaaagtattttacaaaaattccatgtaatattcaaaaaattcagcaggtatgtattattatttcatgtttagtgaaaccaaagtaatgaaagagttttcatcattatgtggctaataagggaaagagaagagaagggtcaaacctatgtctatttaactgcactttgccatgagttttctctggaagctgagaaaggagattcacaacaagagtagatgagactcagataagaaggaagtgtggaatttgaaaaagcccttcagaaaacaggatctcccctactcctaaaactgctatactgtgaacatattgcttgtctcataactgaacttttttggtactctcagctgaaatttgctctataattgtacagaactttaggccaaatgtttcttttatggggacacacattatttgtttcgtttgcacccattttctcaattactttgtgttttctcttgttgtattggatgcatctctatccactgctacaaatctgtttaatagtctttatattaataagaccatgaaattgctctttgtgtgctgacatagttatcctttattttctaatggcagtgctagatttgctaaaatttaggtagtagcattattaataggaaaaactaccaccaacaactaaacttgaaaggtaatatagcctagtggctaagagcacaatccctgaagtctgactgacgaggttctaaatcttgctgcatttattagctgtgtgaacctgggcatttttagttaaccttacagtagtttcattatcttatatggaaaatgaagataatagtagcccctaccctagagggttgttgagaggagaaaatgagctcatgtatatacagtgctttggacagcacctgatgtacagtaaggttcatgtatgttgttgttcttgctgctgctgctgctgctatggtttttgttatgtaacaactaccttttcccctttgttcattcgttattgcttttcctaaagactacaatcacaaaaaagaagaaaaaaattagagagcatacagtgaatgcagtaatgaaggcttgaatgatcttttctagttaagtcagaagtgaaataaaactatccaaaaatttctatgaaaattatcctttgtccagattggctacccactgagaactccacttgattctccatatcaatcttttgctcttttgtgctacctgagtctgaggtgtagtctttaaatgatgagtttattggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatgcaacttacaagggatgtgaaggacctcttcaaggagaactacaaaccactgctcaaggaaataaaagaggacacaaacaaatggaagaacattccatgctcatgggtaggaagaatcaatattgtgaaaatggccatactgcccaaggtgatttacagattcaatgccatccccatcaagctaccaatgcctttcttcacagaattggaaaaaactactttaaagttcatatggaaccaaaaaagagcccacatcgccaagtcaatcctgagccaaaagaacaaagctggaggcatcacactagctgacttcaaactatactacaaggctacagtaaccaaaacaacatggtactggtaccaaaacagagatatagatcagtggaacagaacagagccctcagaaataatgccgcatatctacaactatctgatctttaacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatgtacaagaaaaaaacaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcatttaaaagtcaggaaacaacaggtgctggagaggatgtggagaaataggaacacttctacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaaaggatgagttcacatcctttgtagggacatggatgaaattggaaatcattattctcagtaaactatcacaagaacagaacaccaaacaccgcatattctcactcataggtgggaattgaacaatgagaacacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctgcacgttgtgcacatgtaccctaaaatttaaagtataataataataataaataaataaataaataaataaaaaatgatgagtttagacaaatatcattatggtagtattatattatgttatgttatattatattatattatattatgtataatgtatattccttgcagcctgccctgcattcccaatctatgactcatgctgccttattgatactgaaaaatctccactacagcatgccagcttttgaaagagagccttgggttctttcccaatacttaccttccttttagggcaacctatctgagtcctgtagcttgaaagatttcctaccagcctgccatcccaaaggaacatggatgaactatgtttatgctgatgtgtcaagtcatttcttggtatggttcatagtagtccacatggctcttgtagacaaagagatgaattactgatggcagaatttctgttctggcaacagggaaatttgcagaaaggagaccttttcagtgtgaacattttttgctcacaggtggtccaggatgcccaatgctaaatgagaagtgaaaagagcaatcagggccaggtgtggtggctcacgcctgtaatccaagcactttgggaggccaaggtgggcggatcacgaggtcaggagatcgagaccatcctggctaacatggtgaaaccctgtttctactaaaaatacaaaaaaaattagccaggcgtggtggcgggcgcctatagtcccagctacttgggaggctgaggcaggagaatggcgtgaacctgggaggcggagcttgcagtgagccaagatcgcgccactgtgctccagcctgggtgacagagcgagactctgtctcaaaaaaaaaaaaaaaaaaagagcagtcagaattcaatttttcattcagaacaaatcaatccacgtgggtaaacattttatcaaactcaagaatgctgtctttcagggtgcttttccctcaacagtcacttatttcctcttgcaagtagtatcttcgttcaggttcagtgactactgtgtattatatccaatgcttctggcaagtgggttggtggaggcagcccaagatcttctagaatcaagagaattggatccatttcccagttctaacacttatcagctatatggcttttaggcaagtcagttaaacatccgagtctcagtgctctcatctgcaaaacagaaaatgtgatgtacttcacagagccagggggaggaataactaaggtggtacatttgtacgtgctttgtaacctgtaaagccctttactgtacacgtgtcatttacagctctgtatcaccatcatgacctagaaaagcagtactgacagaagacttatcttcttgccaatgctaagataactttagccatttctgcatttctaaaggaaggagtctttatcccagtatctatgaagacttggcaggaattgccgtcaatatttagttggtaatataaacgaattaaacaaaaatgcacactaggttttaggaaaattaaagacagaactatcatttgtactcctcttacatttcccaaagtgctaaaactagacaataaatcagtcctcaataaatgcttgtttatcaattttatattcatttatttgttgataatacaacaaagatgtttatatgcagtataatatatatggcaaagatgaaaagtagcaaattcatgaatcaacatcctatttatgcttgagaagacaaagaaagtgttggtgacttcatggtatacataaccttaaggagctcgtgattgagcctgggtctctgctatcaatgtaggatataaatttcaaatgtactatcctttatatgtatgttaatgtagtaaacatagaaaactgatgctactagtgagaatacttttacttgaacaactaaaagtttgtctttaatcccctaagtgcatacacaaaaggaaagtactgtacaaatcaagtacaacagaagaagtaaagtaaaagacaagtgaaggaattatctggaacttagatctggttggctttttctcctgaagtacttagataaattaactcacttttctcttttgctgaagaagtgcaaattaggcaggcatgttattccacgtaggcaaaaggaaaaaagaaagaaaaacataaaatggctatatatttgaccaaacttcgttctgcaagaatcccaatactaaccttctaccatataaactactttcaaaatcaggctatatccttccagtacaaacctggtttgtactactcagagatactactcagaaatactttcagtatttcccttctttcaacttctgatgtgattctatccatattcccctgcctgtctcccagtcaaagagaatgggacacaactctctttagagtccatcagtgatgctttagctgccaaaaatagtgacaatagacattcattgtctgtctaccttacttgttcaacattcagaattctgcatcttaagaggctgtggctgaaaacttgagccagttcttcagaatttctaacatgttatttctgccactttttctcccttactttagcagagtaatttaattcaatttgagagagagagagaaaaaaaaaacttttctagttacacagatcaatccaattgtttggagcttcagaatgaatttttaaacttgttgaacagaagcatacaaatctctaagagcaagtcagataatatacaaagcctccattcattgtgtaggcagaaaggaatgctggtacccggcagctctctgaggaatgttcccttggctttgactattctgctgggaacaaggaaggaaacacatatataaaatgaatttataatgtctctggcttgtaatggcagaatgataagaaaagttggctgtttaatataaactgtcagttgcatattccaggcctcctctctttgaggttcctcccacatccacacgcctggctactgtttagtgcggagtacaaagtggccgtttattattattgactggtgaggcctgtgctccaaaattcattctgtcaacagaatgtaagcaaagttggcattttaaagcagggctctttcagtttctgggttttctcaggattgctatgcaacaggatcagtgctgtagtgcccggttcaagctgaaaatgttacacaggaagacataccatgtaaaggtcagattcttctactataataattttcttgatctgtgtgtatacaagtgaagttgaatgcataacctcttatcataactcttaccaaggtcctatgtactttccacctgtcaagcctaaaaatgtgtattaaatgggaaatcaaaactaataaatgtatgatgctgtactatatgtatgatgctataataccaaggtgaacttaatttgtgttgtcaagaagattttctctcccatgacagactcccaggaatgtgctggtgctgtgggccaagtgcaatcttgtttattagtctctccacgcttttatggtcagagttaactctacagattactacgtaaatagaaaatatgacttgatccatatagtaatgaaattattggcactggggtacactttatcatagaattttattgcctatcacttccataaaataatacattttgtccatagactagaagatataacttgtgaactttataaagttataaatacattactttccaactcataatggcaaggaataaatctattacaactaataagatgcccattttaaatctacataataacaggagaaggcaatacgccaagaaaagggatttgagatgtatcttcttgttagtttagcctgattgaaatgtcttttgaactaataattatttatattttgcaattctccaaattcacattcatcgcttgtttcttttgtttggtaattctgcacatattcttcttcctgctgtcctgtaggacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtaggaaaagatgtggagcaaaaaggccacaaatgaattaaaatggccaaattttcctcattgtcttagcacaagtaactggtatctcacatgtctacgtaaatcatccaatttcagaatgattcactgtattttgaataaatgaatcatttatttgcttggtatggagatgatacttgaggattcagattagattaaagtggtaatgttttataaacataggagacatgcatattaagacatcagagtgaatttaaatgaggagtgcagctattctagtttcataaatttctctcttggcatatcacagggttatacaaaaagtgataaaaaattaacggatatgtattatggaattatttttggcattagtctaaatgcataccagaggacagtctttaaaaccctttataacacattacaattatataatataaaacctgtaacacattataattaacagtttagaggagatagctcctacagttaaagagagactatagcaacttcctgtcttttgcttcctctcagattttgttaaaacacatcctctgtaaactaagcttttagttgtagtatactcacatactttatattttgcccccttctatgtgccagctttctttggagaagttagttaatggatgcatcatagcatctttgtaaaaagggcagagggaagttcttgttataccagttttgcaatagttccgtggaggaacaaaaggatagagatagtaagtaaaacgcccattgtaacttaaatgatctagcaagggcggggaatgaaagccaggcttcctgctttctaagcagttgcctttcttaattcatttctctttattaaaaatattttgtgctttcttctgtgtctagagaaaaagtgataatgaagggaggtagaagatgaccaaatggacttaataatagttatgggagtatacactaaatgacgggagtagttactacctctaggtagaaagattacagaagggagattttttttcttctttatagttcttctaacttgtccaaaattttaacatatatacttctataaggaggaaaatctgcatttttagtaattcagaagcactattgtaaatgtctgcatcaagtatgaaataatgatagcaactaatatttacatgatgtacctacataccacgcaatgccataagcactttccattcattgaccggtttaatgctctcagcaaccctaagaggtagattttattattgaattctttttacatttgaagaaagtgaggcacagagaggctaaataatttccttagggtcacttagcaagtggaagatacaagatgaaaacagggagtctgggtgggccaggcgtagtggctcacgcctgtaatcccagcactttgggaggccgaggcaggtggatcacgaggtcaagagatcgagaccatcctggccaacatggtgaaatcccgtctctaccaaaaatacaaaaattagctgggcatggtggcacgcgcctgtagtcccagctactcaggaggctgaggcaggagaatcgcttgaacccgggaggtggaggttgcagtgagccgagatcgcaccacttcactccagcctaggggacagagtgagactctgtctcaaaagaaaaaagaaaaaagtaaaagaaaaagaaatcagggagtctgacttcagagtctgaacttttaaccaccatatgataccgtagcatataaagaaagaaggaaacttctacaaagaaatgcatactaattgaaaggatgaaatagagagtagattttttctaggagtagaaaaggatttgtttttatgagaagtagattgctaggagtagaacaggtttatttttatgtataaggttttgttttgttttgtttttcacaagtttgcaccctggcttcccagacattgttccttatctccctattttgtatatgaattttgtgtcaacttggtggtggtacactgggagcaacaatggcaatagcattttcaaagatagggaggctctattagctttctacagcttaaactcttaagagaggtcagtatgtgtgatgacgtaggccactttgataaccttcgtcattaaaaaagaatgaaaatgtgagatggaaaaaatattggcaggtcaagttaagttattcttttctgcacaaaagaaaaagaaagatgctataattgttccgagtatcacttagtgccttttctctgcctcatgtgaacttgataaaataaaaggagaattgaaagtggcaaatagcatgtcagccaaaatatggactcttcattctcagcagtttcccatgtcagctaccgcagtttgattcttgctgtcattaatcaggtagaaaacagttagcttatctaaggtgctgccaattctagaatttaaatattcagatcaatggttttggcttttatataggcctatgtaataatacaggatatgttataagcactcataaaaagcaaagaagtaattctccacatcaaagcaatttagcttatttcctgacacttgattgaaattagggtattgatcaatctacagcaaatggcagggttcaattgagagaagtacagtataggcagtaattagggatgattatgaaatagaatagaataacactggaagagttagatatagaaccattagtggcactgataaacctgcattatgaatcttgtcacttcttccatgggggttattttaaaatgaaaagttgccacaattaaaaaatagtttcaatgatatactggaaaaataggcctgtgtttgcccaagttataacatattataaaaaattacagttggcccattgtttggtgagcgattctgaaactgctcttatatttcaaaaaaataaaaccattaatgtgtccatttttaaagaaacaaaattgaatttaaatccaaatgatttcgaagtttccctttgtattccattggctcataagagatatccttgtgcttccaaatacaagtccatattgtatcgttttccttccatttatttttcttctgccatacatcttttctcttcctgtgattaagattcttatttaagtcatcatgttatgccatattgatacatttgcaagaatactctaccttggacgctgtttatatcatattactcttttgttcaaagcttcaatcttgtaggtctccatatctccctcattcatttatttgttcattcaacaaatatttaatgaatgcctactatgtactaggcactcttctgggcacggaggatgcaaccatgaataaaacataccaaaaaaaatcactgctctaatgaagttatatttaatcattagaatctagtagaaccttctctctctgccaactgtgcctaataagtccttgctaactccttcccttctcttttctttttctgcctccagttcctttctcaccaagcatcattctgttactccccaacatagattctctgagccaagagaatcaataaattctattttctaaccccattcctactctccaacaatttcctcactctcccatatgagtatgtacccttgctggttctcacacttgcaacattctctttcctcttattctccaaattttgattcatattccataacaaatcttttcttttctggctgtttcctcactaggtcttcccaatactattctaatttacacttgataacatgtttcttcaagtgttcaagagttgctttatagggctatgcttactgcctccagctaacttatatgaatacaaaaatttcaaactcgaaatatgtgagtatggtagagtagaaagacatgggccagcagctgggcaacccagtttcccttctgttctattctgtcactaactgtcttagcatataatcttgatcaagtcacttaactgcttcagacttcaattttctccttcactgaaatgaagagtttgaccagaaatatggacagtctcttccagttctcttgcaatcgtacaattttattcttttagttctgcaatcacactttatgaacctggaaaattgtttaatttttctaccttggttttcttaattaaaatagaactgattgatttaaaaggcattatataaagtaattaagatgtctttgagagaaaagaaatttaattgaaattgtataatcctatctcataatttaattcaagaaaagtatatgctatcattccacatgcattattacatcacatgttggccaagaggtataaggaagaaaagtaagtagtcagtgataatttaagttccatcaaacaaaacgaaaacattaactgctttaagtgggagaaaaagagaaaattatttacttaaatgtacacacacatgcatacacacacagttactgatgacgttatccaatattaagatggtaattagtcaaagaaagtgtttttcattctaaaattccatatccacaatccttgcatttttaattttagaatattaataacttgagaagtggtcaagtcaattgttttacataagaaatatatatgaagatttcaatttagtctactactagattatttttccagatcattgtatatactattaactatgaaaatcacataatatgttatcaacataatttcagcagaatttacattatgtgagatttttatatttggcagaaaaatttgtaaatgttatataaaatgttcacatttatacaattgtgaacattaagaggcaaggacactgacattatatagtctgtagaagccataaatctattggggagtgcttgctattagaggttagaatagttagtgtctttgtataatggagaacaaaagaagggcaaaaagaggtggggtctacctttgagagaaaactgcaacttggacattgaatatctctgaccttctttctctctcttttagaatgttaattatgtttggatgttggagttcaagacctgtctagaaaaaaaaaatgttgacttctctttgggattctctctatttaaagagatagctcccattttaattctgtggttctttaattttttttgtttctgaagtacaaattcaaattattcatctgttgatgacaccctggagatttttctcagtgttctcttgtagtagtttcatggtttgaggtcttacatttaagtctttaatctactttgatttgatttttgtatatggtgagagataggggtctagattcattctgcatatggatatccagtttttccgcaccatttgttgaagagactgtcttttccccactgtatgttcttggcacctttgtcaaaaatgagttaactgtaggtgtgtggattcgtttttgggttctctagtcttttccatgggtctttgtgtctgtttttatggcagtattgtggttctttattatttctgcattcctcccttttctttctgcatgtttaagtgctattttattacatgagggtactaaagatttatagggatatatcattagttttataaaggaagtcaaagtgaaaaatgaattcaatataacacatttcactttaagaatgcatgcctttcagagtaaagttttattaaggatttcaaactaggcattaaccaaatcacagttgaaatatctgtgtctagagaaataacaatcactttatcagcccctataattcttagtgtcctgacactgaggagttccttaaagaccaagcaatatactccagcacatctaaaggctctgcgttttacctaaaccttacaaattgtggaaattatcagctttttagagattagcacttgccttgttaaacggtagtaacccctaagctcttgtcttcactaataaagattaatagacatagatagaagctaagcatgcccctttgaaccacctcttttattttccgttgagtgggtaggagtaagcagaatatatttgacaattagcaatgttaaaagacaaactttagacaaattccgttttgcagagtttatttgagcaaaaaacaattcatgaatcagacagtactcagaattagaagttcagaaagctccacccagcaaggtgggcaggcagtatttatagatagaaaaaggaagtgacatacagaaacagcttgactggttacagcttagaatttgccttacttgggcatagtgtaaataggcatttgccttatatggacatgagctgatcagtttacagcctgtgattagctgaaacttgactgctgggattggctgaggctcagctatttgttacaagaatgtactcttaagttgcatattgcttacatgccaagctgggttgcagtttgctatgtacagagtcagctttaggcccaatttaatttaatttaacagcaacaagcctttttgttcagagatcaaaaacatttggttaaaaccactaaggtttaaggattttctcatctaacaaaggtttgtaatttctatttcccatatctaaataggacagctcaagttatgtttttcagcagctgttttatacctttgcaatcttgatttctacatatgcaaaacaagaaggttgaactataatctctcaggttccttccaaccccaacagcctatgtatgatataaccagaaaaaaaagtcattacaaatacaaagaaacattttcaggaggagatattccacatgcaaacataggttaatcatttcaaaatatctggtatatacactcatgaaaataaaaatagggcaactgcttccgataaatgtattagaaatgtgacttgaaaacatttcacgggcttaacatggtcaaagaaaatgttttgagctcacaatgttccttacatttagatcttcaaaatcaagtcactgacaaatgccacctttgccctgtggagaccaagaagtaatgtttggggcatatcagaaatgctttaataaatgctttatcaaagaatggttctggagcttacctgtggaattgtgaaggttcttgttgaaagcagagattgttgatagaattatagaaagtctggaggtggcacctagcaatctcaattttaaacaagctactcaaatgtttcttatacacactatagtttgagacccagagctttaggttgaatacatttgtatatgctgttttaattcattctctggctgcctttcacctcttcagttcttactcagtgttctctgtcctttgtaagtttttcgcttcagtttttgtcctcctatcacatttttcctttcactcttgagctttaggagaggaaaaaaatgaagcaatttgatatgtagttaggatgatcaaacattctgaaattttatctaactccacagcttagaaaaaaattaaaggaagtccccttacccagatatgtgagagcttttcgtcttttgaggttccaggtccgtcttctgctgctgtattagctctcttgactgtcctctgtccctggcttctaacaacttccctatttcatgctattaagtttctcttagatcctttagaactgaattcccggctgggtgtggtagcttacgcctctactcccaacactttgggaggctgaggcaggtggatcacctgaggtcaagagttcaagaccagcctggccagcatggcgaaaccccatctctactaaaaataccaaaaattagctgggtgtggtggtgggcgcctgtaatcccagccacttgggaggctgatgcaggagaattgcttgaacccgggaggtggaggtgcagtgagccaagatcgtgccattgcactccagcctgggtgatagatcaagactctgtctcaccaaaaaaaaaaaaaaaaaagaactgaattccctaggtctcagttattttgctctctcttaggggacctaaaggggttcattgacccactaataatgagtcagcaccatttaacctagaactggaattttagcacttccttacataaacaaagccgcagcttgaggtcttaacataggcagcctgcccttcactatatcctcctctagacctctctgccacaaggatattttgtttcctctaccaggcagacagaggccaaacattagtcatcgttatattctctcttcccttcctctctccctactccccaatgtatcctagagacttaggggcagtcaataaatatttatttaatcagtgtcttttctaccatttgctgcttttccatgtctgagccctacctctctccacctacttttcaatatgtcctgcttgacagcctcttttcactctcaaagggaccaagctgtgaattccagacaccccaaggaattcgtttaaccattacacattacatgctattaaacagctaaaatcttgcatggggaattgtcgcttaggcttatcatggaaaagtggtaactgaaaggatggtacagaaacataaaagaactgacctctaattgtatgcaatctgcatgcactattatattcaattcatgacatttatggtatttcacgattcagttcttgggaaataatacccttagagtctggaacaatttaatttatcttatttgatggaaatgccttcatttttcctggacatattgtttatactgcaattatagaaagaaaatcttgacaatttggaaaagtagaaagattaagaaataaatcacctgtaaatctacctctgagggataacctggttgtcattacaaaattttttcctagtcaagcatgtgcatacaaatacatacacatacacaaatgttttagaaaaattcaaaaaatgtatttgttttgtaacctgttttctcatttagtaactgggatgatgaccttttccatatccataaatatttggctatgtcatcatattgaaccttgcaaaggattttactgtatgaatgcaccattatatatgtaataattcccttttaaattaagagctatttaattaaattcatatataaatttcattaatttctaaatttaaagcatatacaagtttcattacatttgaaaacaatcagtaggttggggttttgcatttctcaagcaattccctcatattgaatatttaagttgtttctgttttgttttatcaatcataaatgatgctatatataacatttttccacctatatctttgtatctttttccaatttctttgttagtataatttccttgaatttaagcctgtgggtcattgtctttgcacattttaaagacttttatgtattgtcaaattatccttcagaaagtttggaacaatttaatttcagtagataagtattctttggtgattctgtttgactaaggccaaaaggagaattgtatttgtaatgtcaagctaagttaccaaatggctaagggaaatgttgctccacctggttgctttgctttacatttcaatctttgcagcgttaaagtctttattatatttatgttataggtagcgttattatgaattaattagtaattgctgataatagctgagtgattgagcataatttctaatttacctgaagataaagctttgctaacactgcgtttcctctttgttttctggatgatgatttattttattaatttagcttctcatcttcaagtgaaatgtggattttatagcacagatcattcatttgtgtattcttaaatggcttctaaggattaacgtgttctaaatacagttgacggtaaagcactcagtctcctgcctaaattattcatgttcgggggaagctttcagataaatgtctgattttactcttccatgtgagttgttgtcttagtactttttacacaaaggaaacaaagcagaaaatgttgaaacttggtgaagacaaatcccaggtgcacacaaataaagaagggtagggggaaaggagacgcatttgggaagaggagcagaaaggaacagacgccagatggaagaactcaatggaaaaggctgcctagggtgtagaaatggaaaagtcaaaatgtggggagagacctttccatttctcaaggcaaaaagaattccagtactagcatgagtcacatgaaaacgaagtgtttttcattagtcactgcatccaattttttctaccagaaatattaagaattgttgactacaacagtatggaaaagcaatagattccagtgtgtatttcatgccaaaagtctcagcattctgcatgtggaaataaacatatggctaaacactgccttttctcaaaattgccatcaaactatcctctgttttgtggctctcaaaagtaagtagccagatttttattcaagactgctttgtagttcacaataggtttattgtactttttcaatggaattgttagaatcatcaattacacttctagatattctgacatggtacgctgctgttctttttcaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggtaggacatttttaagcctcgtgccttgcacatgttaagcacatagtaatccagtgactattttaaaattaattttgtttgaaattaagttgaatagaaatcttttttactcttctcacccaagggtcaattataaataatctaagccattacactgtaaatgtcaaacacatttgtgttaataataccctttaagaaatcgtccatctcttttggctatataaaaaaaagcttttcatgatgaaaaatattgaacatatacaaaagtagacagaatgctataataaaactcgtactcatcaagacatcaacaattatcaaatcacgtcagatcttatttattctatagctcttcccagattgttttaaaacaaatatcaggcgtgtgttattttattgttaatatttcaaaaggttaaaagataggattcactcttttaaggtaatcaccttgctactataatgcttttgaaatatcaataatttcatcatatcaaatatccagtccatattcaaatttccatttttctcatacatattatgcattttttaaactttttctggttttggtttaaataaaaattgaaatcagacccacaccttactttggttagttggtctttttattactttttgtttggaagtaattacagattcacagtaagtttctaaaatagaatagtttccctgtatctttcaccctgtttcttttcatcattatatgtcatgcaactgtagtacaattcttattgtcatttcaacatgcaatcaatagaaaaaatgtacatttacagcacatctcaattcaggctcattacattccaagtactcagtagccagatgttgccagtagctaccgattgaacagtgcagttctatagtttgattgtatttgggtttggctttttttggcaagactgcttcacaggtgttcgtgtattcttccatcatcaggaggtggtatataatgccttgttttctctttttgtgtgatgtttaatagctgttcacgatcagtggctaggggttgcagtgtgataattgcctatctctaccattccttcttcatttattcactggggtaggtctatgaaaaaaatgttttgcacttgtctcctattttggtactcagtatacctttcataccgaacaagcaaaatacgtttcaattttaccaatttttataataacaacttgttcactagcatcctccaacgatgaccaattatttctttgtttgtttgttttatttttatttacatttctatcttctctactaagctctgagtgaaaaaggcagagattttgtcttgttcacctccaagaccctagagtctagtaaagtgtctggtgtagagtggatactgataagtgttttggaaatgagaataaaagatacaagaacagaaatgaatagcaaaccaaacaaattactaccaaataataaaaacttgataaaatggtaccacttttgtatgttgagcatgtaaaggaaagatctctgtggagatacagccaaaggtggcatcttgaggaaaggtcaagggtttatattattctggagaagaggatataggaaattataaaaagggaagagaacatgaaagaagacccagggatctttgcaaaaaaaaaaaaaaatgccagggaaactgccagtttctcctttagccatttgccttcatatatttctgaatattaaattagcttttgtggtagggtgaaatgtaatggtgctatgtgttttaaatgttctgactttgaataaacagccaaaacactctggtgtacatatagaaaagcactcattgagaaggatgggccttttttaaaaaatgcattatgcgatatagtgaaatgagacagaatttctacaaaagatgaattttatgctagttccagaaaccaaagaaaatgaatcactggacatgtgcactaggagtcaggagactgagattctagtcatatttcttcataagatggattctgattgctattttgttcttcaactgtaatatgaggaaattggtccaaataattgctgtggtttcttccagccagtattttgttataaatactgcttcactattcctggttattagttttggttgcttgttaagagtggtaaaatgtctgtacttaacgcagtccttactcaggaatctcatgacaaagaacatgacttggggagatggtgatgctagagttatgagtgatactcaccagaatgaagttaatccgtccccacttggttagtgtgcttgctcagatagctacctgttaacctttcgtgaatttcacaggacttccagcccattgattactctgtgttttatacattagttcctctgcccttccatatttacctccttccaaatacaacttagattcaatcatctaaattttaataacttgttttcaaaagtctgaaaccctttgcttctttatctttttgttgctgcaatctacaaaactccaaaactctagctaaatattccgagactctaactaaatattttctcataccagacaacaatgtagttgtctggtacagtaccttttccggatgaccagccttcagccttccactaccaagacatcactgggtcaatttttttttttttttttttttgagactgggtcttgctctgtcaccaggctggagttgcaatggcacaatcttggctcactgcaacctccgcctcctggttcaagcaattctcccgcctcagcctcccgagtagctgggactacaggcacgcgccaccatgcccacctaatgtttgtatttttagtagagacagggtttcaccgtgttggccagatggtctcgatctcttgacctcgtgatctgcctgtcttggcctcccaaagtgctgggattacaggcgtgagccaccgcacctggccaatttaccttcaaaattgtttttgactgtctactattgttatcatcataattatagaagaccatttctcctaacctttctgcatctactcttgccaccctacaatgcaatctctacatttcagtcagaataatctgtgtaaaaaacataaatccaattatatcagtccttatcttaacactatagtagtcttctcagtgctcttggaaaaagaccaaaatcctcaacaagggtgacaaggcactatctggcttgtctggcctcagcctcctctttcctagatgctcttcccttgctgtttggatgccagccatactgcctccatttactttttccaattctgcgtgtccctcttatgtggggctttaaatatgttggtcctctgtctcaaacccttttacctatacccacccactcataatatcctggttatcatctaataatcctttacatcttggctcggacattgtgcaaacttttccctgttgtctacatttgaccagatctttctttacacacttctaaaattgtctacttttctataacatagcgttgtttgtcatcacgtacatgtgttactatttgataaatatcgactactcttgctaaaccatgtccttcaagaagatttttgggagggggaaagctgtcatttttctactcagcacattccaaagtgcctagtatacagtagacactggttagataaaggaaggctattgagaccaagagcagggaaagaaagaatagagtggtattcccttcttatttacaggagttttctgtttatttctaattaagcatctttttgtaaagtgtgtagagctactttgatgcacaggtttttttttattattatactttacattctgggatacatgtgcagaaagtgcaggtttgttacataggtatacatgtgccatggtggtttgccacacccatcaacccgtcatctacattaggtatttctcctaatgctatccctcccctagccccccaccccctgacaggccccagtgtgtgatgttcccctccctgtgtccatatgttttcattgtttatctcccacttatgagtgagaccatgcagtgtttggttttcggttcctctgttagtttgctgagaatgatggtttccagcttcatccatgtccctgcaaaggacatgatctcatccttttttatggcttcacagtattccatggtgtacatgtgccacattttcttaatccagtatatcattgatgggcatttgggttggttccacgcctttgctattgtgaatggtgcttcaataaacatacgacatacagcttttacttgtagtttggcgcaatgctttttcaagcttctcttggtatctttaagaaaaattcttgacacaaaacactctccttcctcaaacaacatcatcgctcctgagtgctgatgagagaacagtttagtagcctgtttgactcaaagttttgtcacatgtatgtggtagccctttcatatatggactgtctagttagtgatgctcttgaagcctatgggcaaaagaacaatggaaaatccttgaaactggatctgcgtatcagatctcctgaactcagttagaaaaagagaaaaagaacagaatcagtacaaaattccatcaagatctaatagttgacagatcttatatttgtggacttttgttttactttgccatgtttccagaattgtacattgtattgctctttatgggtttcttgatttaattgttgtttgtatagaatccttggtatcaagatgggtcactgtaattgtaaacttattccgcaagtatttagagtgccacttttttaaaaagtcatctgcttactctctattctaaattattaatatcctttgctgatgctttttatggggatacaaatcccattaaaatgtcaatagttgaaactaaaatcaaatgttgttcattttcactttcattttctataaatcaggatgtttacaaaacaggtaatttgtgtttttctttgtataccatttcagattagtgataatattttgtagcaaaatattacatatcttgtactcttttcttgtagagaaaatatacagtcaatatcaattgctgtcatggagagatatatggttcttctgtaggtaaaattccaagatactccacagacatatttggggaccatagtctcactcctcaaagcaattttcacacccatgggagtagatctgtgctccccaaaccagctgggcagcataacaactgcaactgaatggctctcaagactaattaataaaataatgctccagatgcggtgaagtgttataaataattaaagctcaaatatgccttagcaaatataaactgaccaatttttatgtcttttgaatacattatcctggcttttacagttcctcattacttgcctcactagactgactcgttttcaattagtgggtgttattctggtccagatatattttaaaaactgacttcctttgttttacttgagcagtcactaaagtgatatttattacttgtctacttctgtgattaacctagagagagttttaaaggagcaaatcatagtggggaatttctaaggagaactgcaataaaacatcagcttattcaactcccttcctcctaccccaaatccaaatggagattagatcttgattgtaacaacagtgtaggtaatgactttttgtttgcctttttactaatgaaattgtttgtcactaggttttcatctttcaattaaaaaaatctctataatcccttccctagagatcattaaggataccttcaaagcttcccgagattttctggttaagatttagatggaagtaatcaatacatacattattaaaagagtggacagaaagccattattgcttggatgctgttgacaaatgaaaaggcttgaataaagtagtttacttgttcatttgtcaggtcatatattatgcatgttcgatttcttcagaagtcaccacaaagtgagagacaggctgagaaattcaataaaattatcctgaaatcatgttgtagattatacatttatttaggctcattctgttatcagtgctggcctgcttacgtgggatacattttagtatgtatgttagcttgacgagttttctgtgttttctttttacagaaagagaaaatatctttggatgtcatttgtgaatgttaagatttaagtcagctctgtgttaagaaaaatgcgttgttccctatcacctctgaaaaacaaccaaaagttgcgatagagtgattcattcttttttcttttctttttatttattttttctttaatttttttttgagatggagtctcgcctgcagcccaggctggagtgcagcggtgcgatctcggctcaccgcaagctccacctcctgggttcacgccattctccttctcctgcctcagctgggactacaggcacccaccaccacacctggctaatgttttgtatttttagtagagacggggtttcaccgtgttagccaggatggtctcgatctcctgacctcgtgatccacccgcctcagcctcccaaagtgctgggattacaggcgtgagccaccgcgcccggccagagtgattcattctaacattcaatgacctggcctcttagagtttctaaaccacttgactgttagttatatctactctaaggtgtctttttagccgcgttggaggaaatagacgtctttttgatctattcttcatcatttttgtataagtttgatatcctatgcagtcatatttagggatgctgaatagaaatgacttaaaaattatttttagaactgcatttctaggcatttgagtcttctgaaaactaagtctaagtcttctgaaaactagctttatcatcaaaactgaagaactgagtcatctaggaattgctgctttgctttaatgactgtaacaagatgagatgtgaataatttacaaactgacttctctaccagtcttctctctcactttgtcaaaatattttgatgtcctgacaaatactctttaaaacagtatctgcatagtgttttgccttgacaaagcacttttacacacattattcatttaattacaaatgatccccttgatttttttctgtgctcttccttttgtcccccaaaaacattattttaggaaaaattataccataactcagattcctagaatttattggttctttcaagaactttttttatgaagagcctactctatgttaagcatatgttagggaacaaaatgagtctctgcccctatggatgtttagattttagtgacagaaatacatagtaaacccataaattaatatatgaaattatgttgggtagtaagtgctatgaagagaaaataaacaaagcatgaatagagaaagattgaggagtactggcctatgtgaggaggttattttggggtaaagacttgtgtgaggccgggtgcagtggctcatgcctgtaatcccagcactttgggtggctgaaacaggcagatccctggacgtcaagagttcgaaaccagcctggccaacatagtgaaactacgtttctaccaaaaactagctgggcgtggtgacacgtgcctgtagtcccagctacccaggaggctgaggtaccagaatcgcttgaacttgggaggcggaggttgaagtgaaccaagattgtgccactgcactctagcctgggtggcagagtgagaccctgtctcaaaaaaacaaacaaacaaaacctgtgtgagtgagtaaaccatgcaaaaaccttgaatgaagaggattctaggcagaagaagcaccaaattcaaaagcccaatggtaagaacaggttttgagtgttgtagaaatagcaagatgagctgtgtatctcaagggaaataagatcagtagacagtgataggttctagaaagagggaaaggccagataatgaatggtcttgcaggccatagtttggaggtggattttattctgtgagtaaagagacatcactggaagtaaggaaacatcactggaaggctctcagcagggatgatgtgatctgatttatgtgtttagaagttgactcttgctgctatggagaattgactataaaaagagcgaaactgaagacacagaaaaggagggtggtggagtcatctcagaaggaaatgattacttggactagagtggaaatgataggtatggtgaataattatttgatcgaagatatatttggagggtagaattgatagaacttaagatagatagaatgtggagtttgagaggaagcaaagagtcaaggaaaattctgaggtcaatggcttgaacaaataaaataatgatgttgccatctgagaaagacttgggaatgatcacgtttgagtgtatgtgcttagaatgaaccagggttccatttttggattatgttgatagacagacacaaagggtatgattcagatattatttaccacttatacttgacaatctcaaattttggctcagtatcttgagaacatacacaaattaatttgtcacagggttttctaataatccattcatttctactaacatttcagaagtaatttccaaatcttaaagtttaggcttaatgacctaagacctaattccctaaatggccacgggaactagattgagttttcaccagtgatctctcaaggtcagctcagaacttaacaacattattgtcagtaggaagtaacttccccagtgattgttggaagcagcccagccttagaattaagagtcaaacagctgttcaagatgctgtgtgcgcagtaaactattcctccatagtatcacagacctgcaagcaggctggactattctagcccgtgcccttgatctcagagaatacaatctttgttttcaaagacttccagaaaaataaatctcaacacagagtttgttaaacacattttccccttatacactcaaaaatgttttttcattgactataattagatttttaaaaaaaaaacataatttcaggcctgaaatatgttcatttacttttcaattttacatcaaatttattcaatctcatttataaattaatattgttgttcatgttgttgactatctgaaacaatgaatggatgtatctgatacttcaatcccttatcttcacttttattcagaagtggagtgaaaataaggcggagctttttgtcatcttatttagatgattatttagtcaaactcatagaagcagagagtagaaaaatggttgccatacattgtaagggcgagttgttgctcaatggatataaagtttcagttatgcaagatgaaaaagttctagaggtctgctgcataacattgtgcctatagttaacaataccgatttgtgcacttaaaaatgtgttaaccgaggtccggagatcaagaccatcctggctaacacggtgaaaccccatctctactaaaaatacaaaaaaagaaaaaattagccgggcatggtagcaggcacctgtagtcccagctactcgggaggctgaggcaggagaatggcgtgaacctgggagacggagcttgcagtgagccgagatcgcgcaccactgcactccagcctgagtgacagagcgagactccgtctcaaaaaaaaaaaaaaatgtgttaacagggtaaagttcatattaagtgttcttatctcaataagaaaagatgattatggccttttctttatagcccagatacccatgttcataacttctgtaatactagctgtctcaaatgactattaagggaaacctctctttctgttgtttgctccattgcctctttcttcaaatttttttcttccatgaacccctatgaatttgctttagattactgggggcaatattcttgccaccctgccatgtacatcctggattgcttgcccttttccaagacctcgcttttaagttaactgagcattgcttgtcccgaagtgagcatttggtaaaatattcttatgtgtttgagactcaataaatatggtggctctttaaataaagaaggtccttttggtgacagaatatattcagcaactttcttgtcagacatagaaacaatacaggagacataaaaaataaggtagaaataacacaggaacaagaatgatgacgtaggatggcaaaactagtaaatacagatcaagttacagatatgactgttaacatcttgttctatgcctgctcggtatccatttgttgaatgaacagaactgttggatcatcctacatttcagagcctgtctagtgtcctctcatctcctacctaatcctgcagactacagaaaaagccccaagcagcagttcaaaccatggaacttctgagtgtttggacatgaaaatctcctttaagaaatcactaggttgaagaaggcaatgctaatgggaccacttcttgaggaaattccacccagtaactcagcagtgacactcagctttggatctggaacatgagtagacctagaataagatctgtccatttttcccaatttacagcattaattttttcacttatgattcatgagtccaggctttcccctgcaagcctgttttgcatctaaatcaacttggccttcatataacacactctagtgttctaactgggtgttctgtatcttagtcaacaatgtttactgagcatttactatatgccaagctatggctatggtttttaagcatcgataataacgatgcttagcagagactctcaaactgccaccatagagcaggcctgtggccgattaatgatcttaacaaattgattatagtatatgagaactggatgttagaacttagataaggttttagcaaatgcccacattttacaaatgaggacacagaggagcaggaagagtttatcaccttttctggatcactgcagccaggttctggcccagcccaggcttgaagcccaaggcttctgccactcagaacagtgctcttttcaccacttcagcctgcctcccaggatgattctaggaagttctgcttacaaatatgggtagtatttctagtcattccatcagattttattctgaaaaacacaaatttaccatttcaatatgaatacaggtaaaattcagcgccaggcaagctgtacatgattgaaagacatctgtgttttgaaaagcacgggcttttactcacatccatagtaatatgatcctaaatccactgtccccaggagaaagcaagatagcttttctccctgtcatgtcattacctatgcccagagttctcctcttgttcctctcatgaagcaaatcaatatctcacctttcatcccctccatacgtggttctgagctacttctatttatggcattatttagatatttttataatataagcaggaagcaagagggacagaaaaaaataatcagtggccaggtgtggtggctcacacttgtaatcccagcactttgcgaggccgaggcaaacggatcacctgaggtcaggagtttgagaccagcttgcccaacatagtgaaaccccgtctctactaaaaatacaaaaaattagcagggtgtggtggcgcgtgcctgtagtcccatctactcaggaggctgaggcaggagaatcacttgaacccaggaggcagaggttgcagtaagccgagatcgtgccactgcactccagactgggtgacagagcgagactccgtctcaaaaataaataaataaataaataaaaataataataatcaataacttggttcttctctattactttcaggaattttttaagtttctgatttcttccatggccattaggattttccacttatgtggcttccaaattattctaagtcagggagattttatgttttgttatcactcactttcagcttcactttagaattgcaagatttagattcaaagtgtgtaattaactgatggccttaggtaaaccctaacttatctgtatctcaatttgcatggatgaaacattcataatataaaagtatacaccacaaatatacctactcaaccaaactattggctccttaatgacaaagattaagtctctatatctttcctaactttgtacctaataggttcaaaataaatattttttgaatgaacaaattagtgagtcaacaatcagtcacccggttggccagtacctatggtgttttaagtgcaatctaccagataattcaaccttcataataaatagatttatcttgagattatcattgctataatagtgtagtagcatacttcatataagtttattttgtgaaccttaagaagctcaaggacaaacatctgtgtagtattcctaacattttctaaattgcatattttattttcatagaggtgctctacgtctttagtattgcttctaattctctcatatcactattttggacccttgggtctggctgtcttggaaaggtgaaaagaaaggtatggggaagaggatgtgttttaacaaagataattttatctgttcaagggattcaggaagtaattatcttaacatctgaatgctaacatctgaatattgtaaatacgtattctgtatgtacatgggagaaaatatctatatctgataccttttctatcatcacataaaggaactgacttctctggtttaaaatattaaccaaaatttatatgacaaaatcagtatatatgagtatatattttctcaaacctctttcaaacaggcctttttgggagacaagacacttatcaaaatcaaggctcttgacattaaatattcttgtttgtctttttttaaaaaaaagtcttcatttttctttcttttaaaatgcaataaattatactacaacatgcagtttatggtgagttattagatactgaaaaattggctttccattattttaatgcagattctacattgctttttttttactacataaagccatttgttttaagctccatgctacaaagaccacagatgttcattgcctagaacagtgtctgatacatagtagttgcttgaagtttgttaagtgactaaattaaagaggatcttacatataaccatgtttaaaattacatattgttatttatagtttttcccacatgataagaattattgccattttctttaacctctgacctccttgaaccaactatttctctctttttgtgggagttttatccttttgtatttaatctgaatcttttgaaattctaaagatacaatcacttaaccctctcttccatccactttcttttcttaatttcaggcaacaatgtgaaaataatggtgcttatgtctttgtaataacagaactttctttgtcttttctttggcctcattttaatcttcaatgactcatatttaagaaatgaactgtgcagctgtggtggatctaagtccttggcaacaactcgatgggcaaacacgtggtctctcacaatggatgctccttagctttgaattatttactgtccagttttaacaatggaattatatcatcaaatagtgccttggactttttaagtttttagtgccttaagtttttaagtttgatgagacctttaagatccatttccggccgggcgtggtggctcacgcctgtaatcccagcactttgggaggccaaggcgggcagatcacgaggttgggagatggagaccatcctggctaacacggtgaaaccccgtctctactaaaaatacaaaaaattagctgggcgtggtggcgggcgcctgtagtcccagctactcgggaggctgaggcaggagaatggcatgaacctgggaggtggagcttgcagtgagccgagattgcgccactgcactccagcctgggcgacagagcgagactccatctcaaaaaaaaaaaaaaaaaaaaaaaagatccatttccttattttacagaccttgttccaacaattatctccaccttctgtcaaggtcgtaacatatatctagggtgaccaactttcctcgttttcctgagactgtccaattttcctgaaactattctggttttaacatcgaaagtctctcatcctgaaaaactcaatgctggacaaaccaagatggttggttaccctactgctagcttccgtctttcactctaggttcaaatcattcctatgctaaaaagaacttcttatccctttgtcttgttatcctctctgtcctcctgtcgtgtcttcctcttttccttctcagaaaaagaaaattgaacatttgattttcacttgaaatacctactccttcttccactcactcctcagctatgcctacttctgaggcttctgccctccactgaaattgctctcagcacatctagtgaacactctgcaatgctgatcttactttacttctgtgtttcattggactcacttggtcaccctcttcctctcaaaattctcactctctccttgaaatttctacactcctcatttcccctaatctctccacctatttgttccttttctatctctcaagagatcctgttcctctgtttgcccattaaactttgatatgtaggcactcaacgtatattagctgaatgagaaaataactcctaagtattttttttctcctcaaacctcagaatttattatttccttgtggaaggaatgttagctttccaagctgagcatatcacagtcccttactctgtcccccatgcacagaacaccccccccacacacacacacacacaccatcatgttgcatttttaatattactcttcaataattttatcctgaatgagcatgaggggttctgaatcagaggcagatttcatttaattaccttacagtaaatattgttgctgtgcccttcctttgcccaaagacttacccctagggcaacatgatgaacgctgatgaaacattttcctacttgagtggctgggtactccataagtgggagactaggaaaaatcattttttctgcttataaaggagaaggaggctgctatccatctctcattctgaaaggttctctgtggaaacataacaggcctgagtcctaattccagcttctgcagaaaccagctagccctgtgtgtctcatgttttacaatctggaaatgtctccaaggtatgggcttcatattttttgaaatgtaaatacctagaaagatacccactccagtctttctaacaacatagagttcagcttaggaacctaccctgagctataaccgtttgaccctcttggatcagagaaatgaactagacaaattgctacagatctaatctccatggtgtgggaagtttctcaggaggctagagctttctgtaggtgaactgagacatccaggaaagtttatttcctcatacttagttgaattgcacccagcgtttgctcatctactcaacctagacactaagtgtcattcttgtttctttttctctcttctctccagcatctattcagtcaccaaattttcacacttcagatttttagacatttccctatcctatccctgtcatttttcctggtaccattgccctgagtcaaatcctcataatcttgcactgaattcttacaattgcctcattatctctctgattccatttctgttcttctcaaatacatactctgtatttatatcaggaagatctatttgaagcacacatattcctgtgccactcccttggttaaaaccgttcaaaggttcctgattaccttcaaggcaacacctaagcctcttagtggaccatatgtgatcatagagaggcagagcttcaaattctggtttaaaaatctaatgtatttccagatagcaatagtgtctttttcatctttggacatgccctctccttgttctttatgctctagaaacactggcctgcttgagattccgatacataccatactgcactatgtcctatgactctgcacttgcattttcctcttcttggaatgttctctagcatactcttccttgaataagtcatgttcatgcttttgaattctatgtgattactagcttctcctggaagcttttcccgattttcttccccatattgcgcaagtctatagcactgtctacattgtattgaaattatttacgtgtctgactcttctattatatgttaaatattcctaaatagaaagggctgttttgcattcaactttgtatttccagtttcaggtacaaccactgacacatggtagttcaatagagggagccattattatttttataattagtaatgtcagtattaattgcctcccttcaggtccaaacagagaaactaggcaaaatgataatttacttgaatttgggaaacttaattgtatgaaaaaaaacacaagaatacaacaactgaacacacacacacacacacacacacacacacacacacacacacaaacatggagatttcaagtgaaatatcaggagaatcagctttatatgtaagcagagtaaataactcacgtatctagcatgattttagggtacagaaatatcccattattcagaaagtacttccctatctgtaggctgaatcctaatattctacttacagaactccagtattttggttcaaacgccttccctttctctattgaattgtaaatagctgtggatgatgaatcattttgcaaagtatcagactcaggattcttttgaatggtgaacaccgctaagattttattaataaatgtgtcatacaatacagctctggaacacttctgtaacataatggcatatctgaaattcaaggaagaatactgctaatttgtttttccccagtgaaagaacagggcttaaattcagcaggcaacattgctaaaagacagagttgaaaaaagttacaaaaattaagccctagatcagggcaaatattactgttattgttaaacagttatattagcatttatgtagcatgcacttaatacttttattaataccctcacttctgagatcaaagaatctgggtcaataactctcttcaatggtgtcagagtatccgttaggttattctaggctcacggtatacctcacgatccttttagcactcgattatgtgtgaacttactgttttcactctgcttctagtgttaattttctcccttctttggatctagaaactttttgaaggcagaaactattcattttgtttttctcttgatcccctggataaaggaagattacagattaaagattaattctagatctgttcatttatagaaactagtgtccgcaattcctacatccataatagctcaaaacatttctactattctcaaagaggtcacaatggatgatgtaatgactatttttcaaaagtattgagacttttctcttagcttacctattttataccttgtcagacattttgacagaattaactggtgattgtcagttggattcattgtatactttaatatagcctaaggtcctgcaaatggcccttaaggcttcccattatgttctggatatccactatttggggtatgtttaagtcctcattagccatgctagagttttgcaatatataccttgaaactttagctgtagatttgaagtatggctgtcaggttacataaacaaagcactcttatctcaatgagagggcattaactatccagaatgctccccccatctccccagaatagctttacaaacacagcgctttcctcattaacagatagacccatatagcctttaaaaaaaatcattttataaccatcagtgtataaataaaagagatagaaattgacctgggagtttcataaacaagttctgagcacccaggattaattttgagaagaatgccacaagccaaataagcacttcttttcatctcatttcacaggccttcaagagggaattgaaaactaaagaacctgtaatcatgagtactcttgagactgtacgaatatttctgacagagcagcctttggaaggactagagaaactctaccaggagcccagaggtaattgaatgtggaactataataacatattgatagaaggatcagtggtgacggagcagcccatccattcttgctgccagggtctggatagctctcatattttcttggttaaatagaatcaattcaaattaaacatagatgctgaaaaaaaaataaggactcataaactaccatgcataaatcagtttgtgcattcataaataaacatcaaaagagattagcaatcagttattggaacatttagaaaataataaacaaagggagttatctgtgaggaggaattctattgttgcaaagactacaagttaattttccatttaagagcctgcctgaagtaaattagagcttgtggtatgcatcctaacgtttttctcctcaatagcttaagtgaatcttaaattgtcggattgatataaggtagaaactcaggaagatatactttagatgttctgggctgtatcaaaatttatgccaaagtataaaaaagccgttaatcagtaggttaccctcttgttcaactgtactctttctttcttccagtatgacctttttgacaatgtttaaaaaaaaagaatgtggcctaaaaccttgtcatattgccaatttagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggtaccgtctacttctttgcttcagggccctttgagagactcaaaagagcttctaatctgaacttgagtgcagtgttatcttcccacaaagttaaagctagagaaatcagtccgtctttcacaaattcagtcttcattcacatggtattttctccaagagaagacagtgatctaattatttgtctgtcttcagttatatgaaatgaaatattaaaacagttacagggcaagaaatcactttgactttgatattaagtgattgtactaaagtctgatgtgtgtgtgtgtgtgtgtgtgtgtgtgtgtgtgtattggtgtattgcttgtgttacttagtatcagaatacagaaaaataaaacacttaatcaaaagccaggagtctaggtgttggcccttttgctaaccaaattacatgacttgggtaagttatggtttggtgaaataaggctgttaatgtgttgcccttcccttggaaggcaacatttgtaatacagtttcaagtttcattggcccactgcagaaatgagggaaaatcattatatatttggaagaccactgtctataagaccaaagttaaattcccttgtggcacaaagatggcaaatatattctgtagaaaaaaatacatatttaggagtatcattttgaaatcagcaactactcatctattgtcaaaatcacaaaaatcctcctagattaaaattcaaaagaagttaaattccctcatgcactcagcatgtttgccagcatctcagcatcctcattctagaagttgtcctcttccttggctttcatggaactgttccatccatgttcttcttcctatatttttctagattcttctcctagccacccctcaaatactgttgtgcccaagtttctaaccttagcctaattctcttttgattgtttaaaccctccctgtttgagatggcctggatggtgatgtatctacatctctagtccgcatctctcttctgatctctgaatccatgtggcattacgatcacaaatgcaactattctgaaaccaagttcatttgttctcctgttttccatttccctacttctgtcccctcttatctgaccttttttttcctgtttcctatttcagttaatgaatcatcatccaacaaattttccaggctagaaactttaggttcatccttaaacccttctgcattttcactgatggcacatgatggctcatgttacctcagaatagctcttttgtgttttctctcctcttttaaccaatgtcctttttaatccccagcatcttttacttagatgataacagtatacatctttaaatcccattcacccctctgtgtgcctggcatatctcagatactgcattttaaacatttggtgaattaatggatggatgaatggtttctttgctgatgttcctgcattacccagcttcttccaattccaatccaaactccttgcgggagaatacttgcctagagaatgaaatccaatgaataaggagattacgtggcccttttcttcctagccttgacttaccttctcagccatagctcctattctccagaccatttaatacactctgcccatatgatatatatatatatgtgatggcatatttgggaaaaaggggtgatatgggcagagtgtattgaatgtgtgtgtctgtaaagtatgtgtgtgtgtgtgtgtatatatatatatatatatatatacacacacacacatacatagttagatatatacatagtatatatacatatatacatagatatacacatatatatacacatagatatagatatagatatatctgcctttgcaaatgctgttctctctgtctggatccccctacgttgtctacttggcgaattctccttcagccctcaaggaccagccaaaatgttacctatctttgttgtctttcctgagtgtctacaacccccaactcccaccaagcagaagaaactgcttacagttggtactctcatagatcaccaagcatgctaaattgtcacacttaaatttcacatatattgtagcaacttgcttatgcatttttttttctcccagagaaagtgaagttgctaagagcaaggatcatgctgtacatctttgggctgctagcccagggccagcaacatatgaggaatctcattaggtaccttcatttattcactcaacaactgtttatgagtcattatataatgtgctggacaggtagttataaaagaaacagacttgatcattgccttcatgaagcctatggtctaatgttgaattgcatagctcttcattaaaatagtaggtaaaatttttaaaaagaaaagattaaaaatttgactctaatacttgtaaaatcccttctaccccaatgttttatgaccccatgtctaacatttaaagtaagggttaaccttgctgtgtactggaaaactaagggttttgaaatgtattacctagtattttaaaagcattaaatatgttgattttattcaaaaatatagggactaattttttgacagacttctccaaaaatgagaaataagttaggaaaatgtcccagtggaactaaattagttaatatgtcaattaaattgctcaatagataggctgtagagcagacataagggattcatttttagccatacttgtcacacaggtgcatttgtaagatactgagtatggatggagaagagaatgtgtacagcataatttaataattaaaaataactaaaagcataacagttcaagtatcagctggccttcacccaaccctatttgcggtattccttttagtttccctgtcttatctgttcttggtcttaagacaaacttcattttccataccctgattggtaaaactctcattctgatcccaatgatagcaaaacatataaacattaaacatacctttcgaaaaattatatttataacccagcacatctatctttctcagacatatatacacttaagttatggtacttatctgaatttttatgtactggtaatagtagatgtgattgggcttttgaatctgtgttgtattttatgcgtgtttcaaactatgaattacatgaattcatatatatttatctcccttcggtagctcttctttaattttgcagtggaaataaatcatttttctccactgcatcttattgacactgggtttgaaactctgaagctttgggggtagtagtttacaaagaatgagttttattaactaaaatttatttcagaaaaaaagtagaagtgtacttgaaaccactcttcccatttttccactcagcaatttaagccctcagaggattcatgctgtagggaacttttctaataaaccatggtttctctttttttattttattttattttattttattttattttattttattttttttttgcgacagtctcgctctgtcacccaggctggagtgcagtggtgctatctcggctcactgcaacctccacctcctgggctcaagcagttctccgcctcagcctcccaaatagctgggactacaggcgcccaccaccatgcccagctatttttttttttttgtattttttagtagagatggggtttcaccatgttggccaggctagtctcgaacttctgacctcaggtgatccactcaccttggcctcccaaagtggattacagcactgataactaggcagctagctagaagaacattttatatatccatatcagttcattttccttacccctagacactctatcatagtaccccccctccattctgatcttatgtgttaaataacttgttattcaagaaactaagtaatatgtgtttctgtgagatttagcattctgtaattgtattagcaaatgtggcttttggatttaaagaatgggtgaaacaacaatgactaagtccctggcctttatggaaatggcattattgctagctgatcatctgcgggtggtgaacatggtaaattaataaatggaaacacaatattaatattgactatattgctcactaagagaatctcagccttccaaacatagcttccataggaaaaaacagtagaatcaaatttaagttttaaatgcttctttacttttaaaattcatgatttatactgcttatcaaatattttaagggcaagatcatgacttttcactttactgaaaatagcaccagtgcttatttgactagacaaatattctaccttccttgtaatggggaataggaataactttttgaattactaggtgttccacatagatctgtaagtggaatatataaaggctttaataaagtagaataacttttaaacctgtagtctggatacaagatttttgttcttcaggacaatcccaaggtgaaaaggtttgtggattgttgttttctttttttttttttttttgagacagagtctcactctgtcaccaggctggagtgcagtggtgagatctcggctcgctgaacctcctgggttcaagcaattctcctgcctcagcctcctgagtagctgggactacaggcgcgcaccaccacgcccagctgatttttgtaattttagtagagacggggtttcaccatgttggccaggatggtcttgatctcttgatctcgtgatccgcccaccttggcctcccaaagtgctgggattacaggcgtgagccaccgctcccggccagattgctgttttttaatgttttgtttttgttttaataaaccatggtttctctttttttaatttttttttttttgagacagtctcactctgtcacccaggctggagtgcagtggtgctgtctcggctcactgcaacctccgcctcctgggttcaagcaattctctgcctcagcctcctgagtagctgggattacagacatgtgccaccacgcctggctaattttttttttttttttggattttttagtagagatggggtttcaccacgttggccaggctggtctcgaacttctgacctcaggtgatccgttcaccttggcctcccaaagtgctgggattacaggcgtgagccactgcgcccagactataaaccatagtttctctgtaccaaaagtggtatgtccttcttgagccaggaatatttcactgttcttagtttacctgttgactctgaacacagtttttcatacactgtaaataactctcccaggctgccatcttggaatatgcaaatctgtcgcatctatgtagttatgcatatcgcatttttgtcaaacttttaacttgcatttcttactgtgaaaagtcagggcagggattctatgagttttttctttaaagttcctacaatgaaatgttttgattaaaccttttttggcattcaaattgagattgatttaatgatgtgtgtagtaggctagaaattatgatgaagtgacgatgccatccttatttatcttcagcattcacatctaaagttttaagaagaaaactggcaaatccacctttttaggcttaccatcctcagtccctgtggctttgggtttttttgagaaatttgtcaaagaaacgctatgttagaatttgacattgaggaagccaagcatatttcctctgaatagataatgtgaaatgtgatataatgtattagaatttcatcttcactttggcaagcaagatacttgcaaccatgttcatgcaactatcttcccttattgcttttctcttcttaaccttggttctaaagttttcttcttattgtattaattttgttatgcttcccatttatatgagtcaagtcaaccttacttgatttcttatatatgagttatgtaaggaaaacttatcttttcttatagaattaggggatgaatgagcagatagaaccaacatgaacagggcgatcctaaaaatcattcaaaacatgtaagctctcccaactctgaataaacttgtgatatcttcataatgaataaggtatactgcctatagtaggaagaggaaaatttattaatgttttgtgcattgttaaagaactacaaatgaattgccgtgtggaggctttcattgttgttgttgtaaaaatgctatgtgtattaagtaagcctttgatggagaagaaaaaacaaagaaaaaatatttaatccttcataaatctgggttaaatatgaagctaattcctgttatttggagtaaccagggttttatctagtttacaaagcatgcaattgcaatgtttaaaagcatatgatttggcctttaatatctgaaaatatgtctatcaaaggccatattatagcgagtgtcactccatactttataagtacggtatatttttaatagaatgtttatgtactggtgataagagatgttactgggtttctaaaccagtactgtattaaggattttatgctattgtaagattatggattatgtgaattcatatatattgatttactttcagtagcttttcaatagaatatctagggtttaatacagcttagaaactaaagcaggaattattcatctttaaaatcctgaccaaagaagtggctggcaagatggctgaataggaacagctcaggtgcgcagcccctagtgagatcaacacagaaggtgggtgatttctgcatttccaactgcagtacccggctcatctcactgggactggttagacagtgggtgcagcccacagagggcgcagaagcacggtgggatgtcgcctcaccccggaagcacaaggggtcagggaattccctcccctagccaacagaagccgtgagggactgtgccctgaggaacggagcattccagcccagacactatgcttttcccacagcctccgcaacatgcagaccaggagattccctcgggtgcctacgccaccagggccctgggtttcaagcacaaaattgggcagctgtttgggcagacaccgagctagctgcaggcgtttttttcatatcccagcgtcacctggaacaccagcgagatagaaccattcactcccctggaaaggggactgaagtcagggagccaagtggtctagctcagtggatcccacccccaacggagcccagccagctaagatccactggcttgaaattctcgctgccagcacagcagtctgaagtggacctgggatactcaagcttagtgtggggaggggcacctgccattactgaagcttgagtaggcagttttcccctcacagtgtaaacaaagccgtcaagaagttctaactgggcggagctcaccgcagctcggcaaagccactgtagccagattgcctctctagattccttctctctgggcagggcatctctgaaagaaaggcagcagccccagtcaggggcttatagataaaactcccatctccctgggacagagcaccacggggaaggggcagctgtgggtgcagcatcagcagacttaaacgttcctgcctgctggctctgaagagagcagcagatctcccagcacagcactcgagctctgctaagggacagactgccttctcaagtggggtcctgacccccgtgcctcctgactgggagacacctcccagcaggggttgacagacaccctcatacaggagagctctggctggcatctggcaggtgcccctctgggatgaagcttccagaggaaggaacagacagcaatctttgctgttctgcagcttctgctggtgatactcaggcaaacagggtctggagtggacctccagcaaattccagcagacctgcagcagagggttcctgactgctagcatcaacatcaacaaaaaggacgtccacacaaaaaccccatctgaaggtcaccaacatcaaagaccaaaggtagataaatccacgaagatgaggaaaaaccagcacaaaaagcctgaaaattccaaaaaccggaacgcctcttctcctccaaatgatcacaactcctctccagcaagggaacaaaactggatggagaatgagtttgacgaattgacggaagtaggcttcagaaggtgggtaataacaaactcttacgagctaaaggagcgtgttctaacccaatgcaaggaagctaagaaccttaaaaaaaaggttagaggaattgctaactagaataaccagtttagagaggaacataaatgacctgaaggagctgagaaacacagcacgagaactttgtgaagcatacacaagtatcaatagccaaatcgaccaagcaaaagaaaggatatcagagactgaagatcaacttaatgaaataaagcatgaagagaagattactgaaaaaagaatgaaaaggaacaaacaaagccttcaagaaatatgggacgatgtgaaaagaccaaacctacatttgattggtgtacctgaaagtgatggggagaatggaaccaagttggaaaacactcttcaggttattatccaggagaacttccccaacctagcaagacaggccaacattcaaattcaggaaatatggagaacaccacaaagatactccttgagaagagcaacccaagacacataataatcggattcaccaaggttgaaatgaaggaaaaaatgttaagggcagccagagagaaaggtcaggctaccccaaaggaaagcccatcagactaacagcggatcatttggcagaaaccctacaagccagaagagagtgggggccaatattcaacattcttaaagaaaagaattttcaacccagaatttcatatccagccaaactaagcttcataagcaaagtagaaataaaatcctttacagacaagcaaatgctgagagattttgtcaccaccaggcctgccttacaagagcttctaatgaaggaagcactaaatatggaaaggaaaaactggtaccagccatggtaaaaacataacaaattgtaaagaccatcacactatgaagaaactgcatcaactaacgggcaaagtaaccagctagcatcataatgacaggatcaaattcacacataacaatattaaccttaaatgtaaacaggctaaatgccccaattaaaagacacagactggcaaattggataaagactcaagacccatcagtgtgctgtattcagaagacccacctcatgtgcagagacacacataggctcaaaataaagggatcgatgaatatttaccaagcagcaaatggaaagaaaaaaaaagcaggggttgcaatcctagtctcagacaaaacagactttaaaccaataaagatcaaaaaggacaaaaaaaatggtattacataatggtaaagtgatcaatgcaacaagaagagctaactatcctaaatatatatgcacccaatataggagcacccggattcataaagtaagttcttagagacctacaaagagacatagatgcccatacaataatagtgggagattttaacaccccactgtcaatattagacggatcaacgaaacagaaaattaacaaggatattcaggacttaaactcagctctggaccaagtggacttaatagacatctacagaactccccaccccaaatcaacagaatatacattattctcagcaccacatcacacttattataaaattgaccacataattggaagtaaaacactcctcagcaaatgcaaaaaaacagaaatcataagagtctctcagaccacagtacaatcaaattagaactcaggattaagaaactcactcaaaaccacacaactacatggaaactgagcaacctgctcctgaatgactgctggataaataaggaaattaaggcagaaatgaataagttctttcaaaccaatgagaataaatacacaacggaccagaatctctgggacacagctaaagcagtatttagagggaaatttacagcattaaaatccccacaggagaaagcaggaaatatctaaaattgacaccttaacatcacaattaaaagaagtagagaagcaagagcaaacaaattccaaagctagcagaagagaagaaataactacgatcagagcagaactgaaggagatagagacatgagaaatccttcaaaaaatcaatgaagccaggggctggttttttgaaaagattaacaaaatagatagactgctagccagactaataaagaagaaaagagagaagaatcagacagacacaagaaaaaatgataaaggggatattagctctcatcccacagaaatacaaactaccatcagagaatactataaacacctctacgcaaataaactagaaaatctagaagaaattgattaatttctggacacatacaccctcccaagactaaaccaggaagaaatcgaatccctgaatagaccaataacgagttctgaaattgaggcagtaattaatagcctaccaaccaaaaaaagcccaggaacagatggattcacagctgaattctaccagaggtacaaagaggagctggtaccattccttctgaaactattctaaacaataggaaaagagggactcctccctaactctttttatgaggccagcatcatcctgataccaaaacctggcagagacacaacagacaaagaaaatttcaggccaatatccctgatgaacatcaatgcgaaaatcctcaataaaatactggcaaaccgaatccagcagcacatgaaaaagcttatccagcatgatcaagttggcttcatccctgggatgccaggctggttcaacatacagaaatcaataaacataatccatcacttaaacagaaccaatgacaaaaaccacatgattatctcaatagaagcggaaaaggccttcaataaaattcaacaccccttcatgctaaaaactctcaataaattaggtactgatggaacgtatctcaaaataataagagctacttatgacaaacccacagccattatcatactgaatgggcaaaagctggaagcactccctttaaaaaccggcacaagacaaggatgccctctcccaccactcgtattcaacataatattggaagttttggccaggacaatcaggcaagggaaagaaataaagggtattcaaataggaagagaggaagtcagattgtctctgtttgcagctgacatgattgtatatttagaaaaccccatcgtctcaacccaaaatcttcttaagctgataagcaacttcagcaaagtctcaggatacaaaatcaatgtggaaaaatagtaagcattcctatacgccaataatagacaaagagagtgccaaatcatgagtgaattcccattcacaattgcttcaaagagaataaaatacctaggaatacaacttagaagggatgtgaaagacctcttcaaggagaactacaaaccactgctcaaggaaatgagagaggacaccacaaacaaatggaagaacattccatgctcatggataggaagaatcaatatcgtgaaaatggccatactgtccaaagtaatttatagattcaatgcagtctccatcaagctaccattgactttcttcacataattagaaaaactactttaaatttcatatggaaccaaaaaagagcccacatagccaagtcaatcctaagcaaaaagaacaaagctggaggcatcatgctacctgacttcaaactatactacaaggcttcagtaaccaaaacagtatggtattggtaccaaaacagatatatagaccaatggaacagaggcctcagaaataatgccacacatctacaaccatctgatctttgacaaacctgacaaaaacaagcaatggagaaaggattccctattcagtaaatggtgctgggtaaaccggctagccatctacagaaaactgaaactggaccccttccttacaccttatacaaaaattaactcaagacttaaacataaaacctaaaaccataaaaaccctagaagaaaacctaggcaataccattcaggatataggcatgggcaaagacttcacgactaaaacaccaaaagcaatggcaacaaaagccaaaattgacaaatggaatctaattaaactaaagagcttctgcacagcaaaagaaactatcatcagagtgaacaagcaacctacagaatgggagaaaatgtttgccatctattcatctgacaaagggctgatatccagaatctacaaggaacttaaacaaatttacaagaaaaaacctaatcaaaaattgggcaaaggatatgaacagacacttctcaaagtaagacatttatgcggccaacaaacatgaaaaaaagctcatcatcactggtgattagagaaatgcaaatcaaaacacaccagttacaatggcgatcattaaaaagtcaggaaacatcaggtgctggggaagatgtggagaaataggtgtgcttttacactgttggtgggagtgtaaattagttcaaccattgtggaagacagtgtggcaattcctcaaggatctagaaccagaagtaccatttgatccagcaatcccattactggttatatacccaaaggattataaatcattctactataaagacacatgcacatgtatgtttgttgcagcactgttcacaatagcaaagacttggaaccaacccaaatgctcatcaatgatagactggataaagaaaacgtggcacagatacaccatggaatactatgcagccataagaaaggatgagttcatgtccttggcagggacatggatgaagctggaagccatcaatctcagcaaactaacacaggaacagaaaaccaggcaccgcatgttctcactcgtaagtgggagttgaacaacgagagcccatggacacagggacgggaacatcacacaccggggcctgtcgaggggtgggaggttaggggagggatagcagtaagagaaatacctaatgtagatgacaggttgatgggtgcagcaaaccaccatggcatgtgtatacctatgtaacaaacctgcacgttctgcacatgtatcccagaacttaaagtataataataataaaaaaaaaatcctgaccaaattatttattcaatgtgaaattaattgtaagttagtgttgccaggagagcttattacttagttaccatgtattccctctcatctcctgctttgtttataaagctaaaagcaaattacttaggacagcaatgtcaaatcactttctttccccaaagcatctgattttagatagcgctgtgtgtgttttaaaagcccctacctcgacttaggcaaacagaaccttcgtttaccatgctattcccatcccgcctttgaaacttctgaaaaggcagagcggagtaattgtttcagacatctgcttagcatactttgaagtgcatataagttctttttcagtttcatttgaaccccagctgtcttcaccgaagtctataatcaatctgaattaagttgtcctacttctcctaataagtctcttattaagttctgcatcagcctcttagggagacttaaaagctaattcatgtagaattgccattttctactaattcacttgtcagctctccaaattccaacaaaaacaattgcaaagactattaatttggctcttcataaacaacttatgtaagtgtagtatacattggaaccaaacaaacgatttaaaacagtgggtgggaggaaatgagttgatggcattcaaaacgcttccttttttgactgttatgaaatgccttccacatcgaaagcataaagccatttatttaataagggaaacatccttctgcttttactttcatagatgagataatgactgaatgaactttgcttaaagacaggaaaaggctttagaacagttggaaaaggaacatgttctttttgtcattgaacttattttaatttggacttctttgtgttattttgatggactgtgataaaagaaggagctagaattggttattattgttattggattaaatcagagttgtacagctactcttctggtcatgggatatttaggagaacacgggtaatcaaaatgttcagctaatgagttcatctgattctactcaagaagtgtttaatcagataataaaaatttctccaaataataccatccttcctactatttgaaaacaaccatatcaacatctgatcctataatatgccaatcctgtttgctaggattttctgaaagctttgtttgtggtgggtaataactagaaatactattcctcaagagtctcgggtaataaaagattattcaaaaaacttaagtaatatactctcagtattagaggatatacaaatgcactcattcattaattcatgatatgattgaaacctatacccagagaagtctgatctcattatagagtgtgaacatttaatttatttcaaaaacaaaaattatattgagagttgtatagatggcatcttagttttcctgggaatattattatttagcaccaagctgagggagcaagaatttgtattagcttgtgtatacatgtgcatgtaccacattaactagaaacagtgctaaaatgtgagttatttatttaactgaaattccatatttcctaagaaaatggaatcacacagccaatatatatttttaattattttttgacatctaccaaagttgtgacaagaataaagttcacaattctgttactctcctaccgttcagtaaaacaggaaatgctttaagatcaaataacccaaggagttcgcttcttcctgtcatgcttgacaattacaattttcaaaatttaacagttagcattgacaccagtattatgccttacacaacctgaaattaactaagttaagtaatggcattgaataatttttcttggtaaatcagttttctgggtattatgggaacagttgtgtctgtgatactaatgtctctctcattttaatggggcctaagaaagaactttttcataataagattttttcatgttaaaataatatttttagttatagtttacacttactgcaggtttttctatttaaaagcatcttccgagagcagtgattcttaaacttatttacttcagttatcttaacagcatagaagacatagcctgacatctcccgcttccacttacctatctcctttttccatgagcatgaaatttctttgatgttcttgttttattttttaaatctcacatcaattttatggtattttccataatggattcatcatgttttaatatgaagatgctttttcttcaaattctgaagtaaggaatctttcagcacattcacctatggacatgaaagcgtaagttgagaatcacagtataaaggattgcccagtttttgcaggctttatctttttccatcaacttctgtcttttatgtacacagacaaaaagagcagacccttgctatttcaaatttatcttttgcaggttcatctgattattgtgatccaaagttccatgactagcagctcttaattttgaacatgtattatttcaagcttttgtgcatagtcacttaactaatgagttaaatggcattttaagtcaggttccatgaacgcagaccctgagaacaggggtctaggtgcctgtgatttatagagggtctgctctcaggagaagcctgtattggagttagggaaacaatacaggagaagaaagagcccagcaagtatgccatttcaggtgaaacctcacattgtgtctgatccagagagagagcaagccctcgagcagaaacctcgctgtggagttgtactctttattttattttatttttttgagatggagtttcgctcttgttgcccaggctggagtgcaatctcagctcactgcaacctccgcctcccaggttcaagtgattctcctgcctcagcctcctgagtagctgggattacaggcatgcaccgccacgcctggctaatttttgtgtttttagtagagatggggtttcaccatgttagtcaggctggtcttgaactcctgacctcaggtgatctgcccacctcagcctcccaaagtgctgggattacaggcgtaagccacaacaccgagccggagttgtgcctttataccagtcattgtctgtgtcactgaagtgctggcaaatatttgtcgactagctctgaggtgggatgaatcctggtgtgtatcaaaaccagttttcgtggtgtaaatactccctctaccactgatctccagctaccgacataatgccactgagtatggaattgggaggagatgcacacaattggctcttgggctctgctgcagcacaccactggctgtggtccactcctgggatatgggttacttcctgggctagggggctcccataagcagaggtcacatgtggagaaggcaggtagctataagacattaatagtcaaccatcacagcagctgaaggatggatgcccaggttaggtaaagtgtcccctgcaactaataagtaaacctagtaatccactcactcttcatattcaacttggctttttttaatgctgttttgtttttgcatgtacagtaattctttataaataatgagaattttgtttctttatggaaaatccacctaccctccaccctaccatgaatagcttgatagctgttcatcagaattagtgatggaagagaagagttaatgaatgaaaaagtctaagaaagtgatcactattagtaagaaaatggcctcataagtgagtttggctttatagttatggaatctgtaaatgtctaggcattcagacatgtccagacatcattgagaatgtcaagaattttcagtggcaatggttctcacctcagcatacatcagaatcacctggagggcttgtagaaactcaggttggtgaaccccttccccagagttcctgattcaaaatgtctggggcaaggctaagaagtcccaacttgttcccaggtgttcatgatgctgctggttcagagatacattctgagaaccaatattccatagtaaagctactgtgtatgtacctgaagacatattttgtgtagtgttagcgtttcttcaattacaagtaataaatatatcatttattatttcttttatatttatcaatatccagaagatttagtttaaaaatgaatgcaggcacacagcctcttgttggattgattaatagtttagatatgggagcatcatagggagcattgtttcgcttaggaaccttgaaatgaataaatggcttcttttctaaatctcacttgtggaagactttgacggtggtttatttcattttttcctgttggtattttaatgacactggtacaattttggggttgcttcagatgaccaacagcataacttgccttcccagtattaatttttaacgttaaaaatatttagtcatggccggccgtggtggctcacgcctgtaatcccagcactttgggaggccgaggtgggtgggttgcatgagctcaggagtttaagaccagcctggacaacatagtgaaacctcgtttggacaaaaaatacaaaaattaaccaggtgtggtggcatgtgtctgtagtcccagctacccgaaaggctggggcaggaggactgtttgagcacaggaggttgaggctgcagtgtgccctgttcactccactgtactccaggctgagtgacaaagcaagaccttgtctcaaactatatatatatttagtcacataacttttcactttgtgtaaatattttttgcatttaccaataaaaacaattacatttaaaaattctccttacacttttctaccaaacatactgatgataaaatagtactttatagagtttctgaatctaggatattaaaaatagttgggatcagtcaacactttttaagtaaaatctacttgctagatatgaatagctaacagcttctccaggagtgcctacattttataacttactttgtccaccccttgaggctctgtgttcagggggagggtatatttttgtgtatagaaatagagatgaggtgaaatagagatgaaatagagatgatgtgggatcaactgggagaaagtagaaaagagtcttagctgaagtggttgaggaaggaggatttttcccaaaatggtgcaaaaaacaatgtattaaatatctgtgaaaaagttcatggttgtggtatagggtgagtggtatatgaaaagagaattatgggataaactaatggaaacagatgtcttaaaatttgcttttaactttaaacaagagacatgaaacttaaacttttcccttatcctagaatctgggagaggagaaggatgagaaaaaatgaaattttacattagaagcaatttgattaatgttcaatggaaaatggaaatagctatggtcaaacccactcaaatcaagtgtacattaaataattgagttaactgaattaggcagagtaagggcacattgattttcagtgttgttgaaaattggtccacatatcattgttatgctttttgtttgtaaacctcaatatttattaagtttccacagtgtgctcagccctgaaacgccaaattctcttaaccagaatgaggctggaggatctaacactaagacagatttctattttcttttaaggaattgatttttatggtaattttttttcttcataaagttaagaacctgccagtcctgtttcgaaacacacttatttttagaagtttggttttccgggattatgcatcattatagactcaaatgactcatttagaacttttccctatcaaatattcacattctatcatcatgatcttaacacggcataagcaagttagtgaacagagtgaagtcaatttattggcaatatatgccgaagtacaggaattaagtagaaacaaaagtgaatgagagtctttggcaatacattgatgtgttttttttagaaccaatgataaactactgctgagtttcctttcatttacttttttcctactcttaaaacattgtaacccattttgagatctatccattgttgtgaacctaaagcctattaggtcttattaaataatacccatttaactgacctgtgatttaagtttcttatctgcccccaagcaagcagactgtatgcaacggcattttacctgcttcaccttctgcttgccagttggtttttggtcttcacatgtttctagcagggatggggctaaagcaagggagagaatggtccattgttttagactttcacaaacccaatatactagaatctccacaaaggttatccaatatcagggtgacttttgtgcatccaataaagcataaggttaaaagaaatacaggctaaacaaatgagcataaattactccgttggcttatgctgtgaataaaatattacctttggaaccatctcaattttttttttgtataaaggttgaaggaagacatttgcaaagtcgtttctcctataaaactgcctagggtttggggttgattgttgtatgcaagaggggtcttggtgaaatctgacccactttgaatctaaaattactgaattattagtgaaaagattattttaaaaagagttttgaactctttttcctactgaaattgtattctcctttagataatcaatgcagcatcacccccacagatttttgagggcactaaatcatactcctattttgaaaaagaaaaaagtctattactattaaatatatctgttagttgaatatcaatcactttttctaaagggtagatttggccaatgagtgatttttttttttttttttttttggaaatcacatctgagaacgttgtttagacagcttgacacttagactcatttgtgtaagtagtaatttattcatcatttgcatgtacttaactggacattatcatgatagcagttgtcataacagactattacaggatatgaatttagatattaccttaagatgtgatcataaaaatcagaataatatcttgaaaatatcaattttatggtgagaaaaatgacaaactgaataaactcttgactcaagaagctagacttttcacaacctcatgtattcacagaagtaaaaataacaactaataatgtgtccagagggcccacattgctcagaaatgaatacataagactttcttttcagcctcagaatatgatgaaaagaagatgaaccattatgatgttgcatagattttaatgaagaaaattcgttttctgttcctttcgtttgactttaagtagttgaacatcctgcttttttattttgtttgcaagaaataagaccattttagaaaggctaaaaacattaattacatttaggaactacaataatctgaaagtaaaattggatattaaaggacgtttttgcaatcctttttagccctcttctgtgtattatttttatcactgctcttaaaaatttgtattaatctttggttcatttctgccttagtatttctaagttaataatatattgaatgaaaaatcaaatcagtaaaaatccattttgtttcagtagtgagtgccttccccctagaaccaaaactaaataaatgtgctccatataaagcaaaccaggtacagcatattgcacgggtaactcacaattctagattcctctattaatcattattcagacatgcagaggtagcttaatttgctttaataagtgaaaacagaatctctttgagactgctatctgcaatattatactttgtcctgcattttcttggtcaaaaattgtattttatagccatgatatattttggcttggaatttgcttctttataagcctagttattaatagtcatcatttaaatgaaatgatatccattagccttaagctgcatgattacagagacttggtctatcttacgctgtatttccagtgcctagaacattccctggcatataataggtacccaataatagtttttggaataaatgaataaacaaatttgtgcaaaagcatagggcaaaatgctatcttttagatagcgtgacccttaaaaattattttgcaaataatttgctccatttgccaccagcttatttctggccattgttacttcttgtctctgcatacaaacactctgtgtctcttctcctttccacaatgaccacaagttatactgatctacttgagattttccaggtgactatttcatgtccagaggaacatgcctcttctagtgttcccctctgtgaatgatttcagtcaccttatctactcaggaggtctctcttcccctccatcagcatctttctctgcaccttccaaacccctatgactcaacttctcataatatggattgcattttttttaatgacccattaaattgtgtacctctgctaatgattgtgagtgtgttgagacttccatttttccagtggatgataggtatataatatatatatatatacacacacacacacacacacacacacacacacacacacacatatatgtgggcacagtatctagtggatataaagtaagtgttttcaagtgagtagtaattaaatctaagagttgccgagaaaatgccattcccgttttgtggacatcttcattctacattgtaaaggccacctcattcaagacccaccacaatcttgatcccagaaaacacccatgattcatcttttacagctgccctgtacttcatattttaagttattaaaggctatttgcttttcctcagacacacattaaactttcctacctcttaccctttgttcaagttctgaacacatatctttcttccccacactatgcttcctctttatcagtttcatgtacctactttccaatgtctagttcgaggagacgtttataaggctacatgatagaggttgcccctggggcgatgtgagaaatcagctccaaaaaggtagctacccggcaaaggatcttagtctgtgactctctcatggatgaacttattacctactgctttgcagagtctccctggactagcctgaataggaacttgtgtgactatatgtgaactaaaagaaggagaaatatgcctaaacttctcatccatctttgtaacagccctaaagtatgcatgttactatcccttttctacacaagtggaaaatatttgtaaatgaacttcgttacagtctaatatttgatgacttcttagttcatatcattatttaagtaacttttctttagtggaaaagcccaaaaattagggaggcagggagagagagagagagagagagagggatcatctgtaatctcagccccagcatctataatcccaatccctgcaagggcctctttgggcaaagaagaaaaaggcactgtgtttttgaagagatccccggtcctatgccaagcctaaccaatttggtagtagagcccaggctggatttcagttggtttgtagtcttctagtcttttcatatgtaaatatttttaatgcttttattcagtgttgttaaaatgccctccaaaagatgcactaacttgtgccaccaccaccaagcagaatatattttccttgaataggctacttcctctttttttcccactcactccatttttattttaaaaatccctggtagagaccaaaaactgaaatgttatattcttgcccaaagaatgagagatgcttcagaaattagcaaatgctccaatataaatcaagtgatagatataaataattcagatatgggataaggaaaatgggtagctttctcttatttaggaactctatgtcaggtttctgtgagaaactgtttacgaagcagtctgacaatagctattggtctgaagtattagtaattagtacagaagtgcctaattctcttgactgcttgttctttaataaaaatgtattgagggattatcatgtactatggcttggcatatactggtgaaaaacaataatgtaggattgccttaataaattttctggtcttgggaaggaacagacaatgaataaatgaataggcaaatatatatgtacttgcaaattgtgatcagggttcagaaggaaaatagggtgttgagagtcaaggaaaaaggagacactttacgtagggcaaccaactgggaataggctatctttaaaagtcacatctaactgagatcagaagtatatgaataagagccagctaggcataaagtggatatataaaactccaagcagagggaacagtgtatctgaaggttctaagtcaagagtaagcttgggccaggcacggtggctcatgcttgtaatcccaacactttgggaggccgaagtgggaggatcacttgagcccaggagtttgagaccagcctggaaaacatagagagatcccatctcgcaaaaaaaaaaaaaaaaaagaaaaagaaaaaactaacttaaaaatatatatatatcaatgccagtggtgtgtgcttgtagtcctggctaacttgggaggctgaagcaggaggatcgcttgagcccaggagtttgaggctgcagtgagctatgatcgcactgctgcactccagcctgggcgacagaaagaggccctgtctgaaaaataaaataaaaataaataaagaaataaaaagcttgatgagttctaggaactcaacattttctaacttcttattagaaatgccaaattctcaggcccaccttacacccactgaatcaaaagcactaagtgggactcagcagtctctgtgttaacaagccttccacatgacaatgagatgcacactattgtgtgagaatcactgccttagactgatgttttgagctatttaggggagggagagggcccattcagggacaatggtggttaacacatgtggctcagaccaagaaatgattgcaagcccaaaaacttgttaaatgtaaaacttcaggcgcagtggctcacgcctgtaatcccagcactttgggaggccgaggcgggtggatcatctgatgtcaggagttcaagaccagcctggccaacaaggtgaaacccagtctctagtaaaaatagaaaaattagccaggcatggtggtggtgtgcgcctgtaatcccagctacttgggaggttgaagcaggagaatcgcttgaacccacgaggcggaggttgcagtgagcccagatcgcaccattgcactccagccggggcgacaagagcaaaactctatctcaaaaaaaaagtaaaacttcatctgtctgaagtaacttctgaatttgaagataaacatcctcatggttgatattttaatggtttatggattattacttacttttaaggaagttaataggtttcattaactgccattttgcttcattttgtcacatataattaaaatttttcagacagaaaatattggtattttttctgtttccttagcaacctaaagcatgacctgcttaaatgacttatttgtgctcattaaaagcctttttgtgttaattgtgtatattttgtatttagcctctgtgaaacactcatgaactatctttttatttgttttaattgtgtcattggaaagcttgaagtattttgtggtttttttttttttttttttttttttgcttgttttttgtctataaaggggagataactggcagttgcagttaggattatagaaacattttcccaaggaaattaataaaatttgttcaagtttcttcttttacaaattgtacttatttttgattttttaaatagtggtaaaatacaaattacatgaagtttactatcttggctctatttaaatgtatacttccatggcattacatacatttacgttgttctgctgccatcaccaccatccatctccagaactcttctcatcttgcaaaactgaaactctatgtctattcaacgataatccccaccaggcatggtggctcacacctgtaatctcaacactttgggaggccaaggcaggcggatcacctgaggccaggagttcgagaccagcctggccaacatggtaaaaccccatctctactaaaaatacaaaaattagctgggcgtggtggtgcacacctgtaatcccagctacttgggaggctgaggcagcagaattgcttgaacctgggaggcggaggttgcagtgagctgagatcgagatcacaccactgcactccagcctgggcaacagagcgagactccatctcaaaaggaacaaaaaagaaaaaaccacagtaattccccattgcttcctgcccccagcccctggaaaccaccattctatttcctgtctataaatctgaatactcatttctatatcttctttggagaaatgtctattcaggttacttgctcattttttagtcaggtgatttgttttcttgctattgagttgtaggagttccttgtgtattttgaatactgaccccttaccgggtgtatggtttgcaaaatatcaattgctcctgctatgttcaacttgttcttaaaaataaaaacttttcctttgtggtcaatacttccctgttcctcatttccaaattttatacatgaaggaaatgtgagcacccagaaaagaaagaagatagacactgttaatatggccaagatataattcggcttttattataagaacattggagttacaagcttcatagaaagccatgtcctaaaagatgaagaattatgatcagtgcaaagagaaaatgttaaaaagaaaaagttatccttttatgtttgggtatatattctttttcgatattgtaaagagaaactagagttttttgttcttgtttttgagacagagttttgctcttgttgcccaggctggagtgcaatgttgcaatctcagctcactgcaacctccacctcccgggttcaagcaattctcctgcctcagcctccagagtggctgggattacaggtgtgcaccaccatgcccggctaatttttctgtttttagtagagacagggtttcactgtgttggccaggctcgtctgtaactcctgacctcaggtgatccacccacctcagcctcccaaagtgctaggattacaggcgtgagccaccgcacctggttgagattgttttttataaaaagatgtggattctttatggaaaacacagagcagttaattgctatttttttaatgtcacaaatttggaagcgtgttgagtctgagaagaaaccatagttaaaatataattactgataatcgcttgggaaataaaagccctaaatttcttcatgcctacaaacttaatattgttttcccaagatcttttttttgactttaacctttcttaagtgtttctgattatgctaaatctaggccattagttctgagtctgtttcattatttatattgttattcagtttactcgtcaaaagtgatcatgcccaaatatgaaagtttacaagaattgccctgaaaactgaacggaaggagacaacgaaaagaaactgcataatattttgccttcaggctatcacaataaaaactgttgctggaaaaaaatgcaatcacatcccttttttttttttaaagtacgtttcaatggcataatttattgtcgagaatgtctctaccagaagcataagtgatactaaaggcagagggttgtattcgctcagtctgcaaagtatcccctttgtcttagctccacacagtccctcagaatttggcagaaatgagggactcaactttcgagaaagggtgacaatcccagttttgttggagagctatgaaatagccccatagtgttagtaatgaaaattcacttaagaagtctcctgcaggcccggcacggtggctcaggcctgtaatcccagcactttgggaggcctacgtgggtggatcacctgaggtcaagagttcaagaccagcctggccaacatggtgaaaccccatctcttctaaaaatacaaaattagccaggcgtggtggcgggcacctgtaatcccagctactcaggaggctgaggcaggagaatcacttgaacccaggaggtagaagttgcagtgagccgagatcgtgccattgtactccagcctgggcagcaagagtgaaactccaccttggaaaaaaaaaaaaaaaaaggaaagaaaggaaggaaaggaaggaaggaaggaaggaaagaaaaaagagaaagaagtctcttgaaaaaaagaaaggaagaaagaaagaaagaaagaagtctcctgtataaaaaaaggaaagaaagaaaagaaggaaggaaggaagaaaagaaaagaaaagtctcctgaaaaaaaaaaaaaaacaaaatataagtgcttgacaactgaagttcaagggtaaaggctattgggaaagcagatgaagttaatctaagtaatggatgctgttggtgccccagtcagattcgttcactgggttggtgcacccattcctcagtgactctgagtattagctgctaaagcctcatggtttcacccctttccagagaacctccctcagccaaaaggaagccaccttgactggcatgtcccaccacaccttctctcttaaaaccaccaggggtacaaagggaaaacccctttgcctcatcatggcacctgctgttgtacaatttgtgatctgggaattcccatggggccagattgatgctggtctccagcccataccacatcccaacttaactttcttgccctgtcttcctgcttctctcactccctttttcttaagagcactcagactctgcttctcttaaacctggctgaaggcagtaggtatctgaaagaaaagctgtacctacattctgggcatcagagcagtcagggaaccaaccagaatgaaaagtcaaaaattacagataatgatggaagtctctgagcctgatacatttcatgaagggcttgcttacagctcaacttgtgtttctttttaattgtttcaacagcatttgagtagctcattccgcccaggtatttgagagattccagtaggcctctgatcctctggaaaaagcaagatacagtccttgactctcttggccccatgaggatgatatatctgctgagaaatgcaggagctgcaaaacatagctgggctgtacctgctgccaattcccgggtaattgcattctgtgagggcttccctgaaccacgaggaagagccccggaataagtactaaacaccagtatttataggacatgatttctaattgctcatccttgccttctcatgactagctcagcatgaagaatgctgggacttttctttcctagcacctcctctttttaggctgttttccaagagtcttggttaacaaacatttgtttgacaaggattcatggtagacagcaatgccattagtccctacttaagtaatatttgtaacataaatttctctgcacgtgtatgtagcccaagaataacacttcatttttggaacctagtaattttgaattcctagtaagtgagataggacgtctatgagttagcaggttaagattttaggaggaatatttaatatccctaagaagggaagtttttcaaacactgagtagcactatatatatttatatatatatagccagatttctatctatctatctatctatatatatatatatatatatatatatatatatatcacaccatttataaataaactcataagtggcaaatccagtagagctaatctgagcatcccagagtctcccctctctgtcgcttgtttgtgcagctactcctgctgtggccttttatggattatcctggacttctacaactgacccctctactttctctccatctacaagcttcattttgctttgctttcctcctaatccagtttagattccacagtatattttttcaattacatcctggctaatatcgaaactcccttatccctaaatgtgtgagccacagtcatctgacgaaaccccaaacctggatcaactgttttccccatgcttacatgcaacactgttggagaaaatgagaaagtcaggcagattggttctgctaaaaaatgttgaacctcatcctcaagtgggccctcaacactgtttgccaacctcattacatctcttaggtcaactccctctcacagtctctattacgattaattcaaatgttcccacttacccttaattcatgttttcattcagtgactattcattgcacaccaggcactgcacgctatgccaggcactgcagactatgccaggtctgttgattcctacttcacagaggaaataaaacccctccaagcagaattccctcaatttactctttctagtctttccaactgaccttctgtgctttgcagtaggaatgttctcttaactgtcaagtcaaaattcctccctcaaaaataagattcccttgttaatagacaattcctttattttcttagaaaagtagtagatgactataattttaaatgtgtatttgaacaaatccttagctacataaagataagcaaagatatgacaggcaatttaattttatatgaagaaaaacttattatatcagacttacctatcattctaaatcagtacttttgtatctataatcagacaacatttaatgaactgaaaattctgcctgtgagaaactagtcataataaaattagacttggtttgctctttcatggagaacatattccagatgtttaagtgattcaaagaaaacccacaatataatggctttcttcaatgttttctcacttactgcttccaaactagaaaaaaaacctaatgcaatcctgatatcacttaaatagcacctcgtattgctcagcgttaactgtgctttttgacattttaggtgtagtgtttaataatttaaacacaaatttatgtgtgtcatattaaaagctctaatctgtgaaatatagccaaaccaatgtcacatctatttaaatagcaaagtacctgtgttcaccctttacagggtgaaggtcttgtgactctgtgtttaggcggccatacttcttgttatgtatgctgctgggcactgagagcccacagtggtgagccatccttgggtggtaaaagctgctaccaaaacctaaatcaaatgccaaagtgaagactgacatgagcattctcctgcctccttttcctttttatctttcctaccatctgttatctcctttcttccaccttcatgcgttgagtgccctcatgatgatttctagctgactgaagtcctttagtctgctcaaccccatctagagacttccccaaagtgaacctttgcccccagttatctgtttatcaactgacctcacaccagtcaaagcttccattgtcaaatattttaacagaaatttaggaattcagattaaactgaatatttggcattttttcttttttttttttttttttttttggagacagagtcttgctgggtcacccaggctggagtgagtgcagtggtgccatcttggctcactgcaacctccacctcccaggttcaagcgcttctcatgcctcagccccctgagtagctggtactacaggcatgtgccaccacgcccgaataatttttgtatctttagtagagacagggtttcaccatgttggccagtctggtctcgaactgctgacctcaagtgatccacccatccacccacctcagcctcccaaagtgctgggattacagtcttgagccaccccacctggtctgggttgttttcttcatctttagcagttgtcttgttcacaactacttcaacaatatttattttctttttctttttgaagcaactctccagagtatttggcctggtttttatagaaataataacttttttcttttctttttaaactaatatttttatgatttaggaaatctttctttattaaattacataatcacaacagttactggcaaagataggtttgagaacatacacacaactgacggttgtaacaagtcaactgatgggagcagaaggtccacacatactgacaggcacctcgaacattttattgaggctgtgagaggttcccatcactgctgtttcacaaagagaatgaagactttggctaatttggtgagtcttaagtggagattagttcagagaacttccactatcattgcttgaaagaagcaaaaaaaaaaaaaaaaaaaaaaaaaatcccaagatcttatggtaaagtttaaagaagaaaagtaaattttaaaaagaaaaaaaaagaggaaaagggagagcattgcaattaattatgagtaccaaaacttatttttgaatccccttcatcctccaaaacattgaagcaggattaatatgtgtgctcaggaatttgggagagaaaatgaaaatcaaaatattctaataagagacatttgaaaatgtacattgtgtcacctaaagggaactgaaatctagctatggcttaacgaggtaggataatcaacttaatggcttgagagtcttgcttgtaaagagagatgattagcacaaaggactcacctgtatcactgaaagatgctgcctgctggcttgccctctctgcagaggttcctgtttacagtttcccctcacatgatatttatttgtggctactagaaatgcacgttattatccagaagagaatgatttcattttgtaaccgttgtccttgtccaagtttcccccattgacatttaagaaatctgttttctaacctttctattatgcaaaacaaaattaatatggatcatttccttttagagataagtattcatatatatggatttaaaccacctttctccatgggcccttattctgatacttttaatccatgtatttattcataaggaaatggaacaatatttactatccacccctataaaactttctgaatttcacactgattccagtgacattccactaacacgaagttgaatacagatgaatacatcacatatgattttttttttgcatgtgtatggtcagaaggggctctcttttgtttgtttttattaatatataattcacatactttaaaattcactctttcaaagtgtacaattcagtggtgtttagtatattcacaagattgtgccaccatcaccattgtttaataccagaacattttcgttatcgtccaaaagaaaccccctgattgcttaacgtaatgtttttaatgaccactttttaaaactttaagttcaacagagtgattatcacaatgttttgtattatctaagaactacacaacagtgttatgctctatacagcaccacggtttactgatgaagtattcaggttgatttgagaggataatgtcgttcttattttgaatgttcatactggctccttttatttggagtgggaggaaatgcaaggcttataaatgaggtcagtgtaaccaatggttttatcaacatagtgaaccagacagagaaataacacctgcccagatcaagcaagtcaaaacaacacgtatagtcaagtggtgctgtccttgtacacagacattacattacacaaactgttctcctaagtgagggaatttgtcccttagaaattgcttattggaacatttggacatcatgcatcatgttaaagatccataaatgccatctcgatagggtagatatgaggcgtggtaatatcctccccatatctgcatagggttcttctgctcaacggattgctatgatgtattgcatcagagactcctgctctagtgcttcaaagacagctgagaagccccacgggagccttctgaagtcattgctacaagggctaaaataccaggagatcaggaagtcattctgaggacttgacaaaataccctactccctaaatgaaactgttatgatgtggttggtgcaaagtatgcatgcaatattttatgactgaatatatctttctattgtaaaaaataaggatccatttctggttgtgacatgagtagaatttagaatccagcagcaatatatttttcttgttactttgccaatccagaatttcttaggggaagcatataacataatagttaagaatatatattctagaggcaggcaaacctgcatataggtatcccaggttcctcaatttttacccatgagagcttggcaaggtttgtttgttttgaaaacaaacctctgcaagtttgttttctcatgtataaaattagaattctccaactactggcctcataggattgttgggtagaaataaaatcagtttatgtatgaatagagctcatcatggcattaggcacctaggaagtgctcaacaaatagtagttatcattattcccccattaacaaatatccattgttataatactaccacaagagactgtcttagtctgttccagctgctataatagaaatgccataaattggatagcttgtgaaacaacaaaaacttatttctcactgttctggaggttgagaagtccaagatcaaaataccagcagatttggtgtctggggaaggcccattcctcatacaaagcaccttctcactgcaccctcacatgctgaaaggagctagctagctctctgaggtctcttttataagggcgctaatcccaaaaatcacctccctaaaggccccatctcctaataccattgccttaggtgttttgatttcgtttcctttttattttttaggatttcaacataggaatttgaggggggacacaaacattcaaaccgtagcatagagcaaacattactggcactgcaccctaaagagaataagcccaggtatcagttcttcttgttttaaatattctcatcttccaatttgcttttgactattgcacacaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtaagcacattgtaaacattgttgtcctttgttacagtaaaataatatacagataaaatttgtaaagaacaatgaaagtacttttttcatgtaatgttcatggtaatatttgtgaggataggatattttatattagtttataattcccatctaaacattttcaaattattaatattaattttggaagcaactaagacttagtatatgtcttagtctgtttagtgttgctataaaagaatacttggggctgggtaattcataaagaacaggtgtttatttggctcagttctgcaggctgtacaagaagcatctgcttctggcgagggcgtcaggctgcttccactcatggcagaaggcaaaggggagctggtgtacaaagatcacacggcaagagaggaggagaaaaagagggaggggaggtgccagttctcatgaaaactgctagagcaaaacctcgctcactaccgtgagaatggcaccaaaccattcatgagggattcactcctacaacccagacaccttccactaggcctcaccaccaacacgggggatcagatttcaacacgcgagttagagggaacatccaaactctgtgtagcagtattcttacgataaacagaaaataatgctgaatcatgatggaagatgtgaattgccaccatgcagttcctttgtactcttactgcttggattctcaaaaacatctttccctttagaatcctaatttaaacaagagtcaatagtaagatgtgtccaaaagtcatttaaagaaagagcatcctatcacaaacttacatgtggaagtttttcgtaggtttgcgtaataaatacaggcaatgtaagtgtgctgctcaaggtcacacttactagccatgggacctggagcaaattacttaacctttctgagcctcagtctttcatcaaaaaaaaaaaaatgcgataataaaattctctgcaatatcagtttattattaggatgaataagtcaaaataaatggaaagtgctcgggagcgaacatgccaaatgataaacactctacaaattctagctcttgatgttgttattattattattattacagtacacaggttttggaatccaacatattagctgagtgaccttgaggccacttaatctctgtggttgtccatttactcatctctaacatggttactgtaacatcgaatgagttaattcatgcagagtaatggttgtagtggtggaagaggtgcgtctaccttctcagtgtgaaggacaccatgttataccccaaaaccctaaaattagtttaaccgtagaattagagaatcattttctctcctttccaattttctcctttccaacaggatgcagaaggtatgcctctgaggaaactgggtttaaaactatttggttttaactttttaataagaaaaatataataaaccaaatcactttcctattgtcagtccatttaggggtgtgattgagaggcctgttaaagaattgctagatctttaataaagataagttgcaaatcccagacctcttgagatctcacataatttaattcttgttgtgatggatagtcctgaaagatttgtattctagattgttataagtggcatcgactaaagcaaggcgatatagctaagtgattatatgcctttctctgtttgctccatagtagttgagtactattaaaattttatctgttccatccttagtatgtttttcatcttaagtataaataaggaaagtaataaatgtccaaagaaaaccaatggccacattagtcccatataagtgttctagaagtatattttataatttcttttagagagcagaatgccacgtttgctttcagaacgtggtaaaagatttgtgacagtggcaggtagatttccaaatgaggtcaaaggattatgactagtaagaaaagtttttttttttttaatcaatgctaagtgatccattctagttgcactatttatttgcatttaaggtatcaaaaacagtaaatagcttactatgtagccattctttacaatgagtaaaaacttggttataagtacaggaaaacacatgtaaggagatagtatgatatagcgaaaagagcattggattgactattaggaggtctaacttcaaacttaagctcagccattatttgaccgtgttattgtgagaaagccatttaacctctctcagctttaattctcctcatttttaaaatgcagaaatctattttgtctaaggtcacatacagttcaatcttatgattctgtctctagatatctgggggagatacacatttgacagaatttagtttaaaaccaatgaagttcctttctttattcataatacaaatgtggtttgttgaaattatatttctccttgtataactctaacttttaatctcttcttccctaaacccacatatacacagccttctcctattaaacagttcagtttgtggtgtctgctctatattgtagcaaatttcatgtttctatttttgaacatgaccttaaagatatgcttaaaaagtgtttttagcagaaagctgataaatccaaggttttggtttgcatataaccgagtcaagttagttccattcttttctttgatagtaattctgctacattataaatgtgaggccttgttcagaaagagaagaaagcaagaaatgaggttcacatcaagcaatttttttcccattactggaaaagcaattcatacatcctgttgagaatattttatatttagaacaatgtatgtgaggctaacgcattatccaagttctatggcgggaagcttgagcccaccaccattatgacatcatatttttttaaatagtaaatgtcaaaaaagacatatttctatgaaaataaagaatttagtcacaatgctatgtcaatctttaaatcgtgataaaaaccaagtacaagttcatctttgcctctgtccactaagacaaagaacaatcaaaaagtaaagaactctctgggcatggtggctcacgcctgtaatcccagcactttgggaggccgaggcaggcggatcacttgaggtcaggagtttgacaccagcctgaccagcatggtgaaacctcatctctactaaaaatacaaaacttacctgggtgtggtggtgcgtgcctgtaatcctagctactctggaggctgaggcaggagaattgcttgaaaccaggaggcagaggttgcagtgagctgagatcgtgccactgcactccagcctgggcgacagagccagactcggtctcaaaaataaaataaaataaaataaaaatagagaactggagtagtagaaaggcagatgtaaacctgagaaaagaagaagagtcttaaatttgggcaaaatagtataatagaaagattagagttacatactatcaggccgtgtctacttgatatcagaatatcctgggttctttgcattatccattcatttaattttcaaggaaagccatgctagttttttagctgtctgtaatatcagtcaaaatggtgaaaccagttaagggatgtgagcaccaacaatacagtcaaacccagtcacaatttacctatgtatagaatcataatgtatagagaattccaaactgactttgaatcttctaatagaaatgtaagagacattggtttgcctgtttgaaattttctgtgggaatgaagtcctattttcttcctcaaagtagacacattggtatgcatgttactatttgaccatttgactttttgtggtgtaggaaaccatcactccttgcagttagaaaaagtcctcatgtgcattctctcatctaagaatcacaaccttgtgattttgtattatgattatgattacctattatcattattcccttttacgtgtaaggaaaccgaggcttagaaacatgaagtaccacagtcacagtcacataacttgtatcagtcaagatctgagtcaggtttttcgaactgctattcccatgctctttttgtctcctcttctcaaaatcctattacgtttggacttaacaaagcaataatggctgggtgtggtggctcacgcctgtaatcccagtactttgggagggtgaggcgggtggatcacttgagatcaggagttcaagaccggcctggccaacacatagtgaaaccccatcactactaaaaatacaaaaattagctgggtgtggtggcgcacgcttgtagatcagctacttgggaagctgaggcaggagaatcgcttgaacccgggaggcggatgttgcagtaagctgagatcatgccactgcactccagcctgggcaacagagcaagacaccatttccaaaaaaaaaaaaaaaaagcaatactttaaaactattttggacaatacaggtgtaaaatacttcacttttttacatgtatcttcttttttgaaatgattcttaggtatattaacttttaaatcttccttttataaaccaatggattaatgaacccagttcagtgtaccccttagaaatcacacttgtttcaaatataaaattttaaagcattatattcctcattgcctttagaactcagcaattgtactaaaatcagccaaaagtgatttcagtgaatcagctcttaaagccaaactaatgctaatatttgaccaagtagaaacgaatatctaaaccaggtgagaaaaaagttaaaatgatgataaacctttctaattttgaaatagtacacacactgagtaatgcagtcaatctctttattcaccaagcgcaagtagtatataaaggaatattataccatttttctttactcatgagtaaacccacaaatagcacaaaagctgcaaaaacactttaacataaggagtatttgttttattgactgtaggaactcatggaatgcaaacacctttaaaatctgaataatatgaaggcatttccagctattagattctttacatatgtcaaagaacagtatcataaattatgtatgttttttaaaggtttcctaagcttcttccaaagtcatgtagacatcattacactccatctgtatacctctgtggtaacttgctgtcgcagggatctagagcctcatcttttgcaaacttcattccttctttcatccctttgttctttcattcagtcagcactgattgagcatctactgtgtacctagaagacattgtaatgatcctgtttggtccaaggacatactaaacaaaactccctttactgcttatgctatattaagtaaagctttaaagatgggttctcttttattacttccatgatggcccacccctctcatcctttctcagtgttaaaaaccagaaatatacatacttacatactatcataacactgatactacaaaagcagtacccattattatctctggtttacaaattattcaataatttcttactggaaacttggtctatatagtcatagtagtaagctttgtgagaggatgtgatgggatcatagttagctaaacaataggagtatttgtgtggcttcattttaaaaaaactaaccagtttttttccaacaagcaattcttatatcagaaccatttatattctttactttggtgagataggattttctaagcaggtcttttatctgtatctatgtatgtttgttcttaccatcattgagcacaggatttgatcctttaaatgtgttgacagattttgaacattttcctcatatctttcttttttgttttttaatgatcctgtactaatcattttgcattatggggtcacttctggacagagagcctagccatctgctcttacaaataatgtcggcctatcactaactggggataaggagaagacatctaccgatgtctttctagcatgtccttcttgactttttctttctttaagaagactaaaatgattcagcttgtggttctaccacagaactcaggagaaaatgataaatatgaggccattctccaaataaatatgttttcctacattagtggttctcaaattttaacaagcatcaaattcacctggaaggcttattaaaacacagataactgggctccacataccaagtttcaaatgattcagtgggtctggtgtggagcttgagaatctgcatctctaacaaactttcaagtgaggctaatgctgctgaatcatggaccacactttgataacccctgttctatgttaagtacttgtcaggtacagacaaatttaaaagttaaaaaaatatatatatgacttctgtaagacactgtgaagggtttagactctggggaaattaagtataatgccatcccaaaaactctgtgttggaggagtgttcaagtgctgcaggatcatggagaaccaagcacttaacttttctatgaggcagaaagaggaagataaagggaaacgtggaggatgaagggaaactgttaatagatccccagaaacacaatttgctgctatatggatttatatttactgtatttcaaatcacatggtctagaactgtgctgtccaatatgatagctacatatggccattgagcccttcaatgtagccagtcgaaagtgagatgtgtagtaagcgtaatatatacacatgtaatatgtatatgttatatatatgatatagatgtaatatgtatgttatatatatgatatatatgtaatatgtatatgttatatatatatatatatatcaggatgcaaagacttagtaccaaaaaaagaatgtaaaatatctcattatttttatattgattacatgttgaaatgatagtatttttatgtatttgcttgggtaaaatgtcataatgaatttcactcatttattatgattattcaaacttggttatttttcttgaaaatgaatgaagtgagcctgttgcttcggctacaacaatgggcagtgtttctgcaaaatttttacatgtgcctactagaacatttaaaattgtacatgtagcactcattatatttctgttggatagcattggcctaaaagttttcaaaatctagcatggataagaatcacctgcaaagcttgttaaaccaatccgcccccagaaatttagtatcgggtgaggcctgcaattctgcatttctatcatgctcccaggagatgctgtctatttgtaaccacatatagaaattcattcccaaactacagatgatagagttttacagagaggtgcaaaaatatatttttgcatcaagcattgtctgtagcttgaatacaaaattatgttgcccatataccactggtttttgtaagtaaagcagttgtgttacaaagcatacaagtttttatcagctaatagccttttctcaattagcagatactaagtagtacttttattatgtggcaattctccagtttttggaatgttattgagaaatacacagggttaaaacaaattagaaagcacctctcccaaaatactgcagtaagatgtaggaaaaactgctctaacatattctaaactataggttgctcttatgtaaatatttcaactataatatctagtctgatgtgcccactggccagagttttgtaaaagctaaaagtaaaggaaataaaaaaaagaaagaagtatgtgtttgtttttgaaaaggttaggtcacagaaggatttgttgatattaggaatagaatgacccgtgaaaaaaggacaattaagttccaggaaaacatcttttcagtaaggagagaataatcatttatgcttaacctcaactctgttaggaaaaaaaggatgtaaacaaaaccctttaaagaattgaagaaggagagtataaatttaaatgcccaggttagtgaccacccttagagcatactgaggtcaaagcgtactgtcaagcttaagaacatttggttttcaatgtttgtacaactaattgtactttagtcaagaggactgttatcgaaattgctcaggtagccttgaaactaatatggcccaaatattccagagtctgtctttctcaccctaggagaagaatggtctggttttcaagggaattctctattttttttttttgaaggcatcaggatgtgtgaaactacagggggataaatgaacgatgtacagaatgtgatgaaaaaattatatgaagtataaaatgggaatgaagccatcaggagccaaagaaatatttatgaatttaagagaatgaaaagcatattattattttcagatattttataaagtgaacccaaatcattataaagtattaattaggctacttgattgcttgatctttatatactaatttctaatttgttttaatcgggaactatttttgctagttctaaggctagctattatggtaatccatgtaagtgtgtttattattgtttttaaaaatggaatgtgttcctagtaaatgtgtttaaatagcaaaatgtatttatgcatgcatgtatttattttagtttcctgagacctctagttccttactagaaacatgtatataattccaggcatttaaaattgccatgatggtcatgttttcttgtccttttcccttattctgcaactgacatttgcccttgtctccaatttctcactgctttattctttgttcttgtaagtgttcttgtctctctgggctgacctctctccttccctggagtttgaccccgccccaccctttcttctgcatttgtttgcactggttgttttcttcattgcctttcccactgccccgctgcgctgcatgtgaaacactccgccagtagctgctcacagttcccatgctacatcatacccagcattcaaagagctgctgttctcacatggccgccagtaagattcccgactcctccttcacagcacattcctctagaaagtagaaagaatcccctttcaggccacatgagaagctgcgtgttaaagccaactccataaaggggaatggaaactagcgtatgaaattcagaaatgctacttttaaaggtaaataccacaaagtgaatttcaaattcatacagtttatcataatacttctttatttttataaatgctataatgtccttaatataatgatcactgtgatataagttgtcctctcccttaatatattaattaatttactaaaggagacgggagggtggaaatataataaattagaagatgattcttatatcagaagtacagcctttatacatagttttactttattcagacaatcaatgtagtcatatggtataaatttgaaaataattttagtgagcattacgcttactgagattaatagtgagaacttacctagcacttactgtatgccattcacaattataagcacttttgcatgtgctaatgcttttaagcctcacgtaacccagtgagggaggtacaattttaacctcattttacaggttagaaaaatgaggagcccaagggttaagtgacttgcctgtggtcatatatcaggtaagtgagagagccaggatttgaacccagacagtctgcctggggaatctgtcagaactcctaactatgcagtaccactcctctgataaaaagttgaattgacatgacaacatttcctattcatttatgattcgaccctttaaacaaaaagaacagcatcattctcacatttattaatttgtcaggaatcacctggatcatgagttgaggaaatttaaagtaggagggttgtatgaatttcagaccacgatctcaagaattgcctgtttaactcagagcctgaatcattcacagactaaaaactagaatcactcttctgtaggaccaagagggttgaatcatcaaagtcttgctgaagtgaacggaaatcctcctttgttcaatcattcattcaataattatttttttctggtgtctactctttaccaaactctgtttgagatgatagggattcagtcatagacagaccttctctgccctcatggaggttatggtttcttgggatgacagacagtaattttttaaatctcataaaataattacaaatgtgtcaggaaagaaaatacaggacactaccagaatatatagtaaggacctaaatgtgtgtgtgtgtgtgtgtgtgtgtgtgtgtgtgtgtgtgtgtgtgtgtgtgtgtgcgcgcgcgctgcagtaagggtgagaggcaggaaagggcaatcaggacaccctcccaataaaagtgacctttgaccgagatctgaaggatgaagacaagctgagtgactcttctattcatctatatcttttgttttaaatggcctgaagcctgggactaactaaacagggttgtaaaattccagtatgtaaattgaataactagggatcatttgaagtaatggactgcagagttaatgtataattaagtcacatctagggaagatttcccatcattatcacagagagcatcctgtttgctttcttcacagcacttacgaaaatctatagctatgtgtttggtggcttgtttaatgaaagtctgtttcccctatctgaatgtgagctccataaggacagaggccctgaataccacatctactgacatttggcagtgtctttcatatagtaagcattctataaatgtcttgaatagatgaatgcataaaactaagttaaaatgttactgaaaactataaaaataagcagaaagttataccagaggagaaaaattaggggaaaaaaactataatttctgaagacgtagtacttacatctaaatttgtggcttcataaggttaaccaacacttaaatagttttgccaaaactccaagaaaaaaatgaccgggtgtcgtggctcacgcctgtgatcccagcactttgggaggtcgaggtgggtggatcacctgaggttaggagttcgagaccagcctggccaacatggtgaaaccctatctctactaaaaatacaaaaaaattagccgggcatggtggcagacacctgtaatcccagttactcggaaggctgaggcaggagaaccacttgaacataggaggcggaggttgcagtgagccgagatcatgccactgcactccagcctgggcaacagagcaagactctgtctcaaaaaaaaaaaaaagaaagaaagaaaaaaaagaactaccatttgacccagcacttccattacttggtatgtacccaaagaaatataaatttttctaccaaaaagacgtgcgctcatatgttcattgcagcactattcacaatagcaaagacataaagtcaacctaggtgcccatcaatggtggattggataaagaaaacgtggcatatatgcaccatggaatactacacagctatgaaaaagaaggaaatcatgtcctctgtagcaacatggttggaactggaggtcattatcctaagcgaattaaagcagaaacagaaaaccaaataatgcatgtgctcacttataagcaggagctaacctttgggtacacatggatgtaaagttgggaacaacaggcactagtgacaagggcaggagggtgtgggacaagggctgaaaaaactacctatcgagtactatactcactacctgggtgacaggttcaactgtactccaaacctcagtgtcacacaatatacccatgtaataaacctgcacatgtaccccttgagtctaaaataaaaattgaaatctaaaaatataaaatatcaaatcataaaaataaataagaaaacaattgaatctactgatatgtttcattgcttttaaaatatccactttgaattactgaatattttaatatttttagttttacacttcagcacagaaagtccagaaatccaacccttgagtttacaaagacaccacatgatagttcatagttcacacagctagttagttgtggaactagaacccaaaatttgctctctatgtctctcacataccttttccctttattctaataaaggcatttgtcagtctaaatgtacaatattcgaagacattttttaaaggaactacttatccaaatcccacctgtcttacaaggtccatgtgaagcaatgagataaggtctgtgaaactgcttccgaaactatcaaatgttataaaaatgttaagttttattattagaactgcagttcatctctatgaaacctttctaaactttctcacttttctgaacttgactacgcagcgtcttttctaatctatttgttctccctttataagaagaatttaatcctttccgccctgctgggttgtaagaaaaaggactctcttcttttctataatctattgatatttgattatattacacatctaatgggttcccaataaatacatagtgaatagaattgaaccaaatttctttctagacatgtgaaaaaaaatcctgatctttaaatagaaagggtactttcaaagattatatatagaacctcttggtattttgtatttgcaatgaaaatattttaatttgggccaggtgcggtggctcacacctgtggtcccagcactctgggaggccgaggtgagcagatcatgaggtcaggcgttcgagaccagcctgaccaacatggtaaaaccccgtctcaatcaaaaatacaaaaattagccaggcatggtgacgcatgcctgtaatcccaactactcaggaggctgaggcaggagaatcacttgaacccgggaggtggaggttgcagtgagctgagatcatgccactgcactccagcctgggtagagagggagactccatctaaaaaagaaagaaagagagagagagaaagaaaagaaaagaaagaaaatattttaatttgtcttatgttcaacagttgcatcatatctgcatccttttgttaaaattgaacaggcttctagtttcatataataatttctggccaggcgcagtggctcacgcctgtaatcccagcactttgggaggccgaggcgggtggatcacctgaggtccggagttcgagaccagcctgaccaacatggagaaaccccatctctactaaaaatacaaaattagctgggcgtggtggcacatgcctgtaatctcagctactcgggaggctgaggcaggagaatggcttgaacccaggaggcggaggttgctgtgagccaagatcacgccattgcactccagccggggcaacaagagcgaaactccgtctcaaaataataataatcataatcatcatcatcataataataatttctaccaacagctggcaggaaaaaaatatgagagcatagtcatgaacttcagattccactccccttacttttggcattccattcctctgaattatagcttatatttctttattatctcagtttgatttagtctttctaaatattcacctctgtttccatccataaatatcgactgaactaccttttaatatactatctttttgtaacagagaaaatcaagtgtaggtggattattgtaagtgacactgaggaaatataaaaagaccttgacttgtccaggcgcggtggctcacgcctgtaatcccaccactttgggaggccgaggcgggtgaattacgagatcaggagatcaagaccatcctgaccaaatggtgaaatcctgtctctactgaaatacaaaacattagccgggcatggtggcaggcgcctgtagtcccagctacttgggaggctgaggctggagaatggcatgaacctgggaggcggagcttgcagtgagctgagatcatgccactgcactccagactggtgacagagtgagactccctctcaaaaaaaaaaaaaaaaaaaaaaaaaaaagaccttaacttgcttcaaacaagtcaggacccccaattccaattcttaggtctggcattcccatcagacacttaaactgtaggggcagtaaagttgcccatgtggctacagcttttgtggctgtgctgtacttgggaattttaatgttaccctctttgaattaggtccttcattgatcatgcatctcaaagtatctcagtgccacataaaaattttctttcagagtcatattttcccattatgaatgctacctactgcttatctgttgagtgtacacttttaaaccttctgtgggtggtggcccctttgccactgggtgagttagatgctgatcctggtcattatcgctgcctttccagccttttctgctcttacaccaagcacaagaattctctgctgatagtcaggatctagggctgggaaaatgggatgagttgtcctgttagacaggcccaaaaggagtattgtttaatccccagggtgtggggaagaaagatactcttgttttcttttccccaaatgtgtccatatacacccttctcctttgctggcagccaccaggcttgttgaggatctaccctcctctgcatatcatgtgcatcaagggaagccccaacccaagggaatacataatgatagtcctgagctatttcatggtgctctcgcagtcttgattgccctcttcggaattggacatggtcatattacgcaattttaggtaataaaatacaaagggcattcagctaagggaccttctgagaaaggtttttctcgtctagagaactaaacaggcatccttctccgggcactatgcgtagttctttattctacctggaacattctttctccagaaatctttgtgactaactctgtcatttccttcaagtcttattcaaatctcaacttaaaaaaaaaaaaaaccttcttaaaatttgaccacactaattagacagcaactgccccatctccctcttcccagccatctgaatccatttcccacttacctttttatgatagctcttctaggaaggcactccctcctccctgtgaatcatgtctccaggcaattgttccttgtgtagaggaacacaccaaatctgggctgctcctgtacaacaaactgaaggaggtagaattgattctgcaagaagttcaaagctaaataagaaggagtcttgtagcttctgtcttggtcttctggaatgctcactctggggaaagtgatctgccctgtactaagtctactctaaggccactgtgctgtctacatgaagaagccacaaatctaagctagccacatggggaagctgcatggaaagacaaatacgtggctagcccccagctgttggccgaagatccgcagccatcccaagtgaggagccagatgtacaagtgaaaaaactgtaacagccattccaatggagccttcagatcaattcagctttggctactatctgactgcaaacacatgaaagaacccaagcaagaaacacccacctgagcacagtcaactcacagaaccatgagcaatactgataaatggttatttttagccagtaagttctagggtgatatatagcaaaaggaacatctgtcctgttttttctggtttttcctatcatacactcattctgcaggattaacatgtgtaatatactttttttttttttttgagatggagtctcaatctgtcgcccaggctggagtgcagtggcatgatctcagctcactgcaacctccgcctgctgggttcaagtaattctcctgcctcagcctcccgagtagctgggactacaggcatccaccaccacgcccagctagtttttttttatttttagtagagacggggtttcaccatgctggccaggctggtctcgaactcctgacctcgtgatctgcccgccttggcctcccaagtgctgggattacaggcatgagccaccactcccggcctaatatacttttttaaattgtctttcactatgagaaggtgagctccatgaggccagggatattgtctgttttgttagctaatgtatccaaattacctaagaatagatcttagcgtggtaaatatttgttgaatgaacgagtgaatagatcagaatttcagtagctacgttgtgagtatgtggacagttcaccaagaatggcagaatggaaggatgggaggaacctggaataatgtcattgtgcttctggattacccagtcctggagcagctttgcctctgtgggccttgactagtcaagacattttgtgttgggtttttatgttaattccatttgcatcactataaaggaatacctgaggctgggtaatttataaggaaaagagatttcattggctcatggttctgcaggctgtacaggaagtgtggtgacagcctctgcttctggtgagggcttcagcaagcttacaatcatggtggaaggtgaaaggagaaccagcgtgtcacatggtgagagatggagtgagggggtgggaggtgccacactcttttaaacagtcagatcccacatgaactcactctgagtgagaactcacttattactgcaagaatggcactgagccattcgtgagggatccagccccatgatccagtctcccccaccgggccccacatccaacactggggattacatttcagcatgagatttgaagggaacaaacatccaacccatatcagttttctacaacctgcagcagaaagcatctcatctggcacatggtcttgcaaataattctgacttagatgcatgggactcagatatgactgaaccagaagataaatctaagtagcagacaccacagtattctcaaaaccactctttctctttctcttgttgaccgaggcttttctactgagcaaagcacctggtttataatatgttctttcattacgccttctcctaagagacctccttagtgtccctgcaatggatgtctggggagccaccaatctcttagagatgactagacatgtagccccagaaatggttacaccttgagcttttctctcagtgcagatgagatacattgcccatcccaccaatttgccacatttatctaaatttctgtgttaagctgggacctctaccactcaagctgggatgcccctcaccaccaccacactgcaaaaactaaacatttttcattagcctcctacttgcaattaagtacataaaacctgcaaaacaagtaataaaattaaggcactatttggttaatgccttttctcagaaatcacttttgcatgaagttcagttcagtattttatcagtgactacattagtctcgagaccctctacccaataggagggacaaagatgtacatgacacaggctcccttcaaagatgattaatacatgaactacatacagtattacaagggctccactagagatgtgagccccccagaaatgatattaatgtgcagaagagttagcaataaattttgcacaaggggtgacatttgagcttagactcgagcaatgagtagggttccaagaggtaaagaaaaaaatggaatggttttctaggaagaaaaccaggtctgggaagatctgatataacctgaggtagtttataagtctggaatgactgagttatcgggtatatggtggggaaggcagcagaggtgaaataagtaatatctaagcaaatgaaaaacatgtaattaggggagatgaaatataattaaattatttaccttaattcctcttttgactctttacatttgtcattcataaggaaacaatttcactaagattgttttgacctttttaccttatttggccaagtaaacaagggacagaaagtttttaatgtaaaatattcattcaacctgaaagaacattgatgattccagaccatttaaagttaaatattttagagttctcaattatttctatttggatgagtagaaccttttttcagacttcaggaatatatgtttagtttttaacagactaattgttcctgctttcatgccagcctcatgggcatcagcaggttcaaggttagtaggtaggaatctgccccctaagaatgcagcctaagagttaaggaatgcatgattacccctgtaattacttgagaggggctctgaaattctggcagggttggtgaggccaccagataacactgatcaagaatgtacacgaggttaggaattcagactgtagctgaagtggggagttcgggtaaacaggctctgaatggaaaagatcaggaattcaaatagacagttaagtcaagaaaccaacatcttagaaatgtaaacctcactttaagtcaaaggctctccaagctaagacttcataatatatttgccaaggcaagagctagtatctgcttacctgagtggtcctggagctgcggccagttgaaacaggagattgcagatggaatgtcagttagaatactttcagaggccagtaacagatacctgactttaaagttcttaagtttgtctttcccaaggttttctggtcataagaatcaccaggggcacttgattaaattattaattcacaagccccttcactggagattctgatgcaatagacttgggaatatatttttttttaacacgaactccagtggaatcaggcaagaagtgaaaaccctatcgttaataatagacacattagaaataatagagacatttgataatctagcacagttcccaaactttagtatgcatcagaatcccctgggggcttgttaaactacaggctggcaggctgctcccagcgtttctgatgcagtaggtccagcgtggagtccgagattctacatttctagtaggttgccaagttatgctgctactcctgtggtcaggaactgcactttgagaaccactaatcaaaataaactgaagtccaaagaccatcagacctagagctggttaattcaacagattagctatatcaagacttgaggtcagcttctctgggattctcttgtctttttcctcatggtcccaagatggcttcccactgcgccaagcaacatatccgcagacaacaataaccaaggcaagaaggaataaggttcaaggataactgtattgtgtgcgtgtgtgtgtgtgtgtactcatgcctgtgtgtctgtgtttggaaaagcaaacgtttcccagaagctccccaacaaatttcttcttatgtgtcaactagaactggatctcactgaacctctttaagccaatcactggctatgagaaacaagcttactgtgattggcttagaccagattttaattttttcctcagagctgtgtcctttgttgcccaatatctgaacataattgagcttctttaccaaggaacaagaagtaaatagctgttagttaggcaaatagctgggtatgtccacaaatgggttctgaaacaagtgtgattataatgaggttcagaattgaaaatattagtacaaatgctagtaaataatgtatgatattggctttcttatcaccatttgcaacagaataacagtctcatgaagaatttggcacagccattgtagaaaaagtgccttttcagagctcacagtatgcatgtactcatcttgcttttattatacctgtatatggaattgcaagctgtcccttcaggtaatgaaatttagacaagttggaacctgtataacagcaaatcaatactgaaattataggcaaagcctgtacttgtgcagactaacacataggatagaaagactttgtgatcaaaattcaacaaatcccacatttataggtatccaacatagagagaaaactatatatagtggtgtgtctttttatgtgtttgcgtttttctccttattcattcctgaaagtgtattttcttttaacagactcacaactcagctacaccccatatgcccacagtcaacacagtggaaaactgagttgtttatttgagcctcaagtcatccaaatacttcgttaaacgttgtagtaaaaggtctcccctgaattcaaggaggatgccctaagttttctgcatccttttgatagaggaaagtattaactaatgtcagactatctgttgttttattttcctttacagcactagattttgttaaggacattgataattttgaaagagaagctaagctaaggtgacaaatatatcttctgttggtcaatatctaaaattatgtattatttcttttttgactacaccttacagtggttagtttgcactttacgtaaaaaactgatgtctaccatcttccatctttgtaagcaccatccagcctaatagttgttggtttgaataatgccacaagctttgtccagaaaccaaaaacctgatttccaaagactagtctatgtagctgagcccttcattccataatcattaaactatggttaggacacagtatccagtctcccctcaaccttgtccaatcacagtctatgcagagatcatgtaactcgattaaaatctagaaccatagagacatttcccttccctggggcaaatgggaattgcacatgggggaaaatggtgtggataagcaaaaaacggaagtttccaaagtgcaacagaatattgataattttagtacatttcaacatacagtgagtgtaatgacggcattttcctactgcttccttagttgtgaagattttgttttttcttctgggttcactgccgggaaaagagcagaaaatgttttagagcctctgccagcagagggggcatttaccatttgtgcataaggtctctggcactgtgccctggggttctcttttctatatgtttctaacagtcacacacagcagtgtgactgtttacagatactttaccgtcttctctgattgaagcagggactggtttgccagcaacttttggttgtttttgtttttttgaagaccatgcaactaacagatgtttgttgttggctccatatctacattctttgaaagctggagaatcaaattgctgacattcagacaacactaattcccatatccagggagcctaatttgccgtccctgagatcctgattcctggtgttcacgggtttaaaaaccatttcagtgacacaatataagaatgggcttgggagatgcagcgctgtctccactaaagataatcacattttataaacatctgcgtcattactggtatgattcatctctaagctgtatacagctgtgtttccagtttcaattaacaatcccttaattgcatatccatctcatgttactaatttagttaatttattcataattaagagtattctgttttctaccaaggtttgtcgagctcagaacattataaagaaaaatattttaaggcagcatctccgagggattttgtttcttataatcacatcacagtaaaatgtcattcatgcgcccaaaggaagatgaattgctaagggatttttttttccagtaaaataagaagctttgggaagctgcagtgtgttgtgtttttaaaccaagttaaatgcgatgcattttgttcttttctttctccttccctgacatcctctcaaaaaaattatcattttatttgtattattgcttaagtatcacagcaaatccagtcaccagtgcaaataaaactgtcattaccctgtcaggtaatggtgtctcttaaaatctaagctataaagtctgtacattttagaggacattaagatcaagaatttttaaattgcctaagtctaagcaagtggagtacacccttgtggaaaatggaaggcagatgaaaacatgatgccaggcagtgaattcattttagtttgatcttttctacaaaaatacatatatccgtgcagcaagagtcttgcctgtgttagtacatgtgtctgtgtgtcattcaaagcagcaataacaaaaaattaagaccatttctcactttgtttattgttcaagaactcccacctatagccttgacctgtgtttgagcttaaaaaaaaaaaaagtcttataactgcccagtggtttggagattttacacaatagaaataataagccatcttttgcctcacatgaattctactaaaatcaaaactccataggatactttccaaagtaactggtgaaaggaaaagtgtggtagtataggtatgcatattatccccatcactttatttctgagctcttctattttttaaaaattttaatttgtatcttaaaagggcaaaacataagaagaggtaggagtattctaaatttcagtgacaacaaattcatttattttacaatttaaccattgcccgtcaacatttacttaaaatttcagcatgggaggttttaaacacttctagagtcccatcttaccccatttccacgatgcttttcttctccatgtgttgctgcagtttaatattgtctgcgtgttttaatatgttaaacgagttaaacatagagtaggaagttaaaactgttagcagctatatgtttcccaagattgatgaaaattcaggtaacactccaacctgttaaagatacctgcaatctggccaggtgcggtggcccatgcctataatcccagcactttgagaggccaaggcaggcagatcacctgaggccaggagttcgagaccagcttggccaacatggtgaaaccccgtctctactaaaaatacaaaaaacatttagccgggtgtggtggcatgcacccatagtcccagctactcgggaggctgaggtgggagaattgcttgaacccggagcctgggtgacagagtaagactctgtctcaaaaagaaaaagaaaaaaaaaaatatatatatatatatgtgtgtgtgtttatatatatatatatgtgtgtgtatatatacatatatatatgtgtatatatatatgtgtatatatatatatatatgtgtgtgtgtatatatatatatatatatgtgtgtgtgtgtgtatatatatatatagaaagagagagagagagagagagagagagtaagcagggaggggttgaagccagaaaagactagaaattatctaggccaaaccctttaatttatagattaggaaatagtttctggttgacttagctgagacgttctcatttgttaaaagcaagatcagaaatcagacacaattcaacgctcttcactacaccttgtttttctctttgtggaaaacaagacgtatcctgttcaaaaatttatgctgtttatctgaaagcccaaaatgcctgtttacatcatattttccattttgcaatagcagctcattttggggattattttctgatgaaatctctaggtttagttgtacttgaatatctttttatctgtacacactggaatatgcatataataattgatagaaatgtggattttaaaagtagagatgatcattattattttatgatcctttaagttaataaaattcacctagaataaaataaacaagtttaactaaagttctcgcattttcccagaaatcgtagactagaaactagtcttatttgcttattttattccaaagcttattttacctctattattttgtggttctataaaatatttctgtgtattcctccaaagaacctcttggaaaagaaagtaaacatcacatctgaaaaatagctgggcattttttcattatctctgcaaggggaggggacgtgaaaggcaaccccatatagaaactcaactccctgctttttacaatgaatgaagtttttccactgcactgtcagaatggtaattcttgctaactactcacctatttcacaacattaacagagttccaggattcatgctttaatattgcataatggtccatgttttgaacatgaggagtggcagcggagattacactttgattccttggatttcatgtggcactggatgggagcaaggcactgattttaagttgagataaaaaggagaagtcagtcaatgcctgcagccagacaggactcttgtaatagctagggagtatgcctcatttggatatgcatgactgccgggcaaggacactgccatgaatcgctaatggcagcagttgtatgacataagagagatgtgtatcagcaactcacaagttgactttgttacatgttatgaacacattcctgtgggcactcattcatagaagtgagaaatgtggacaccacagtgtcccaggcctttgttaccttatggcctgggaatatcttgctttgctggaacatgaagccacgtctggttataagaagaagtttgatctgggagcaaaattgcctgttcacgcatgtctttctcacttctttaaaactaacttgctataagggtgattaaaaaaaacagatgtcaggtgagagttttgctttgcatcaacttcctacttgtagaggtaataacataaaccttgcctggcaatcattatttgtcatccagctgagggtgtttactcttgagaaagaagtaatggacaaaattgacttggattctggttctatgtttcccattaattgactctggacatatacatgcaatttaatccatcttactaaaaacatgaccaactcacaggatgtaaattctattctatagaaagggctttccctcagtagttagtcaagggacggttcctaactcctgtctttattgagcttattttccaaaataaatgtattattttctactttgttcacagagcaaggcagcataaagaaattaagcaacaaaacaatagtgtatttttacccaactttctagaaaacacccatttttcttaagttttgatatttttttgccaacaggcagtcaaaaagaagataaataaaactgggttaagttggtaatgacacaataaataaatgagatgaagaaagaggcaataaatatgagtggataccaacaagaaacatgttcaagccctgaaaaaataatgagaaaaggtagaactattaataatacatcccgctctcgtatcacaccttgctccccagatacatcctatctgtcctggcaccatgttgatgctgttgttctgtaagctatgccaatgaacatgttggatgacctactccagctctacctcaagatttccaaataagaaaaggacccagggatctccttgctgaggtctttatccatttactcaggtcacaagtactaattaagcagctcttatgtgcaaaatgttattgcttcaggtcagtttttcctatactgctgttctataagagaggaagaaggtccctgccctcagaaagccctagaatacagatctagagatgggttcaacatctttgttatgcaattatttcattccaattgtaatgagtacttagaaaggacaaaagcagagtgctgagagagtataacagagggacttgacctggtgtagtaggcctggaaagtttcctggggaagtggtattttagacaaacaacacacacatacacccatgaatgtatacgtgtggagaatgtattctaagtaactatgatgaatgtatttcttactgtaggtcatggtcaaagtttgaaaactattgttctaactagtattataattccagggatagtagaggtcatgtgacctgtttagcacatgcctgccttaacagtatctagtaggccaggcaatgtggctcacacctgtaatcccagcactttgggaggccaaggcaggtggatcacttgaggccaggagtctgagaccagcctggccaccacggtgaaaccgtgtctctgctaaaaatacaaaaattagccaggtgtggtggtggtgcctgtagtcccatctactggggaggctgaggcaggagaattgcttgaacccgggaggcggaagttgccgtgagctgagatcatgccactgcactccggcctgggccacagagtgagactctctggaaaaaaacaaaaaacaaaaaaaaagaatgtctagtaaataagtcagtgccaagcaactacctgataactgttaccaccttagtcatcaccgaaggcagaaggtcttgcattcattggaggagagttaccaatctaagacatttgcatgaaaatgtgcacagagccctcacctgataatcaaagcatgttccaacacttctctttggataaaataagagttacatctcaatgaaatcacttgtggatcaagttctcatcctttcgtaaataaagagaggggcagcaagaaatggaagtgagcacatataagtgtgggaacctgtactttcctaacctataaagcattggatgtagtttttgctattggtgcgcatggagtcatgtggccttggagcagttaggtaccttccctgatgataggggagaaggcaaagaaattgatgatacatctctctcattgtcattccctagtatattacacttaaatctaactgccctattttgtgattgccttactgctgtggcttgaatatttgtgtctccccaaaattcatatgtggaaacctaattccatatatgatggtattaggaggtaggccccttgggaggtgattagatcatgagggcagagcccacatgaatgagattagaacccttataaaagagacccagagagctgctttgccctttttgccatgagaacacaagaaggtgctatctatgaacaagaaagcaggccttcaccaaacactgaatctgccagcgccttgatatcagacttcctagccttcagaattgtgagaaaaaaactttggttgtctataagccacccagtttatgatattttgttatagcattccaacggactaaaacattcattttccagaaaatctactccatttataagccagcattcttttttttttttttttaattttctacagatctctgcagaaacatgcagagtaataatagggccaggcacggtggctcacgcctgtaatcccagcactttgggaggccacagtgggtggatcacctgaggtcaggagttcgagaccagcctggccaacatggtggaaccccgtctctactaaaaatacaaaaaattagccgggcatggtggtgggtacctataatcctagctactcaggaggctgaggcaggagaatcacttgaactcaggaggcagaggttgcagtgagccaagatcccaccattgcactctagcctggacaagaatagtgaaactgtctccaaaaaaaaaaaaaagaagtgataatatatttgctgtatatattagttatagatagttatattgcagtactatcagaagctatgccacatattatttacgtatttcttaagatatagaaaacatccctcccctgcagtcattagtacttttgcattcaaacttcaaatgaaacaggactttagaaattataggcttggtgccatcctggccaacatggtgaaactcgtctctactaaaaatacaaaaattagctgggcgtggtggtgcacacccgtagtcccagctactcgggaggctgaggcaggagaatcacttgaacctgggaggaggaggttgcagtgagccgagatcgcgccactgcactccagcctggcgacagagcgagactccgtctcaaaaaaaaaagaaaaaaaagaaaaaaagaaaagaaaaaagaaattataggcttggtgatttctcaggcattaactcaagaaagcagcctttataccgattacctacattcacccagcacttaccccattaatttctaatgttgcttggaacaaatgaacattcctggaatgcaagctaaatgaaagagccccgaagaagaacagggcatttcctggttcctcatattgacaaatttaaaagcctgtgctataatatgggctcctgtttcctttcaagtttgtctttgaataagtggacagagtagctgaaagcagagtatttaaagctttgaaacgaccactttatttcagtctctgttcttgctgggaccactcttataaatgaggagattagaaaatcacctagaactatttaatcgttgtgcagaagaccctcttaccccaaatatttacttaccgctcattttattggcacactgcctcaaattccacctgctgtgaactgacctaagtgaatttaggtcacgtgcaactattaggttctttttgggaaataatggagaaccacagatgtgtttgaggtggatgaggaatggctacctcaagccgcagcttcatgcttcatgctgaagtcctccacaagtgcaatcatgtcgttaaccaacatttgttagaaggcaggcagaagtcagcttacagcctgttctacaatttttatgaagtgtaggattttaggcttaaattgacaccattgcaaatacagtattctcttacctttagatttggcatcaggtcacaagaattcttcctaagccaatggttggatacaaggccattggagaccagacgtaaaattaaaagcccaagcaacaggttttgctggattcttatatcctgtttatgcaatgttaggggatgtcattaaaatattttagttaatccatgtatcttgattgtcttaaattttactaatgagatcctatagggatattcattgcaatccactatttccctcagcaaaaacacatttgcgatatctattacatgcattacaaaatcctccaaggttcacagagatatatagtagtagcagtctctgggttttggcctttttcataagatgaaggctgtgctgtcctagaatatgaattcctaattaaaataaccatttgcctcaagcctctagagttgaaggttgcactaactgcacatataaaatatccaactatctatgttgagatatttaaaattaattacagatattgtaacaccattatttaacttaaattccattacaggtcctttgagtatgcaaaatatttctttgagatgtggtaacccctttaactgatcaggaaataaacctttattatcaagttgttatcccaccttgacaggcctaaagcgcagaccacatatcagaatcccctgggcagcttataaagctcctcatgcccaggctgcatctcagaccaattcaatctctgggggtgggctccaagcatcagcatttgttgaaaatccccaggattacaaagtgcggtgaagtttgcaaacccttgtaataagagaatgggaggagggatggctgtttgccaagcagaaccaggaatgaggaaggatattggtaaacaaaatttatccataattgacttttcatgaatcacagtcctactgagacccagccttgtctcatgagactttggctacgatgatgagtgagaaaaggactcctcctaatttaccagactcttgattagaagcaaatgaaattttggaaaagagacaagtcactttcaaaagaccccagcctgtacctgaccctacctctggactccatagtaatggcaggtagtggtcattcctggagtaactctgtatttcttaaaggaacatttgcataatgaacctacagcaatctggaagacgactggggtaaatagagaatttgttgattttagatggctgaatactatccgtgcagagcaattaaaaggacaactgtcagaatcaagtaagagaaaggaaataagagaagtctcatgttagtagaccttgtttgatcaatgtgttttcatcttgtatatgattaataaaataagtttgggagttaggatcaacctttgtttactcactggagaataacttgcatatagaatgaagctgggattgtccaggctggtttttttccatttggaagtttggatacaatacaaggaagcctgaattccaaactgtttctcttaaagagtgcctttctgagccgctattaaggaatgcttattgtttcgaaaatggtagcacagaagtgttataactagagtacaccttgtgcctgcaattaattacccagtgtcttcaaaaattcttgtcttttgctggtagaaaacctttgaaactatagttgtctgtggtattcactgcagcaccttagatataaagagagaaatttattttcagaggaatcttgagacagtttgtgtgtgtgtgtgcatgcctgcttacacatctattggttttccccaaggattgtagaaatcccattaaaattccagcttcttaaggagctactgaaactccagtttttcatattttcttttataatatttggatgcgtttaggtaaacttgcagcattttaattatgtctgtatcagatgagcggaagaaatgtaaaagggtttggggagagatttaattttagatagcggcgtaattaatagcatttggaaaaactagtggaactttaattaaatgtctctacattaatttagtcatttaattgaacatgtagtgggatagtccttacaatttttcacccttactctttgaggaaaaatgatttttgaataacaaagcatcagtatgactactttttattatttagctgtatgttcactacttggcactttgtttaatttttccccccatatgtttcgagctttttaaaacattaatttggcttgtcgcttttatcttaaaaactataaatctgggggccgggtgcagtggctcatgcctgtaatcccagcactttgggaggccgaggtgggtagatcatttgatgtcaggagttcaagaccagcctgaccaacatgacgaaaccctgtctctactgaatacaaaaaaaactagccgggtgtggtggtgcatgcctgtaatcccagctacttgggaggctgaggcaggagaattgctggaacccagggggctaaggttgcagtgagcagatattgcaccactgcactccagcctgggcaacagagtgaaactccatctcaaaaaataataataaaataaagaaataaagaaaactataaatctgggagaaaccgtatttggaaacattgagcaactgtttcttttcctttattttagactttaatattcactagagtcatgttgtaaagttttcaccttaatattgtaggctttttttttttttttactttgccaacttaactggcttttttaaagtggtgttatgctgcagcagtgtatctgaatttcagcagtgccttttacgtggctgctcacaatcttattaaactacatgaattatacatggagagaaatataatttggtaaatttggtgatgtttcaataaccatgcccaaggaggaatgttgtgttaaactgtcaatttgagaagtgttttgtggtgctaaccacagagtgaattcagttctacttcatttcacaaccctccataaatagtgccccctaaaagtggtgcctccttgcctgtactttgacccagatttttgtcatttttctagataagcatatacattgtgcacttattaatttttcaaatgacacaaaggtgagaatgggagtcaacacactgaaagatcaaaatcaagactcaaaataagattataacagactgggatactgtaccaaaataaaaaaattaaaataaaatttaacaagaacaagcaagatgtcctgcctttaagatttttaaagtcttttgtacaaatataggctgaggaacatctgactttgtggcgctttatatgaaaaacaaattgggattttaaataaccacaaggactgtattaatctccagtatgatctggtgtggcttactgtacgaggcaatacagtattagattgcattaatgaaattcacaaatgttccattaatctcttcactagttaaaccacatctgcagtcatattgacttatgagcatcacgtatgatgagaacactgaaaaatcataatacattgacagcagggcaaccaagattgtgaaaggtatagcgatggttatatgacaaatatttgaaagaatctagaatgttcagtaagaagataacatgaaaatacaggacagcttcttcatgcatctggggagggtgggtaaaggacacagcacacttaattaagtaagattgtagaagagaactatgggcaagtgttacagtggagcttactctgagtaaggaaaatgtaaacgttagagttgttattaagtggcatgggctgcttcacaaatttccatcattttttaatctgattcatctgctaataggacaaactgtaacaatagcttaaacaatagagaaatgtaggtctctctcatgtacaagcccagaactaggtagatcaggcctccttccgctattctgcttcactaagtccgaagtcctcctttaccttgtcctgccatggtggcctcaattctcgttgtcaccacatggtccaatatgtctgcttcagctccagccaacacatctgagttccagcccccagcaacatggaagaaggaaggaggcacagagagggcgtgtgccagcagtgttgtgagaaaatctttcagaaactgtcatgaaatgtatcccctgatagttccttcaccagaactttgtcccatgattatatttacatctatgtgaggctaagaaatatattctttccttcaggcatctacatacccaactgaaaattatgagttctattgccacaagaaaaaatggaaaatatatggggacaatcaacagtacttgcacaaagatgttttacagagaattactcttttacctgggaattttacaagataaactttaagatcctatcaactctctctctctctttttttttttttttttttttgagacaagagtctcgctctgtcacccaggctggaatgtagtggtgcgatctcggctcactgtaacctccacctcccgggttcaagtgattcttctgcctcagcctcccgagtagctgggactgcaggcgcccgccaccatgcctggctaatttttgtatttttagtagagacggggtttcaccgtgttggccaggctggtctcgaactcctgacctcaggtgactcgcccgcctcgacctccctaagtgctgggattgggattacaggcatgagccaccacgcccagccagatcatctctggaggcagggggatcacttgaggtcaggagtttgaggccagtccggccaacatgacgaaaccctgtctctactaaaagtacaaaaattagctgggtgtggtggcaggcaactgtagtcccagctactcgggaggctgaggcaggagaatagcttgaacccaggaggccaaggttacagtgagccgagatcgtgccactgcactccagcctgggtgacagtgagactctaactcaaaaaacaaacaaaaagagtctatgatcctataatttatagacaacatacaacctcctttctctacaaagagaattggttctcaagggctgtttggaaattcatttccttttaagtccaaaatgacatacaaaagtgaccaatatatacaatgtacacccttctacaataagttctcttttgttgccgtagtaatcgcatgtcttttcttaaaggaacacttttttgactcttttgtacttttgaacatagcggtgttaataataatatttataaaacattatgaaaatatgcacacaaaacacaacacaggctaagaaaacctaatggtggcctaaagtaagttctgatgtcctctgttggtggtattcttcattgccatgcttctgctgtgcctgggacctttattgctacctatgggaagttgtaagtagagaagtttctttactacagggatgtgaacaatcattgtaagtaaggaataatgaattcacataagttcacagagcatgtttttctgccctggtaatactgcatttctcactttgcatttaaagtacctacgcccttacacagaaaaagttatcggggttgggtgcagtggctcacgcctgtaatcccaacactttgggaggccgaagcagggggatcacttgaggtcaggagttcgagaccagcctgggcaacatggtgacaccctgtctctactgaaaaaaaaaaaaaaaaaaaaaaacacacacacagaaaaattagccaggtatggcggtacatgcctgtagtcccagctacttgggaggctgatgtggaagaatcgcttgaacctgagaggtggaggttgcagtgagccgagatcgcaccacttcactccagcctgagtgacagagtgagattccatctcataaatatataaatatatatatataattatcgattgattaatattattatatggtccccattactctaaactctcaaaatgtaatgtaggtcaaaatcagaaaaaggccatactgtctactccttcctctgtttcattccaactataagagaaagggagagggcaaaacaaagatgacaggaggccaaattgtacatagaattcatggaaattcttacccaacatgtaaaattatgatagtataaggaaaagtatactgcaaaaattaaacttctacattgtgaaatggagaacatttttacatctagctctattgcttctccctgtggagctgttctaagcacaaagttcccattacataatgaacaactccttaaatactgtgcaactatttctcactagaagcacgatgcagcaaactctgtttctcagtaaccatttatatcatacctagtggtaccgagttctataataaaagggtgatatgtgcatattttgtggtcatagagtgcaaagttgacatctacagtttaaagcattgcattgcatgaataaggtcaaaatttaaatacttttctatgatcatgttctttacattaaaggttaaagatgcatgccgctttaaaaatggtttaagggccggacacggtgactcacgtctataatcctggcactttgggaggctgaggtgggcagatcacccgaggtcagacgttcaagaccagcctggccaacatggcaaaaccctgtctctactaaaaaatacaaaaattagtcaggcatggtggcgggcgcctgtaatcccagctactcgggaggctgaggcaggacaatctctggaacccggaaggcagaggttgcagtgagcagagatcgtgtcactgccctccagcctgggcgatagagcaagactctatctatctcaaaaaaataaatgaataaaataaaataaaaatggtttaagaacttcaaaccatctggcaccagaaaacacctaaattgaattaaaaatctggaaatttaatttcacaacttgtcctttttcaagcctaccctaagttttgtttacttaatggggagaatctgttttatttgttcctatgtagaagactgctgattttatcatgattgtattagggcccaaggatatttaaaatatttcagtagctattacttatactttatatctgcattgcactttagagttgactgagcattttcaaagtattatcttaccaaattgccacaatagtcttgagaggctagtaaatcatgggagaagcccccatttccccactggaaagcagagaaaacccccattgtagtaaaggaggggttccctccagagctcttgtggttgtgttgaggaggaagtattaatgctgctgggcatgacttacaagaaataagtcaattcacttaagcaaaagtgctatgatcctgtataccatgtgagcagctctaggatggggtcacccagcattttggagcagacattagaacatctggagggagtaaacgcaaagaaaatgggctagatacctttccttggatgggaaaggataacattaagataccaagatcaaatgttcaaagagcacatatacaccagagaatactatgcagccataaaaaatgatgaattcatgtcctttgtagggacatggatgaagctggaaaccatcattctcagcaaactatcacaaggaccaaaaaccaaacaccccatgttctcactcataggtgggaattgaacaatgagaacacatggacaaaggaaggggaacatcacacaccggggaatgttttggggttgggggagtggggagggatagcattaggagatatacgtaacgctaaatgatgagttaatgggtgcagcacaccagcatggcacatgtatacatatgtaacaaacctgcacgttgtgcacatgtaccctaaaactttaagtataataataataaaattttttgtaaaagcattgtataataaaagtagtaagataaaccagtaaaaacaaaacaaaacaaaacaaaacaaaaaaaagttcaaagaggccgggtgcagtggctcacgcctgtaatcccagcactttgggaggccgaggcaggcggatcacttgaagtcaggacttcgagaccagcctggccaacacggtgaaacctcgtttccactaaaaatacaaaaattagctggatatgatggtgcgtacctgtaatcccagctacactgaggcatgagaatcacttaaacctgggaggcagaggttgcagtgagctgagattgcaccactgcactctaatgtgggcaacaaagcaagactctgtctcaaattaaaaaaaaaaaaagtttaaagaaaaataagttatttctccatgcttcaggagatatgtttcgcaggagaaagaggcttaatagagaaaacagatccctacaaacatttgtggtttttaaaactgccccattggttactaagtggataacatgagcgtgatgccagattcagtactctagtgagccatgcagctttgctgtgctctgcacctgatgagtgtggcctcacttcttataaatgcctgtcattgctaacaggggtccttgctgaaacaacagggctggactaatgctctagttcccttcctggaaaacctatcccaaagctgagatcctcatgatgccttctctcatatatgaatgattgcaggttacgctatcatcattaaatcgaaacattttagaccactttgcgtttgtttgtttgtttgtctcattatgtccagttttatcctgtttcataatttaataaatttttattgggtctgtcttctggttaaatgttgtgtgtataaaaaataaagtcaagagagagaacaggagttatggaactaatgacaaatccatccttcagctaaataaaattatactatggatgatttgagctgtacgttgagtgataatttttaaaaataagatagatcgggtgcggtggctcatgcctaaaatcccagcactttgagaggccgaggcggatggatcacgaggtcaggagttcgagaccatcctggctaacatggtgaaaccccatctctacttaaaaaaaaaaaaatacaaaaaattagccaggcgtggtggtgggtgcctgtagtcccagctactcgggaggctgaggcaggagaatggcgtgaacccgggaggtgaagctcgcagtgagccaagattgcaccactgcactccagcctgggcaacagagccagactctgtctcaaaaaaaaaaagaaaaaaaaaaagggccaagcatgctggctcacacctgtaatcccagcactttgagaggccgaggtgggtggatcacctgaggtcaggaattcgagaccagcctggccaacatagtgaaaccctgtctctactaaaaatacaaaaaattagctggacgtggtgacaggcacctgtaatcacagctactacggaggctgaggcaggagaattgcttgaacccaggaggcagaggttgcagtgagccgagattgtgccattgcactccagcctgggcaacaagaacgaaactctgtctcaaataaaatgaaataaaataataataaaaaataagataaagtatcacaagtaagatgtagttgaaacttcatgcatttttctatgatgcctatgatattcaaaagataactgaatttcatgagcagagttcaagaacttctgagtatacttttcattgatgacttaatgtaatggatttctatgatgatggcactatattcttttggtgtttatggtattaataaaaaattgtggtaaagcttgtggaaatgaacatgccttggattagggtgccttaaatgtgcctttgtaaatgcagctaggagactccaagtcacccttctagtctaactgctactcctttcttttacaaactacatgccaactaaactgaccttgatctgtttatgaaaaggcggtataggaacaggggctctgcaattggacagatccaattctaatcaatccactccattgatagatatataaccttgagtccttcctgtgcctcagtttcctcatctgtaaaatggaattaaaaaccaacttcgtgaggcttttggagaatgaaaatgacataactcaaagattattgggtatcagaaacaataatgttatctatcactgtctttactgttattattattattgtcattattattattttctctacctggaacaccaattccacaaactcttaatgtcaagaccatgctgtatcatggagccttccctgattcctccatatgaaaataattaattctcatattaataatattacttttctagttgtattttctttttttagcttttattttaggtttgacggtacatgtgaaggtttgttacataggtaaacacatgtcatggaggtttgttgtacacattattttatcacccagatattaagcccagtactcaatagttatcttttctgcctactcgtattttcattatccccaagtatactatacatatcttaaaattaggatccatgttgaaaaaacattgatatttcctatggcttctaacacagtacattgcacttagatattcagcaactctgtattgaatgtatgggtacaatctgctcttagtttctaatttggtattaatatgttcaagcctcaagagctcatgtaaatgatggtttgactatattgcccatcttttgttaagttgaaaagctgaaattcatgcactgtttgttagtgtagtaatttgtgacaacgtctagctattaagtcttttctaggtataaaacctttatatctgtcattgttcccctcttgtgtttttgctttaatatcgttgaaagcatctattattggaactttcacttctgaatagtacttttgagaacctgtatagaatttcagaggccttagaaaattgtcatagattgcttttagtatatggtttaccactgtggtctcttaacttttcaaaaagtatttccaaagggcacttacatccataagtggaaattgatttacatctattattgctgattgttcactattctgaacttcggctaaacaggtgatttaggcagaatttttttaaatattagattttttcctactttctaaatattttgtagctctttcttattaatttgagtcaacttatgctcgcttttttttgtcaattatagatggttgtcaggggtttggcaaatgtcatatgaaggtaattctttaaaagttgggatttttgaactgtttatttctactacttttgattttgctggaaattatcattctattaaagggacaaaagggtgctcagaaatatgcattgaaaaatttcttacagatttatcaaccattgccctcaggcactgatattcagccagtatgttccaatacatccatgtctttccattttaaaccttttaattctgttctaatttttcattgcctgtgcctgattgttctgtatccatctgatacgaatggttaagtacaacattttaaatatcactcttgcctatacatattatttttcttgtcagatgatataattgtagtcattacatgtttcttaagcacaactgaaatcttaatttaaatcaataagtcttgtttctgtggccattgtttcccagaactctccggatttctaagcatggtggttattcttccaggaatagtgccgagagtcttcagcagcatgcatttctctctaattgacattatttcacactctccattttccttactattgaaaactgtatttcattggtattttgccaaggatcctgctctgtttcataataatgttctgttcgcactctctgcactgacaaatacctattccatgcatcaattgcataaatggcaatttgaaagcatttaaccacagctggatatttttcattgattcttttcatctgaagatcattcattaggcttctccctcctgtttcttctcacatccatacctcctttcctcctatgtacatagtgtcttttgcattttctgtatttaagtgtaaattgctgactacagttatgcttttacctcattccatggtcataatgaaatcacaaatttaaaaatgtactactttttaaacctgttttctgacttgtccatctaaatgcaattttataattcttcgacattcagcctcctggtgaatgatttctgcaatctctccaagacatctgtgcagtgttatggattatattgattgcattttgtccatgttcaaatttgcagaatgtaacctacagaatatatattgactaataaagaaatgcatccacatggtggatggttgtaaagagaaaatatatattggtgtgcagcaggcgcccacacaaatgaaatctagaaaacagcagcttgccatgtcagagttgcaaatgaaggctgtggctacaaaacacagaaagtctggagtgtatgaaaggtttttcttccaaattcattcacacataaaaatgaaaaaattgaaaaatcatatatgtgcaccttaatttttatatcgcattggtgtttgggcatacgaccctgagattttcataccctcgatttttttaatataaccacctgagcgtttcttcccatggggttactttagaagatggggggtgtacacactacgtatgtatgtcaataaagaaatgaaggaataaaggaggaaagaagtgaagaaggctgggggtaggaagggagggagaaattcagtgattcattacttattcatcatcctaaactggcatataaaataatatgtttaaatcagtctaaaattttcattgtataatctctgaaataactagtccccactccctaaactgtttggtgtaaatatttatctatgtctaatcatttctatgcaaaatagccttatatatattttcattttcataagatcatctaagaatcaaaggaaaagctattttaggcaatgaacataggcagtgatttcaaaatagaatttgagaaatgcaaggatagatggaatcacaaaagatgatctcattcatggtgttttaaaccctacaaatagatttctgtttagttgacctcatttcaatagcttctcatttttttcagaagtgtatttgatgtgtatatttctaataaacttatttttctttttgtacccagtattaaggagcacagcatttatatccactgaacaaaggataactgaaaggaaactccttgatatccaacttggagtatttgtttctcgaatgaatatgagtttatataagtagtttttttcacatacataaaattagaatttgtttgtattattgatattatttcagaacagcggatttaacgtcatagatgatctagatgtgtcctttccttagaaatctttaaaatgaatcacatagtctagaaacagatccagatactacatgctctcatcagaaaggactttcttctcttcgtgtcaagttcagtgttggcaccgtatagacaaagcgtgttaaaatagcagggttcttgttctctgacacattacaagagaggcaagattataaaactgctatgtgtctcattataattcccattagtttcatttgcttcaaaacattcacttctgtgctttttgcaaaagctttcaaacttattttttgatgattctaaaagtaattcttctatgtcttttcctagtgatactagcattagttttcttttccaattgtactaggaggcatgagagattatcgatgccctattttcttgtctaaataggcaacccaaataatcatagtgacctgttcatttatattatctttatttcttgcctcatacttcttcatatttcttcatttcccatgtttccttattctttggagccagaaacgatcacgttaatcactctttccattagttttctcctatacattttctgatctttctctgagccagttaagagtcattcagccatttgataatggacactagtttactttgaccttgcaaacacaaataccctgtttgatctttatttgctgagagcagtaagacagaagaattacaataaactttttagcacccttctgttcaattctttttcagaaatcgttccctcaaaaagcctattctaggctctttcttttggcagtttcctagaattttcctttgcttttcaccaactggaacattatcactagaagtaaactaagggaccatctaattcaacaccctcgttttgtactttaggatactgaagccaagagaagctaatttttttgcctgccataacacaactagttagtgaagcagccaaaactataagggatcttgccaccataagctttatcggcccatccgtttatctcctcaaagcagccctatacctgatttccttatttctgttctctaagtaagccaagctcagaccttagagtgaccttcccctaatccaccctgcctgacatccaataaactgacaaatccagttgattatgaagctacagtgtttttcaaaccataccataattgtctaggctgttgccatgctctacacaccagttttcttattccagtccctccctgccccagtcccagttcactctactcagcctctctactgcaatggataaaatcacagtttccagattcacaaagctcacagctctgccactttctagccttgtatttgtgtttcagttgctgctgaaactctctaagcctattttccatctataaaatggaaaccaacccagaggctcgttgtattacagagatattgcatgaaaagcatttagcgcagtgtctggcccataagaagtcctcagtaaatagtagtcttggggaagcagtagggtgttgtagtaagagagcagagcaggggacagcaaactacaggtctcagtacaaattcaacatggggcctgggttttttttaatagcaggggagctaaaaacagtttacttgttttaataagttgtacgaaacccaaagaagaatatgtaacggagatttatgtgttcctcaaagccagaaatatttactttctggccctttacagagaactttcattaattcctgttgacagctgtcagggtatgaatcctctctaccacttagaaactgtgtaaccttgggcaaatgttttaacctctccaaggtttggtttccctgactgtgaatagtacctatgttacagggttgttatgagaattaaatgagatcatttatatcaggtgcttagctcactagctgaaataggatttaataaatgttagctgacatggttacgtctactcattgttgcagataaatagcctctaagtgcagctttaatagtgattgtttcttaaaatttttgaacaaagtttttctatttcttatccaattaaataaatattccacattctggcattcaatatttctaacgacatcaagcaactctaaaatcattgaatgttttaaagcaacaggaaaccttagaaataactcatctaaactcatatcatagatatggaaactaagggccaataaaaccaaggcttctaggacctgaaatcagatcctctctttttaggtagtgtgatcttcatcgtgcttctgccatgcaatctcagaatttaaagggatttaagaatcattcattttcttcctaaggcaggattcgaccctataaaatccctgtcagtttggtcattcaaacccagtttgagtacagtcattgatgataaatcacccttttcccagggagcagttctggttgtttcaaagtctttataataaatgaaaattggctttcctgaaatctctatatattgatctattcctgcccactggagccaaagagaaacgtcacttctctacatctgtaaaatactcgttgtcaattttcgtatcttctctaagcatcctcgtttcaagctgatgtgaactagttgggtttttgattgttttcattgtcctgctaagtcgaaaagctaagaaaagcttggctctttcatcactgttatatatcccactgtgtaacagaacttgagttcagggtatacactctaaataactgcttttgtaaaagtattcaattatattgatttttttcgttccctctgttgttcctcataattaccctcagtcaagactttcatcttcgtctttatcttcctctgcaagaattaacagtggtcccttttgtgaacttcaaatatctgagactggtctcagttaatttaggaagtttattttgccaaggttgagaatatgcacccatgaaacagcctcaggaggttctaacgacatgtgcccaaggtgtttggggcacagcttggttttatatatatttagggagacatgagacatcaaccaatatatgtaagatgtacatttgttccatccagaagggtgggacaacttgaagcaaggaggggcttccaggtcacaggtaggtgagagataaatggttgcattcttttgagtatctgattcgcctttccaaaggaggcaatcagataagcatctatctcagtgagcagagggatgactttgaatagaatgggagacaggtttgccctaagcagttcccagcttgacttttccctttagtttggtgattttgaggccccaagatttattttcctttcacactttcaatataagctatccagaactgatgataatattccagatatggcccaaccaatggaaatgattgtgtttcctacataccatatcacaatcaaacctgttttgcaccttgcatttactttctttattaatgatgtcattgcaatttagaaaatttggggccacatttacttcttcctctctattatcttcagtttttatttggtcactaaattctgtttgctgactcttatatctaaaaataaaaacactcaaatccagctattcctctctaactactctgcccttccctcagtcctttctcagtgactattaatgatttggccttctaatgattagcctccctgtccccagacttttatccatctttatcactatggctagttatcttgctaaacaacagatctaatcctagtaccccattatattaaaaaaatcttctatagctacagctttctctccctccaggtcagtatccatagcctgtcaagatgtggctttgataaaggacagaaggcagggaaattctgggcagaagagggcaggtccccattgaggacccaccctcaagccaaaaagcctggaaccatggcccaaagtgagaacttacatccctgttttccctcttgaagggtgccttttccaaaaccatccattaccccccacccaccccccaacctgtgcctataaaaaccccagagctcagctggcagaaggaggagaagcagatggatgtcagaaactacagttggacatcaaagagaagcggcttgactttagagggacagtttgacagcatagctttggagaggagtccagctgtggatggtcagactccaggggaagattaccttcccactccatccccttttcagctccccttcccactgagagccactttcattggcaataaaatcccccatatttaccatcttcaatttgttcatgtgacctcattcctcctggatgctggacaagaacttgggtgccatgcgtgtgggtgaaaaaggctgtcacactgaccctccactgagctgttaacacttaagccatctgtgaatggcaaagctaaaagggcgctgtaacacttcctcatgggcaccctcccctagaggctgctgcagggcccgtacggtgttcactcttgccagcactcaaaaatgctggccccagctgctgcacctgctcacctgtgctcccccttccatgaggggtggaccagcgagtgagtggagtttgctcccctccagttcccacccacgaagggatcagggaaatatcctccttcagctccagtgaggcacagtggtatacacctatagtcccaactactgaagaggctgaggtgggaggatctcttgaacccagaagtttgaggctgtaggcactgtggttgtacctgtgaatagccactgccctccagccttggcaacatagcaagatctcatctctaaaaaagaaaaaatatatatgatgtggctccaattcactgatctagcctcttaactgaattccttcctcctggctgggcacagtggcttatgcctgtaatcctagcactttgagaggccaagacaggagaattgcttgagcccaggagttcaagaccagcctgggaaacatagtgagacttcatatctacaacacattttttcaaaaagaattttttcctccctgctccccaccctacccccttgcaaccttatttactcttcggcctctggccctctcgctatgtctttctcagcttcatgcctttgaaaatactctttctatgcctggaaagcccttataaacctggaaattcctattcttattcaactctgagccagtccattttagtggcttagttcagaggctctagatttaaattgcaattctgtcagattctgtctgctttgccaacctcaatcaagttatgtactatgcctcagtttcctcatcagtagaatgaaaataatacagtagtgcttttttcatagggttgtagtgaggattaaatgagatgaagcgtataatcctcatgtacataacacagtacatactatatgtgttgcacatagtaagtgctcagttctttttctttgcattattcttagcacataagtcaagttacatttgctctcccttacgcaaggtcaattgttcttttttatgtgtttacccgttactttgttcatgcatttgttataaccactgccatcataaagcaacttgctatctttgttcataaaacaaatcccagattcactgagctcaaagtgagagaaggaaactttgcattatgtgcagttcctatgcttttctccaaatttcacatctccgttggggatctctcactagttatccttgccatacccccacaccagccttacaattttgcattatgtttcctacatcatgattctaaacggtcctcctgttcgctttctctccatcccatatcgttgcagatagctatttcctctttttaagacagaaacacatttgcattttgcctaagctacatttgtaaattttacagtattttcgaaagacacaatggaatctaggaaagatgcaacagataaagagattaactggccaatttttgagagcaccatccgtaaagtccacgaacaagtgaggcttccttgtcggagaaagcaattcagtcaccataaatgatcattcaagcctgatctcattccctcttgaaactggaaattgaaagcttgttcctctgacagttgtgttgtcagtggatatgcccagtgtgcaaaggactggacaaagggcaaaagtacacatatcccatctggaattctgagtcatccctgagacatcattttggatttgtctactgagatgaaattaaaacatgagtaatcaagcccacacttcttccccctcaaactcatctctttggtatcatcaagaaaatcaaatgctaatagccattgacctcctaattctagtgctcttagctatgataaaacagtcattaacttaatctaaatgttgcaaataaaggagccccatcaaagctgaagccccaaaattatacaaatgagttaactgggaaggcatgggggaaacaacagttttcataagacacactctaaatctagtttattctcttaggaagacttttctcatcaatagagagccacataaagatgccttacctgcctttcacggggactatatcaattggctgtactgtcactcactccaaaactctcaaaatgcctaacacagattcttgattttattgattgcattagatgttacgttttctaaattttcagcaccctggaggtcacctcaggaaatcatgcagtttttgaatgattttccttagaaatacacgtgtagctatacatatgcccatgcgttatttaatcagttagtgaaaggaggaaaacagcatttctattattgacctttctcaatctctgaggagactgtatgtcttgcctacagtccaggattgaaagcaaaagaaaaaggcactgacaaaatagcattttattttaatagcacattatggagagacaaaaaaaaaaaaaaaaaaaaaaaaaccctgggatttcctttgtctaagtagaattgacgtatgggtgagatcagtctctattttactcagtacaagtgcacacatatttatgtacacacatataattgtcatctttgggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccgggcgtggttgcgggcgcctgtagtcccagctactcaggaggctgaggcaggagaatggcgtgaacccgggaggcggagcttgcagtgagccgagatcgcgccactgcactccagcctgggccacagagcgagactccgtctcaaaaaaaaaaaaaaaaaattgtcatctttggaagctaagggccctgtatcagagtatcagaatatacctatatccaggatgcaatgttctccagttttgcattaacatcagctacaaggttcactgccatctaagactaatcaacagtaatagctaaaggacaaaggtcagttcctgagagatatgcctaaattcatctggctatatcttctgttcctcccaaaccctaaccccataaattcttcattgtttagaaggattcatattttttgtttgtttttcatattcccattttattggctggggttagaattgcaatggcagcaaaaaacacagaagctatctacagtggcttaaataaatagagttttatttatctccaatattaagatgtctggaaataaggtgctttgggcccaacagtatcaggactggcatctgtatattttttattgacttttcctcatgcaatatagcagccaccattatttcacagggtgaaaaagagaaggcaaaaagggtgtactatctgagtcttatcatttttataaagccaaaaatttcccagaaaccttttttgaaagacttctacttgtatatcattgtgtagaactgtgtcacatgacagccaccaacaaaaagatggctagggagaagtggttttcaacaggtattgaagtagctaaccggcagtgtctgccggtcttcagttataaacaccagcagctaactctggctaattcaagtcagggaaaacaaaggggatggggtaggggctctttatttaaaagatactcatagaaatgaacgaagtaatttgaaaactaggtctcagaataggacatgaagtataagagttctaaaatctcaaaagcaggaacacatgcatcttctttttaagtgttgtctttgaaatactaagctccaaagtctttccaaccttgtattattttcttcctttgtcagcttcctgagtggcagagtctgagtaacctatggggtctttgaactctttaggggaattgaggaaggcaaaaaggtaccatgattggcagctctactagagtcacaagaaatatggggaaagcgattcctcaaaggaaaaacaaaaacagaaacaacaaccaggcagttagtagaaggatgaaatactggacccacaaagacaacatatgtcttctcaccacacttggtctctctctctctctctctctctcacccttctctctctctcatagtaatgaaactaaagctgcaaaactaaggcctagctattcattgtgatccttatgagatcataaaaaaaatctgtatttaagtggagaaaaataaatggaatatcaactttaaaaaattttttttgagacagagtctcgctccgtggcccagactggagtccaatggcatgatctcagctcactgcaacctctggctcccgggttcaagcaattctcctgcctcagcctcctgagtagctgggactacaggcacgtgccaccacacccagctaatttttgtattttcagtagagacagagtttcaccatgttggccaggctgttccgaaactcctgacctcaggtgatccacccacctcgacctcccaaagtgctgggattacaggcacgagccactgcacccagctggaatatcgatttaattgtaagagaaaaatgcactagtttaaaaatgtgtcctctttatcctcaggttttaaaaatatttttaaggtagtttagaaaaactgaagtgattatttgataaataaatttcaaatgctatcaatggaacaagaatggatattagatatcctgctaacaaggatcatatttttacaagttgtttctccaaagagaacagagctacagctgagattctggtgcgcataaacctttccatcagagctgtagtcacctaacaattcttatatcacaatcttcatatctcaatcccttttccaaataacttcatctttcttaagttgcatacaaatgttataatctaatatttttgagatggatatcatgtgtcataaaaagaaagccattgtaatattaccaataccaagtattagcaaatattgacatagctttagaataaaaataaacagagctcaggttctggctctgccatagctagctagatttatcttaagacttcagtttcctcatatacaaaatgttgatagtatcatcatcttgtaagccttgttgtaaagagcaatttagctaacagtaacagtgtttaacatgcataaagtgaagactcctttctgggctgataagaacgctagtttattcatttgcttatttctatatttttaagcttagagtctgaaaattttcagagtctgggagtcaacgtgtggggtgtgaattggaacttcaccacttactaacaactcccttttgtagtgcttccatttatttatctgttcaataggagtaataatagcactcgctcaaagagttgtctgaggattagatgagacaatgcttgcaaaatgcaaagtggagcacctggtgtatagttggtattcaataatttctagttgttgatatgatgatgacgatgatgatgtattctcttgatatgtgaatgctcatcacaccatcctatggaatatttgattttaagaaaaagttgggtttgttttttttttttgtttttttttttttttgagatggagtctcactctgtcgcccaggccagagtgcagtggcgcaatctcggctcactgcaacctctgtctcctgggtttaagcaattcccctgcctcagcctccagagtagctgggactacaggcgtccgccaccatgcccggctaatttttgtatttttagtggagaccgggtttcaccatatttggccaggctggtctcgaactcctgatcttgtgatccacctgcctcggcctcccaaagtgctgggatgacaggcatgagccaccatgcccagccaagaaaaaatattttaaacaagttaagatcatttactatactgtgccctaagatgaggtgaacatgtagatcatgagatctaattgattttagatgcagttcagttttttaaaagaatgacctgctttccatattaaaatttcaaaacaatgatatgtggagatgatgacagaatatggctgaatgaggtaccttgttatcctcaaccttttggctcagagacctcttccttgctggaaactttcctaaccttttaatgatttattaacattttgcatgcactctttatacctttcattaatgactagttcactgcaaatttttctttgctttatttcctattcttggtgtgacattcattctctatctgtttctatggaagcttttgtgatgcctcagagagaaagaattctgagtctttgaaataatgaaaacattactaaaccataaaacctagatttcaggagcctaatagaggattagagctttattacgtacagccatcttacagtttagccttcaagtctcaattgtggaatgatcttttgtcctttctctccagtgtgcatgtgtgcatacacatatagacacagttcgcgcttcagtcatataaatgggaagccacaaagcttcctagagtacccagatgcagaattagaagacccaatcttgacaccagggtcaggggatctgtggtttggggggacttgtgctggctatattgttgtcacagcaggaacagtttgtgtcggtatagaggctttaacttctagtaaagggatatataatgaaaatgtaagcaaccatcgtttatttttctcacataataggaatttaagagaaagatatacccaaaattggtttattagctcaacagtttcattcagaatccaatgtctttccatctttgcatttgctatccttagcctttggctttggtctttggaattgtcacgcgatggttataaaatggctgccacactccaggaattgcatcatgacagtgtgaatggaaaataaaggaagagtggcagttcttgtcatgtttcagaagcaacagcatgtctccctaacatctctttggccagaactaggtcaagtagctgcatctacctgcaagggaaactaagaaattgactatcagtgctttttaaacttttttttgtgtgtgtggaaatagataatcactagagaaaaaagggagagtggaatggttgttgatgaggcaaccaacagtgtctaccactctatttataaaccttttcttgatttttcctactaaatgtgtggccgttttttttgcttgctttttgttttttgtttttgagatggagcctcactctctcccccaggctggagtgcagtggcgtgatctcggctcactgcaacctccgcctcccaggttcaagcaattctcctgcctcagcctcctgagtagctgggattacaggtgtgtgccaccacgcccagctaatttttgtatttttaggagacatggggtttcaccatgttgatcatgctggtctcgaactccagacctcgtgatccgcccatctcagcctcccaaagtgctgggattacaggtgtgagtcaccgcacccagccaatgtgtagccttttagttcaaggacctttcattataaatcttcatagtccaaacacccggcatattgtctggcacaaaataggaagaaatatttttggacgtgccaaggaatttgcaagacagtgagacaaatagccagtaaaaatgttagcattaatatattattaaaaatagtgagaaatgctccaggcgcagtggctcatgcctgtaatcccagcactttgggaccccgaggcgggcggatcacttgaggtcaggagttcaagaccagcctgaccaacatggtgaaaccctgtctgtacttccagctacttaagaggctgaggccggagaattgctggaacccaagaggcggaggttgcagtgagccgagatcacgtcactgtgctccagcctgggtgatagggcaagactctgtctcaaaaaaataaaaataaaataaaaagaaaaatagtgagaaatgttatgaagacaaagaataggctactttggaagaataatagtgggaacttcttcatagtctaggaaggcctctctgaaaaggatatatttaagctaaaatctgaaggttaggtcagtcatatgaacagggaggggaatggaataatattttcaagacaatgacctaaaaggaggcaagtatggctaggagctaatgactgagggggtgagtggtacaggacaaggctggagagtttattttatgggtaagcagagaaataatataatctgacgtacctgtgaaagtacacctgagctgatgtacctgcaaaacatcatacaatctgatggacctgctgtataaatgagagattgaatgtggcaagagtagaagcaaagaggccaggtaagaggcatttgcagttgtcttgatgaaagaaaatgactactgggagtaagatggcggcaatggaaatagagagaaatgaacagatttgagatgtattttcgagacaaaatctgtatgacttggtgatggattagatgtcaggcatgagggattgaggatgactcccaagttttttttgtttgatcaacttgttgtactgtttgctgaggtgataaagatggaggaggaagcagatttggaaaagatcaacagttcagttttagacatgttcagtttgaaatgtgtgtgatatgtccaagtgcagaagtcaaattcaattatagctcaaaggagagacccgagctagaagcgtaaatgagaaaaatattgatacaaaatggaatttagagcatccagaatggaaatcacttagcatgtaaagagggaagggaagatggcctaggaccaaaccttgataaacttcaagaaaaagaagtcaagcagaggtaggagaagagaagtcagtcaaaaatcaaaagaatatgacatctcagaattcaaggatgtgaataaatgtgtaagtgatggatggctttcggtctgggctttttgttttttttttccattttaagttccaactttgctacaatccggctacgaatcccacaccctcccaaattatctgaggatgttaattgatacttgatcagaaagcagtgatttttaaaatcatatacttctaaattatctgagatatgaagcaatgagatagggaagtggctgaaatatgtttctctggctcagctgtcatgagggcttgctctagaatggcactcaagcacatgtttatccactgagctctatatcatttattccattagctgaagaaggaatctctcacactctaacttcagttctgttggacatgggaataaaagttagatgtatacagactaaactaaacagatggtagaaaaacaaaggattcttaaagtatattggagaaatgcatttctatggtcaattttcttgaatatcctaagatcaggtttcatgtatataattctttacatttcacaaagcacctttagatgtgtctattccatttaaccctcatcctaactgtgtgaagtagggcacagaagtgtagaaatgattttttaaaactcactaagctaatcaatggataatctgtgattataatagaatctgagtttcggcatctttatcttattccttactgcactatatctggaatggtaaatattgttcatctcacaagcaagctcttattgactgatatcagctgcctagagtggtttattgtaaaagagcataaagcaaattggggaagactacaatacagtgccataggctgattagtaatttctaccattggtattaaatgagaaaataatggtacaagtgctttacatttgtctgccattcctaaactaaggcacctcctgttatttataaggaagaatattctgagaagtttaaaagtctcttgttaaatcatttgatgacgttggataaaatggcttaaaataagaatatgcctgttgcacaaataatctacactcccccaagataatgaataagtcagctggagcatctcaagtttcaatatgtagaggatcaaaatgaaatagtcataaaaccccttgcagacatttcttgggcaggcaaactaatttcctagtaaaagaagttggaagttggacaaattgtatatgggaactttctatactacttttgcaaattttctgtaagtttaacttttcctaataggatgctgagattcagctcttccaatggtctcaaatgttttttggttttgttttgttttgttttttgagacggagtctcactctgtcacccaggctggagtgcagtggcgtgatcttggctcactgcaacctccacctcacgggttcaagcaattctcctgcctcagcctcccaagcagctgggattacaagtgcctgccaccatgcctggctaatttttgtatttttagtagagacgggattttgccatgttggtcaggctggtctcaaactcctgacctcaggtgatccgcccaccttggcctcctaaagtgctgggattacaggcatgagccaccgctcctggcctcatttaaccattttgactttcactttttctgtcttcaaaatgaggtattgagctaggtaaacttaatgtcttttttcgctttaattatctaataattctgtgattctcaacttggtgtgttaaaccagattacacctaagaaaccctgaagactttttagctaggagtttaaatattcacttagtcattcaattaatatctattgtgggtctgttatatgccaggcgccattttaggtattgataataaagcagcaaacaagacaaaacccctgccctcaggagagcttacattcttgtaaagaagacagatgataggccgggcgtggtggctcactcctgtaatctcagcactttgggaggccaaggcgggtggatcacgaggtcaggagatcgagaccgtcctggctaacatggtgaaactccgtctctactaaaaatacaaaaaaaaaattagccgggcttggtggtgggcacctgtagtcccagctactcgggaggctgaggcaggagaatggcatgaacctgggagctggagattgcagtgagccgagatcgtgccactgcactccagcctgggtgactgagcaagattccatctcaaaaaaaaaaaaaaccgaaaaacaaagaagaaagatgataaacaagtacacaattatcatataacaattttaaatagtgacagcatgttgaaataaataaagcaaggaagacgctagagagttgttcatggaaggaattgtcattttatataaggtgatcagggaaggttccactgaggaggtgacatttgaggaaagacctgaaagaagtggggagggagacccgaaagttcatgaggaattgtgtcccaaacagggcaacacataaaaagtccttgaggcaagactaagctgattatataacatttaaaagaattaggccaggtgtggtggctcacacctgtaatcccagcacttttggaggccaaggcgggtggatcacctgaggtcaggagttcaagaccagcctggccaacatggcaaaaccgcgtctctactaaaaatacaaaacttagccaggcatagtggtgcatgcccatagtcccggctacttgggaggctgaggcaggagagtcacatgaacccaggaggcagaggatgcagtgagccaagattgcaccactgtactccagcctgggtgacagagcgagactctgtctcaaacaaaaaaaaaaagaattaatttacatatcatgagatcatctagtctaacacccttactagacaagttcaaaaaggttaagacttggccaagatgacacagctatttaatgtgatatctgggttagaattcacctcatctgaattcctctcaaattgtgctctttgaggtcaatgtgccttttaaaaaatgacagaaagcatggctgtagatttcagatcataccaaatttgatggaacaatgaccatttttagcttcctatagagtctaagacttgaacttgccaagggagtcacagctggatttgtaagcatcaaatccacaaatgtacttaatgtcaaccaaggattttgtgtcacctgtaatgctcccccaggaagcccccaagtccactagtcctaatcactgtgtttggcttcataacctgttggcccaaacattacgcaaaaaagagcaatattcccaaggtggtcatgttagttgtggtgagatgtcaaccataagtagatctgaccgaggaaatgccttaaggaagcagctcaggaacacctgagtatatgtgtctagaatgaagcctattaaaaaaactactgcagagctaaagacagctgaaagccattatgacagtcacaactacttgatagattgaaaccaaagagttcctttgtgattagatagatcaggactctaaatcatgtttttacttcatgtgttcattcattcatcatacagtcagtgattcagtaaacaatattgagcatccattatgtgccaagcactgtgttaaattctggaaacacagagatggattagacccctgtccccagggagcataaagactagcagagttagacctccctcccatatgaagaaattaaatgaggtaaggcattaaaagtgctatgattacataatacagaacccaaaggggaaggcattttctgaaaaacagaaaactgaaaataccagcttttcagcctcacacagacataggaaaaccaacccccatcaacatcatctcttcttttttttttattattactatagtttaagttctagggtacatgtgcacaacgtgcaggtttgttacatatgtatacatgtgccatgttggtgtgctgcacccattaactcgtcatttacattaggtatatctcctaatgctatccctcctccctcccctcaccccaaaacagtccctggtgtgtgatgttctccttcctgtgtccatgtgttctcattgttcaattcccacttatgagtgagaacatgcaatgtttggttttctgtccttgtgatagtttgctgagaatgatggtttccagcttcatccatgtccctacaaaggatatgaattcatccttttttatggctgcatagtattccatggtgtatatgtgccacattttcttaatccagtctatcattgatggacatttgggttggttccaaatctttgctattgtgaacagtgccgcaataaacatacgtgtgcatgtgtcttcatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgctatttctccacatcctctctggcatctgttgtttcctgacttttgaatgatagccattctaactggtgtgagatggtacctcattgtggttttgatttgcatttctctgaacatcatctcttaatataaaaagcataatgtgctgatttcacattgcatgcctgtatcaaaacatctcatatgctctataaatatatacgcttaatgtgtacctacaaaaattataagaattttttttaaagcaacaataaatatcttcattagtcaaccaaattaaatctattaatatatccatgtttgtgaacaggatggccacagaaccctgtggatgcttaccacttaaacatttcctgaaacaaatatgtttccaaaacatcttgcctgtctaatctgacaactgcagacatcctaactaggctctgaaggtgctctccatagcactgatgttattgattcagttgttaacagcgcaggcataaatgactgatgataactctctaaacgtcccttcctactgccgttgaaatggctctgggctttatccaagcagggctgctaaatgaatagtagatgtaccagcagaggagaaattggtcctgaggtgaattaactctcctgaggtagatttgtttgtgcttccaacaacctgtacgttaaaccttgtgaaccttcatgtaggaattttgaggagaaatgggcaatttttggaaagcctaatgttttatcagccgctttttcttctcattgagacctgtgtattctcaagggactttggaagtttgccattttaagaacagacttgatgagaattatttgaagtcctccacgtttccatttatcagttttcctaatacagacatcctacgcacatcgttgaaagaatgttctttttgcctcacaggtagatcacaaaagtgggcccataatcattgggtagagggtttctcagctctgagttaaattgcagctgggtattgtttttctgtaataggatcttctctgagtgaatggtgaaacatgcccatttttgaggtcatgagagcagagctttccacatcatggacagaaaagggcaaccggccatggtttcagttatacagggagaggaaacaataggttttgtctctgctttgctattgcttcaacagcagcatactgttggacactcagacattagggcacaatttagacttgtttcacagctgtcatttctttcctcaaaaacaacaaacctgcatgggggaaatgagtctacatttcagggtttttcaagaattgataacataacatgtacttcaccatgaatttatattccacaggtccctgttctcttctctggtcatcagagtacaaaatcacaaccaaaaagcaagaattgatatctatgaagctaaagtagtagtagtagtagtagtagtagtagtagtagtagtagtagtagtagtagtgaagcaggatattaccctgatcccctcgcgggcgggaactggactgcatagccgcttcggtgctggcaggggcagactccactggctcagtctcactgagttccacccctcatgggagaggaagcacaggtgagtgggtacaggagccagggtgagtgcttttgggcgccagcaggaacaaaactctgtgtgggccccatggcagtgtctaggagggtgcccgcgacccttgaatccccagaaggagtgttacagggcccttttatctttgccatctgcagatggcttaagtgttaacagctcagtggagggtcagtgtgacagccttctgtactcgcacttgtggcacctcagatcttgcccattttccaggaggaatgaggtcacacaaactaattggagatggtaaatgcgggggattttattgctgatgaaagtggctctcagcaggaaaaggagctgaaaaggggacagagcaggaaggtaatcttcacctcgagtccagctgtccgcaatcagactcctctctgaagctatgctgccaggctgtccctcggaagtcaagccacttctctccaatgcacaaccatagtttccaacatccagctgcttctcctctgtgccggctgagcctgggatttttacaggcacaggatggagggcagggtgggctatgggtggttttggaaaaggcaacatttgagcaggaaaacagggatgtaagttctcactttgggccacagttccaggcttttaggcttaagggtggggcccttgccagagacccgccctcttctgtccagaatttccctgcctcctgtccctatcagtagtaatagtagtagtagtagcagcagcaacagaagtaatactaactactacataccaagcattatctacgtacttcatatctattcaccaacctaattgttacaactttcactcgcgtccgtgtgaagagaccaccaaacagtctttgtgtgagcaataaagctttgtaatcacctgggcgcaggcgagctgagtccgaaaagagtcagcgaagggagataggggtagggccgttctataagatttgggtaggttaaggaaaattacagtcaaaggggggttgtcctctggtgggcaggagtggggatcacaaggtgctcagtgggggagcttttgagccaggaagagccaggagaaggaatttcacaaggtaatgtcatcagttaaggcaaggaccggccattttcacttcttttgtggtggaatgtcatcagttaaggcaggaacaggccatttaaatttcacttcttttgtgatttttcagttacttcaggccatctggatgtatatgtgtaggtcacaggggatatgatggcttagcttgggctcagaggcctgacattcctgtcttcttatattaataagaaaaataaaacaaaatagtgttgaagtgttggggcggcgaaaattttcggggtggtgtggagagataatgggtgatgtttctcagggctgcttcgaggtggatcaggggtggcgtgggaacctagagtgggagggattaagctgaaggaagattttgtggtaaggggtgatattgtggggttgttagaagaaacatttgtcatgtagaattattggtgatggcctggatacggttttgtatgaattgaaaaactaaacggaataagagaaggagaaaaacaggtattaaaggacgaagaattgggaggacctaggacgtctaattagagagtgcctaaggaggttcagcatagccttgccagcaaagattatttactttaagagttaagagtggtggtttggggatagcaccaagagatatcagctgtgatggcttggagaaacagtgtaaaccagcagtgtaaacaagagcagggcatttatgactagttgagactggtgaataggagtatgactagacagaagataggagggatgacaagttttttggggtgcagtctaagttggtctggtgtctggaatgagactggggcctaataaaaaggagcgtccatacaggagcttaaatgggctgtaccttgtagcattctgaggacaggcctgaattctgagaagggcaagtggtaaaagtattgtccagtcctttttaagttggtggctgagcttggtgaggtgtgtttttaaaagaccattagttcactgaatactaagagcctgagaaactgcttgggtgatttgactaataaagtccagtctgttataggaccgtatagaggtgggaaggccaaaccgaggaattatgtttccctgtgggaaaggcctctacctatccagtgaaagtgtctacctagaccaagaggtattttagtttcttgactcggggcatgtttagtaaagccaatttgccagtcctgggcgggggcaaatcctcgaacttgatgtgtggggaagggagggggcctgaataatccctgaggagtagtagaatagcagatggaacactgagaagttatttctttgaggatagatttccacgatggaaaggaaatgagaagttctaagaggcaggctagtggcttgtactatagcatagcctgcctttgctggtgtgtggccattaggcctggtggaactgccatcaataaaccaagtgtgatcagggtgaggaacaggaaagaaggaaatatggggaaatggggttgaatgtctggtggatcagagatacagtcatgggggtcaggcgtggtatcaggaataatgtgggaggccggattgaagtctgggccaggaacaatggtaattgtgggagactcaacaaagagtgagtacagctgaaggagccggggagcagaaagcatatgcgtcaggtgtgaggaagaaaatagattttggaagttatgagaactgtagagagtgagttgagcatagtttgtgattttgagggcctctaaaagtattagggtggtggcggctgccgcacgcagacatgagggctaggcaaaacagtaaggtcaagttgtttggataaaaaggctacaggacgtgatcccagtccttatgtaagaatcctgactgcacagccctgcacttcagcggtgtgtaatgaaaagggttgggatgagtcagggagagctcgggtgggagcagtctctaaagctgtcttcaaggaatggaaagaggagtggggaaaggatttaggatctatggggtcagctaggtttccttttgtgagtttatataatggttttgttaggatggcaaaaccaggtatctaaagtcgaaagtatctaaccatgcctaggaggaaaaaacttgttgttttctagaagggattggggtttgggagattagtcagacatgatcagcagggagagcacgtgtgtttttatgagaattatgccgagataggtaacaggtgaggaagaaatttgggcttgactgaagtaatgggggctgtctgtgaagccttgaggcagtacagcccaggtaatttgctgagcctgatgggtgtcagggtcagtccaagtgaaagtgaagagaggctggggtgaagggtgcaaaggaatagtgaagaaagcatgtttgagatccagaacagaataatgggttgtggagggaggtattgaggacaggagagtatatgggtttggcaccacagggttgataggcaaaacaatttggttgataaggtgcagatcctgaactaacctgtaaaccttgtctgcttttaggacaggtaaaatgggggaattgtaaggggagtttataggctttaaaaggccatgctgtagcaggcgagtgataacagactgtaatccttttaaagcgtgctgtgggatgggatgttggcattgagcggagtaagggtgattaggttttaatgggatggtaaggggtgcatgattggtcgctaaggagggagtagaggtgtcttatgcttgtgggttaaggtggggagatacaaggggagatgtgaaggaggctttgaactgggggaaaaggcggcaatgaggtgtggctctagcctaggaatagtcagggaagcagatcatttagttaaagtgtctcggcctaatagggaactgggcaggtggggataactaaaaaggagtgcttaaaagagtatcgtctaagttggcaccagagtttgggagttttaagaggtttagaagcctggccgtcaatacctacaacagttatggaggtaagggaaacaggcccttgaaaagaaggtaatgtggagtgggtagcctccgtattgattaagaaggggacggacttaccctccactgtgagagttacctgaagatcggcatctgtgatggtctagggggcttctgaggcaatcgggcagcgtcagtcttcagccactaaaccgagaagatctgggaaggagtcagagagccttgggccagagttccaggggctctgggagtggctgccaggtgagttgaacagtccgattttcagtggggtcctccacagatgggacatggcttaggaggaatcccgggctgcgggcattccttggcccagtggccagatttctggcacttgtagcaagctcctgggggaggccattctggaggaacccctcgcagctgcagttcaggcatttggagttcttctgtgctggagatatggctggggtttgtctcacagtggagggaaggaattgcaactcagaaatacattgctacttggctgcctctactttattattgtacaccttgaaggcgaggttaattaagtcttgtggggtttgagggctggaatttaatttttggagtttaatgtcgggagcagattgggtaataaaatatatattgagaataagacggccttttgaccttttagggtctagggctgtaaagcatctcagggttgttgccaaacgagccatgaactgggcttgtttttttatttgatgaaaaagagcctaaacgctatctgatttgggataaagaaaaaggagcattaaccttgactatgcctttagctccagccacctttttaagaggaaattgctgggcaggtgggggagggctagtcatggaaggaaactgtaagccggaccgggtgtgaggagcggaggtgataaaaggattatagggtggaggagcagaggctgaggaataattgggcctggcgaggaggggagaggtcagatgggtctgtagaaaaggaagattagaaagactgagcgatgcttggggttgggactgaggggacaggtgggagggaaagaaggaagatttggaaggagttgcattgggaacagagactggggaggggcagatgtgtaaaagaatgcctggacatcaggcacctcagaccgtttgcctattttatgacaagaattatttagagcttgtaggatggaaaaattgaaagtgccgttttctggctatttggaactactgtcaagtttgtactggggtcaagtggcatcgcagaagaaaataaggcatttaggttttaggtcaggtgtgagttgaagaggttttaagttcttgagagcacaggctaagggagaaaaaggaggaatggagggtggaaggttgcccatagtgaaggaggcaagcccagagaaaagggagtagagacacggagagaaggggtggggggttcttgtcccccagaaaagcggagaaggggtagagacatggagagaagggttggggggttcttgcccccgagaaaagcggtacttgccgctaaaggtgaaggaccaaggcaggcgtccccgtgtggtcagacacctctgaaatgtgggtgaataatcaggcaggcatccccgcgtgattaaataccaagggaagactcttccgagtccgtgaccggtgccggagttttgggtccacggataaaacgcatctcctgtctctaccagaaaaggaaaggaactgaagttaagagaagggagagattgaagtggggcgccaagattgaaaggagaaagaggttgagggatagtgagaggttggaggagagagtaaaaagaggccgcttacctgatttaaaattggtgtgatgttccttgggctggttagtctgaggaccagaggtcgtaggtggatctttctcacagagcaaggagcaggaggacaggggatagatctcccaagggaggtcccctgatccgagtgatggcaccaaatttcatgcgcgtccgtgtgaagagaccaccaaacaggctttgtgtgagcaataaaactttttaatcacctggatgcaggcgggctgagtccaaaaagagtcagcaaagggagacaggggtggggccgttttataagatttgggtaggtaaaggaaaattacagtcaaatggggggtggttttctggcgggcaggagtgggagtcacaaggtgctcagtggggaagctttttgagccaggatgagccagggaaaggaatttcacaaggtaatgtcatcagttaaggcaaggaccggccattttcacttcttttgtggtggaatgtcatcagttaaggcaggaacaggccattttcacttcttttgtgatttttcagttacttcaggccttctggatgtatacgtgcaggtcacaggggatatgatggcttagcttgggctcagaggcctgacaacaacgatcttgtagataggtactgttgtaattcccagtttacaaataagaagactaaggtatagagagattgagtaatttgcccaaagcccacagctagtaagaagccaagattcaaacccaggtaatatggctgcagacctggtaatcctaaccattacattaggctgactctcgatagttaacttatttaagctagtgttaatcacatcttaacaagtttgagtaataaaatcttaggttgaaaggggccttcaagatctagtctaaatcctttcaggagttcttccacatttctgctagaaaacactttggcctaggcttaaaacttagtgatggggaactcctcactttgtaaagcagcctgttcagttcacaaacaccctaataattaggctgttatctcttgcattgagctgaagttgatcttcccataacctctgcctttctgtctatatgtatgctttggaaatatacacagtaagtgtaaaccctcttggcaaagacagcccttcaaatacttgggaggcattcaattccccccgccacctcccgctctactctcactaccaagtctttagaatagagtacaggtatcaaaatcaaaacaaacagggagtagaaacttagtgccagactttaagtattttttacttataaaatctttttgtgtaacgagtagagcaactcctaactgcatatatgtactaagtttgcaaatggggcaatttgtttttccccatgcactggcatcagaggtggtaaatgctggcctgtcagattcaatgcattttgctgggttagaaccgcaagggctttccaggggaccaagctctctctgctgtaatcattaaaacctgcagaatcctgtgtgactctggggagaagcccagtgctcttggccctcatccaccctcactaggaaagctgcttaaaactaggacagaagaaacaaccactggcttaggatcagtcctcagacctgccttggcactaccccttttattccaaattttgcagtggcacctccaacttcttggtcacgttttgtaccttgtctgtttcctcatataacttcattccaaattccaacccatgctctgacatttcctctccattcttgctagacaggaatttctggatattggatattggcccctgcccataccctgactctgtatattcttttgtcctgctgaccagtttgagcttctgaataacaaaaactccccaaccactttaaagtcctctactttagcttgatgggtccctctcctgtattttctgaccttgactctgctctctgtacaaatagtaattacactcacccccaagcagagaatctgtgtcaaaatccatcaggatatctaagcacatcattatatctgtcaacttccccagactcctgatctcaatcccttattttcaacaacctggcaccgacagagtataatttcttttgtatcatgatgcagtttgatgtgcttttcgaaaggttatggtggtgattttaaagagatctgttttgttagaggaaggaaggaaaatagtgctgtttgcttccatgcagttcctcagagcctatgccagggtgatttcagctcatgagagaatctaaagtctaaagagatgtgtggagattagaaacattggtgtaaaaaatcagattacggagacgtaatatccagggtgtcagaggaggcagggagcttcaatcatgtttgaaactataggtcccacccaacaggatgagaaaatacaggagaagccagaaaaggtacctgcttgtgggtaaaatcaattaaatggaatcaatggtatggtagccatcatttctttcttttcaaattgtggtaaaaacacataatgtaaaatttaccattttaaccattttttagagtatagttcagtaatgttaagtatattcatgttgtcatgtagtggacttgcagaactttttcaccttgcaaatctgaaactgtacccattaaaccacttctcatttcctcctttcccccagcccctggcagccatctttctactttccgtctctatgcatttgactattctaggaacatcatgtaagcggaattatacagtatttgttcctttttggactggcttatttcacgtagcataatgtcctcaagtatcacctattagctgtcattgcttgaacacggttttctgccaagcacatgatctcgttttattcccagcacaactctcaataacaactgtgtaccttttttccctttcacagattaggaataaaaggctctccaagactaggctcagaagcagaagcagttggagagttgcttgcagaaggattattgtcatactgggaagtgctctcaggatttacacctctaagaaactgaaaggggcatgactgcgcagaggaaaagctggttcaccatgcagttgcaattatggctgcagcaggagcatgcagggaagctctggagtaggtttggcctttcagagttgtccccagtaaatcaaatgggtgaagactttaacccatttatgctggaggttgcaaaaatgttttgtgaaaagtcagaccttggcgatgaccttgagcagtaggatataaaaaactcccacaagcttagcgtcccaataatggaacactaggcataaatgagttaatccctgcatcagccagtcattggccctaggtctctccctgagggaggggatgtagctgtgtgaggcagttccctgagggcacattccaatgaaggccccagctgtgagccagcagccaataaggcagcaggtggcccatgcatgcaaaggccctaaagaggaggtccagggtggagcgccacggtgtctactacagatgctgaaagagtaaatacattttatttatttatttatttattttattatactttaagttttagggtacatgtgcacaatgtgcaggttagttacatgtgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggtcttttgtccatgtgatagtttactgagaatgatgatttccaatttcatccatgtccctacaaaggacatgaactcatcattttttatggctgcatagtattccatggtgcgtatgtgccacattttcttaatccagcctatcattgttggacatttgggttggttccaagtctttgctgttgtgaatagtgccacaataaacgtacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgaccgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccactttttgatggggttgtttgtttttttcttgtacatttgtttgagttcattgtagattctggatattagccctttgtcagatgagcaggttgcgaaaatttttctcccattttgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctgaatggtaatgcctaggttttcttctagagtttttgtggttttaggtctaacatttaagtctttaatccatcttgaattaattttcgtataaggtgtaaggaagggatccagtttcagctttctacatatggctagccagttttcccagcaccatttattaaatagggaatcctttccccattgcttgtttttctcaggtttgtcaaagatcagatggttgtagatatgcggcattatttctgagggctctgttctgttccattgatctatgtctctgttttggtaccagtaccatgctgttttgcttcctgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaatttccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgcacattgcttttgtatcctgagactttgctgaagttgcttatcagcttaaggagatttggggttgagacgatggggttttctagatatacaatcatgtcatctgcaaacagggacaatttgacttcctcttttcctaattgaataccctttatttccttctcctgcctgattgccctggccagaacttccaacactatgttgaataggagtggtaagagagggcatccctgtcttgtgccagttttcagagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttgtaaatacattttttaaggtcacacaaatgacatatgggacagaacagtgtttaacttcaaaactcatgttctttctgctatactgggccttctctccgaaagaggcctaatttgcacactacagtcaagcttagaatctattcatagttaaaatgtggagtcaaagcccaggaactatgtccttcaattcatctttcattacttacctattccttatcattcccgctgacaccaaccattttttctgacccttgtcatgaggagtgaagttgtatcattgcagcagctttctacttgtactctatgcctaaaatctctccttcctccatctggtcagccaattgctgtcaagttaatcttgcaagaacactacttttgccagtttaatttcgcaaaactcctgctgtgtgccaggagtgtcccagacatcaggtagtctaagataagcgatagtctctgcccctaagccgtttgcaacctttggagagacaacgtcattatcaccaccagcacccccattaagctcagagctaatatatgccagatgagactctgccagtcactgtgctaaggacttgacatacgttatctcccttaattctaacaactactttctgaggtacctctgatgagtagtatcatttttagatacaaaagcagaaacttagcgagttaagtgctttgcccagtggctctcagttgagaaacgaggtagtcacaccaggcagtccaacttcagtacctgagttcttaatcatcatgtttacaactttggctcaacattgtcaccaagatcgggttcaaatacatccattatcaatattctttctgtctccttgtatgtccaaacaaacaaaacaaatgcttccctcctgatgaggaaagtctccaaatcttgatacctgctgtgtctggacagtttttcctgctatttgctgagtgctggaaggattccctcaatccagatgtgattgcagatccagctcaagctcagcgtcctccagggaacctttgaactaaccacccagaaacgagcctttcaccggacactactcattttcacatatctagatcttatttccccatctgaactgtaagtgtcttaagagctgattttgttgttttttaataaaaaataattcttagttttttttcttattaccaaaaaattattcgccattgaagccttctgaatttttaataagaaaactattggtatattgcttcaaaaagaaatctaagcttctagattcttgaaaagggatagtgacagaaccttagaattaatattcaatataactaatctgatgaaaattcagtcattgatacattactgagaactactagatctcagcatttttaattgtagattcacatggagttgtaagaaattatacacggactccacatacctttttaccgagtttcctctaatggtacacctgcaaaactctagttcaatgtcacaaccaggattttgacgtcaatattgtcagtatacagaacattttcatcactacaaagatccctcctattggccttttatagccacacccacttccctgccccccctacctcctacttccagcaactactagtctgttttccatttctttaattttgttatttcaataatgttatatgaatggaaccatacagtatgtaatattttgggatggacttgactcactcaacataattccctagagatttctctttttatatgcagcaagacttgtttcctttttatcgtgagttgtatgctatggtttggatataccctagtttatttaatcactcaccccttgaagacatctgagttatctgtagttttggactattgtgaataaagctaccaacattaatgtacaggtttttgtgtgaacataagtttttatttccctgagataaatgctgaagagtgcaattgttaggtcatatggtagttgaatgtttagttttaaaactgccaaacttttccgaagcgtctgtactattttatattccaccagcaatgtatgagtgatccagtttctctgcatcttcaccaacatttggtgttgtcattattttttatttttagccattctgatatgtgtgtaggaatatctcattgtgcttttaatttacgtttccctcgtggcaaatgctgttgaacaacttttcctgtacttgtttgccatatgtatatcctcctcattgaaatgtctgttcatgtcttttgtctattttctaattcaaaagtttttttatagttcggttttgagagttctttctgtatcagatactagtcctttcttgtgtatagggttttcaaatgttttctctctcatcttttcatcttcttaacaggggatgaaaaagaattttaattttggcgaggttgaatttatcgctttttccttttatggatcatgcttttgtgttgagtctaagaatactttgcctagccctggatcccaaagattttctcctgttcttttttttttttttttttgagacggagcctcgctctgtcgcccagcttggagtgcagtggcccgatcttggctcactgcaagttccgcctcccgggttcacgccattctcctgcctcagcctcccgagtagctgggactacaggcctccaccaccacacccagctaattttttgtatttttagtagagacggggtttcaccattttggctctcctgttttatatgtcttatagttttacattttatgtttaagtctgtgatccatttgatttttatataaagtatgaggtttaagttgaggtttattttttgcatatggatgttcaattgctctagcataattatttgaaatggctggcttgattattgaagtaaggtcagacttatttctctcctgggcttcagacccagccaccttctatgtttcttgtccaccacaacctgaatgtcccacagacacctcagacttaacatgtccccagcagctcattattatcctccttttgtcccaatccaccctcaacatttttccctccctaattgtgctgttcttatgaacgctacgcttcacccaattgcccaagtcaaaaattagggtattatttctgaatctacttttatctttaaatctaacatgatgcattgccaaattctgtcagctctatccccaagccatctcttaattcattcccttatttacacctcccttgactccaatatcttttgactcaaatgctacatagcctctaatttatctccctgatattgttcttgcttccgaatcccttttccacaatgcgcctatagtaatcctcctaaaatgcagatctgattaggtgactctccttattttaaagtctttcttattgttttctcctgccctaaggcagaagttccaacaaatcttgttatcagattctggattaaatcccggcctcagcagtgggacctaagatagtgcctgaatttccatgaacatttattgatgacaaagagggtcttaaataatgagtgatgtagactttccactgtcaacatcacagattctggtttttaatggtattcacatttgccttctccaagagtccaggtttaatgatggtgagacctatcctaagacctggctttgtagtgaggggttacctcatcacagaatcaagaagggacctcgggccgggcatggtggctcatgcctgtaataccagtactttgggaggttgaggtgggcagatcacctgaggtcaggagttccagaccagcctggccaacatggtgaaaccctgtctctactaaaaatacaaaaattagctgggcttggtggcacacacctgtaatcccagctacttgggaggctgagacaggagaatctcttgaacccgggaggcagaggctgcactgagccgagattgcaccactgcactccagcctgggcgacagagcaagactctgtctcaaaaaaaaaagggcggggggacctgggtgcaagtaattctaagaagcaggaataagagaacaagaagaatgaagcgacaaagaaagatgagcaattctctggaactgttgagaagtgtacagaagaaaacaaatctggatataggtagctacagcctgaaatatggaaagccagagcatgtgtatacctgctcctgctcccactggttgagaattgattcctttttcatctgatatgggcaagcattggatctgagtgggacacatcctctccagtgcacccctgccttttccgctgctctgaacttcacacaacgtcggaaagattcaaaacaatgtagaaaatctaagtataaatacaaaaaggaaacaagaagtttttctatcaaagctgtgaactatatgatatgagtaagctcaataaacactgtgcagaagttgggaggggaaaaagagaattgctgccaaagcactaacccctgtggctggctatgcttgcccacccaggaagctcccatgtcatgggggtcaggggaacctagaacagaaagctgaaaggctcagggatcccttttgagaagggatgctggctatacagcacgagttagaacttgcacagaaccgtccactactgctgacactggaatcacaggtgggctgacaagatgtgatgcaagcaccagacatatttgctacaaacctcaaagtggagcagagcagcggcagtgtcagtcttcttggtgtcaatagaatacctgtttatttgttgaattctccctatatgaataataataatacaagaattcaaagcaggataggctttgtgtcattggaggagtatggagaaccatcagtgcagtaagtgtcgtgggaggtttctagacagtttttaaaagtcgatattgagtcaaccatcaaatgtgaacaattctgatatgccagagcatttgtattcttaactcatggggttattacaaagatcaaatgaaataatcattataaagcactttgtgcagtgcctggcacaaagcacgcactcaatacatgttaatgtttatacaattattattattgattgtcagaattatcagccccacatcagcaaagaatagtaggtggtctgtcagcaggaacatggaaacattctcattacatagaagtcagtgttgcagggacagtcattaaaacaggatctaattttagtcttctgagggaaaatgctaggttctccggaaatgttgaatccttcctcgagcatgtagtttaatttttcaaaattatattgcatatcctgtaaaatgaaaatgaaattgtactgctgttcattaaaggcccccaaaaatcttaggcactatacaatataaatgaaaaaaaaggcgttatttttccatagggcataattagaaataaagaagcaaggtcactcacaaatttccgagctataaaggaggaaaggaacaagattttcccccggttattttatagctgccaggttgaactcatacttatccaatgagccccagaatggaataccgttctacaccaactgtactgatgatagtgattcagggagtaaatgataagattccatccttctaaagtgcttttgggattggattctagtaagtttcattttgctattggccaatcacaaaagagactacaatagagaaaagtgaagacatcatgctgaagacagactgctgcatagaaaaggaagagggaccccctaatttagagatatggatggagaaaaaaaggcacttatgctgtagcataagggaaacattaaataaagctataatagaggagaaaatgtctttgaatagaagaaaaaaatcagacagacagaaatagactaaaatgctaaaaaaaaagatacaaaaggacattgaaggggacatacagtgattattacacaaattaaatgcacacagttaaaagggaggtgaaaagcttctaaaaagaatgagtgtgtagtgaacttaattttatcatctttactaagacaaagttaaagtccctaaaatattttaagacacttaaaaaaaaaagtcttaaaattttgagagcctttcagctctgtcaactctagactttccctcctacttaagttttttttcttttttttcttttatcttttttatttatttatttttttttttatgttttttttttttttttttttttttttgagagagagagagagtggatcagccttaataagagaatggtcttctgccaggtggtattctcctaatccctttccagtgagatccacaagggttcaaaaccactttctggggtcttagaggcaccacttatctctcttcctctgctcatatctttctgctccagtgcccgcatagtttgtgttatcagtggtgcgtagcctgagacatccacgacctatgccagctctcgaagtaatgtgattggcatccaaagaaacacaagaagcccatgatttcgtccctttgcaatttaaaatcatatttaaaatgccttttggtcatacaaatttgaaaatgatcttgtaaatcacttccgggaatctatggtcaaaactcagcttagagttctctacttcttaacagagtgcctgccggtaactagtgactgtcaatgagtttgaaaacataaattgatgtgcaaatgctagataatagcaacatcctgtgcaactgggcagcatttctgttgtttggcttttttattttcgtggactctcccaatctgagagaaaatagatttgagttcctttttaatcggtttagacccagacaaggatttaattggtttagaccccattcacctacgtgtgtcactctgtctccaacataacagaggagatgaccaagacaacatgctctccagccaggaggtggggaatactttggtgtcatagcagacaattattgatggaaaactcatgttagaaaatgtaaggtaccttcttctagacggagtaaaaggggcagctgcccagactttcattttaaatagggagcccatgatacaaatcttttaatacaattttaaaaagaagagacatagggggtatctcttaggacctgtcaacaaccaaccctctatcaaatggccaaatcacaggtggtctgcagcttagccaaaatgtccaagtacctttttgtaacacagaatctcctttgaagatccagctttcattaatgatccccagcagctctggtcaatgtgtcttttcacaaatgaagctttttaaaagctttcagtggacaaatgtggctttgagttttcaactaaatctttctgtttaaaaggagtgctgaaatgggcatactttataatcttaaatgctgcacacaaaatactgaaatattattgaccctgagaggttggttcaaatcaaatagcatactcacgtaaacgttctcttttcctaatattagcaacagggaatgtgaaatagagaggggcgggatatgctggataggggtgcaccaaaattttcaaaaagcctcgaaactagtgtatattgataaccttgtggcatctaatatctagtattctttttttttttttttttttgagatggggtctcgctctgtcgcccaggctggagtgcagtggtgtgatctcggctcactgcaacctccacctcccgggttcaagtgattctcctgcctcagcctcctgagtagctgggattacaggcgcccgccaccacgcctggctaattttttgtatttttagtacagacggggtttcaccgttagccaggatggcctcgatctcctaatctcgtgatctgcccgcctcggcctcccaaagtgctgggattacatgcgtgagccaccgcacccagcctagtattctatgtctattatttcttcataatgagactgggggaaatctttggagaattaatgccgcagttggtaaaatcattctataataatgggtaccattctgctctgtcccacatttttatgaagtctctttaaatttaaaaaggcaatgtgctttgtggttcttgagcaacttaaatacgttgctctgaatagttattgtgatgaggtaatttgtaacaacttttaggatcaatgctaattttcttaaatgtttctgtagtttcccctttattataaagtatattaggctggactcttggctgtaagtgacagaaaactcaactcagattagttaagaaacaaaagggtgttggtgacagtggtggctttcagactattgctgcaggcccacctgccatcctcttaacaccctcaacataccctgcagaaaagagagagctactctgacccgagagcttaaagactggtcaagtatgggcttgactctttatggcccaaattgggtcacatgcccacctaggctaggggaatggaatcgtggaattgattgattgattattgttgcaggttgagtcctccaagaagcagatgccagggcagatttattgcagaataacacctgtgaagaaataggggtggaagcagaattgaacaagggaagccatcagatcacaatgcagatcttctagactctgtgtcagcacaacaaggaatgccagagcaaagactgccaattagaggaatactgaattgggcagatctgacaatagtctgtatataactcgggactgttaacttctccttcctcaaccagttatagacatagaataggactctcttatctcaaacatcaatatctgtgtatatgaagtagagggtgaaagtttactgtacactagtggttctcaaccaagagcaagtctgtcccccaggggacatggcaatttctggagacattttcagttgtcccaactggtgaggaggtgctactggcatctagtgggtagaagttgtggatgctgctaggcattctctataattcgtgggatagatagcacaacaaaaaattgcccaggccaaaatgtcaataatgctgaagttgagaaaccttgctctataaagatacatgtcttggccgggcacggtggctcacgcctgtaatcccagtactttgggaggccgaggtgggcggatcacgagatcaggagatcaagaccatcctgggcaacatggtgaaactcatctctactaaaaatacaaaaattagccaggcgtggtggtgcatgcctgtagtcccagctactggggaggccgaggcaggagaatcgcttgaacccgggaagcggaagttgcagtgagccgagatggcgccactgcactccagcctggtgacagagcaagactctgtctcaaaaaaaaaaaaaaaaaaaaaaaaaaagatacatgtcttatgtgtactgaaagaggccacggaaaccttttgttgatacattcttgatagtttttgttcttatatgtagttatgaatacttgagattccatccaatttatttaacttttgaccagaaagggtagattgaattggtgaaacatctatatcctgaatatttaaaagattctgttttttaaaacaaatattaacttgaattaacgtaaatattcttagtagttaaagtccttaaagaccttagtttggtgaacagataagaatcatctgtgttcagcatatgcattgccttatgaagatggtaagtcaaaagtatgagtttatttctgatatttaaatatccctgaggtatagatttgtttactctggaagtttactctgttgtttgtttgtttgtttttgtttttgttttttgagacggtgtctcactctgtcacccaggctggagtgcagtggcacgatctcggctcactgcaagctccgcctccggggttcacgccattctcctgcctcaacctcccgagcagctgggactacaggtgcccgccaccatgcccggctaatttaatttttttgtgtttttactagagacggggtttcaccgtgttagccaggatggtctcgatctcctgacctcgtgatccaccagcctcggcctcccgaagtgctgggattacaggcctgagccaccgcacccggccttactctgttgttttatttcttcattatatattacaaagttgaatgttagggccaggttagatcggaaaacaagttaagtattccttatccaaaatgcttgggaccagaagtgttttggattttttatttttgtggattttggaatatttgcatattcctcatgagatatcttgggatgggacccaagcctaaacatgaaattcatttatatttcgtatataccttatacacataccctgaaggaaattttatacaatattttaaatacttttgtgcgtgaaacacaaaagttttgactgtgacctgtcacatgaggtcaggtgtgaaattttccacttgtgacgtcatgtcagtactcaaaaagtttcaaaatttggagcatttccgattactttggaaaagtctagaaaaagtttgatatcagtgcactgaaatcattttcaagtaggaacaatagcgatactagccctttactcatgcaaaattcacagtttttatctaaacaacacaaaatcattcaatgcttttatatttaatcatctatattcacctaaccataaaaaatcaatttcaatacagtaaggaaaagacaagaaaacgaatcattctaatcactgtattttgaaagttctttgcaaacaaccgtgaaatggttaaaagataggaggatggagaccagcctggccaacagggtgaaaccccatctcttctaaaaaatacaaaaattagccgggtgggttggcgcatgcctgtaatcccgggtactcgggaggctgaggcaggagaattgcttgaacctgggaggcaggggttgcaatgagctgagatcatgccactgcactccagactgggcaacagagcaggacgtctcaaaaaaaaaaaaaaaaaaaagatggtaagagaatgatgacttgttgcttactaaaataaaggaaagattgacactataagtgatactgtttgaaatctcaggaatctctgaatcattaagattatatcacaaatggcatgcaaaatacctgttcaaaaaatactcctcatggacatgagatgctaagctgctgatactgagtctgacctaggacaatgatgttctgtgtcacctcttttctgatgcctcccagattgctcctggcctcactgctgtctcacttccaaaaatacatattgcccttattggtcataacacagagactatcagttcaaaagtctctaattcgtctcagctgcagtcatctcccagcaagacacaaggttcttgagaaaagaaatttttcatgtcccatctttgccatccaccacacgatgaacatacagtacagtgtacatagcagcccttgaaaatgctggtggaatcattgattcttgaacccaactgtcatactttccagatttaagtcctggtaaatgattaaaatcgtatgggttaccctcaacaaaccagctcaagtatttactataaaaaagggaagctagatatggaacttcccctaaagatgggtctgtcaaactcaccccattgtattctgctctgacaccatgttttttgtttgtgttatttttttttaagagacagggtctcactatgttgcccaggctggtcttgaactcctgggttcaagtgatcctcccacttcagcctcccaggtcactgtgagagattacaggcttgcaccaccatgcccagccccaccttttaatacaaataagtaacagttaccatttactcagtgctcaccttataacagatgctgttaaacgctttacacgccttagctcatttttagttaaatacattgtttttgccccagctatggtagggatcttgctaacaatgagaatgaatgataagaggggctttaaggagaattcactgccacacctttcataattttcccatcattcctccagtctttgttcaaccgtccatgatttactgatttgctattacatcaaactatgctgcaacaaaccagtggttccttctgatttttatccatctcctcctcacctagggtgagagtctgaggcttccttgagtctactttctgatattgttacatttaacacagaacatctcttgttttcgtttctggcagcttatcctctcttcgctttctccatgctttcattcatcctaaaacaccattctgacaatgatatttaggttggtacataagtaattgtggttttaccattaccttcaatggcaaaaactgcgatcacatttgcaccaacgtaatatttttcttacttaaaaaattaatgtagagtatggaaatacttgccatcagggaatggggaagaaaatggctagagagacatggtgaaagagagacttgatttttaaataactttttttgtttttcttgaattttattatcatgtgaatgcatttgaaagaaatacaattttaaaataattattaaaaaaatatttgaatgccttcccatgaacaactaaatgaagtctctattcttaaacctgacagtcaagtacagctctggtttgactccaagctacatttctagccttgtattattcaactctttttctgtttatccttcatatccgggcctttactagtgccaaaaaaaaaaaaattgctcattctactcttgtcacccagagtgtttcttctgtttttgcccatcaaaagcttacccaattgtgaaggcccagtttcaaagcaacctccttcattaatttcatccagatactctgtaacccccatagctgtttaggcttgttctagcaatttgcagttatcagaaaaatgagtacataccgagtgccagaaagtggtctctccaactgtgcacattacaacatctcattctctgtgcctccatttcctcatctgtaaaatggtcactatggtgtactttcctcatagtgatgttcattctttcaagtagttagttaggtacctactatgagacaggcactgacctgggtcctgggggtacagtaatgaataaaatagattgagtcctgccctcatcaaatttaccttctgataagaaagacataaatgaaatatacctataatgctcttgaaatagcacttgggatatagtaaatgctctataaatgtttgctattattactgtcattgttggtagtgttgttatgtggtatttctattaacacataaagaaactaaggttcacaggctgttagataagatgctggttaaatagctagtaagggactccaactcaggtcttcctgagtcataaaattcgtggcatttccactacactgatggatgtataccaggctgtacatcagaactatctgtggagacttaaagaaagtaaagattctcaagcctcagcctcaaattaactaaatcagaaattatttagacgagctaagaatctgtatttttttgaaaagttctcaaatagttgtgatacactgtcaaattggggaatgactgcactacattaaaatctttcccataatactttattatgcttatttgtaaatatcaaatctacaaattcactaaagaccatccccttgttttcttatttatttttattttttctgcttcctctcctagcaaagtgccttataaacactcaataagtatttgagtaattaatggcttaattatttaaagttgcacttaaaatgcaaatactcacagctgtggtactggaagcctgttatgaacaatcatttatcttcctagggttatttactaatcagctaaggacaagcagttgggaaagaaaggctgactatttgggaacagaactgagaaggccctcaaaccaaatgttagccacgttattgaacagcctagggccccgccttaactttacctacacttcgttgacaatttcaggtaaaatgcagaaaatatacgctaacaatcaggagattcctccctcacaccattgtagtttcatttcttttaagccgacacatgtctctcttatggaaaatatgggaacaacctgttttaaagaaagaaaaagaatcctttattcttgtcacaccacaaacatggagttcactgctatacgttaagattataaagcaaaatcccaaaaacgcagtgactgattattcacagtagacatatgaagtcaggaagcttattttttctctctttgctaaggcacaaagcctggggctatatgcatttttattacactgtactgtgttgatttcacttgaggattaaaaagagagttgaggcacagtgcacgtatcttgatggattttaggatttcttgctttcgtgaaagaaagaagcttataaagtacctcagattatcgcccagggaagtgtacctacttccatgatgacctagaaattcaatcttttgtttctcctataaaagatcacattgtactttggatgttttccctgtagttttctgcactatgtaaagccacatttggaaaaacaaaatagttttagtttagagttgaagtgaaaatatctgaaatagttcaggaaagtcttatgagcatttggggagcttacaaacagccttgggggtggggtgagggggaatgagggaagagggaggcagggggagagaagaggagggctaggtcagaagtgtgcaaagaagacagagggagagagaccgtagagactgtgagtccatggcagagttttaattctggttctcacacatctacacagagaaacaatggaagcacattgctccatcccctgtcctttactaagaagcgtgaagtaaataacttgtggcttatgatatgcgaagaagagagaagacagaatgttgtaggatttggaagtacagtagatgagatcttccggtttattgatttgtaaagaacggcttgatactggtttgtcagttctgcatcagtgagagaaaagaaaggcgcttttcagtcacttgccagaggaggagagccgggaagtggaaacagggtcttctggcggacaagcttccttgagtggtggtcaaattgactgtgaagggagtcaaggtcaggaagctttggaaatgctgcaaggatggtacgggatttaaggagggttgatttcctcggttaagggttgttgcagacttcagcaaattcccccttccagcctttattaaagaagtgtttagtagaacaaactgaaaatctacaagtatattgttacccaaaatataaaagcttctgccactgagatgaaaatgtttgatttccagtgctttatctttttgcatttatctacctgtttcagtcattcgttaatatgaatttcctaatatatgccgtcttttttttttttttcggacaataccagttctatggtatctcactgatgattatttcaaattgccacttttgttccttggaaatactcctgtgttcaaataccaggaggcataattatgtaattaccatgtgaacattatgctacttatgggccaaaatgcccctagaaaggaatgctccaatggcctcagaaaatttctgtgagaacgatatcttccaaatgtggtataaataaagctcaagaataaatagctaaggctggaatgtaaatgatttaatgtaatgatgttgtaaggtgagagccacttgactttagttcctgttgcaaatcatgagatacattaggaaaacttttaaaagggaacctattttttaagataaaatctgtatcaagttacatcaccttccaggcaaagtaattcaactttcctcttttctctctgagaccaaaaaaaaaaaaaaaaaaaaaggcagaagaaatgcttcctatgatctcttctcttcctgtcacaattttcataagtctgtagatgtaattaaaactaaagattttgacaaatgaaacaggataggaggttgattgctgcttttctaaattaaaatgaatgatacccttaaggtacttgggtctatgaagtcaatttaatgttgatataacctgactccattatcacagaatgaggcagttgcataagcaagaaaaccaataaacaaacatccaaagtgcattttagaaatcggtgaggtgaaagattaaaggcttaacaacggacaaagagcttgctgttttgttctctcttgccttccagtttgatggcagagttcatcagaattagaggaagaatgttcttggagaagcgttgggctggcactaggctaggagtcctattcatatcctgcctcgcttgtcttgcaagcatgcacagccccttcatttgaggcactgtttgcctcagcagagtctgtgtactcttctggtaggttgtatagaacataataaagggggagggctggaggagaaaggacagaaaaaggagggaataaaaaaaggagtcagattaagaaagaagtcagcacagaaatataaaatggaaggaaaaaaagctgtgatgcaggaaccttaaaaggtagattaaggatggtctcagatggcacggcattagtatcaatgccataagtcacacaaaatctattaagaattatgctcctactcagagtgagtgccatgttagcactagttgtttcccgtgatctatcctgaagtcaaacgcaagaaacactgtttaactcctaagtgccctaatgtcaggaaaacacagaaataaactcaaaggaaagacaattcagttaatctttgcattcaacaagcccaggttgttttgccgcagagctatacctatcacaaaacttcattccagaagatggccggtagaggtggctcatgcctgtaatcccagcactctgggaggcccaggagagtttgaaatcaagaccagaacttatctcagactttttttttttttattattttttcagttacaactcaaaagaatcagaattagaataataatggattttaactgaaagggattaccattagttaaaaggattttaactgaaactgtaatcagtctcaggagcgtttcccggataatgtttgggcacgtatttatgagtgttacttgtgaggatttgggagtaagaatgaacgaggaagttcctcccccaacacagacacatgcacacagaaactgtacaaactgaaaaacttcaggacaaaaactcgtgaatagactggagagtcatttgtgtgcatatgtgtggtttatttactagcatcacagcacaagagtttctgtcttttgcttttgtttttgttttaataggctcatttgtgtaagtgtcatgtctgtttcttgcattcccatggatatttatctagggtctagacaaactgagaaccagaaaatcaaaacatacgttcctagttacatattttctctagactggagtaaacatgatttatgtatgtagtaatcagtaagatgtagcttggacactaggaagaaaccacattgcctagcagtgtatttccacatggggaggtaatgcctgtctctcctaaacttctagtgaagataaaactcaaagtagagtaattaacagaaaggtcaaaagacaaagtggaagcccttgagaatctaaaacaaagttaaagaaccaacatttacatttagataaatttatttgaaataatttctaagagccatgatgttgttatcggtcctttttctttctttcttttattcttttggcttatttaaaagcaatgttgaagaaaaaatgaaataaagcttatctttcacaatacacagaggaatggactgagctttgggaaacagtcacagcttggaattaagagtgtgtgtcgtatcgtaatttagttggatgatttggtgctcattcattatacccagaattacgctttcaagtctaccgtattcatacttatctcagtgcctgacaaataagaggaactcaaaaagcctttcattcattcatccattcagtatttcttgatcatcttctatgtactaggcattgtgataaattcttaacaagacagataagatctctgtctttgtggacaataaacttacattctagtcaatatcttttgaatgaatgtagtgatatttcttactgaagctaagaaaggaaggtctctgcaaacagtatactgtctacagaactcatctgaaatgagaagaccaaggagaataatatatagccctcataactctcaaatcttaaatatgattatttaaaaactagagtaaaacaaatgtggaggagatttggacttcagggttgttttataaattgccgttttacatttttaaatctagtattataggcaaaattgaatctaaatggttttcttcttttcttttttttactttcatcatcaaaaatggaagaaaggaagaaaaggaggaaggaagaaaagaaggaaaggaagaagggagggagggaagtttttcaaaagcttgtgtcagggatcttgaaaaagaaatgattcattcaaaatatagttgttaatagtaaagatccgtgaataaacagtacattaattcattcaactaatattaatttagcacctattatatgccaggtactgtgctactcactgaggatttagcagggaaagatgtgtccctgtcctcatggaacatataaaaaaggacctttttttcctgagatgcttttactgaagaattgctgcaacctagattatgagttctcatggaccagatggcagttttctgcccatctgggatagttctgaagaatagaccctcgtgtatcaatcaaggtttcttccagttctaagctttcgtgatctatgatctaatagttgaaacaggatgtatgcttccaaaaagatgttatatttgtattacttttataaaaggaaacagagacatgccctattaattcagaagagattgggttcctcctggctgtttaaatcattctatttaaactcctttatctcttctttcttggctcaccttccaaagctcactcttaccccttttagtctcacttccctttcctttctttaattgctgagacaaattgttcatctctaactggctatacatgacatctccagttaaatgtttcactgttaggacaaattcattatgttccaaatgaattcatacatacatatgctatttcttccttttctgattttcatattgccaccagcaatatcttcattctcccagtcttccttactcgaaatccaagagtttatttgcttcttcagatattaatctccaacaccaaattggatagttcttcctcctttcaaaataccttctcatatgtaccttcttttacattgaatacaatacagccttaattctaatgcatatcaacccaagtctagtaagttacaacagcctctttctgatctcagtctcaggtgccctttcgaatctgttttacactatactgatcttcccaaaccctaactttcctctaaaatagtgagtcatgtcacagaaattttcagtggttctctttgcctgcagggtaaatcttgagcctcagagtctgggacgccttgctttgcatcatcggctttcaacatgactaactaattgtatctcactgtcgtcctcaacaccactgttctgcagccccaagcctttcttcagcttgtcactacttcttacctccaaacctttacacttgcagagatcagggactatagcatttgttttttgcctatctctttcaatattaacaaatacttataaaatgaataaaccaccaaggaaagaactgattgtgccagaacataagacacaggtatatcatttctggcttttgcttcctgttttgtatataccacggtatattgatttaacatacagccagttagaaagatctaatgcatggaggctctcgtttaatagattatcaaatttcatttccttgcataattgctcaaagaataaagtgctttgttcctaagtcccaagctaaagctttcgaggactttggttgctttcaagtttttctcattcataaatttgtttctttatttagccagttgtgcattcaatccacacaaaacctttctccagtgataatttgtggaaagaaatattttatgcttaattcttctcgctgtcataccttctcttaagtttgagttatgaagatggaaattcactttgatctcattttaaaatcttgacaatattgaatgtacactggaaactaccactggagcgctccttgtataagaaggcaaaattcttcagagagaagattgggagtctagaatgaactttgatgctgcatcggctcagtccctatgaaactaacattcttactagagaaagtggcctatggcacagtcataatcctttaccatctacatcttccccttgggatttctttctcagtatgtgcaaagatttctgatcagtgtccactcccatatggcatcttcatcttctcctctctacccccaaacactcacatttatctctagattgatttattcatgaaatgacccattctaaatttagaaataatgacatatgcccaacatttatttgcacgcgttttcccacaacctttctctataatcttatggtatcacattcttcaagaccaggaattgaccttgcattgggccataaaatacgttgaacaactgcagtttcatcgatatgcacactagaattggtctgcattcaataaactgattaaagaaattaaaaagccaattacttattaaatatttataaaatactttttttcaactttaatcttcaggatagcagttaagagcaagacccagactgaatgagtttgaatcctagctctgccaatttactaactactgaagcttaggcaagttttttttttttaacctctcatgcctcagtttttatgtcaatgaagtcggggggaataatattaactcctattgcagagttactgtgaagatgaaataacataattcatattgtcatgccacatattgcttaataaacattagccatttttgtattgtatgtggtgccctgcacattatagtctattgctctccttttttgctttttttttttttttttttgagatggagtcttgttctgttacctaggctggagtgtagtgacacgatctcggcgcactgcaacctccacctctcagattcaagtgattctcctgtctcagcttcccgagtagctgggattacagatgcccaccaccacaccaagctaatttttgtatttttagtagagactgcgtttcatcatgttggccagaccggtctcgaactcctgacctcaagtgatccgcctgcctcggcctcccaaagtgctgggattacaggtgtgagtcaccatgcctggcctattcctctccttttattaaccataatagtagcaagaacagtagctggtaacatttattgagcaattaccacgtgacagaaactaggctaaatgctttacattgtatcatcttatttaattcccacaaaaccctataagttatattattttccacattttactgataaggaaagttaagaataatttacccagggacattgattagtcaaggttctccagagaaatagaagcaacaatatacatatgtatgtatgtatgtatatgtgtgtgtgtgtgtgtgtgtatatatgtatgtctatgtgtgtgtgaatatataaaattaagtattatctcatgcagttggagactaagaagtcccatgacctgctatctgcaagctagagagccaggaaaattggtagtgtgatttcagtcccagtctgaaggcctgagaaccaggggagttgatgatgtaaatcccagtgcaagtgcaggagaagactgacatcccagctcaagcaggcctgcagggaaaaaaggaacatgcctttttgttctgtttaggacctcaactgacaggatgatgcccgcccacattggggagggcaatctactgaatccactgaaccaaatgctaatcttgtctgcaaaacaccctcacagacacacccagaaatagtggtttacctgggcaccccatagtccagtcaacttgacacatagaattaaccattacagacctgcagtcagtgcactcagtgtcagtaggcatacttgtttgttccgcatcgcttctcttctcttctctctctctctctctctctctctctcacacacacacacacacacacacacacacacacacacacacgtaccacatttactcatttactcatccatttgtttggtcaactagtcattaaacaaatatttgctaccatatactatgtgcctcctgcagaaagggttggagacattcgaagagaaaggtaaacaaaaaatggtccctgctatcaagaagtttccaatctattgcaagacacactcatgtccatataactaaaatgaattatatgatagaagtgcttcaggtataaaccatatactgttagaatgctgaggaagccattaattctaacctgggagatgaggaagtaaacatataaacactaacagcattgatctgggagagaagtggggtaagagcattgccgagagaaggagcagcatgaagaagccacgcacaagagttatattggatggaatagtgcaggacaggcaggtagttttggtgggcttagcaggtagagtttgggagtgcagggtcataaggttgggaaggtaggtttgatatgtccctcatgcttttgtgtatataaaataaagtaaatcctgcattgtaggggaaccccacttggttatccacgtatttgggccaagcaaaaatgggcaagtctagggagagagtgaaaaaatgagattgttctggatatacactaggcacttaattgatattggaaggccagagttggtttgagaccaggctacctgagccacttttctgatgagattaacatcgatttttacctctcgggaattctgcacaccacgggaactaccccctgagttctgattgctctgtgcaagctctgatcaacccctagtttagcatggactgttcacaactaaatcaaaatccagagttagagagctaggatgcctggagccaccacttatattggattggcaaaatgccaaataagtaagtatagcatgtcacccgtaaaattattcctttcttccccaccaagaatagaactcactaagttgacagcacactgtgtcaatatattatagaaaaacctaataggaagaaaagaatggcagttttcactgcatgccccctaaaggtatatttcttaataatttccaagtccactgaaaactgaattccgaaaattagttttatcttactacccaccctattttatcccaaatttaagccttgcctgtacttctttgatacttaatatttttttctttgaggtggagtttcactctgtcacccaggctggagtacagtggcgtgatctctgctcactgcagcctccctcctgcctcagcctccctaggagctgggactacaggcatgcgccaccacacctgactaatttttgtatttctagtagagacgggttttcaccatgttggccaggctggcctcgaacttatgacctcaagtgatccagccaacttggcctcccaaagtgctgggattacaggcatgagtcactgtgcccagcccataattaaatattaatcaaccactggttaattaataattatcaataattaaatatcactcaatgatttattatctattaatcaatattgcttctttaaaaatttgtcaaaaacaatagcctaagacttaaagacaagacatgtcatttctgagattctgtagtcacctataccaaatgtcaccctccctaatgtttttgtgaaagtaaagatttgtatttttttatggtactaattgaagcagtagttcatttgtggctgccaatgagttgactgtaaaaaaaaaccaaaatctcattttaacattgtcgagagaggaaatcctttgtgtttggccttggattgataaaaacgagtctggaatactatatacggtaagtgaatattaaaactagagttatgaaatgttgctttagtgttctcagtcttggagactcaaagtatcttatcagaaaggatacattgttttaattgttcctcattatatagaatgagagaacatcatttctctccttttcctcccaggtggccgtcgaggaccgagtcaggcagctgcatgaagcccacagggactttggtccagcatctcagcactttctttccagtaagtcattttcagcttttatcacttaactttattgcatcttgattaataagaataacagttgaaaaaacaaaagaattaagagttgaattatagtaatcttttatcagatgcagtagaagcataaatcatcctgaaatataacttggttgataagttgagaaggttaggaagaggaaggccaattggatcattttgtccagtcttcagctaatgcataattgtttcctgcactatattctcaaatgttaaccatattaatatttttgagtctttttgaaaaatgtggaacactttgctcaggagccatgctagtattctctgtatcattattccaatgttagtatatgggctgctgaagcaaaaacatacttttgagtttttaatttctgcctatcagttcagttcataaagctaataattatgatatcatgtaattataatatgatcatccaatatatgttactgtgactctataattctttaaataattcattaaatgatccctgccttatgaaatgagtgacaattctcaaaagaaggcatacaaatggccaacaggtatatgaaaaaatgctcaacatcactaatcaccagggaaatgcaaatcaagaccacatgatatatcgtcttaccccaattagaatggctattattcaaaagacaaaaaataacagattctggtgagaatgtgaagaaagggaactcttttacagtgttgatgaaaatgtaacagtaaattagtaacagtatgaagattctcaacaaactgtaaatagaactaccttaccatctggcaatcccactactggttatccatcccaaagctaagaaatcagtatatcaaaagggtacctgcacttgcatgcttatcacagcactgtttaaaacagcaaagatgtgaaatcaacctaagtgtatatcaacagatgaatggataaagaatatgtggtatctgtacacaatgaaacactgcaagaatgaaaccatgtcattcacagcaacatggatggaactggaggtcattatgttaagtgaaataaccctggcacagaaagacaaaaatcgcatgttcttactcttgtgggagctaaaaaaattgataataaacatagaatagaatgatagatactagtggctgggaaaggtgtgtgggtagagggggagataaagagagggtggttaatgggtacaaacatccagttagatagaaggactacgttatatcatttgacagcagaatagagtgactgtagttaacaacgatgtgttgtatatttcaaagtaccaagaagaaagggcttgaattgttcccaatacatagacaaatgacaaatactcaaagtaatggatgcctcaaataccctgacttgatcattatgcattctatgccagtaaaatatcacattacctcataaatatgtaaaatattatatatcaataataaataaatactatgcctccaagttgaaacctcagcctatgggcatttcctttccctaactgtttgcatccttcctttttttttttttttttttttttttttttttttttgagagggagcctcattctgtcacccaggctgtgagtgcagtggcgtgatcttggctcactgcaacctccgcctcccgggttcaaactattctcctgcctcagcctcccgagtagctgggactacaggtgtacaccaccaggcccagataatttttgtatttttttagtagagacgaggcttcaccacattggtcaggctggtctcgagctcctgacctcaagtgatccactcgccttggcctcccaaagtgctaggattacattcgtgagccttgtattctccttttgttcttgacctctagccattctttttatttactggttttgctattttattaattatgtttttataattaatactaagagaaataaccttggttaactgaaagtttaagtattagaaaatcctatttatacaatattgcatattaaattggcaagcacctgttttcctctgattaatgttaatttataccactttttatttgattataaaagtatatgtgttgagttttttggtatttaaaaagccatactttaccacatggagttaacatctgttagcattctgatgtatttccttgtggtcatatatgagtatatatgagggtttatccatcattttaacgcaattactttgtgcctagaaatgttacagattttaactagtttaatccttatagcaatcccttcaatcccttaaggtaggtaccattattatacccatttcaatgatgaagaaactgaggcacacattcatacagctagtagatgagggagccaggattgaaactcaagaagttggctccagagtctgtgtttttaagcatcgcactgtaattttacttaatttatatattttatagagaggaagtaattctgtatgatctccattcttctgccatattctttcattgccattttctgatcatttcctttcttttccattctccacgggttaataaaaagatccacgctcacaaatactttaaagtatttgagtagatgttgtcatgtgtgtctccagttggctgttgtctttttgaacaaaatttcctggaaggtgttggtcctgtgtttttgtcatacatcgataatagattaagaagaagtatcttattttctggactggctctaactttattatccgcatgtggtctagttatttggacacagtttcacaatgctttggagttgccaagaaaaagggataagttaaagcagtttatctaaatgagtgggatcgtggcttttaggaacggctctagaaaaatgataaaggctacagatttcgtcttctgcatctttccaaatctctggtctacttaacttgccttggtgacagccattctattcgatttaattgagattaaatgtgataacatactcctaagcgactcataaaccataaataaaaaatagtactattatgaatattaattactcctcagacaccaggtatattcattcatattttcttctccctgactccccctctgaattcccatgtcttacccattaaaacctattttcagaaaatgatatactcatttaacccaagtgataggtaaagtttaatgtgtacttctcctgggttatttgcattttattagtgtgaaaatccataagcctgaggtggtagaacatcggccataagctctgagctgtgaggaaggaactttgaggggccaaggggagcattctcacacctttcaaaccatatcacatcagtgcccacttccagaaaggtcaggcctgttagacacaggtattcataaagagactgatctacctgcctgaatggagccagccccggaagtcatcagtctcttggatgcccatgtggaatatcaatatacgcttaaaagctttgcttgcaggtataaagaaaataccaacttggtttaagggatatttaagaaataggacggtgagactaaggatggattgtttctttacattgtactttttaaaattacaaaggtactctatacacatcaagaaaaatttggaaagcccacagtacaaacaagaaaagaaaaagtatccataatcctatgactcagagataatcactatcagaaatttggtttatatactttctgtatttctcttgtggttgcgtgtgtgtgtgtgtgtgtgtatcaaggttctatcttttatttttttatttttttgttttttgagacagagtgcaatctcagctcactgcaacctcccccgtcctgggttctagcgattctcatgactcagcctcccgagtagctgggattacaggaatacgccaccacgcttggctaattttttgtatttttagtagagacggggtttcactatgttggccaggctggtctcgaacttgtggcctcaagtaatccacccactgaggcctcccaaagtgttgagattacaggcatgagccaccacgcccggcctctctcttttcttttaaaccatgcgcagataaaaacatgctacagttttatgagctgcttttttcccttaaaactatctttccaatattttcgtgtgtttaaatattcttcttcagagtaatttttctaatgactggctaatactctcttctgtggctgtaccaaatttaccaacacaattctaaattgctcaatataaagattatttcacaatctttattatatcgagcattatggctaatatcctttttatacctttacaaatatctcagattctttctacaggataaatgcctaaaggtggaattgtcatgttaaagaatgtttacattcgtaagccttttcaagtgtattgccaaacttacctctagaaaattgcaccagaaattgggtgtgccatccaaaccgtatttgagctaggcatggtgtggctcatgcctataatcccaattctttgggaaactgaggcaggaggatcacttgagcccaagaggtcaaggctgcagtgatccataatccacccccccccgcactccaatctgtgtgacagagcaagaccctgaccctaaatttaaaaaaaaaaaaaaaatcaccatatttgaagcaggacatctctgaagtcacgtatttgctactataaaagcagcttccccccaccaatgaataaaaatatgttttaaatattcctctaaggtcatattaaatgaatttgaattgatacttttttttagacaggcctgagttgatacatgtttagtaatgtgctttcaggttactataaataataatagggtggctcctaaagcttagaaattacaaagaaaagaaaaataaggaggaactactaattgcacccgccagcgtaaacatgcttactgtctctgtttatcttattctctctctctctctgtctcgcacgtgtgtgcactctctctctctctctctctcacacacacacacacacacacacacacacacacacactcccctttggaaattatttggaaattacattaccagctgtctgttgtttatcagaagacagaggcagccttttactaaaaaaaagaattcactgtttcttcctggtggcccaatctctacatgttaaagaaattttttcttttatcttagatctaagagaaaatgagaagagaaaagcattgtgaaatatgacccttctccgctgatagacactaacttgtccttacttctagttttaatacactgctactcctaattgacttctacaacttaaaccaagaaaaaggagaaattctaatagtgtgacttcaaatatgtatataatttacaataaaattatcatttaaattatttaaattatatactaatttatagttatatatgtataattggtaggtatattgtcagtctcttcatatgtctgtgattaagaaagtactaaagtattcattggttggcatagtagtctgaaaattgtccttttcttttgaagagtttaaagatttgttgggcgtggtggctcacacctgtaatcccatcactttgggaggctgaggtgggcagatcacttgaggtcaggagttcaagaccagcctggccaacctggtgaaacccccatctgtactaaaaatacaaaaattagctgggcgtggtggcactcgcctgtaatcccagctgcttaggaggctgaggcaggagaatggcttgaaccctggaggtggaggttgcagtgagctgagatcatgccactgcagtccagcctgggtgatagagagagactctgtctcaaaaaaagaatttaaagatttttcctgaccattatttcaattctctggtcttctgttctaaattctacttttctcaccaagaaagatcactatatatttgggtaaagggagaaatcattctataacagtaaaaagaatccatggttttcttaatattttacaagttccagaggtcccttaaaagaatattttccaagccaggttctttaaaacattaatgttatattaggttttgataactgtcccttgaaaaaaatagtactgattaataagattggaaaaacactaggtttcaaagataagcaagtttatttcttgttagaattcttggaatttttattatacactgagactctaagaggataaggagtctatagttctccagttttaggtgactgtggaagcctttttcaggcacaccagttaatttcacactaaactttatgccatggatcacagtgaatctttgccttaatgtggtatttgccagatgctttaatgacaaaaaatttctgctaaaggttgtagaaacgtgatccaattaaaaagaaaatgagtatttatgaggcaaaagggtcaagtccctctctttactgaagttcccagccccactcccacccaggagccctcttgtgctgtggagtttcctaactggagataagcttagaaagtatctataccagtagtttccaaactctgaggtgtggctcattagcaaatcctaaaatcagtttaatgacttacaaccaacaatttttgactggtatggaatggaatggaatggaacagattagaaaatatcagagtgcattacctaagcaaggttaagtgttgttttggcggtggttaatttgttagatatgtgtgtacatgcgtgtgtgtgtgtgtgtgtgtgtgtgtgtgcgcgcgcgcacgcacgcgcgcacgccagatcacagtgtaaaacgtttttcttctgtgggttgcagtcgaaatagtttgagaaacattgaatcattcgagccctttccttattttacagataatgaaataggtgcagaacgatcaaatgacataaccaaggtcacaaagatagttataatactgggactggaacccagtttctggacatccaagccacacatcacactgccttacccgttaagaagaaatgcccaggccaataactgtctagtctatctgctattgccaacgattattctctcgtatattcctcttcgtttggccatcctaagttgatttacataacctaaatttttctctcaacacctctgggctaaaaactgccttatcaaaatggtatcgatagcggttaagagtaaaagctgtaaaatgaaactgactgggttcaaatattgactcagacactttatgcttttttctttctctttattcttcatctttaaaatagggataatagtaacatatttggtcaattgtaagacacacttttccacccacgtttcaacagttctgaaatcagaatgcaccatacgaccaatgggatattgaattcggtgaaatatggctgtattatttcatagggttacagtgaagatcaaacagttaatatttgtaaaacccttagagtagtgcctggaacatagtaagtgctattcaagtgtttgctattagctttagcattagtatcattattactatcagcttgatagtataacttaatgcatgcctgttagagtcaaactagtcatgaaagtttcattcattctcttgcatttaatggtcagtataagtagttcctctcctttctgaagatgatttccaaggatctaatctgaaagtccagtgttttgcacattagaacggctcaatagttgtttgtataactaacgagtgataaataatcaaaaagatagaccttaatctctaaaatgtcaggatagtattagtcttgttgacagttatattctacagtacctaatgtggtatgtggtacttggtagatgttcagtaaatatttacagaatgaattatgtcttatacccaaaagaagaagaggtaaattcactcttgacattgataatacacagaggcatgagatttagcatagtggctatcacatagtagacactcaataaataatgtgaccttttctgttgcttctcagcaaagactaatagcattcataactttatatggtcgtttttatcaaagtcgactgtaccatgtaatacattaagggaaaaggctgacttcaaaattacagcatgatcacaactatattacaaaataaaataaaaataacagaaatgtacacataaaggaaaaatggaaaataaaaagataccaaaagacaaacagttattgcatcatttctttctttttacttttacaaattttctggtaatagcatgtactacctttgtaatggaaaaaaaacaataaaggtaacattttatactccagcttttaaccagtgacctcttgcagtggcaatgggactctgaaagacaaatttcctttttactatttattctgaatttaaaagctgtttcattgagtgaccttctcagattatgagacactgtaaaaagaaataactgatccattatttcttgcaggctttacaatcttaactgccttaatcatatccctggttaagtctttttctctcttgtcaaagtgactcaagcttttacagtttctccttgatacatagggcctagcagtttgtttctatcttgagagttgccaagctttcatcctggacattccccactacacatacacacttaattttaaaaaataggggaaacctttaagcacatctaataattgctgacatttcacttaacagtgctccaacctatgctaccagtgtcctcaggggacagacaatttgaaatatgagtggggcaataatttaaagcttcagattggcttaaataagccatcatgaggccgggtgcggtggctcacgccagtaatcccagcactttgggaggccgaggcgggcagatcacctgaggtcaggagttcaagaccagcctgaccaacatggagaaaccctgtctctactaaaaatacaaaattagctgggcgtggtggcatgcatctgtaatcccagctactcgagaggctgaggcaggagaatcacttgaacccaggaggcagaggttgcagtgagccgagattgcgccattgcactccagcctgggcaacaagagtgaaactgcatctcaaaaaaataaaaacatcaaaataagccatcatgataaaagtcagaaagaattttgcaggtccaatgtgagatgatttgcaggctaaaattctctttcaagtaaaatctcagggtgaaatgatttgagccagtttcttcagcagtcacatgttgtcccaagtgttaggaatttgggacaaatgccatgtgacctaccagtgatgctgataatgcccctataaattcaaagacagcctttccaatgcccataaaaagcagctacagcagtaataattatattctcttcttaaaatgtgttgtcatggcccttttctcctttagctcaaatgtatactccccaataagctctcagatttatttgctttacagtatcattagcaaccagattttgcatcgttggccctatatatcccatcaatttgaacacatgaggaaacagaacgtttttgtttctgctatgggaatttctgtgctggggctggcttacaatggctcaagagagccaattgtaaaatatacaggaattgtgagctagttattaagcctacctttggtagcttgaaatcaggcatagtgggaagatttactccatggaaattggcaaatactacaaattggggcactttgttttttttttttttttttttttgtgcatagatggtttcccagaaatgactaatttatctatgttatttggatcactcaagtccctgtaggcaaagaatcttcataaacttagcaggaaggatgctcaggatccaaatatttatgtgcgttgcagagtgaccactcatcctggtttgtctgggactttcccggatttagcactggaattcccattttccaggaaatctctgtagtcccaggcaaaccaagatagttgctcaccctagccttaggtaaaatccctagaagtagagccctatttagatagatggggcttcttgtagaagtaatttgttcaggtgaaagggagtgagggaagcaggataaagtaagaaggatgctggtcaaggagttaagtgggaaggaagagactcacttcagcttgatcccacagggagctctggagaacaaattgtccctactttgagataaggggcctgggctttttgtttgtttgttttgagatggagtcttgttctgtcacccaaactggagtgcaatggcgtgatcttggctcactgcaacctccgcctcccaggttcaagctattctcctgcctcagcctcccgagtagctgggactaccgcgcctggatttttttttttttttttttttttgtatttttactagagacggggtttcactaggttggccaggctggtctcgaactcctgatctcctgatccgcctgcctcggtctccaaaagtgctgggattacaggcgtgagccaccgcgcccagccagggctgggcttttattttcccgtgtgaattagtcattggctgtggatttctggggagtaggagatagcaaagcagttcccatttggccaagggaggatttctggtgaaaggaccaatgaggccttagcaaccaacactcacaacaactgcggctgggtgaaccagctcagtaaaagggatctgagtggaacaacaatagtattaacctctcctagactttatgaagctgctatcataccccatgcataatctggctttagagctgaatgggcgcatttagctggatcactaaccaccactccttcgtcacggacttacatggaaattagcccggtggcatggaagagatgagacaaatgtctgtttctttcttatttcatcttcctcattgtgacagattcttctgggcctcatgaggagctagggccaagagaccagcaccagagttctgaatcagttttataacatgggcactattttggtggaatgctggctctgaagggtgtatttttacactacccagaaaatgaaggcatttgtgaatttggcctggggtagcattttgtcatctgtccaaaatacaaagctttgcacaacagaaatagtgggatcacatccctgtgggcaagaatcattactttcgtttttccatttggatgttttccattttcagaacacaaccagtttgggattacaaagtactttctggtgagaactttgaagtgaggacaaaaggcattttgttctttagtagacttacataaactgttcctggtttaaaaaccattctagatttttaaatagactttcagatatctgcagtaaaaatcatcttgatttcaggcgactgcaggtactgctctgttatgtgctatgtctccttaaggctgtaagggacagggataggcttaggtgataaggaacattttcaggatacagagaggcatgaagaataacatgggccgggcgcggtggctcacacctataatcccagcactttgggaggctgaggcgggcggatcacgaggtcaggagttggagaccaacctggccaacatggtgaaaccctgtctctactaaagacacaaaaaattagccaggcatggtggcgcacacctgtaatcccagctactcaggaggctgaggcaggagaatcgcttgaacccaggagacggaggttgcagtgagccaagatcacaccattgcacaccagcctaggcaacagggcgagactccatctcaaaaaaaaaaaaaaagaaagaaagaaaagaataacatggaacaacagacaccacgaaacatgtttgcttctttctgtatatgcatttgctgccatagacttcagactattacagtatcatatcttctctcttctctccacctaacaccttctacttatagtttctactttcttatgacttccattttcttcctttgttatccgactttttaaacttccccacccatctgtcatctctgtttatctctgtgtattacattcaagctctccaagacaaagcatctgattggattagttatttattatccatctaagggtaatgccatctcacaggccacaggccagactgtaaactaggctttcttgacctgggcactattggcatttggggccagataattagtggaatgctggctctgaaaagtgtatttttacactactcagaaaatgaaggcatttgtgagtttggcctggggtagcattttgtcatctgtcctagaatacaaagctttgcgcaacagaaatggtgggatcacacctctgtgggcaaaaattattgggggctgtcctgtgcattatctctggcctctactcactacatgccagtagcactcccctcccttagctgtgacaaccaaaaatgtctccagacattgtctgtctgatgtcccctgttgggtgaaattgcccctagttgagaatcactcctttataccaatgcctgcacaatttgtggtaatgaaagtcatgtggaacactaaatacagtgacctatgcctgaggaattatttgaagttgcttttctgcatccttagggaccctttagtctctcgatgaaagggagtgtcctcagcagacaatcttcaggaattgcatcagctgcctcacccaagatcataccccttacaggggcagctcttcctgatcagtgtaggggaataatgacctggccattttggcccaactcaggagaacattaacattctagctcaagagctcccatggggttgaatgagactgtcactgggtctgcattcaccttgacttctccctatttctattcctgtttctttcacttcccttccacagttgtctatcctgctctctaatcattgccttagagttggcttcctggaggaagccaatctgtgagggggcaatgaaattgacaggcatttagaagcatctaagaaaaaggtattataataggcccattacagtcactgggtaatttgatttactcttgctttcataatgaggttgattattttgttcaggataagtagtgattattattatttaaggtgtccaacctcatgatctccattaataggtaaggactttggggacagcataaaattacatgaatctcttaccttaaaccttaagctcagcagcatacatgcccatgacaggcaagagttagaacgtaagatggtcagtaacatagatcttgaaaggaaatatgttggagtgtgagcactttaagggcatagggcctgcattacttttttattaaaaataattttgcatctaacacaacatcttgcatattagatgcaggatatgccttgattgaatgaataactgggcacttaaaagattgttcccagtctaataaaatgaaagaacttagcctggtgcttagtctaatgtccagaaagagttaatgaacttcactttatcttcagtcagttaagaattgattcactttgttactcaacaaatgtctgttgaatgaccaatgtaaatcaaactctgatctaggaactggggaaacggcagtaaataaaacaaagtttatttattgtggagcttacattttaacaagagaagatggacaatcaggtcatgataagtttgatttaaaaacaaagaataaagcaggctaaaggggctagaggatgggagaaggggacccttttagtggagtggtcaggaatggtgacatttcagtagagatgtgaggaagtacaccagtcagatattgggggacaaagtgttccaggtggaggaaacagtaaaagtaaaggatccaagatggagcatgcttagagggtttgagaaatattaatagcaaggaagccagtatgactgaagccaaggaagaaagatggtgaatgataggaggtcagtgagtgaccaagggccagacgaggaagggtcttatcaactatggttggctatcgttaaaagcctttggcatatatgctttgtgagaagggaagtcatagaattctgagctaagaagtgacatggtgcctgtagcattgttacttactgtgcctgtagtattcattcattcattcctatatttattaacaaaaacgagtcacctgaaatatgaagataaaaagagaattattgccttgggacatttaaataccaatcacaaaagacagacctataaaaaatgacctcctacagtggtagtaaatagtgggtgcaatgggagtagaatggaagggaggaatccattccacagtgagagaaaggagatgttctatctagttgagtattaacgcatattgtccctgaggctacatgcaaatccaaagtagagggtattccttttgataggaacttagcaaagaatgtttataattgcttggtccctgatctcacctagcaagagtcacaagatgcattcagtgatgaaaaatcagtttctcccttctacttagccattctgataagatgaatatctcgggccgggcgcggtggctcacgcctgtgatcccagcactttgggaggccaaggtgggtggatcacctgaggtcaggagttcaagaccagcctgaccaacatggtgaaaccccgtctctactgaaaaatacaaaagttagctgggcatggtgacaggcacctgtaatcccagctacttgggaggctgaggcaggagaattgcttgaacccaggaggcggaggttgcagtgagccgagatcgcgccattgcgctccagcctgggtgacggagcaagactctgtatccaaaaaaaaaaaaaaagatgaatatctccctttccagtttcgtgtgtagtctccttaccgcccttctgttcagaaaagggatttcttacgtatgtataatgaatataaatataggttttagagagcactaatgttttaatgagatagaaataggcagacgagagagaataattgaaggattagtcaacatgagggcaatttgatagggaaagaaaaagtctgagcaggaaatgtctgtggaaaaaaaaaatcgaagaggaatggaatgaaatgagctcatttatggtgtgagttagggacagaagggatttattctcaggaggtgaaaagtgaaggagttcatgttatagaattcgacctagaccagctatcaagggaaagaaagtaattcaaaagacttggtccaggagatctggagcagatacatctattagaggaagattcagttttgaactgcatcttcagttattcctggaacccaacacaaaagctcatgacaaccttgttatcttcaggcaaaaaaaaaaaaaaaaaaaaaaaaaaggcgggggcagcaaggcttatgtcttaaacaagacagcacataacttcaggtcagagaattccattaacatgaatcacccacaccaatttaaataggaaaaaaaatagtaagcttggttatgtaaaaatttagtttaaaaatcagaaccaacaattgaaattaaacaagaatgttttatttatttctaaaaatatttagctatttattttgaattctgaagcaatactaatatagtatataatgataaaacacagttgattttcatagtaaacatcagcatcagaatgccaagaggaagatttgtctccgttcatgttttattactctgagaaccgcgtaacattttttaaagagtcagaaaatggctagaaaaagaggaagaaagattatttccttaactagttccctggtcccatgctttggtggttaacagtcagtttaactctagaaccatggaaagtctctgtcactttcctggttaccctgggattcctcacattggcagtaagttcgtgaatgagataaatatcctgataactagctacattaatgatgaaaataattataaacgtaggagttggaatttttaaaaagtatcgagcgctctgtgctcttaacacagaggaagcattttgcatagattaacccgtttaatcctcacaccaacctttaaaataaggactgttattgtctccatttcacagaagagaaaactgagactagaacaatttactaacatattcaagttcatacttgtaactattatggattatcagccttagaaaaggggttccagacaccagtgaatagcaacccacacgtctcaactgcacagaccaaagaggatgataatccccattaatctttgcatgttagtagaggcagtggctagtaacaaatgggagagactttggctggaggatattttttattctttaatctttatgatactgtttcccctctccccttctctctctactcctctctctgtcagctgtatccacaataatgccacaatataactactatacaagaatataaagcttctgttctcatgcttatgggtctacaggtcaactgtaattcgggtgatctggataaaacttgactggaaagctctacttcatactgaagcatgcctgggttcgcctctaggctgtgagttcagtttagatggtttctaaatgtgttgggttgtgagccccagactaaaggatcagaagcaacctggggcatgttctcatggcagattgccagtgtgacaagcctctgttcacatcatatctgctaaagcaagtcacatggtcaagcaagccaaggtcaaggagctaggaagcacactgcgctcaccatgaggccatggctaaggtatacatgtttagttctttcacaactgagtgaaaaatgggccccaaattcaatctctcctatactctttttgcgttaattgctagttctttctcactcttctcgctttctaatggatgtacatcccatctatgatcatttggtttttaatatctgagttgctccctactgtctcaggtttcaaattttactttccttgaaatttccctggtgcctaatacaatacctttcacacagagagcgttcagcaaatggtgtggactgcctgtcgtcttttaaaagtacatctgcagagacagtaaaggcacctggcgatattgcattgacttgttagtaacctgacttaacccagatggcccaaagactgtaaccaccattacctggaggaaagttccctggtaatgcagtcagccaattatgttcgaatttactcgaaaattccttgagcataaattattcatggctctatttatgtaggtatctatcttcctatatctgaccttaggaagcttgattgctttcttactcttctaataatcaccgtgatgtttttgaagttttctataagtcggttagaagcagcttttttttctttttttttttcatgagtaatgccgcccaactttggctattagactttgtgtgactgtgcagccatcagcactggatattagatatagttttatctctgcaactcagtcaccttgccaagaattttagtatgaactcttgacttcccagatcaaatgtgagcctgatactctaaatgacttggcaatctactgacaaatcccatggtgtggtattctgttcaccatgtgcaatggtctcagagctcagcattatctgtctgacagctcatataatatttacaggttgttattcgttaggaattttagttagccataaagattttcacagctatggcagacattagaggtctcattcatcactcttgtgaccttcctctctggaatgtagcccatctgtctctgctgttgaaatctttatggaaagtctgcccatctttgaaagtttagtaagtgatcttaaagttttcattgaatctttacttttgatatacgatatagacatataaagcactatccttattttaatttaacgttttgaaaagtgttaaatttaacttggcctttcatttaaatgacagaaaacttactcttgctacaggaactatatgcgtcacatcaaaagaaaatagaaatcatacagaaaaaaattggaatgggaaaaattacacatatatacatatatattcaacactaataactacatgaaagcttaaatactgtattataatcctgattatgactttaggaaatgaaaacgatagaaatacattttgcatataatttaacgttataaagaaaccctaagcaaattcagtaatgaagtgaactgaataggctgggttacagagcacaagagagggatgaccaacaatcagatgttgcccctttccatttctgttttcctctttttatacacaacttctcaaatgcttgcttcccctccgtctactccctccttcagcctctgatcactagtgtgaaattgcccttttgaggtcaccagtgatcgtgggatcaaatacatcttcttcttctacacccttagtctgtcaggctcaagaattgcttatacttcaccagctaggctgttcttgtgtttcatcccactttattctagcttctgtattatttttctttgacagcagttctactgccaccgccatttgggggcatttgccagggtacattcccttttgttttcctccactgtactcatctttttttttttttgtacttttatagctttcttggggtataattatatgcaaaaatatgcatatttaatatatgtaatttggtaagtttggacatatgtatacacccaagatactattgccacagtcaaactaaagataacgaacatattcattacctacaaaagttttgtgtccctttgcttttgtgtgtgtctgtgcatggcaagaacacaacatgagatggaccctcttttttttttttttttttttttttttttttgagatggaatcttgctctgtcgccaggctggagtgcagtggcacgatctcagctgactgcaacctccacctcccaggttcaagcgattctcctgcctcagcctcccgagtagctgggactataggtgcgcgccacctcgcccagctaatttttgtatttttagtagagatggggtttcaccacatcggccaggatggtctcgatctcttgacctcgtgatctgctcaccttggcctcccaaagtgctgggattacaggggtgagccaccgcgcccggccgaggtggaccctcttaatccccttaagttttaagtgcactacacagtattgttaactataggcactatgttgtacagcagatctctagaacttactcatcttgcataagtgaaactttatactcattgaataacaatttctcgtttcccctgccctgtcttctggcaaccacttttctatttactgcttctatgaggttgactatttcagacacttcataaaagtggagtcatacagcatttatccttctatgactggcttatttcactgagcatgtctgcaaggcccatccacattgtcaccaatggtaggaaccttcttttttttaatgctgaatggtattccattgtatgaaaatgtggtgtatacatgcagttctctttgtacgatcttccttccttaaagagtccagccattctcatagcatctgctatgattctagtacttatggtcttgtcctttcacttgcatttcagtgaaaagaaccaaacttatgctgatgcaaatacctgtacacaaatgttgataccagctttattcatgattgccaaatgctaatcagtctatgggcctctgattttcactgcataaaatatagactaatctgtttatcattcatgctgatgaatggtggataaatggtctagctaagaatgaaagatctgttgtatagatgtcattggtctaggaagacagagatgtagaaagaagtaccataagcccaggcagttagatactattcaaaggcatttctctctgccatactttatactacatgtggcacattaacagtagttaggagtggattcaaggctgcagataaatgctgcccaggtgagagagaaagaattggttccacaattaaccatcattcagacaacacatcatagctatgtgattacaaacattatttgtgtggtgattaacattttacaaagcaatttcatattgatttcctcattttatcctgacaacattttggtgagggagatatcattattcccattggaatataaggaaaataaggcttaggcaggaaaaagactagcttaagatcatgaagtgataggggagtcaggactcaaatccagttcttctgaatctgtactctggacattttctgctatatccagctccctctcaagatgctggattgggctttgaaatagaaagccaacatcctgagtgcctttctaaactctgagttttacagtctatcaggggaagaggagagtgtgagaggaatgttcccaaataatctactgtatcaagcagtatatctaacttgctttgagaattatgccaactaaatactattgacctgcagaaaattgatttttctctttacacttatatcaataaagagaggcttctgctgccataagtgtaatttatgtaaaatgtttttaaaacattcatagcctttaatcaagtaaatatacttctaggaattttgctttaaaaaagtaactaaaatatgtgcaaagatttatctacaaagatgttcactgtggccttacttagaacagtgaaaaactggagacaacttatatgttcccaaagagggaatttattcaataaatcatggtacatccataagtgggaattttttagcaatgaaaaatctgttgtaaccctacaagcccactcttaagcattcatcttagagaaatgaaaacttatgcttatgcaaacacctgtacacaaatgttgataccagctttattcatgattgccaaatgctaaaagcaacctaatgtctttgaacaggtgaatggataactaagctgtagtacacccatataatggcatactacttagcaatgaaaagaaacaaatcgttgatacagcaatatggattatgcattatgctgagtgaaataaaccagtatcaaaaggttacatactgtatttatatgacattctggaaaagacaaaacaagtctagtagatcctccctaatgccttttgttcaaccccagaggtgagttttctattttacctccagtgattgctgtatcggttatttatctaaactgtccccacttttttgacccacctatgttatcaaactccaaatccaccaagtatgagaaaagtagagagatgaatgaaggtatttgtgttggaattccagaaagtgctcttttggcatgtcttaaaataacattagcattctttttaattttctggttaggcccctatgttgattaaaatatgacttaacaccagggtgcatcacttggaacattctgttcatcatgcatttaaaaacggctgaaataacaacttcccctaaataatgtggcctgtgcttgtgattttcaaaactaccttgggcacaatattgaatcctgtcacctcaaggaaggaaaagcatttgaagatagaattgctaccctttcttgctcttaataacatactgtgtctgtaacacaaaaggaaattcagaggttggttttgcaataaataaatgcatgtgtagtttgctatctaaattcagtggacaataccccatgatgctggtgccgtatgataatggttgatttgtacattcaagaatctgaatcacaaagctgccctggaattacacgtagtggttataagcacatctgtataagaaaataccaaaggacaacccggtgtcatatagaaactatttgccgataaatttgcttttgatgggctactaaaaatggacacatcaggcataaaagatgtgtgtgtctattacgtaggctagctttatgaagaatgacaagcttccactggtacactgagataagaaacagctgttgttggcatcagtactgctacaagaaatgaaaaaattctgtggcacacttgtgagcactgccacatatttgatcaacttttgaatagatggaagaccagaatcatctggcagccccaaatgaaattgtcgacaacccttaagaatctcttgagaaggagcactgaacccaattccgtagaactatcatccaattgtgtgttatttctaaagcaagtagttccagtgtgtgtgtatgtgattatgatggggcagggaaggaatgaggggaggctgttgttattttcctttttttttttttttttattgtgtcaaggacatttttgagcataaaattgtaaggtttcaaacaatgactgcaaagcagttgcttaggtgaatttataaactgtgaatcaaaggggaaaaacatctttcagaaaaaaaatacactgaatctcaccattggacctatttgatggctacacataagacaaaaagcttttttaaggaaaataaatgaacacttaagaactgcaattacaaaagcttgaaatttcatattgatctagaatttataatatttttaaaattctttaaaaatattttcagctatttagttcaagcatattctgataacttctctgacatttaattgaaaattttccccttttaatgtaaacataaaaagtcaactctagataccctacgtaggtcttcccattagctcagccaggcaacgccaattttcctctgtctctcgctgcttagaggttgtttctttcaggccgaaagcccctaagccaggccaggcagccagcagccctctccagcacacttctttctgagagacgcctaagaatagtgtaggaaatccaaagtgattcttctgctatcagaggatggtctagcatcctccaaattagaaagaatttctggaccactagaatgataaaaaaaaaaaaaaactagaaaggtataataagagaaattgtgaggcctcagcccatagatacctttaaggaaagaatagccattcttttctcagtttaggtattcacaggcttggcattcacagccagtgagggctggaccaagagctctctggagttctcttcttccttttatgatgctggtattttaagaagaaggtacactgagcagccaggagctataatttctggctctccaccatgtttcctgctatagagggctagctttttaatatttccataacaacagactctgaccagataggtcaggaagtctagcccatggtttgtttgtttgtttgtttgtttttcagttggagttttgctcttgtcgcccaggctggagtgcagtggtgcgatttcagctcactgcatcctttgcctcctgggttcaagtgattttcctgcctcagtctcccgagtagctgggattacaggcacctgccaccatgcccggctttttttttttttttttttttggtatttttagtagagatagcgtttcctcatgttggccaggctggtcttgaactcctgaactcagatgatctgcctgcctcagcctcccaaagtgttgggattacaggcgtgagccaccacgcctggccttagcccatgtttttaaatcagatcttatttactctgtgaacttatttggacaggagagctgcatcctacagaagaaaaaaggacaagagaagagttgggaagagaatgagaaaggcaaagatggaaagggaagcagggaaggcaggaggaagggaaaagaaaggaatagagaaagaaggacagaaagaaatggaaagtcagagactacttcaaaacagcagctaaatgtcttttttctctgtattaaaaatttccgtctgccaaaatgaaaaagcataattaccggccaaatacaaatccatttcctatatcgtttaaatgacatatctccaaggtacaaaacagcatgtctggttaaaggttgggtgatttgatccctctattactctatataaaacaaagaagctggagtttcattacgcttaaattgtctggcagtgggtgaagttaacttttattagaagctgttctttcatattatacagtgtagtcgaggatatattagctttgacgttttcttacatctcaatacactgcggagtgaatttactgtgagactaatttaaaagggagtttttcataggaggaaataatggtcagcatcagctgtgcttcaaattattagcagaatgaaaattcaggggaaaaagtatagacacataaagttgctagatattaataagaatgcgtcttttatttctgtttctgataatattctgtgtttcttaaagctccagtgtcttaaaactatattcaggaggaagattatattgttgaggaaatgttatagtgcctcctcaacaagattattttgtcttaaagaaagaaaaaaaaccatcagatcaaacagtatataaaatatatttgtagaggttcagctttagggaagaaatcctacaacttaagcctgaaaaaaaaaaaaacaatgcaaagatcattcatttgaccaatacacagtgaagtcataataaaacaaattcctagtatgtgaaatgaaatttcacgtataggattcatcactcataacaaaagtcttattacgctctgatatcagtagacattccctcacttttggtcaccttttctaataagatcacactggtcagctgacattttgaggcaccaaattaagcatctatttggtaagtgaatttggattctctttaaaccaataaagataaaaacaaccatatcagagtgataagcatattactttagcttcaataacttagaatgtaaatatatcacagagggatatttcagctactgaaataataaaatccagtcagtcaaatagtaaaaaatattgagaaccagcaacaggaagtattataaaaaaaagcactcaagggagacacatacaagaaaccccgtcagtctactcattcagtttcttatctgttctataggtttagcagtggaaatgtttgtgggttttttttttcttcgcatttatctttgtgcctgaatgagttcagtttcgcttagattaggacagaaatttcagaacagcaggttaatccatcctgtcttcatgggcagctgagcaaacagaccaatatcagtgtaaaattgtaattctggagattaatgttgtctttcctgtttgcgatgaatttgacctccttgcctttctttttttcctcccttcttttcagcgtctgtccagggtccctgggagagagccatctcgccaaacaaagtgccctactatatcaagtaagttggaagtatcacatttttaaaagagcatttattgtgactaacctgtatattcacaagtgagtttatttttaaaatgcgacattagcctggcctacaatacctgtgtcttttttttcctgaggaagcttggataaaaaacttattctaaaattaccattgtaaatttgctgatgcaatggggaacgacttttaagaaaagtttatttaatgcaggatatatggtgtgttttgtgacagagggggcggatttttcacaatagaaccaaaagctccagataattttattgatagtgggagtcaatctttgcgagaacaatttcttttatttaggggttttctcacatttcttcttccgtcaaagatagaagatttccgcagttatatgtacacaactgttttgggtgaatgaatactacatgtttccaaaaggcagaaagcagcagtcctcgactcgtagggcttagttgttcattcttgatacataacactcagtatttgtcacctaacaacagaaagatactgttttctggaaacatttgtgccagtcaaaagaatacgagtgcttggaagcaccttctgtagtattttgcatgaaatataaatgacaatacattgggtcaacgtggaagagagaggagagaggatattgagtgattacgataccttcacagtctctcatccattgtgcactagagtctaacttaaatttaactttgaattggaaacctcaacaacaattacaatttactgggttcataaaatagtcctcgataccaaccgaagtctttgaacttgcttctgccatgagtctgactaaaaatattagatgttttcccatttttttccgcctgccatcttttatcgaatctgtttttattctttcactgtccatcaattcttcttaattcggttctaaagcaataacagcagtcctagatcttcattactacagtcctcaagaaatttgattttatgcctctattttgttaactcagaaaaatgggagtgaaggtagtcttttgactctttcaggagaaatacatactttaggaaacggtttaccatttgtcttattacatttttccagatgaggtatctcttaacttgaaaattcttttttagtatgtttgattctgctttttagttttcatattttatgaatttaattttattattgttatatttaattcattagtcactcaaaactgtacattttaaatacctatttaaatcacatgctttattaaataatatattgctgtagacatgcactgtatattaccttacatccactgtatattttatggaacaattttcttcaaactctagacagtgatttcctacatcagtgtctttgtcctcacaaatttttatttccgactaagatgtttgagacctgctacttcttcaaccaattcataaagctctcacttttatccaattcctttatgagctgaaataaagactctttttctcctttcatagatgaggttttaggatcactggagaattcaagacacctttaagctattattctccaaatgactacttgtttggggctcactagaggtctcacatggattgctagggtctccccggtcccattgtcctttccctatatattcatcttctccctgatgttacttctactacaagagatcccagtacattgctgtgagggaatggaaatgaactccgtccaaaaaataataaagagacaaattccagaaaagctgtaattcccttctgtgtattagtctcttgctgtttctcagtggaattagagagcagctacatatcctatttgtccaatgctccttcatgtacctaaagaccatggtgatggtattgataagggcacagatctatgaataagaaaacttcaattttagtcctccagtctagtcttagaggctctgtcattaggcgactgtatggctttaggcaagtcacttaacctataaaaatcttggtttctttctttttttttttttttttttttttttttgagatggagtttcactctgttgcccaggctggagtgcagtggcccgatctcggctcactgcaacccctgcctcccgggttcaagcaattctttcgtcttagctcccgagtagctgagactacaggcacctgccaccatgcttggctaatttttgtatttttagtagagacgaggtttcaccatattggtcaggctcgtctcgaactcctgacctcaggtgatccacccgcctcggcctcccaaagtgctgggattacaggcttgagccaccatgcccagccaaaccttggtttctaatttataaaataaagagttggactagatgatatctaagatcctttttagctctaagacgtaatgagcatgactcattcagttgtcctgtccaaacttaaaaaccgaagatctcagcttttgttcgataatatctttatttttaaaattcattattttaatgaacataatgtaaattcttactttaaaaaacaggaattttatttttccactgtttaattagctttagatatgccctatcaacccactccaatttcaccacacacctctttaaagagctcaaatcttggtatataatttaggattattatgcttcctggctcatgataagagagagagaacaataggcaggaaaatttgccaaaaggtgagtatggagaccttaaaagcctctgaaataatcagttccttgaaatgaggaaattacgtaatttctcaaaaatatctctgaaaccttatggagagcaattctctctacaattataatctctttgaaattagggatggtataatttctcaaatatgagtgtaaaatgttaaactgtaatatagggaaaacatacatgtttataaaatgaacattgtcagtaagcagatgattaatggcacttgtgtcttattagccattactattatctaaaatgttctatggaaaccaaattaatttgatgtacaaggttcggtggactttatgcacagcttaatgccgttcataatctgagatgccgtcttggtctaaaaagaacaaaaatacgtttacagtgacagtgcttcaaccagtcctcatttttcctcttttttatcttgtttgtcttgacttccagtcaagagtttttaccacagatgcccagctgcaaaaccaggtgtcttctctggctatgtttttaatgctttgtaactttttcttttcaatgctgggataaagggatcgcccacataacaagaggtttctataccagtggcacagttcctgttggttgttgaattgtgcactcattcttgagattttaagtcattaacatcttttgctctagtttgcaaatcaggcagtgtttatgcctgcatcctgacatcagcttttcatatgaggctaagaaccttgattttgatacttcaaactacgtgtttgtctagtttatttgtccacagcatacatcattgttacagttttcatattccctctcccttggggctcccttattcctgccagcatctctttcaggttatttgattacagctttcattgccactgaaaaaataatcaccaacaatgttcaacctgttacaactgccttttctactctctgccattttgtagttttttggcctactgtcaaactcatgaaaatttcaatataatagcctttaaccagctgctgcattctgttaggatttctttcacctttttatgttgcatgctcccatatgggtaaaccaaacagagccaagagctgggactctcttgctttcttaatgagttagaaaattgttcttctgtattctggactgtcaaaagaatttaggaatcccaaacatgcatgcaggatgttccagtatagatgtcataataaaagcataagaaatatcacactgggtcagaccaacagggcaactagcccggaactctgtcccagatgaagataccaatggttgttttgtcaggtaacctagtacattttaccttaaaaattcggatacatcatgaccacttcttaataatgcattgtaaatcaactggcagtgagtttatccaatggtgtcaaacttttcctattccccacttcagctttgtcttaataataatatgttccataaatgtaccgacttctatataaatataggcattttaatttctcttgaatctgcatcctttaacctcaaggaatggccttaattaaattctttgaaattcagtaaaaacatttatatttatccagagtcgactttagcctcacattcccctactaatgcttttcattttcatcttcccagtctgagaaattctaatcctttttagtcttttagtctgtccttgacggaaagataagctttccccttgattatcttagttgtttttccctggatcttttccagctctgttatatcttctttgggatgtcgtgactagggtggcccaaatattggttatgaaatttgttagcattgtctctagtttccactcactcatgaagaaagtaaatgttatttgctgtctcccattggtgcagaaatggagagatcaattgaggtcataacctcttctgcatatattagttctagccgaaggttggttttctgctacttttctgtaataccagcaaaagtgtttgaccttatatttctgccagctgtcccttaggaaggatttgatttttagacaagctggtcctttcctccttcaaagacgctgtggttgctaaatattgggaagaattcactaatgaaactcaggagtaaacctgctgactccatcagcagtaatgcatttcatcaggttccctttcgaaatatctctgaagcccttcacagaagagtgaaagatggggttcttgggaacttgctaactgctcagctttttttacatgcaatgctcaagaagcaactcatgtccaaaggagtgtttatcttttcctgctggtaattttgaatgttgtatatacattgctgtatatgttgcctgatgaccttgatcgacccttctcttcactctcaatctcaggcatgtttccacaaccatttattgcatctgagttttgctcacaactttctgctgcttcctgcttagcaaaatgcgatataaaaccttattggatgaagttaacagttgcttcagtcaacatttcttgttactgttgctgtttgtgctgacaaaattgctgatttgggttctgactgtcctgtcttcttatggcctaccattcctatagctctatttgtacgagtatttgactctctgcctggaactgtggccatctgtctagatttaccttttggtatatgtggctctctgtatcctgttggtctacattctggtttgaactcacggatcttggtctggtttttagtaccagtgttcccctaactccagtagcatctgaatcttgacaccaccttcccctgccccctactgtattgcctctattactactttcatggcaattttttcggattccaaatatgtcccatgcttaaagcatatcttgctctcattcttgttctagcccctgttggtaccaggcattgctccaattcaagttttggttggttgatttcttccttcataatattgattgctatttcagtacctgtatttatatacagagggagcagtgcctaactacatcttagccttaacagcaatcaacgtgttaaatatccctgtgttggctggtttgcagtagacacgtcttctgacaatgagatgggctcttattataaagaaactggagtatgatatcaacatagaaaacatttcctcaggccgggtgcggtggctcacgcctgtaatcccagcactttgggaggctgaggcaggcagatcacgaggtcaggagatggagaccatcctggctaacatggtgaaaccccgtctctactaaaaatacaaaaaattagctgggcgtggtggcgggcgcctgtagtcccagctacttgggaggctgaggcaggagaatggcgtaaacccgggaagcggagcatgcagtggacgagatcgcgccactgcactccagcctgggtgacagagcaagactctgcctcaaaaaaaaaaaaaaaaaaaaatttcctcatttcttattccagacacctcactcttctaagaatgatacaagtcttctgacattgggtttgaaaatcagttgaattttgtcataatctttcatacaatgtgaacacatcatgtagtatataattttgtgctatttctggtaagatccttcttatgtatatttttcttcaaaatataccttttagcagctaagacaacattaaataggggaaattttaaataggctaggcatcgcaagacttgaattctagttccagctttactgtcacctagctattaatacttgaccaatgggaaattgcttattttctgtgggcctcagtttctccctctgtcatttaaggaagcagaatgacatgatatcataggtcatttccagtactaacattttctgattttgtgaatgttgacttcgaaatagaaattgtttgtgatcattttccagagaagtgaaaatgaatcttcatattgcccttgaggattcttattgcaccatcaatcttatcgggatagaaaggacaaataatattaaatgtttcacttaactatttagcactattgatgataagaagtggatgcaacagagaatcagctgtctaatttgatctgtcagtctttgaggatgctggtgaatgattcggggtaattaaatttttgaaatcactgccaaaagcctgatgctctgacttttcaaaaggctttagtacacaaagataacccagaggtcaatcttctctgctgtgttttctcctctgccatttgatggtttcaaaggtcacgttacctgagtctcagtaagctctggaaccacaatgaaggaatagttggtaatacattattgatgatataatcatgaaaacaattcaggttaagatattaactgaaagagagtgaaaggggtgccatagtgttgtgcagagtgctgagtctggttttggttttatagatcttgttgggagatgtagatgttgatatcatctgtgtctcataggttcatgaaaaaaaccctcacatccttttttgtagtttcataagctgatttgtatcaccttgactgaaataacagactccaggaggatagctgttgttatctctttttctagcatagtgcctcacagataacaggtacttggtaaatattggaatgaattcatgaacatatgtcagtaattctatgtgcttttcagtttgctgactcatttcaccttcaaaacaatcttgtagtatttgtgtgtcaatttagatttaccactcaaatccatctctcatgccctctagacatgaactttagtgttaggaagcatgccgagtgtttgatagagtttctcatagctcctacagtttggtgcttaagggacagtccttggcatggatgtatgaatggtacataccaaaacatgagttctagattccgttctatcttaatctaacaatatgataaggagtataacttagctcaacctcaatgagaaggttgaactagataatgcctgggaccactctcagctctagctttgtttcagtagaactagagtctgtttttcctaaatatcattcatgaggcttcttctggttttctagtggtcaatagagctttaaattgatcaactactgtttttcactgagcattgtggacaggacctactttttgggccaggatatagtagccactgagtcttaacagaatgtcatcaatgatacatttttattttacagaaaaatgttgtaacattctatatggcatatgtcatgtggaaaggtggcaacatatatacatacacctatacatgtggcagctaaaatttaatgtgtgtatggggaaaataatcctgtattataatacacatggtatagcattccctgcctcattcgtggcacttttggaaatgtgagaatgagcatagaacatattcaagttggtttatccaaaagaagaggagtaaattatttcagctatttccccattttctttttctaactttcttaaacatgcactttcttacataatcacgtgttagaaaaaaaccagtagtcacatcaaataaatctgcatttgaaacaactgtatcatatcccaactctgttcgtttgagccatttgcttaacgtgacacccattctactttatgacacataaggaatattgcttaagaaatgttaattggctttccttttctcctctgaaactggattgaagtcttattgacctctattagatactgagtgttcaggtttttaggaaaacactcatagagatatagccccagtgtgagctgcatttttagaatattttctagaacccaaatatgtccctaatcaaagttagtttattttcattcttagcgttcccacgtaatttggggtatgtgtgaattcccaaacattcccgggcctctcctaggcttctctaattgcttcttattctgttcccctgggaagcagcatcctgttcccttcacaaaggtcagcagcaacagcccaggcaatgttttaaaataacttaataaccctgaactgcctctctcttctttgggataatttccttagagcattagtcctttgaacactgacctggttgcagaaaatgcccctttctcagtgggaaaactccaaatcccattcagtcttcccctccttccttccaggggatagggtgggggagtagggggtagggagagggtattaaatactttcttcaggaaaaatgttaacacggtaaaacactctctctctctctctctctctctctctctctctctctgtgtatgtattcttttttaaagaaatagactgtgagtgcattgtataaatcagtgctgtcacgttgcaaattttttaaaccgttgtacaagatagaaaaacagtatctctggatattgactctggaaagcttctaagagcaggtcctagatgagacttagctcactgtcggcattcggcaaatgatcacgttttctgtgataccattaactcctggggggatgaaactgaaaagcctcgctgctcttcctgaaactctcaactgcttttttctgtttttctttctcagcttatccacatccatcttggtccccaaagccattgcatgtcagatggtcagtgcaatgtgtaatttttaacttgcttctttgttgctttagaaggaatcgttttgttgttttctttccttttggtcactatttcttgttcatgagttttctgtaaacagtgtgtctcatagataagtccatgtaatctgctagacaggaagaaaagcaaagtttaatgtgtgcctactatgtgctaaatgacaaagtgtttcatctgtatcttcccatttaatccttgtaacactccacttattatccaataaagaaaaaaacggctatcagtcgggcgtggtggctcatgcctgtaatcccagcactttggcaggccaaggtgggtggatcacttgagctcagcagttcaagaccagcctgggcaacatggcgaaaccccatctctaccaaagatacaaaacagtagctgaatgtagtggcatgcacctgtggtcccagctactcaggaggctggggcaggggaatcccttgaaccagggaggcggaggttgcagtgagccgagatcacaccactgcactccagcctgggtgacagagtgagaccccatctcaaaataaataaataaataaaagttaaaaaaaaaaaaaaggaagaaacagctgagattcaaaaaagttggaggcttatccaagtcattctaataaaggggaggggggagaattgatacttaaaatcatcatgataagaaggatagacattggagattcagaagggcagaatgctgggtgaggggtggataatgagacattacttaatgggtacaaggtgcactactttggtgatggatacactaaaagcccaggttcaccactatgcaatacatccctgtaacaaaactgcacttgtacctcagaaatttatacgaataaaaataaataaatcaaataaaataatcatcatcatctcagctattgcttctagctgtttcaactttctaatgtttttgattgaaaactggccatttgtataaccaaatgtggccaatccaccactgtgaggctgccatcttgggcatcaccaaaactactctagtagtccttccctgcactgttaggtggattttccttggcgtatcttcgcaatcaagttgcagagacctaagttactctttgctgctttgggcaataaaggggaacaaaaaacaaaatgaaacaaaaacttggccagccctgatgtaagcactcttctacctccctgcaggctgagaaaacaaagtatttcttttttttttttttaatttttaaaatgtttgattctggtctaaatcaattaaaatgagatctccccccttcttttttctttttttcttctaaaaaaaaaaaacacaccaaaaaaccgagatacatgtgcagaacgtgcaggtttgttacataggtatatgtatgccatggtggtctgctgcacctaatgacccatcgtctaagttccctcccttcaacccccaaaccccaacaggccctggtgtgcattgtttccctctctgtgtccatgtgttcttaatgttcaactctcacttgtgagtgagaacatgcagcgtttggttttctgttcctgtgttagtttgctgaggatgatggcttccagtttcatgtccctgcaaaggacgtgatctcattcctttttatggctgcgtagtattccatggtttatatgtaccacattttctttatccagtctatcattgatgggcatttgggttggttccatgtctttgctattgtaaatagtgctgcaataaacatacatatgcatgtgtctttatagtagaatgatttatattcctttgggtgtatacccagtaatgggatggctgggccaaatggtatttctggttctagatccttgaggaattgccatactgttttccacaatggttgaactaatttacattcccatcaacagttcaaaagcgttcccatttctccacagcctagccagcatctgttgtttcctgactttttaataatcaccattctgactggtgtgagatggtatctcattgtggttttcatttgcatttctctgatgatcagtgatgttgagctttttttcatatgtttgttggccatgtaaatgtcttcttttgagaagtgtctgttcatatcctttgcccactttttgatagggttgtttgtctttttcttgtgaatatgtttaagttccttgtaaattctggatattagacctttgtcagatgggtagattgaaaaaatgttttcccattctgtaggttgcctattcactttgatgatagtttcttttgctgtgcagaagctctttagtttaattagattccatttctcaattttgtcttttgttgcagttgcttttggcgtttttgtcatgaagtctttgcccatgcctatgtcttaaatggtattgcctaggtttccttctagggtttttaggatttggggttttacatttaagtctttaatccatcttgagttaatttttgtgtaagctgtaagggaggggtccagtttctgttttctgcatatggctagagagttttcccagcaccgtttactgaataggagatcctttccccattgcttgtttttgtcaggtttatcaaagatcagatgtttgtagatgtgtggtattatttctgaggtctttcatggataggaagaatcaatatcgtgaaaatggttatactgcccaaagtaatttatagattcaatgctattcccatcaaactaccatgaccttcttcacagaattaaaaaaaaaactgttttaaatttcatgtggaatcaaagaagaccccgtatagccaagacaattctaagcaaaaagaacaaagctagaggcatcacaccacctgaattcaaactatactacaaggctacagtaaccaaaacagcatggtactggtaccaaaacagacatatagaccaatggagcagaaaagcaaaggatttctaagtcatattccaccacctccatcagggcttccctaagatagagagtatggccaagaccatacttaataaatgtcatggaatgtgtttctcttcataccctcaattgtaagtctttctgaaaggtagcgcgtggtcaatttagatggacaagaagtgctctgcaggagcctttgcaacatttgtgcatgtccttgattttgacaccaccccccgccccccattccagaacagatcgtctcatccttcccttaagccagaggcctatggttctagctttactaggcaaatatatatggtctgtggctataagtcacaatttctcccaagccttgagctgggggaatactgagtctgcccatgtattacatgcagaacatttcatcttattgcagaatgatactttattcttattgcagaatgatattcattattgcagagtgatattctttagtctttattttttatcattataactacatggtgcaaaagaagtatttctcatactttttctcataatgactcaaaattacaaaagcaatctgggcaattaatatgtttttgaagataaataatggcttatgttttctgaagattaagaaaaatctctgtctgaatatagctgggcacagtgtctcaagcgtgtaatcccagcactttggggggtcaaagcagaaggaacacttaagcccaggagttcgaagccagcctgagcaacaaaatgatacctggtctctacaaaaaaaaaaaaaaaaaaatccttggcatggtggcatgtgcttgtggtcccaggcacacaggatgctgaggcaggaggattgcttgagcccagggggccgaaagttgaggctatagtgaaccgtgtttgtgccactgcactccagcttgggcaacacagcaagactctgtctctaggaataaaaaaaaaagaagaaagaaaagaaaaatctctatccgaaaaatgtaggcaccctgtgttaatatgtaaatacaagtgctttatcaaataaaggctagattaattgttttttctcgctcttacttatatcaatactacaagaacttttctgccaaaaaaaaaaatcaaataatagaaaagaatgaatcctagatagagcaggaggggctgagcaggcacagcaaaagttcaaggtggaaatatctttatgcatccaattaaaagtaatttgtgtacattttactcatatatctatatgtacacatacatacatacacagacacacacacatatatatatatatatatatggagagagagagagagagagagagagagaggacaacgaagaggaaactaaagagaataaagggtattaacagcaggtctgtgacttattccctgggggatgtgaagggaataaatgaccttaatagaccacttcataaacatgttaatgacctcccagaccttcttgtttatcttgttaatagtggttaactagaggaaagatacctgcaaatccctatctataaaatgattttagtagggtatacctggcctggctagatagcttattgtaaataaacctggaatgtttggatttatgagtcgtggctggctggagaatagggcatagctacatgaacgtttttctatttttgtaattgacagattataaaatggaaaacttttgagactgaaatgatttcctttcaatgtttctgtgtaaatttttaaaaacgtatctgttaatatgaaaccaaagcacatcataatgggaaataacatggatgttttggaaacgcatgtgtgattatttcaggttccccagggaaataatgttctatctgtgcccagcacttccctataattctttcagtcattaataaagattggtactagataagaatctgagatttgtgtgagtctgatgtgagatccaaatgttatacttacacaatttgtgtttattttagtttaaaaattatctttgccatgagcaagaggggaaaaaaaggaggatgagcgggcctacatatttttccttaacatcttgtcccaagttttaggaaatcacaagtctaagaaaaggccagggtcaggactaggaagtgatataacagttatacatgtctacctttaaaattatataagtaataattaatttttaaccttattttaagcagatcctagaaatagcaagagcctctataacgtcccagctaagaccccaagttttctttcttgtttaactcttgaaatattttgttaattttcagatcccttgtctcctcagttcagctgtaaactctctgacaacgcttgtgccttatgcatctttgcatcatccctagcatgtattatatatctcacatgtaaaaataataataaatacttgatcatttgttttgattttgatgattaagcactggaagctgagctatgatcccaataggtatgcttatttaaagaaaaatagatggcagtccaggcgtggtggctcacacctgtaatcctagcactttgggaggctgaggtgggcaaatcacctgaggtcaggagttcaagaccagcctgtccaagatggtgaaccccgtctctactaaaaatacaaaaattagtctggtgtggtggcagatgcctgtaatccccactactcaggaggctgaggcaggagaatcacttgaaccctggaggcagaggttgcagtgagccgagatcgcaccattgcacttcagccagggcgacagagttgagactccatctccaaagaaaaaaaaaatcacacacaaaaaaatagatggcacggcacagcagcttatgcctgcagtcccaacactttgggaagccgaagcaggaagatcacttgagtccaggagtttgagaccaggctgagcaatatagcaagactccatctagaaataaataaataaataaataatttttaaaaaatagacaataacagataaagaagttccatgttatttttttaaattctagatagccccactggtgttacagtttattaaattacatttggaagcgattttttagcagtccatttattttgtatatttcagtttgttgagagcagatggggttgagtgttgatggggttgattgcctggctagattatgctataaactataaatctttgaaagttactgttttgaagaaagcatctttaagtgaatatattccttcagtagctcctattaccaaaactgttgtgagaatatcttaggaaaacaccttaaaatcctcttctatcaaaactcccaagctttcttcaggagccagcattgttcagtgaatgcatgtaagcctatgtcttaatagagggatccctaacctctggaccatggactggaacagcaggaggtgagtggtgagcaagtgaacattactgcctgagctctgcctcctgtcagatcagtcgtggcattagattatcgtaggtgcacaagccctattgtgaactatgtatgcgagggatctaggttgtgacctctttatgagaaactaatgcctgatgatctgaggtggaacggtttcatctcgaaaccatacccccgcccctgcctcccagtctgtggaaaaattgtcttccagaaaactcatgcctggtgccaaaaaggctggggaccactgtcttaatagatcttgaaaaaagttggagtaaggtaagtggtaaatcctaagacatacattgaggcagagctgcagtggtatccagtagggaagaaaagacttcaagtttagaattcagttatactcaaccagtttttgcctttctctgttaaatattagatatcattaccagacacatacaaaagattttaattgcatgaatgcccgatgttgatacaagagagccgatttttttttcacacatagttttttggggtttttttggtagggagaaacatcatctcatgatatcgttttaaaggtgctttattatcaaggaccttagagctttttctctcactcatatttcatatactcttagtcctcaagccatttctttttactgaaagcactatagagtagcaaaaggcatcattatattgctcagcctcattcatcatcaacaaaattgccaattatattccaagtccttgaatgtattgtttaaaaagatgtataaggtgaaaggaagcagttcaatgttgaggtggaagatgaaacatactgactggtagattcagagcatactaatcttgttttcacttgtgaactggaaaaaattaacatggagggatggagaaaacatgttcaaactacaaagtcattttttctgagaagttatctgactgtaactgtaactgtaactataactcagggtatatcagagggctcaaatgtggaacacttctttaaaattaaaacctaaaagtcctgatgtgtaatagaacgtgtaaaaatagcagcctctgaaggatctgagatgagcagaggaacactgaataatataatctgacagtatgggccatacccttacagtagttgccgtggcctggaaactatagaattaattcagtaaaacatcagaaaaaaagcaacataaatataaaatattttaaattaaaaagactgaataagaacagaaaaaaatcccctagcaaatcaatattgcttggggaagcatgaatcccagaccagcaatattttaatccaaataacttttagttccatcgtgaacacctttatcaccaagttttataaagagtggagtgaagaaaaaaagtacttgaggttgttggaaacacttctcaaagttggtggctttattcagagattcatgcttgactgtaccaacttctgtttaatttatacgtagtactttgtcaatttaggaatttggtttacttgtcctttcctaaatatgtgtattacaaaacaaaaaatagagaaatgataaaataattacaaagatgattaagcaatagtgttggctatagtgaacagattattgccattttatagagtaataatatacctaaggaaatctgtgggaaatttaatttgggatataaaacacagaagtcaggcggagatgaaataataaaccaataggaaattaaatttaggcatgagagtccaaagatgtaaattctatagatgttataaaataatatgtatgcccttacataatttcattactctctgaacttcatttctcagtgaaatatggggaaatgatactgaacagtgcagcagctcttccgcttatgaaccaaccagaagatatataaacaactcttaagggttatacattataaagatataatttagtctggatttttttttaaatttgaaaactaattttatataaaccctaattgggcaattctccattctttgacttgaatattatagtaaatatgttttcccaatttccaagtttcatgtattattttcaaagaaaaaagacaaacttttaaatgtccagctacctgggacttcctctgattatcttttaaggtagttcaaatatatacaatttcaaacaacaacaacaacagcaaaaaatattttgccagacaatatgtcttgtttgtttttaatgttcacaatgtaaagtacacttattgccaaacctcactttcaatggtgttacaaattagccaagtataactagtttgtaaatactaataagaaggttgctgaaattcagccctgaatatttcttttctgcaactccaaagaggaaaatttttgaaatgcaaaccttgacctttatcaaagcctaggtgaagtttgttggaggtgtttggttttttgctggtgctttgttataatgcagtttgaaagtagactagattggcaagacataattggctgctgtgtggagaatgcatttggtggaacacgtgagttaggggtgaggaaatatgaagagccagagtggaagcagggagaccagatagtagtgtgggaagcactggtgttagataagatctagataaaggtagcagtggagatcacaagaggtggttggaatcagggaatatggtttagaaacaatcacaggtcttgctgatgcattggaggtcaggagggacagaaagagggcaatccaggtgtctcctcggctttcagcaggaacaggtacttaaagaggaacaaatttggtagggaaaatcaagttttagtgttccattgcagtacatggtaaccatggctaataataatgtctcatatatttcaaaattgctaaaagaatagatttttaatgttctcaccgcaaaaaataaatgatatgttggtgaggtaatggatacgttaattagcttgatcaactctttctacaatatataccaagatcaaaacatcacatcgtatcccataaatatacaaactattatttgtcaattacaaataaatgaaataaataattttttaaagagatgtcttaaagggtggcttgaagagcttctgtgctccaataatacctgcccattagccatactttgcttccagcaacaacaggaaaacatttaatctaaacaaaaaaaaattgcttgtcaactagatagctactcttccgtgtagaaaccctagagctgcctgggtttagacatgtttaagtttgaggtacttattgggtatctagctgtgcagttcaaaatttggatctgaagctaggggaagacgtcaggacaagagctttaacttttgtaatcatcaatatatacatccttcttagagtcatggggtgggatgccatcatattgggatgagggaggaaaccctgggacttcacaatatcgagctagtttctgttttgcaaaaggcaaatgtattaatgaattcattacattaattaagcaaactatatttattgggggctattgtaccagctattgtaaattttatattttatattatatatatatatatataaaatgctcacaaaataaaggaactaagtcataaatatgcatatgatttacataaaggagctaaaataaggatctctgtttctgtttcaattctttattaaagatctatctaagactataaagacatatataacaaggtacaggaggtaaagagtatattcttaggcatctaaaaatttttcctatgcttttgaaatctgtgtgatttactttcttgaattggcctgtaatataggagtacaatatcattgcagagattaattagtgtgtttgtgaactgttctcaaatgctaaaatgaaagcataaaactataaaatggcatcattattccttaaagaagcatagtttccaagggtgtctctgatcattgtcacagcataaatgaccaatttcacccataattagccaagttagtaagaagttattttttactgggtatattttgtttaacctcagttatatttgtaaaagtagaaactgctacttgttactgctttcagaatttctcacaaatgctaaaatgctttttaattctaatgcacttaaatggtttgattctccttacctaagaaaaacatttatctaaagatatactcttgactgattcattcattgattcatttgtcaatagatgtttatttatcagaatatgtgcaccagatacattgctagatgtaaagggtacatttggtgagcaacatgcatgatacctccaaagtatagccagggaatagataatggaaatgacactaagaatgaatacatattaacacaaaaagagagagagagtcatgtgtcaaggcaatttagcaggagggaacttgtcaatacaagggattaaaaggacagcatgactagggctggaggaggtgaggagaaaactcaaaaagtcctctggctgatgcaaatgaattggatgaggagcctatgaatacaaacgtttgaaggttactgatgaaagccaggtgagagaagatgggatttggaccaagatgatgatagtttggatatggtgagaaaggcatagatttgagagatttttaggaggtaaaaatccttaagatttgaggatagatatcataggaggaagggcgcaaagagaaagcaaaacatgtcaaggaatcacacctagatttctgggcaatgcacagttggtaattctttacagtgagttagggaactctaaagaaagatcagatttagggtggcaatttgattgtaaatgtttggatttcaaatgattggtgacatccaaaaagcactgtaaatagacagatagtgtgcacctaaagaaagaaggaggcgcatctgggttggagtcactaatttacatattacttgtatatagctagtaactgaaaccatgagtgtgaatgagattctgatgctaaattctggaaggtcactttttaaagtgttttgctttttgaagtacaggtgcaatactaaaaataaaaaagactaatttttaaaaattaaattaaaatgaaaagcctggaaagataaacaccaaagttatgatactagttgtagtatgggagagggggcatcagagaggatcggaatttcatcttgaatggtgtattttatttcaaaagaagctttgagcaaagataaaatgttaattctgagcattagaaggaacacatttgtttttttgtactgtggatctttttgtatttcctagaactcttaatctaaatcaaatattgcaaaatatatcactgtaaacaactggttggtcactagctttttaaatactttgtagcaacttggttgcttgtcagaggtcttctttgagtgaagtctttaatttatagttctttatgcttgatcagcataattgcaccaaactgttacttaatctgaaaaatagctgtttcctagagccctacttaatactgaaaacctactgtgtttgtattgcaattgcatttttttttttacttttccccctgcttttcagtttgtataatttctgttaccctatattcaagttcactggttctttccttgtctttgttgaatctacagatgagcccatctaaggtatttttcttttctgttactgcttttaatttctagcatttccatttgattcacttatagtttccagctctatactgaaatatactgaaatatagagctggaaactataagagtgaatcaaatctaatcttgcatattgtcttctaatcttacatattttctatctaatcttgcatattgtctttcttttccctcaagagtctttaaaatattaattatggttattttaaatttcctgtctgatagttccaacaactgttacatatctaagtctggttctgattcttgctttgtctccttagactgtgatttttcttgcttaggcatgctttgtatctcaggggtaaaagtcaggcatcttagatagcgtaatagatactgaggtaaataaacctttgacatggtaatttatcttaatctgactgggaattgggctgtgtttgatgttggtagttgctttggttgtcattgttgagttttgttgctgctgtggccaccagagacttcaaattcctctggtaactttgtttcctcattggaagcttgttagtgtagtggttgagtgtcgggcagaggcattctctaatgtttgaattaatacacagttggcctgggtcttggggatgtggtctttacaattatttctttcccttcctccagaggtagagtaacttcaacctcccattcccttcctggagctgcagtggatatccaccagtgttctcagtctatggccccaaggccctttctcctgcataaggctgaaaaacaacaacaacaacaaacaaacaaaaaaaaacaaacaaaaaaagaacaaaacaaaaccacacatagatgagatctggtgttcccttcccctaaaatgcagtggtatttcctcagtgcctgatatggtttggttctgtgtctccacccaaatgtcatgtcaaattgtaatccccacatgttggaggaggggcctgatgggaggtgaatgaatcatgggggcagatttctccgttgctgtacttgtgatagtgagtgagttctcaagagatctagttatttgagagtatgtaggactttccccttcactgtgtctatcctgctgctgtgtgaagatgtgcttgcttcccctttgccttctgccatgattttaagcttcctgagggctccccagccatgcctcctatacagcctgcagaactgtgagtcaattaaacctctttgctttataaactacccagtcacgggtagttctttatagcaatgtgatgtcttttcctctgaagagaagggtataagcagattcatggtgactagctactgtgacccttccccaatcagcaacacagagggtgttggggaggctttctccagattcttcgcatcctccttgtgaaggcaaggtacagttcctgaaggaagaagcttgcaaaaggttgggactccacctatggcagtagcccccaggatcttcacactctcaggctagctcccacatgtcccccaacaatttaatctccctactagtttatatggcatctgctccagggatccaaatgctcaggcactgcttctggctaaaggccaatctctctccagatttcaggttgttctataatgtcatttctctgatggactgatgaaaagtcattaatttatctgtccagcagttttcttgctacaagtatgggagcaacctctttgcagctctccatctccatctccaagttgaaactggaagtctgagcaatacattttagaaattaatatttgtaagttttccgtgtcataacaaaaataataaatgttcactgtggaaaacatagaaaaagattaaaaatatttaagtgcccatcaccacctagacaactgcaatgaacatgttggtaatgtcttcttccagttttttaaaatctgctgataaaatacaaaagatattgtttatataactttgtatcctaccttttcttgagcaatgcaagtttaaacctaaatacgaagatactctaacttcctactttacatttttgacggcagatgtcagctgtcttcccaagtgcagtacccttggcttaatatcaggtagacaaataaggccaccacaaattcacctttcacctcaataacacaggtaatttgatagttctacagaccctataatattacttgactgaagacccagaatacaagtctttcaaggattactctagaaactatataaagtattggtatcatctcccttcatcatatcttgccaaatccaacaggtttggaacttctgtaggaagatttttgtaacatgaaaaatgcgtgttgcaccttccatatccagcaaatacaccatcggttttttgttggctgcaccaatgacataaaatgatttcactgaatagggggtgacccagaatggaaatgtagagcatcgaaaataaaatcaaccgacgcagtctttgcagcaaaccatgtggaaacaaatttaaatatggaacatactctttccaactcatcttcagatgttgctttaaaatttgtgcaggtgaaaaaaaaatctttattttaaggtaactcaatcttttaccattggagagaatagaattatttttgtttcctcttgtatattcccagttgtttaaatgttctctgtttccttgtgtggacacataaatccaaatatatctaatatcaaggtatttaccatatgcagcactttttcctcagatagttattttttgaaatattcaaatagcttacctgtatcatcccccccatccttttttttttttttttttttttttaagacggagtcttcctctgtcaccaggctggagtgcagtggtgcgatctcggctcactgcaacctccacctcccaggttcaagcgattctcctgcctcagcctcccaagtagctgggactacagttgcatgccaccatacccagctaatttttgtatttttagtagagacagggtttcaccaatttggccaggatggtcttgatctcttgacctcatgatccacccacctcagcgtcccaaagtgctgggattacaggcgtgagccatcacacccagcctaccctattttctaaacgaacaattagttgacttttcttcagttcttactcagaaatatctgaccctaggttccaacttttgttttgctctttgcagttagtttttatgtgtactgttagggagatgtgctttttttttaccttcaaatttaaaagagagagttttcaattccttttaagtcaaaatacaactgttctactctaaagctttctttaaaaaaagaaaagtaccaaatcctcatccgtagtaattaattttgacagtgtaggctcagtagtgattcacaaacctgtattttgtgcatcagcattccttattattctaattaaagtggaacattgtgccctcgctaatcattaatgggttttcattttgtaaatgacatttgcagaagttaaaacagcgagttcatgtgaagtccacaggcaacggtgttgaaattagcatcaccatagcaacagtcttccatcattagcattcagggcaacaggaggtgttttgttgtgttttgtttcccaaaaaaagaaaaagaaaaaaacttcaaaggtaaagcctacagaaactctctcagaagatatttatgttccttgtgtgtatgtgtactgtactagacctctaagtctacatagaattttttttaaaaattgcaatgtggatcatctcctttccagatttgtgttttgcctagtatactagctaaatttcatgatctttctccagctgtacacgtctgacctgctgagcagcatttactcattgccaacctgctgctcaccaatagggtttcctacgtggatgaagagagtctgtattcatgaaaatatttggttcaatctaaaagtattatgtgtattcatgagtttttaatttaattcatggaaaatagatttatgctgttagatcctctggtgaactcatttagtcatgttgtagatataggtcaatgattattctcattcatgtttagacggaattaaagaggagtcaaatagagaacaatattatcttaactgagtctctggcagtggtattaccactattactctgtatgtgtgtgtgtgtatgtgtgtgtgtgtgtgtgtgtatgtgtgtgtgtgtgtgtgtttgaattctaatattctgggaaactttaaaagtggcatatctagcacttatgtttttctcagtactaaaatgcataaaagagcaccatattgacctaccagctgcttctaaatcacaccagtagtaggtaattatgaaattcaaatgaagtttaattttcatttattatacaaaaatgtcatagctcaaacccagaagtgttacccccaagcttggatatagacaggtatgtgtgtacattttacttttcaagatgaatcatagcagtcttctccattacatgtaaggactagaagttgtacattccactcaggtacctaaaggcaagcctgtgctagcccacactaacaaagcaaaatgaagcaaaggatctatctggctttcaatcagggatgcatctatgctatcatcagctctgtcacataataaatgagtctatagataacttgaactactcagccaatgggctgtaacccagtgattctgtggtattgaaaggcagcaacccccagaagccacatgtctcagtgtgcactccaggactgtaggcccatagaacttgtatgtatgcacacatgcatatgcattccccacttttctaatggcgatccaatctaggcctaatccacagctagtccagaaaagaacttttttaggttttctgtctgccatcactttgttgagaggcagtacaagccaagcaggtgtctgtatttataatatgcacaatgttaggataactcaaactcataagggaaagattaatggctgactactatgaaaaccgcttctagccttgtgataccagcacctactatcttcctttttctcttatatgatgaaaagatttcaatgttggcttttcattctgatagaatgtgcaagccaaaatctaaataaagtccagtggcaatgatccccttaaacattatatctttcttctcgatatgctgatgttttcccttataaaaatctatgtaagtttcaagatttatatgacagacaaaccacacaaacaggaggtccctcacattcactactagtcacttgctctatcactctgggaatagcggtcttcagattgcatctctactctacctcttgctcttttcaacccctctcctcttttttagaccatacagggcatcagacaaggtttagtttaccactaaactttgggatttggaagatggtgtataaactgatacaggtagtccactcacagatgtagtatataattacagacttgagttttcaggggctcttctccagtttcctgtcaatcaatttccctggctgagacattagcatttgtcagtgaccatgcttactatatacatacacaattgtgtatacacaattgtaaaattaaatacgggctttagaagagattattttttcttaagagtaggttactctataaatgccaaagcatgtgttatgacatagaaattcaaatgactaagaatagctaattgtttagaaacatcttacttgatgtctattgttccaaaatttgatccaatttagagtggtaccaatccatggtgtagaatataaaagctaaaggataacaaaaatcctaggaatctcatgccagtaagaaagttctaccagtcagatgagatgttgagagcatttatgacttggcatcaggaatattataagtaaaattcatgtgagcagtaattgcagctatgaaccatgttatttgttcccacttgtccaactgtaattctttcacttagctcagagtagttctttgtaacattagggcccactcatctgcctttaggtagggttttaaaagatgcctagaaaatagttctgtgctagaaatcagagactcttgacctactgtaaagggagcagtaagcacgtttcctcaggagaatctttctacatactgcagattcccataaaaatctttgtgacaaaattgcctttactgaaaccatcatccattggattaaaaaatagcttaccattagctttttgaaaatagaaaacgttgagccttttcaatgatactttcaatagtttttcacaactatgagtcctcaagctatcagtcttatttttagataccatacttataagatagttatagaatttatagagtatggtttaaaagactattcaattatagagcaatcattcagtttattcccatggcagaagtaaatggaaaccactccagatcaacaagaatctactctcttctgattcagaaaagagatttcctatcttttcatgaataatccatgttcaatgtttaacacctcaggaagattttcttaatagcttcttctggtcataaatccttggtctgtcatcagggacatattgaagagttagttaccaaagttcttaatgtctcccattgtaaaaaaaaaaaaaaaaaaaagtcactttttggattgtttctttcatagagtccatgcttctgtacgcttaatactttagcttttgacttcaagctttaggtaatgcaaatgaagctattacatcaccaaagttaaatttttcttgtaagtatattctcaacattcacaattgagagctgcctcttctttggctggtataaggttttaatttattgtagcactttcaccctagaatggcaaaaaatgttgaaatcaattccatatatcaccaatacaaagtactaagtcaaggccgggtgtggtggctacgcctgtaatgcaagcactttgggaggccaaggcgggcagatcacttgatgtcaggagttcgagaccagcctgaccaacatggtgaaaccccatctctactaaaaatacaaacattagccaggcgttcatagcgagcgcttgtaatcccagctacttgggaggctgaggcaggagaatcgcttggacttgggaggtggaggttgcagtgagccaagatcatgccattgcactctagcctgggtgacagagcgagtctcaacaaacaaacaaacaaaaatattgaattgtacaccttaaatgggcgaatcgtatggtatgtatactaaatgtcaataaagctgttatatgaaaaaaaaatgctaacacacacattctgaaagtatattaaaagcaaacctacggccgggcgcggtggctcacacctgtaatcccagcactttgtgaggccgaggtgggcggatcacaaggtcgggagatcgagatcatcctggctaacacggtgaaacccagtctctactaaaaatacaaaaaattagccaggtgtggtggtggacgcctgtagtcccagatactcgggaggctgaggcaggagaatggcgtgaacccggggctggagcttgcagtgagccgagatcgcgctactgcactacagcctgggcaacagagtgagactccatctcaaaagaaaaaataaaaataaaaaagcaaacctacaatgtctcttacaaacacaggcaactattcaattccgagtttacactactgaaacacacatgaatatgacactaagagaatcacgtggatctgcactcttcaatcaacactacgtctctgagcacaagaattttacatctgatttccatttggggaaatagattcagaatgccataaaccagatacttcttgccttcctttagtggtcatttctgccattatcatttaagggaatggatctccttctcccaaaactgttaccctaagattacaagcttgtcctttaacttatctctgaaagcacacctctataacgggtcatcagtattcagtcagctaattagactgcagaagtacgtttactcaaatgtgaggagataaaattgtgaaatgtaagaggaagaaagaatgtcaaagataatccaacccaaactcttcatcttacagataggaaaatggaagtccaaaaggggaaagtaattttagtaacatggctaaactggtctagaaaaccagatcttctgatacctgatcccatggtctttctaatgccatggatgttcgggtagaggatatattcaggtagataacttatagatagccccatgtgtttgtatagcactttatcgaacactttcacctctattatcacacttgattcttacaatatcccatggaatgtttgagtatcatatatgattattcttattcccacagacttggaaactgaggctttgagatgtctggatctatcttagatcatttgctatggactagaatctgggactaagttgcttttgtctaagctgtgtgtttgttctgttgtgccgtattgttaattcatttctgttggtaaacaacacaaaggaaaaacttctataattatgtttctttttcatcctcaggtcatctatcctactttttatctaagctttggaaaatattatgtgctttccttttttttgtattttcttttcgtagagatggcagcagggggtagtctcaccatgttgcccaggctgacctcgaactccttggctcaagcgatcctcctgccttggcatcccaaagtgctgggattacaggcgtgagccaccacacctggcctattatgtcctttctttagcttgctcgtttaaccatttgtttggcagggggagtcagaactgtgttttacttagtcgattaactgataggacaatttaatatctaccctgcactggcagtaacccccatagccccgctctgtgtctcattctgtgccctgaacaaccttgtcttaaaaacattttaaaagcagcaagtatggggagatttcttatctccatataatacagaagcaagtgtagagtatggctacggaaaacaaccagcaggtgaggctgtgacataacaattttaacccaagcctcactgccacattgaggtatccttgttcaataaatagatcagaaaatatggtgtagtttttccctaacgctgtctaaacagcaacaacaaaaaatcattacccatagtatttcagtaatgtgttgtattgaatgcattgttttcgagggcgttttcaaaaaataagttgattgaatctcttttttttgcttgaagaatgacccacattcagaaagtatacagatgaaacatgttcagctcaatgcaattatcacaaaatgaatacacctatgttcgccatctaggacagtaaataaaacattatcagtagccctaaaccagattacacacacacacacacacacacacacacacacacacacacactaaaccagactacacacacacacacacacacacacacacaccgggttgggggagtggtgagagagagagagagaaagcgaatattatgttaacagttggggagtctaagtgaatggtttatgggtgttcttttaacatttcaattggtttaaaattttcaaaatgaaaagcttgaggagaaacatagaatataaccactacctcagaaatcaccaccctacctcacccacattccctctcccaatcactattcctccctcatcttaaaggtaactgctactctgccttataacactatggttgagttttgcctgtttatttgaactctataaaaatggaattgtacagtatataaccttttgtatctaggactcaacattgtgtttatgagattaactcatgttgttgcatgaatctgtcatacattttcattgcaatttgatatcccatttaaaatgtatactataatttatccattctattgttggggaacattttggttctttccagtttgaagacattatgaataaggcctcctatgaacattctttaatgcgttttttggcacacacgtgtgtacaactgtgtttggtatatactttgcagtaaaattgcctatgttgagggtaggcatatgctgagctttagtagatactcctggttttccaaagtggttgtaccagtttacaccatcattagcagtatatgaaagttctagtagctccacatctcaacaatacttgatacttgttagtctttaaaattttcgccattgcagtgagtgtgtgagtagaatctcattgttattttaatttgcaattgtctgattacttatgaggttgaatatttttacgtgtatttattgaccattttggatatcctgttgtgtgaagtatctattcagtctcttgcctattttttttattgattcatccttctttttcttattgatctgtaggagttttttttacatattctagtttgtagccctttgtaaattgtatgtgttgcaaatatcttctcccattttatagctttccttttaattaaattgtttttttgattgatagttcttaactttaatatagtccaatatgtaaatttttccttagggttaattcttttgtgtcctctttaagaaatctttcctaatacaagataatgaatgtatcctcttttattatcttctagaaacttactattttttaacttttccatttagatatatagtacacctggaattgaccttttgtgtaatatgtgagatagagattgagttttatttttcataatatggatatctagttggcccagtacttgatgctaaacattcatttagaattcatttgatagtatttcctttagagttattgcatctgtgtttattagttatattggtctgccattcttgtcaaggtttggtatgtggattattctggtttcataaaggcaagtagggaagcattgcctcttctagtctctggaagagtttctttaagattggtatttctgccagtgatatgatttggccttggaattttcctagtgggaaaatttataattacagtgtttatttcttaaatagtacagggctattccaattttctatttcttcttttgtcagtgtcagttgacttaaagcacactaagatactctaagattgctatggtcagcctttgctggtctaaaccagaggttgcaaactgaaatgccaacagaggggctagcctgctactgtaactgggcaaggctagcgaagcgtaagttaatgggagctggtagggactatagaatacatgtgccgttatagaatggtggctccggaaagttattgtcatgcaagaataggagcccagcatggacaaatcattccttttaaatgagaagtcagaaggttggattattctgtaaaatatctctgaatatttaaatgttgagtaattcagattaaaaaaaaaaaaactgtgtgggctaatcaaaacatttgtgcatgccaaatttagcccaaagtctgctagtttgcaacttgtactttcaactaatgaaaagcgtaatagcacagatataattccattttcaaataatataattcatttatagttgacatttatttaatttacacttaaatatgaatttgtcatttaatttaccatattaaaaaagtttagattttaagacatccaagtctgcaaataactagaatattttcatttactctcatgtttgtgtacttatttttccttaaatgttattttcatgatatacttagtgtcttgtggacattccaaaaaactgatttgacttaaattgtcctcactccaagctttaaaattgcttagttcatagcctaccttgcctaaagcaaacctggtagtctcatttcaagttactggattttttgtttgtttgtttgtttgcttttgccttgtttcttttcaaggttatatagagtgaaggaatatcagacttcttttaatttttgcagggaattcagattgctgtggattaagatcctatatataagatgcttaggatagaggcatcatgaatgaaaaattattcatatgaacacactttttagagtattatttttattcattcagcaaataatcatagctgccatactaggcaggtagggaccatgaagactactgtccttgtagtctaaagtcttgtagactaataagatatgtataactgttaaatagtacactgaaaatacaaccttaaacaatcaaaatatttgcaaattgtatttagttgacatgattgcataattgtatttatgtgacaattatatttgttattcacatatttagggagtcaatatgtacttaaggtaatctttgagctattttcaggatgaggtattagctcattactattaatactaccatcaccaaatgcattacctacttatctgcatttccaggaaaaattcaggaaattaggatttttaaaataataaaataatagtaaataagactgggcatggtggctcatgcctgtagtcctagcactttgggaggccgaggcgggtagattgcttgatgccaggagttcaagaccagcctggccaacatggctaaaccccatctctactaaaaatataaaaatcagccaggcatggtggcgtgcacctgtaatcccagctactcgggaggctgaggcatgagaattgcttgaacccaggaggcggaggttgcagtgagcagagatcatgccactgcactccagcctgggcgacagagtgagactctgtctcaaataataataataataataataataataataataataaacagaataataacctaagtgactatatttgatatatagttaagtgatgtttttgtagactttactaaactaaaaaataaattagcagttatttaattttctagtttataaagtacctacttacataaagttgcatatattacttcatttaattttaaaagaatatcgtaaaatatgtaggatagatttccattttatagtcaacaatacttattatttcaatacattatgtgattttttttcccccagtatcacagtgttagagcccaggttcaaaccagcattttctaactgtaagtctggaagtctgtctgcttactctatgtaagatgccttatgaagttcatagaggagacagctcagtggattcaggcctggtcttatattttgctgttcatcttgttttaagtgttatgttaagcaaataaaacataactttaaacattctgtttacttttaaaatttgatttagagctaacaaaaattagaatttgtactccatttacaacgaacagaacaaccaaataagcaaaattgtatttgcgttgtcaattacaataaataattataatggtatatcagagtgttaaattttgatttttttttttttgagatggattttattttattttttattttttttttttttgctctgtcacccaggctggagtgcagtggactgcaacctccacctgctgggttcaagtgattctcccgcctcagcctctcgagtggctgggattacaggcacccgccatcatgcccagctaatttttgtatttttatagagatagagtttcaccatgttggccaggttggtctcaaactcctggccttagatgatccacccgcctcgacctcccaacgtgccaggattacagatgtgagccgccacacctagactaaaattttatgttcttatatttctttaaggaaagcaaaaatgttgacagagagggttaatactagttatatatacaaaaaacctaaaaataagattttggattattctattatatgattattcatttattgaaaatcataaactaattgaatgactgagagcagcactaatgtgattactttggtaggaatctgtcctccaaagttgtcagttgtcagttattcttagcattttgaactgaagtctatgtaattaagtcacctgttgtttctgacaaaatgagcaaacacacataaaatctcttggttcgtcttcatgtctctgtggcagagaactgaccacattattcagttcctttgtcctttttagacaaaagccacctctacatggccctataagtcttcaattcaaggactatagccgttatcttaatgggattgtacttggttatctgataaattgtcgggaacatacccacattgcttcctttacctgacataaaatttagtcagctggggctcaacgattgaccagctttatcttgcacgtagtgaagggaaggactttcttactcctggatgtgcctaaatttaagcctttgaaaaagattgaagataccaattggcctacctgccctaagtagatgcttcccacagacttaactggtgaagtgcttgtctaaggtagacagaattttttctttagagaggagcaaacaaaaacccaaaaatactggcgtgttcttttgatgttctatttcccaattgatttccgggttcacactactccacaacatcttactgtcccattgcatcttaaccctctctcctctcccgcccccactttttttttgtctgtttcttctgcttccaccgttgcttctgctctgaagcaatcattttctctcccttcaaccaagggtggaattggcacacagtcaattggcttgggagactgcttactgatctgtcttttttgaacactggaatcttgacactggttatcattttgaggacagcctggtttggatatttatctattaagaggaatccttaattggtgtctttgactggagtatttgaaggagtctttaattgggaggttttaaggcaccagaaaagattcattaggaatgactgacctcatgttatataaatgagaaatatttaccatttgctgtacacgtaattgaagcatgattatacataaaagcatataattaaaaaatgtaaataaatacctaaataaataaatgcctataactagcatggcaaaggattctgatatcagctttcaatctcttttagtagagactggacaaatcagaaaaagaggatttatacctgtcctcctatagattatgctttcttctcccatcatccagttttaattgaatctcctcattgtgctttctttcaatcttgagctgcacaagttgttttctcctgtcagagcttttaatacacattgacaagaattattagtctctatctgcagttgttccaagtgcaggtttgaaataaggagtcgtcatcaatgtgctaacgcgtgctacttttggtatttatacaaagtgcctgctgccagttacttgccacttagaatgtgtttttcttttcctctcttgcgttgtgggagtagaaggattctctgtttcttttggcagacagagaaattttcagattggggtctaatgaaagaaataggttccattatacagatgtacagatgttctaaggtcacgatacctcctataatattcttatgtgaaacctcctctttatgttcaacctgtgtacgttacacttatacatagcaggcatagtagccatcaatattagttactttaaaacccaggcctcctaggctgtggtttgtactaaaacatcatattcaaataaaagcattccaatacaaagtggagaaacagggacaggcatggtggcttaagcctgtaatcccaacaggctttgggaggccgaggagggcagatcgcttaatcccaggaggtttagaccagcctggccaacatggcgaaacctgtctctactaaaaatacaaaacttagccgggcatggcggcacatgcctgtaatcccagctgtaatcccaggctgagttatgagaatcacttgaacatgggaggcggaggttgcagtgagccgagatcacgccgctgcactccagctttggtaagcctcggtaacagagtgagactctgtctcaaaaaaaagaaagaaaaaacgtgtagaaagaaagagaggatctgattaagctcacaggaacattgcttctcaaattttaatgtgcatacaaattgtctgggaatcttgttaaaatccagattatgagccagtgggtctaaaatgagacatgatgttctgcatttctaacaggtgatgctaatgctgctaatctgtggaccaaccacactttgagaaggaaggaagtagactattatatttactcattcacttgttccatgataactcttaaaacagactggtgactttaatacaattcagagcaccaaataaagattgtcatatgccttatttttaacctatcgtcttatatcaaaattatctgataaacttcccaagtgtgcatatatattgtcattttaaataggtttcaataaaatgaagattcgtgagtaagaatataggaataaatgacattaaaatctttctttataatttatatttctactttcttttgaaagaatttgtagtggcttaaacataagagcacaagatgagccagtgacaggaaaaaccaagtgcatctgacatcttagcttattaggtctagaagacaacctccattacttggtagcaagcggctgggaatattggtgttcaaagctgtgctttcctgaaggcaaaaacagcatcaaaatatgaaaagctttttacttctggcatgagtgataaagatgccgatctgagaagcaggtgaaaaaacttagcttatgcttctaaaggctaattttatataagtgttcttgtccagctgttcttggtaagtccagctgctagttgaacaggacaggtggtaatccctgttcagtggctcattatcacccagaggctttgatctggctaatacataatcaatcagcttctgaatattaatattcttcctattttcatttcacttgttttacctaaatttattttccaaagttccagtatgtttttgttttttaataagatttttgatcatttatttattttgacataactaggctcatgatatgccagctggagtttattacacccctgaatcacaaactttttttcttccctctttatctccttacaagatccaaattgcaaaacctaaggataaagttctaattttggaagcacaaaagactgaaactattttagaggagagcgttaatgaaaatcaatatctaaaatcctcattttaagactgtgaaccctatagtctatacttctagtgtcttcagagttgtgatatgcatacattaaggactaagaaacatttttttaaatagtcagatttgggagcattagatatgtttgtagagggaaaaatcaatttatgataaaaattactgacaatggtttaatttgtattagttttgcccacttccctgttatctcagaatggcacctccatggacagtggaatggtcctaacagcctaaatatggtaagctttaaaaacagatggcttggggccattctgcttattatatcattgctttcaatagcataactgttcttctccaatggccctctttgttgtttgcttcattactggcacatttctttaatatgtaatctataacattaacatgaaaatggctctcaaatactattactttctccatctgtgacccagtactgtttatcatcatctaatgatcattcttattgcagatggccctctttaaatgtttcagaatagcattttaaagacattgagggtgcttcctacgtacattggcagactgaatgttttaatatcgaaaatctcggtctacacgatgtgtgataaatgactggagatgcaaggcaccagtcagttccaaagcaaggtgtaagagggacaggaggagagtgataaaaaagaatacatactttgcgtgtgtgggtgtgggtgtgtgtgtgtgtgtgtgtgtgtgtgtgtgtgtgtgtttaagccattagatttatctttaaggaagcattatctttaaggaaagttggagtaggaagaacaaaatttaatcaaaagaaacagttcttggccagaggaggtggctaatgccggttatccgaacactttgggaggctgaggtgggagcattgcttgaggccagcagttcaagacctgcctagtcaaggtagcgagacaccccacctctgccaaaaaaaagaagaagaagaagaagaagaagaagaagaagaagaagaagaagaagaaacagttcgttattgcagttcttaaagaaggagtttgtgtttcctttctgatcattcaccatggcagtgatacaaaggagtgatatcaaattgataaatgagttccctaaggctcaacatatactaaatgcctatgctgaacttccaggtttcaagtccctagagcctctctgtctgaagatcctatcaccaaggattctttgtcttcatctagtactttctttctcctctctctattctttcctcatttgcggatgcttgctggggcctgtcaatcaaacatagatgatccctgacttacaatggttggatttaggatttttttacttgataatgctgcaaaagtgatacacattcagtagaaaccatacttcaggtatccacacaacccctctgtttttcactttcagtacagtattcaataaattacatgagctattcaatgctttagtataaaataggctttgtgttagatgattttgcccaactgtaggctaacgtaagtgttctgagtaagtttaaggtaggctaggctgagctatgatgttgagtagattaggtatgttaaatgcatttttgacttagaatattttcaacttatgatgagtttattggtacataacctcattgtaagttgaagagcatctgtatctgggttggagcagaagtattgctagtaatgcatccatgagtcaactgtttgcttaattggtatgctaccacacatgtcttgagcttgttcatcccatggcttgccattgtgttggaaaggaaggtgttacagcattgccgttaataacatttctaaatgggaccaaaaacagtattttctttatctgctagatctttttattttcttctttctctgtatacgtgagctgttcccaaaatttagcacacatgttttatgattctcaacataacgtttatggtccttaacattaatctcatattagaaaataaatcatgatgaaggtgaaatatagaccaagcaggggcagttatgaggaccaaatcgtcagtataaaacttttataattaatattttcatgaattgatagcacttgcttcagagagctaaactcagaaaaaagagaaatattctaacctgaaaatatatttttaaaaactcataatttaaggtagggggcaagtagatttggccatattttgggctttcttcaccaattcagacacgataatgactacatttgtatcctagatttaaatttgctagatggaaaagaaacacataaatataaaccccatctgcgcaaacaaacataaccattcacattcttatgcaggattctggggtaggggagggctttttttgtattataacatagcatgttaatttttaagataaaatggaaatatttttgtgcttttgttaatttttatgttaaaaatgacattttaggcacctaatcaaattctctgagttctttcactaaagaattttgcctaatatttgattaaattcattattattaaagatcaatggaatttctttcagtttgaaaagttgaaaaaatgagttgacacattgattcatagaaaaagttatgaaatttgagaaaaattattgaaccaattttatttaaaatacatatagatattatgtgtatctgccttcattttcaggataatgaatgtcagtgttaaatgtggaaacattctaaaattggaaatcagactccacttggttcaaagaacaccttattttagataagccttttaaaataatgattgaaatccagtcaatccataccctcacacataatcctcatgcatgatctttgtttttccctatctctcctctaaatgtcctttacaaagatgagaaatgttcttcccaacacaaaattcctttgattgtatattagaaagaactgacactttgcagcaaggtttaggaaaagctaacgtaagtagagcttctctgaaaactgttttaccaaaacatactggatttactgctgttaaataatggatttttttttttttactatttatatttgctcctcattgaaacttgtaaatgactttattagtcttaggcaacacatttcattttgcattggataaagatgcttcttcagtaaagtgttcatttatagcattgagaatcttgaaatataaccggtgtcatcaaagggtaggaaggtagaggcacagagaagtgattaatcacttttccctccaatgaatgatctactgtcaagttcaataatcatatttcatctataaagagcactttgagcaaagcctgttttgcacacgtcattacatttgattacaattaagtataaatatatgcctattatttagctctagttaaaatctgcaaaaatatagaaggcttgtgggtgatgtaaattggagatttgcataggtttagggtacaatattagaaaacactgtagttttatttttgctttatgactaaaaggcactagctatgttatctcgtttgttcaccaaactaaaaaacaacagctaaaaagcaatgtaacaaatttcctctaaccttcttaacccatccactgctgtcgcatgactctcacaaatcagaaataaagaaccatttctctactgaaggtcatcaactcatttgagggccatagatcagtaaaaaataacttagtctgagacattcaaatcacttgctttttaggtaaatattttggcttttaaaatgacacaaatctgaccaaaatgttactcagctttatgggaacgggattcttttctagataatcttagggacgatcttaactcatattgtttttgttcagagactaggtctaatttgttagaagtgctgccatgggatctcattctactcaacaggagtgcattcttcttatccagtatccactaaaagtcactcctcctcccatgaaaagagttgccagtggaaaactcagagaaaacatgggaagggattggtgatgtcatataaggagattagaaaacatttttttaacgtttaaaaagtaaagagatgaattttaaaatttacaaaccaataagtttgatgttgatgagcaacaaaatcctggaaaatgacatcgtactgattattaatgattacataggataacatgctgctgggaatcagcgtgatactctcaaaatctgccatgtcacatgcacctcattttcattttttttatggctgcttgatggttagatgagaagactgttagagacagcataacttaggattttacaccacatttttcaagttctcttttgagaatattgggtacaagataaagaacagtggggctggctaataggctgaatttgaagctgattaaataatgacatctaaagaatgtcaattaatagatctagatcaacacaaaatagagtctctgtcgttggccctgcctttgcacatggctgtttcttcttcagtcatctcttaagctcaactcagccctctgcctgaagacctcatttggccagttttgcccattcattactactgtgaactctcttttgttatttttttcctgttttattctgagaatggattgagctagatatgtggaagttatgggaaagcatattttaactaaatattaaagaaacttttgtaatcgagctctccaaaaaataaaatccgccactttgaaaagcattaaactccctgtacagtagattttcaagactgaaatgactgtctcacccctaaaggcaatttctgtattggatgagaggatataattcattaacctttaaggtcacttgtgaatctaatgttttgatattttcggaattaatcagaagggaactgacagcatgacctgaatctgtcctatatttatgtaaacatcctgtgtgatgcacctcattctttgtgcagttgtatgcatttttgaatgttaaatttgattttagggcaaacgcttttttaaaaaaattttaaaataaactttattaaataaaaatttacacacagtaaactgcctccatttaaagtggttcagcgatttttggcagatgtgtacttgtgaaaccaccactgcagtcaaatgacagaacgttcttactcccccaaaagcctccttgtgcccctttgcaggtcatttttcctttcacccctgattctaggcaaccactgatcgtctttctctcactgtgtattactttgcattttcaagaattttctataaatagaatcatacagtatttttgtatgtatctggtctcttatattcagcataatgattttgtttccagcttgaggatattatgaataagactgctaaaaattgtatacttgtttttctaaataccccttataaaatcttacttttgagaagcatattactaaaataacttcccaggttatatgtgtatttgttctttctgttcatttcagcattatcttattaacaagcaactggaggacatgcaccaaggataaattgactaggtgctaactgaatttgtgagaaaggcctagtttctaacgttctttcttgggagcagatgtgtaacagctacttttgctgtataacagaccaaccccaaaacttactggcttaacactgaggtcagcaaacattttctgtaaaggacaacatagtaaacactataggctttgtggagcactttgcatctttgttgcacattctttttctttttacaactctaaaaatgtagtcatacttagctgagaggctgtacagaagcaggccatagaccaaatttgaacaatagttcataaactctataacacaatggccagccatttacttagctcactatttgatgggtggattgggccatttatgtggtgtgaccagttgtactactgtttgccaggcatgcttatgcatctgtagtcagctggcagctggataagctatcgtgacctgactcatatgtctgatggttgacaggctgtcatctaggaacagatgcaactaggtttgtgtgtatctcatcatccaacatgctagttcaggctagttcacatggaaacttctcaggtttctgcttgtgtcatgtttggtagtgtccattagccgaagcaagtcatgtcatagggccatcccagatgtaaggagtggggaaagactccacctgttggtgggaagagatacaaaggcacactgcaagagctggacaccaaggagagggctagaacttttggccatgttgcaagatatcacaaaatattcaagaaaagttacaggaaggttcctctgtggactaaattctcttctgaatttagatgtaggtaaaatggagtgtgctgttaaaattcatgctttgtgagtaatcattgctaggctaaactgtttgtggcttcacagccaatggtagacatacagcatccataatctagtgcttttaaaaatataagaaatactgattacaaacatagttaaccacttattagtactgggaatttaatgaaagctgctgtgattaaatactgaaaaaagaaagattgtgggtttccttctggtaactttcaaagctggtcactcttttgaaaggaattttattcttaaagctgttatttttactcataatatgcttaatacccccatggctgcagactgtctaaaatgttcctacaattatatgagaatacttttaaaaatcatgataattatcagtcttcatggacacttattcagattaatttccccaagcacttaataggatgaatttataagcattaaatagaatggggaccatccagccctaaaatgtgaccattctgtcaggcacacacttgccaatttgttggcgtggacctgagcacactagcaaggactttgaattaggtctcactgcaagatggaagcagaagggcatttctcagtttatgttttgaagtgttttgttcagacaggcaacgtgcagttgtgtatagtagtgtgagctacctgttactccccttaacaatacttttagcagcaatgtttttcctcctgcaatgtgacaatatcaccatgccatttggaagaaaacaaaaaggctgagtgattcctggtatactcccaaacagccacccaaacgaacagctggcagagaagacaccccctaaaacttggagcagattctcagcccctgcagcatctcatgtggttagaacttcagacttgatgaacgcctccccaacttgctccccctcctgaatcttttaatcctcctccagtctcttgtaatgttccagcccttaccagggaataagactgcaaactgtcttccgtcaacttctttccaaatcctagtctagagaaattataatgatgcatgattgtccagtgggcatgtatagtttgtccatttctttatgtagtaaagcctgtagctttcatcttttttgccaatccactataaaaattaattttatatgtcatcctggtacacacacacacgcacacacgcatctatatctgtaaatctttttctgtctattcatgcttgtatgattgaaagaaaagtttcacaaaacattacttacccataccaaatagtacactttcatattttttttttttttttaatttcaacttctattttagatacaggaggtacatgtacaggtttgttacatgggaacattgcatgatgctaaggtgtggggctcatgacctgttacccagattgtgagcatagtacccaataggtagttttataacccattttccccactccaacctctacactgtcatattttctattcttttctgtttcattaagaacaatactggtaatgatccactatatagatttcatgacgtactaagggttcatgacctgcagtttgaaaaacactgtagttagttttatctccacctcaggccaggtcatcagaaagctgcattcttagaccactttgccttggcccccataagattgcctcaactcaggtgtacctcggcatcatgttcctggcttatgtcgaggggcactgaaaactgctgaagggatttttctgaaagtcgacaccatgcagtgtctcccaccttagatcccatgcagatctgtttattcaatctaagtcattccagacttggattttcctttgtttcacttacactctttcctccttatcaataatccaaataataaaatcgatcatatttccttttatattttttcttttgctttgacatctacaaaggccacaaccaaattatacccaccttttaaaacacttttttactgaaatatattaggcatgtagaaaataagggagatgctggttaaaggatatgaaacttcggttaggaggaataagttcaagagctctattgtacaccatggtgactataggtaatgaaaatctagtatagtcttgaaaattgctaagagagtagatttaagtattatcaccataagaaatgataagtatatgaggtaatgcatatgttacttagcttggtttagccattccacagtgtatacatatttcaaaacatgttatacatgataaagatatacaatttttatttgtcaattaaaaaaaaagaaaaaatggcttaaacttatacagttcagtgaattttcacaatctgaacacactcatttaaccagcatccaaataaagaaacagaacattaccaacctttagaaggccctttgtgtgcccttctgatagttacctgtcctccaagggtaaccacaatcttgattttgaacaccattaaatattctggcctgttcttgtcctttatataaatgaaattgcacagcatgtactcttttgtgtctgacttctttaaacctggattcatccatgctgttgtatgaagtggtggattgttcattctaattgctatgtaatatcccattgtgtcaatatcctgcagtatattatatactctactgtggatgggcatttggtagaaaaaaatgatgttataaacattctaagacatgccatttgatgaatatatgtatgcattcctttgaggactatatcaaggggtagaatttctgggttatagggtctgtgtgtgttcagcttctgtacattcttccaaacagttttccaatgtggttgtaccagtttgcactcctactaacagagcatgagagttgtagttgctccacatcctttctaaccctgtgttgtttgtcttgctcattctggtgggtatgcatagcaaaattttcataaccacatcatgcactgtgatcttcaaagctgtgttctggctgggcatggtggctcacacctgtaatccctacactttgggaggccaaggtgggctgatcactagaggtcaggagttcgacaccagcccggccaacatggtgaaaccccgtctctaccaaaaatacaaaaaaattagccgggcgtggtggcaggcacctgtaatcccagctacttgggaggctgaggcacgagaattgcttgaagctgggaggcagagtttgcagtgagccgagatcgtgccactgctctccgacctgggtgacagagtgagactccgtctcaaaacaaaaaacaaaaaacaaatctgtgttctaaattttcctcgcttcttaaagttttatgctatttatatttccttagtgctgggttttattaatttttaagagttatacattgttataagttgccctaaagcctttacagaacaatgcacagtataaatatgtacatagtatatacacaaatatgaatccatgaatgcacagctaatagggccattatcaaaaatcctacacttttccttttcctctagccctcacattcaattggctcaaaagtagcattgattttattctataacctgtcatgaattcagcctctccacaaattcccagtgctcctttcttagttcagactttcatccactcttaactgggctgttgtcatcatctacttggcatacatttccattctgatccctaccctcttttccacccttgtttcttcccacctcaaatttaattctattttaaaaagaaagatattcaaaagtacaggtggtgccaattttttcttctctatccatcatatgcaaagaggcttccaattctttgtcgacctgtttctaagggatgagagtaggtcaagctgtgaggacttcaattcccacgtgaaggtcttgttcatattaactcaataatgtgctttgatgtcctaatggggaaagtagtattttctgccagttagccttcccaagatatcaaatccaatattggccaaatacatttttgaattcctaaaaagcctaaactgatgtcgtaacacagctgtatattaacataaaaactctgtaccttagtaaattattaatatgagcgattagctcacagagtcaatgtaagaaacttgtttcaactcttcatattctagcaaaaagaacacacacacacacacacacacacacacacacacacacacacaaaacctgatttaagaactaactaggtgattaaagcctacttagtttttaattgaagtgcatattctctaatcccaagaggccaaactaatcacctttccctttttgctgctttttttctctctatttctgtaattattataatctgtctgatactgtgtttagctatatatgggtctatcttctctcattagatcataagctccttaaggaaaaggccatatttccttgggatcccacttaaaaaaaaactggattacaatgttgaaatttttatatatttccatgtcattctccaaacactccccagtttttaccaaccataaagaaaaaatgagaagagtttaaatgataagcaaatacatatgtaagtgttccataaatacactatgtttgaagttatttaaagaacttaatataggataatatttaatagagaaacttagtctagatagagcacataaaaaacattcttggaaatttgtggataaataaaagttccttgcatctgtattttcctttcatcttgaaaacatgccttgacaaaagtaagccagagctggagtacaagattcagacattggtagatcattaattggttaaactggattttatcttatttccccttttatggatccctgtctttgtgtggaattcctgccacttgctggctgttcaaggcttgccaccaggagactttctccatcaagctaggggatatttctccctcactgtcccccaccaaatcaatattcacttgctctctgactactccaggtttctgctgtctgagaatatgaacatggatataccttttaacatgcgtgaatactattcatattttaatctcggccccactgaatgatagcaaacgctgtgaattttatgcctatctcaggctacagctagtgccttatcttgcacacacacaaaaaaaatcttacttttcctacttgcttccttcttaagtgtaaaaagcaaaaagaggaaaggtgccttttgtaaactgctaaagagcagtttacagaagagcagtttactaaactcagacctctcattttccctcacacgacaatctaaaacagaatgttaaagtgaatttatttggttctgtatacctaactattcctgaacatactgagttctcttttaagaaatcatacctgcctgacaggctgctttgcatgaacacagcattccccagccttcaaattgctgtcagagccgttgtgtcattttgacccacaatatggcagtattatccacattctatagatgagttaacaaaagcttccaagtggttaagtgacttgcctgtaaagggttaagtgacccacctctaaggggtagaattggtctggacactctgcccctctatcttcatgcctttgctataatacacagctacgcttgctgaagattaaggaagctgcttttgataaagcgtgattcttgtagatattcatctcaggaaaaaaaaaaagaaaaacgctggtgtcttcatctgtagcatttgattattacattttccttatctgtttcaacttaggatgacttccttgttcgcttaattgactggtaattcctttgtttacttttttccaaatctcaagaagcaagtctagagtattaacaatggttacattagcatttaaaatttttttttgaaatttgagtatttcagaaaggggtaatttaggcaggcatgtatgtagaactttgcattttaattaaaaagactcaaaatgaaatgaacctctgacagtaacagatgactacttctaaaagctgcattactacttgatatatgctcagtattttcttgtgggtaagtcctacgacttgtttcaagaaaagtgacaggactaaaacaattaaaaaagacaaagctgctgttttttaatcatatgttcataaataaaactaggttgtgaattgtttccagagaagcaattgacaaagtatgagtaaatcactctaagaactaaagctgcgttgattttttttaatgttcaaccaaacatctatccttgtccaatgatgaattttctttgacaaataaatatttacaaagtatgaaatatagactctgtgcctttcctaaggccaaagcatactgtttaaactaaaatttaattttttttctcacctcaaatacaccaaaataagaacataactaaaaattaattctctcttgtagtagactgtccattaatcttttgttagataatattagcattgtgagtgtcaggtagaaagaaaaactgtaatttctagattgatcagaaaatgtgagtatttatggatttgaagaaaacaataaagtctgataaaatagaattttctgtaacctcccttatggagtcaagaaggaggaatctttcaacatcctcccattttgcagtgaaaagtcttcatgcagtaaatagtttgcttgggtagatcaaagggttaatttacttctgatttgagaagagacgcagacttccctgatttttttacaaaaatgtgttgtgtgggaggaaggtagaggcctcagaatgaattcactaattggggttttcacctgctgtgagtctaatcgaatacaaagccttatttgtagctgaagaggaagagagattatgcagagtgtaagaatttctgcccagttttgaaattccgcttatttggcacaatcggtggggaaaggcagacaaatagttacaagtttgagctgttaaggtagaccaggaatgctgtagtcagatatacttgaaccacattaaccagtgatccatttttagcaggaggtggtgtgggtcatatacatgggttatcgctatagctggcaggctaataggtactccaaattctttcccatgaagcaaccgtcggcctgtgaggttaatgaagtatggctttattttagtgaagatgctaaaattcacatctttttagatgttcggcttgatataggtggctctgtgaagctttgagaaatcttattaaaagaaaactgtgtgagagtgaagcagagctcgactttatctggaacctgtctggtgaaatctctggtttagatggcagctggctcacagagaactttcctgagtctggcttactctgcctccctaaagagacagggcctggaaaaataggcttttgtgtgggtgtgaagtgctctgtgtctgaacttagaggcctcttcatttgctggttaatgtgacctggctggatattcttacatccagaagatgttggtttcagattgatctagggggattgttatatatatatttcaattagtatgctataatatttgccctaaccagcaatgattcaccatacaccaacccatttgttagatgtctgagtcactgttcatggttagtacttgtactatgcaaagaggaatatggaattcttatgtctttattgtatacccaaatgctgacattttactatagaatatgtattcgagttaattgaagtgatacctatactctaaatgaatttttataaagtgatgcaggttatactaaaacttagggcgcactatagatagagagaagctgaaccctaggagttggtgaagtctctcgggaccatccctccaggcaagtacccagttcaaaccattccttgtctttgtcctttcctatgccactctgcatttttacacagctagcatcaggccaacattgaaaccacatgcaacccagaaaggaaaaagatgtgtttgtggaaggtaggaacagcctagtttcagctgttggcccttcacagcctccactagatgggctcattcgaacccaagacccttccaacagtacactgcaaatccatagctccaattcagacatcttccctctgagctcaagactcagatgtccaactgtctcttggatacctgcacttttacatcaccacctccaattcattatgttcaagactggattcatcatctctttcctaaccctcttctgccccctcctcctgaaattcctagctcggagaatgctactcatccaatctttgttgtcactcaaggacaatggtccttaaccttcactgcatattagaatcacttggagagtcttagaaatcctaatgtccaagaccaattaaattagaatctcagggtggtgagacccaaacatctaaatttattaacaatccctgagtgattccaaagggcggccaagcttgaggactattgctttacttcttccctctcttccattcatacatccagtcagtcaagactcctgtagttggaaccttattgtatcatttctccacctcctctgccactgctgtaattcagatcctcctcatactgcaatctccttgtacctgatgtctgaatttcagactcttgtcttctgatcaagcccccataccattgcctgagtgatttttctaaaagacaaaccggacagagccacactcatgctttaattctttcttccttaaaaagctccctcatacctttcaggatacaagtcaaactccagattgtcacactaagccctttccagtttgcccatttctctaacccttatcttgacattctctccaaaagatcaagcagaccgttgaagctcttgtaaagaacaagctggttgcatcctttttaccctcacatctgctgttgtcaccatcataattgttgatatgcctttaccctcaaaaggccagaagctctttgtgggcctacagaggaggcttctctgaatatttatccaatgactgagtctcatctgctttttagccccagagtggggggatctgactttctcctctatcagtagtccccactcagcatcaagtctattgccccagagggtggctttggctggatgggtctcagtttggtcagggtcctgggagaaacagatggtacattcaaacggaacacttgaagagagtataatgaaaaggctatttacaaggctctaggcaggctaggagaaaaaaaaaaaaacaaggaatggtaaacttttgcccaaagggataaagggaggaatggtttgcgtaactggtggaatgctattgctgtaggaaaggactggccaacaagacttgtggctgcaggtcaaggaactcagcagctgccaggccagagatcagtaggagggaacctgaagaataaatacccaaacatcaccttcctcctgtcctttcctctccttctgtaggcctttcatcactgcctcccaattggctgaaagcaaaaggaagccaaacggcaggaaagcctgattgatgtccccacagaggtccaacctcctgggccacagagcagaatggagaaggacaaagaatagagatggatgggagaatggggaagcatcctgcacagtcccttaggtcagagatgcccttattctctaaagataccctcaaagtttaagtggttcaaagaccagagttttggctacgggaaaatgtactgggtcgccttctttgacctcatcccatttcatttcttctttatctctatttctagcaaatttactcttctctgctctgagccatcagtgagattgtctatgagtatactagaaaaaacacagacctttctcacaggaaaagaagccatgtctcttcatggcagcatagcagaatagctaagcgcatgagtcttcgagctggattccccaattccaatccttgcaccattctagacagtggtactgggaacaagtaggtcatggctgattctgaagtcaaaattttagctgaagtttgttctggtagcagagcttcaggctcttttcatgtccgtggttcatatcaaaacagtaataataataataataatataatcagaaggaggagaagaagaaacatctactataaacaaacaatatattatcatacatggcatcactacataatttacatatgacacgaaggtatatcaattatgttcttttccaaatgctttcctctaataagcaaaattcataatctgactgcaattgaacaacaaaacagtctctgtgatgcccgcgtcatttcttaatactttcagtatttaattataatatgacgtcaagatttgggaacaagtcttcaagtgcctataactccagtctaaaaaagaacttaaagatgtatttttgaggattgccatctgtcaatttttttaaaaagtctgaatagtgatttcttattccattcttttttcttgtcaacagattattcttagtagttttctaattggacactgagaaaagagacttaagcatttatagagaagcgtgtcagaactcctgaattttgagcaggtaatttaaaagtgtaaaacaaacaaacaaaaaacaggaaaggaagagagtgacaaatgtcttactatccaggtgttacaaatccttagtttatcgatttgtaatatttacaaatgtccatgctctgaggcttctgtcttttcgttgaaataaacataaacagtagttaagtgatttgccacactgacacagagattggtgtctctgatttactgcaaagggcactacttcctcattacaggacactaatccctcttccccaaggatcggagcagacctagaatatactattagaccaagggacaacttcagccaaagcaaatcttagtgtgcccccctcagaccgtaatagcagctgcctccacaactcactagcttaaaattgctaaagggcaacactaagtaatctcagtgtatgagccagaatgccagaagaagtgccatatttgcttaaaaatagcaataccgatcatacttacatgcacatatctttagtgataacatttacctttatatttggtttgttaaaggtaataaagaatcctggcattcccttttgcttttgtccagatactttatttttgcctcttttgccatgctatagcattagataaagcaaaacgggtgtgcttccacctaaaacattctagggggaaaaatgttgagcagaaaaggattatttcaaaagaagccggatatggtggcatgcacctgtcatcgcaggcacttggaggctgaagtgggaggattgcttgagcccaggagttgggagaccagcctgggcaacacagtgagacccccatcccttaagaaataaattttaaaaaggggaccacatttaaactgtagaccgaagtggaatgaatcaatcggaaaggagagtggaaagcaaatgtttgaaagaaaataaaaagaaaagcaagccaacaaaataaatggacaaagaagggcagtgaaaatatcactaacagtttatcgtaagatgctctttggatgctaatctaaggtgttatgtgaagtttgcagaaaattcttgtgctaatgaaggctttcttcttcttttgagtatttccaagcttgaaataattgtgtgtagttaacttctatcatcatactgcaaactctaaaattagaattatttgaactgttcaggccctgtaacttttccaataaaatattctattagaaacaagttccttctagatcttcctaaaagaatactaaaggaccaaaccgtgcaacagcactggtggtattgtcttaatttagagagtccataccagtgattctcaaacattagtatgctcagagtttctggttcaataggtctgggccgggcccagggaattttcatttctaagaagttcgcaggtgatactgataactgctgttcccagggtctacattttgagatccgctgctatgtcacaaatccaaatccaaagtctttttaacaatcccttttagcccaggatgagcctaacggcaatttcacgtccttatcgccggccactttaatcttcaactgaggaggaagggagagtgagaattatgtatataatttttttcttttattttttaaaaagaaaactccaagcccacactcttaattatctgggatgaggtcatttgcacctgggtcatttatttagacaacaagtagtcttgctagaggctttaaggaggtgttagcagagcggtgtgtggcttccaggttcctgggtctaccttaaatccccatcctctttctttctttctttctttctttctttctcttttctttttcctttccgttttgaaagccccaactgcccagtctctgggtgtccgggttcccaggtccctaggtgggggcggagcccgacacggccccgccccgtctgcccgcagcgccccctccccggcccgcccgcgccggctcctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaagggtaagtggatcgcggccccggccccgtctgatggccgcaatccgtgcacttgtggcgcgagcagggggcaagctgaggcggtcaaaacttggacaggcgcggcggctggacccggggcgccgggcggctgggcgtctaggaacctctcccgcgggttcccgcggcgcggctgcaggtgcgcccccggggtttctccccaggcgccgggctagtgggggaacctcttccctcggctttgggacgggctcggagagaaaaagctgatttctccccgtccccagaggggataacgcgttcctcacgcggggattggggccgggggagcttttcactcctttccaggctgccagtgtggacgtgagcaaggctggctgttcctaaatcgtcgctcttactcgtagaaggaaggggcgcacgcggcgctaccttccattgcactgcaagtgccaaaaggtcaactttctgcctgatttcttccgaggattccaactgacatttccctcgctgcattttctaccgtgctcattccatgccccaagacctgcagaaatcaggaaagaaagaacaaacaactaaagcccagaagtcaaagatttcagggggtggggatttttgtttgtttgggcttttttttttttttttttttttttgcccttcgggattgggtgtggagtcatttctagggtgttctctcgcatttctccaggtgtctgtgctcatcttcaagcaaagtttgtcactcccaatcccagcacggcaataaaaagggcagaacactttgcttatattagtcaaatttgaagttaagtttgaagctttaaattgaaggggtttagttgctcgagggaggcataatattaattataaactgtttttacatcatgaaaaaaatccatccgatttaagtggtgaacttttaagtggcgtctttaagtgaaatctacatttttccttgggcaataaactcttcttggtcttctgctttatccctgtcatctctccttgtcacccaccccccccccccccacacccccaatcaacctttctttttttgcctagcttttttattgccttttactcaagcccctctttggaggatacatttgctgttggagaagcgagtggagcaaatgaagcaacacggttatatgaaaggtctctgacccttgaacaccgtggaattggtttcagtcatcattgtttgatctccgattggacacgaccctgaaaagaaattgctttgaccaaagttgagggtgggtaggagttaaaccttgaaaagcaaataaaacggaggacaactaacagctggaacagccaccgaggcaatcatctttgccctggctttagccagacagaataaaatggtaaatatcccagggaacaagaaatggggaactagaatggatttctgatgcttatattgatgcccacccctccaaacccctgccccacggtagcagaaactttaaaatatattttaccatccacaccctgccagtattccagcaatgcaagccaagttcaacaattcagcacgcaaatgccaaggttcctctagaaaaagagtctgatcctcagattaaagggaaatcatttgtgtgtgtggatcaatgggctccagattatatatgaaaccaaactctaatcctctgcaaatcgcaagagaacgctccctttttatattgctgcatagcgattagttttctccctgggaagtagtggacagatagttttttaaaaaggcaactgtttggaatattttcagtaccaaataacaatggtggcagaagaaatcttattttaattaggcaactgccattttcccagccacagcagtagatatttgttactttttataagtgtttaatgtttgtttttaagaaactaaaaaagcaattccaataagtctgattattccagcactgacagcaggaacagctctgaggcagttataataaccttgcacactacttgaaactaaagcaggtgagagaaaatttaaattgtatggtaggaaattaggtcagccttgtgctcagtagagtaatgctttaatttcttattattgacaagtaggtgttgctggggtcttttgtcatagtcgatgactttatattttaatttgcatcagggtcctatcaccgcctcaaataaaagggaaaaagattatcatggtttgtagaaagaagaaggagaggggaaatcttcgtataaatactgctcagagaggcatatctgatgccaggctttggaaccagcagggccaaaatcaataacattttttaaagatgtaaagagcgttttaaggattatttatgaagctgatctctgtgttaatgtacgtacagacttgtgatctatgttgaacattgttgttctcagaaaggccaaacaaagatgtacccattaacatgtgaacaggtttcagaatttcccttttggttgttcatggtatatggggagtgtatttccgatgtggagagtgaaatgcagaaaagagacaattaccaaaacagtgccacccacccttccactccctcctccctagcacaccgtgtttttctatatcgtctgcatattccaggtaaatgtgggctcttctcatggagttactgagaattctctactgttttagaaggcaggcacagagtaagaaacgaagctgtaaaatcggtattgatcacagacaaaaatgtggtttgtccttcaaggtacaagatagatatgagttatgcagatttgtgcttacagtttcatccagtccatattcatagttcctatctattttggagggttaaatgtgtcccagtggggctctggattcatcacaggtagaaaataacaagccgtgaagtgaatatttggttcgtcatatagttaccaaagaatctgaaggttttttggctacgttgccaagcatttttagcattaaatgattaaaagactatttttctcgttttaagaattagtcacaccctttattcttttcttctttccacttgtgctcacttcttttgcttagaactgatttgcaattgaagtgaaactaagactgcaaaggtgaaatctaaatctgtttttctagttcttttgcattgcttagaaataaaaggtttgtgtgttgaaggtgagaaaggttagcttctggaattgtttgaggagttcatttatctatgttattcaagtcccccagaatcacagataactgggagaatagtacctatcaaggactagtatcttaactcacaaatgggcaatggaattgggggcttagaatttcctccttcttccagtaaaggagattttcagttttgccgaggactgatggattaaaaaaaaataatttctaaaacccttttcataattttaaccttcaaaataaattctttaaaaaggcaggaatgtatgtatgccaacagtcatgaaatttctttagaagatggggagctccatgaagccctcattcattctatgtgggattctcctgtaaattgtacacactgtttccctttccttttagaactgtgtttggtacaggtttatttcttgcctatgttcctctaatttgaagtccattccagatggtggcttttcaccgtggttccctgtctctgtctgatcaggcttatcagctcagctaaatgtttttctgcagacctatagaagatgctacggtccttacaaatatcctggagatgggacattgttgttacacagtgtgactagtaagggcctgtgtgagcccttgtacatgtgggcacacatgtgtgtgcttcctctcttcgctcttcctttctccctggtgcttatatcacatctggatgacctttggaaatagaggaggcctgaatgcagggtggtctcaatagaaggtaacctttccttgctctgcacttatatatggaattggtatacactcactttccgagctgagaaatgcctgagaacaagcaacactttttccacgaagctgcaagctgcagcctccttgtgctgtgcatgtaaagtaccagtcctgcctaccccttctccagatcataaaccggcttggtcatggggtgtcctaaaaccccttaaagcatagagaccatatctcctgctcttcttgctctttaagacttgaatgtcactctgttatattccctcaactgataagcccttgttatagtcctcaaatgtgagttgtctctatggaaaagtaaaactgaaataaacgtatttggaagacagtgaaacagcacttcacaagtgaacattttcttgcaaattgatttcagtagccctcactgttcaatcactgactagtaaatattacagggatggtctttgaagttgtacagtttggatgatttccatatgtctttatgaggtttatgattgtgttccatttcttaaaccaacttaaacggttgttttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcaggcttgctttaaatttcaccgccagtagggcgcagagccctaaaattcaaaacatacgctaaggccattcgacattgttgcctctccagactcctctttctgtgtgaggcccctgtactttctggtcctctggaaatgccccagtttaagcgatttctcttttttccttccctccccttcccctcaaaagtttatgaataggctctgcatatgagtacccaaatatcattcagaactgcattttactgtatcaaagcctgtcatgcaatccctgaaaactggaaatatgacgctatggtgatttatgtagatgggccaaagtaaggaaaagtatatgtagttatttctccagggtttattcatgtaattgaatgaggaacaaaggtgttttgttctttttgtggcaggagctgatagccagcaaccacacttcaagaaatggaagacagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatattgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaattttctgccgtctttccggtgctcacaattcctaaggcctggcgggtcattaatgtgaacatttaaatgatttctttagtatggcttgttttgtgtttatgtaagagcctgacagttctgttttctttcccctcataacttgaattattttgaatgggtacagagcatacaaataagggtttgaaaacaccagtctttttacactggacaaatgtccagatgtctggtttgtcgttttagatctacaaggaatattctgaaatgagttatcttaagttgcagcttgttttgggttttgttttgggacagggtcttgctctgtctcccaggctggagtgcagtggtgcggttatagcttattgcagcctcgaacccctgggctcatggcggttcttctgcctcagcctcctgagtagctgggacaacaggaatgcaccaccacacccagctcatttttaaaatttatttttatttatttttgtagagatgggtctcactatgttgcccaggctgtgtttttatgtatttttttaatataaaaacgtcatgtcttttctactttttcaagcctgcatttctgtgaatggacatattgatagaaaaacacataaggcgatctctttggatttaaggttatgtgatgaacactgtgggaatcagggtacttaaacataaattctgtgtaggtatacgtaagtggggtgtgtgtgtgtcagggggtacgtagctattactgcttttgtgtcatagattctcacaaaatgaattgcagctatagagacaccaaggactagagaagagatattagccaaaaaatggttttattaaacatttttctaattataaatgattaaatgtcttctagaaaacctgaaaaatgtaaataaaaaacatgaaaaaggaaaaacaaagtcacttatactagccagagagatccaatacatttcgagtaatattatgtcatttcagtctggttataagtgtgtaaacgtttaaaattttaaataaaattgggatcagctaattttcaagtgctacatttccagcccctacagaatgtttttggcttataattgtggactgtttataccacaggtggaaaacgtgaatgcttatcttttggcaaatgagagaatgaaaaggcttcatctgaagtgggcagcagctgtcctgggcaagctggtctttctatcccagtactcccaggacccctgattgtacaagagaaaaactagaaatctgtccacaaagagctaatttaaattagtctgtgggcctcctgatcgtaacctgtggtttacacagatttagcccacttctaacatttcctactctaattacagtaatttctagttgtaatattttaattcactcttattttaaaatcattattattatagaattaatacctattcatatttttgaagtttaaaaatatagacaggctaacaataaagaagagacaaatcattcgtaaccccacttcttagagttagctggtgtttaatagtctaggatcttcaaaaatgtctttctatacatatatttttatagaagttgaatcattctgtcttataacttgctttttttttttccactggaaagtaatgtattaccatggccatatttccattttgttgtatagtattctctaccactttcaattactctgtaatgagaaattgcaaacatgtttgatgaaaagctaattatggactatcaatgaatacatgtttgctcctttaatacaaattaaatatacatttaatcattatatttctaaaattttctccatactttagatgtggtgataaactcaaaactgataatctctcatgacttgtgacattgggcttgtgacatcactcaattttgaattataacagaattttacagttgcaggggattttagaactcatttattgcaaactttctcttttatgaaatcaactttcaggtataatttttatataataaaaggaagtcatcgtaagtgtgtgatcaattccagccccctttgaaattctgtttcttgctagcccaataacaaaccacttgcaagtgaactaagtgttgaagtttgcttttcacctttcagagttaatatttccaatagttttgtaacaatcaaacattcgttgggcttttatccaagtggtgattcatcagataacatctcccatttattgcgggcctattgtatgttttccacatgggatgtgccagcaaccaacctgcatggtggatggtatcaacatccacatttcacaggacagcgaagccaggctcagggaggaattgatcagggctacacagctatgtggggctacacctggatttgtcctcagttttctgttagtactttcactgttctcattgattttatttactaggtaaagtatatttatgttggttactacatacctgctacacgtatataggaattgatagttttacctatgaatagtaagttacttgagtggtatttctggaaatggtatggtgggtcctaaacaatgggcactcctttcactgttgcctggcacatatagaatgattgttatatggctacatccttttttgtttgtttgttttttgagacagattctcactctgtcacccaggctggaatgcagtggcacgatcttggctcacggcaacctccgcctccccaggatgaagtgattctcctgcttcagcctcccgagtagctgggattactaggcacccgccaccatacccagctaatttttgtatttttactagggacggggttttgccatgttggctaggctggtctcgaactcctgacctcaggtgatcctcccaccttggcctcccaaattgttaggattacaagcgtaagccacagcgcccagcctgcctacatccttgagatcccatataagattaactaccagcactgcctttccccctctccaaaattacagtgtttcagagtcgaaacataagcataaaatactgaaaagaaacttttcattgattttagtttttacttattagtttatatttttcttcttcaagaggtatccctttaggtccaaattgctctttgagctggatgaaatggtcggaagccttcaactacagtcagttggtgaaaggtatcttgaaagcagaaatggtgttgtggtctggcgtgtcaaatgtttaagaccacatctagccccctctcctaatcgaacctgaacctcatgtctctggtgaggtgctgaaaatatcaagatgttgctttttccctctgtacccccactccaggcatactctaccgtggaagctacagtggttcacagtatgcatggtaggttacacattcctagagacgcccacttctaaggagatttccattctctaatttgccaaagttcccaagcagcctgttcaacacatgtttatgttacctgccttgccctcaaaagcattcaggtgttcccctgcacccagggtttgaacacaataggattagaaggtgaaaacattttgttagaactgaaaaagtagcaagtatttactgatgaaaagctataatattgcttgagatattaccattggagctctctaatacattctgggtggttttctttttcattccttttccactgattttctacaatgaatttatattatttacagttagatgtttggtaaaaaagtttcttcgtcgatacccccattccatttcttacttagtgtctctatagctacaattcattaactaatgagaacttatgacagaaaagcagcagtagccacacacacacacacacacacacacacacacgccccacatatatgtagataatttatacttaaggaccctgattctcatggactttgtcaggtaactttaaactcaaagagatcatctcatgtatttttagtctgtatgtccagttgtgaaaaatgcagatgtagacattttagtggtagagaaaatagaacttttttgattaaaaaatagataaaaaacaatataagataattaattttagattatttccaacagatctaaaatggctttgcagaggaggtttccatcaagtgttagaaatattgtgtttccctcatttatcggctgtgtacctacacaaaaaattgagagaaaatattgccagagtcctacacaaacaaagcaagacatagtaaagaaataatttaaaggttcactatgatgactgaacagtcattaggaatttgagtccccagaaaattttttacatcacattaatggtttgacaaaagcattgtcttggattttcacagggaataaatcactaaaagcaactggaaatcagttttctttcagcatttgtctgtgactacccccaatagtcatagaatggtagtagagaatagtagtggagtaagtgggatataagagaccaagtgtctcatgtctattttttgtagaccttggtgctttatctttaaaatgtgaggatattggggctgggcacggtggctcacgcctgtaatcccagcactttgggaggtcgaggtgggcggatcacctgagtcaggagatcaagaccttcctggctaacatggtgaaaccccatctttactaaaaaaacaaaaaattagccaggtgtggtggcacatgcctgtaatcccagctactcaagaggccgaggctgaagaatcacttgaacccaggagtcggaggttgcaatgagctgagatcacgctgtagcactccctcctgggcaacaagagtgaaactccatctcaaaaaaaaaaaaaaaaaaaaaaagtaacgatattggacaagtgtctaagatttttgtttttcttttactttgggctgagggtggggcaggctgtttctaaacttgctgtgatcattatttttcaagaggtacctttcggctaactctgcagacaagtggatttctaaaaatgtaatcattcctatgttttaaaatgtacattctgagaaaacaaacaacaggagaagattatgccacccatccgtgtcttacaggctgagtgaggcaagctgttgtcaaatagagaggctcttgagatatttcccattagactcctctgggtcattcatttgttattgagagggtacattcttcgtcactccctagaagtaataatatgtttgattcatgaggtgagttttagatttctattagcatttttacaaatgtaatggaaagactgttccaataggttagcttggtgatttaaaactctgagctcttcaaggctccagaaagcatttacaacatcagtagatgttagatagtaatatgctctggaatttattttgaaatactaatataatattgatttacatgaagtgcaattatgtggttaaaagcctgtccttttctcacaatttatgtctaggtccctaagttcattactgaaattttaagaaaatattttttaaaaagctcaccctgcccccacacacataatatatgctgcttagagatacttttattggggtttttttttttttttttgacagcatcttgctctgtcacatagactggagtgcagtggcctgatcatggctcactgcagctttgaacacccaggctcaagtgaccctcccacctcagccttccaagtagctgggactatagccgtgtgccaccgtgtctggctaatctttttttaaattttttgtagagatggaggtcttaccatgttgcccagcctggtctcaaactcttgggctcaagcgatcctcccaccttggcctcccacagctctgagatcccaagggtgagccactgcacctggccttcacaatttccaatgtcaaatcttactacaaatttaagtaatcaagagtatttacatatggacagatatactgaccaacagagtagaatttaggctgggcacagtggctcacatttgtaatcctagcacttttggaggccgaggcgagcagctcacttgagctcaggagttcaagaccagcctgggcaacgtggtgaaaccccgtctccccatctctacaaaaaatacaaaaattagccgagcatggtggcatgtgcctgtagtcccagatactcaggaggctgaggtgggagggtcgcttgagcccgggaggacgagactgcagtgagccgaggttacatcactgcactccagcctgggcaacagaacgagaccctgtttaaaaacattatttcttagcctgtcttattgggggggggtctcttaattataaatacaataaaatatgtggttccccaatggttcctttttaaattacaatgtgagtttttttgcatttgtgatactgtcagtatagtacaagaagaccagtttatgaaggagacatgtaggtaaaaataggataatgtgaagagagaatcgctgcacttcagaaagctgattttatttcaagcagtttattaaaatctagatgcaccgtatgttctggtgttacttattccaatttccttttccttcattgaagccctcttaaccacaagtgttttctcaaggggtactggttttccttttcttaagttatagcgttcttcagaaggatctagccctttttaatctgttgcccaatttttggatcctactatccagcatgatgctcacctgaatgatgcgaaagctctcaattttcaaaaatggacttctgagtgtttttggaattcttaggaaaagtggtctttaaaaaccataagatttgaaggcagtctatcagcacgtagcccttagcttcatgtctatggtttgcagagagcttcagaatgttaaaatgagggtttaattttagggtctgctgggcctgaggttaggggtgtgattcttcagcagttctagttaggagaactagttaagtcctagttaagtcaatggggctaaaagctttttaaagatacatcaatatcattataaatcagcaatttgcaagagagttaaaaacactgctatcaaaatccttgtacctctttcctcagcttgcccaagaggaagggatattgtagttatttgttcactctcctcttttgataggctttctacattccattaagtattccctcctgaggatgctcttgggttagaaactgcaggattctgaatgactatgaattccttccttttgcattaggagcttgtcctaatgcttttctcagcatattttgtgaactaaactgttctccactaagctactcaatatttagctttccttggctcttgcttctagttccttaatatattgctcagtgttaaaacctctgccttttgactttttactgccataacgctttgaactggaaaggatagctagattcagatgccagctttggtgtgacctcgggcaagtcccttgctttctattggtcttcattttcttatatgtcatgttggccagtgatctttcatcattaaatgactggttttgttttaacccctggctagagtaaagcttggttgtatgaatgttgtcagccctaaacccccagttcctctttgtcaccaccaacctaaaggatatgaataataggataatcatatttattaatttaattttttttttttgagacggagtctcactctgtcgccaggctggagtgcagttgcacgatctcatctcactgcaacctccaccgcccgcgttcaagcgattctcctgcctcagcagcctcccgccaccatgctcagctaatttttgtatttttagtagagacggggtttcaccatgttggccaggatggtctcgatctcttgacctcatgatccacccgcctcggcctcccagagtgctgagattacaggcgtgagccaccgctcctagcctataatcatatttgtaataattgtactttatttgtgtagcactttacaatggcgaagagttttcagaaataaccatatttaatcctcacacagctatagagtaggtggcatatgacctggattttctatcaatttcagtttcagattttttgtcctgtcatccctttgagtgtccttccagtttttgatttgggaaataatgctaccataccggtggatggggcaacttttcccttctttccatttggacttgagcagactgagactcaagacttgatttgatttatactcactatggtagaagataaggaaccaagtccagaacacacattttacaaactccgagttctctgttctcaaaggaacatccattactcttagcatgatttataaaactgctttatcggcataattaaactggaatccatatgacattctttattccctagctgacaaaattagcacaggagatttactcaaatttgttattaaggctgttataaatgttcttcctttactattcagcttataaaagaaaaaagaaaaataatctgctcttttaactttgattaggatccattgactttccccatttgtaaaatagaaatgtaacttccaaatcaaaatttatggcattttaatggactgttctaaatattataatattttttcttgttcaaataacttgatttaaagcttctaattgaagaacataatagatatttctgaattgcatctctccaagcttatttcagaaggaaactcaaaaagaattgttccttagactttgactggtttacagttttaaaagagctgccaaattgtagtttactgatctaaataagaggaacattaaggttacacctgcagctagaagaaaagtgctggatatgtacaattttatgtagctggatctgcagaagatgatttttgcacacagagtaaaggcatctaaaaacgtgtctgctcttattcagacatttccaatatttcttttttaagcccacaagtctgattacctctgtatgtctcttgggagctgcaattttgctggaaagagattcagaacagtcagagcactcacataaaatagatagtttttaaagtctgtaccctctacggtagtaataaaatgacctaaaaatattctgaaagtctctcttatgacatagtggatgaatcattagcttatttatgaattggtgatattctgtgggaatgtttcaaaatttgctattccacaaagcgttcatcgcttgcataactccaggaaagtcattacaccccctcataaatagaagcttatataacggagacaaatgttgcttatattgatatatttacatacagatttctttaccaagcattaattttggtaagaaagtgattgtttttatattttactttcttggtctgtaaagaggctatcactttaaggccaggcatggtggcacgcacctgtagtcccagcgcttccagaggctgaggcagaaggatcccttgagcccaggaatttgagtccagcctgggcaatatagcaagacgttgtcttagaaaaaaaaaaaaagaagctatcactgaagagcagtgcttctcaaactggtgaagggccaggtttttgttggtggtgggtttttttttttgtttttttgagacagagtcttgctctgttgccaggctggagtgcagtggtgcgattttagctcactgcaaactctgcctcccgggttcaagcgattttcctgcctcagcctcccgagtagctgggattacaggtgtgcaccaccacacccagctaatttttgcatttttagtagagacggggtttcaccatgttggctaggatggtctcgatctcttgacctcatgatctgccagcctccgcctcccaaactgctgggattacaggcgtgaaccactgcacccagccgcggtggtggtttttaacatactacacatcacagatttttaggtggtgctaatgaaactgacaagtatgcattcacaccacatgtaactcaacagtcaagttcaacaacacttgacctcgtctgtaccctgctccatgagatgaattcattgatcatgaatttggatgtcatggcaatgtcaaattgctatagaagttacttaacacactgtccatatctatgcttgtgaaagaccatattttgagtagcactgttctagagcacttaatttttgaaagtataaatgtaaactcaaatcaagtgactcaggtcgggggaggataattaaccaaacaggaacacctgaaaatgttatttatgcggtttaatgttttgccagttgagtcaagttcaggcagaggagggatctattttctttcccacttggtagctctccttagcaattgttttagaagacaaagcatagaaatcattgtgttacaggaaggaaccagagattaagcggcagagccactgctgcctagtttaatgtctctcgcaccccctataattaaatataatgtatataatgtgataagtttaaaatacaggtttgcttttatctagaatataaactgtgatatatgcactctttatggggtgcattcagtgggggaactaattgattatactgtgactttcctattgtcactttatgagtttaggtttggaggcaatgttttgcagcaacaaaattgttcattgactttgaggctggatttaaattctgattctgtcaccagttctctgtggtcaaaaaggaagccactaataattttaaacctcagttatgtgatgtattaaatagttatgatgagacttatcttgtgttgtgaggattagaatgacatatgtaaggtaacagaatgtctgatgtagtaactgctcaaggaattataattgctattagtgatatgcattattattattagttattattatcatataccagtgtctctccttatttaataatctattgggttcctgaattgagataccaagaattcagatagtgagagacacctaggtttaggtcttcacatttgacactcaaggagccactaaatttttctgaagtattttacttcttaaccaaggtgataaagatcacctgatcacaatttatcctaacttttggaaagcatacacgtactttaatttgacatgcaaattaaaataatacattttgtactgtgttgtttgccctcccccaattctaaaataatatatcattcaggataaaaaagactacactttgggaggccgaggcaggtggatcacctgaggtcaggagttcgagaccagcctgggcaacacggtgaaaccccatctctactaaaataaaaatttaaaaaagccagaagtggtggcgtctgcctgtagtaccagatactcgggaagctgaggcaggagaattgcttgaacctgggaggcacgggttgcagtgagccaagatcgcaccactgcacttcagcctgggcaacagagtgagactctgtctcaaaaaagagcataaatatctaataaatgatggtggtactagtctgtggtagtggaggtatcacagaatggctgtagagatgaggagggctaaaactgtgaaaagccttatatggtatgttgaaggttttttatactaaggtttttgatttggaagatgtatcaatcagggtctgcctggtcagaaaacataaaccctctagttatttcaaacaaagggaatttaatgcgggaaattggttactcaagaatggaagtgctgagaagccacacacacagcatgaagtttctgttatacctagggctggagggacaatgacaagaggtggtatcaccagagccccagatgtcatgggcatcaaggcggagttggaacctttggccagctgggaccaatgagggaggggctccgagggagctggagccaggaaggagacacagttagccagacctattgccggaggtagaatgaaaaaggaagtacgcccggcttctcctttccgcctgccctctaggcttctgccagtgactcctattggccaaacttacttggaagccaattggtaagggagcaggaaaatgtactgtaataaacagcagagcagagaaaaggcagagaaagtatcaaaaaccaacaagcaaatgattgaagtacaggagatcccatggacagtaaggcaaccaaccctctatgcagatatttcgggaacaagaaacataaaaaaactaaaaagctttcataggagtttgaggtgacatagataagataccagaaggacatcctgggttcaaaggaaactgatcttaaaggagaggaggtagcaattaaaacaaattatctgcagagaagtccaaacactaaggataagcttccatgcatttgatgaaagtacttgcgacgtttacaggtgtttatgctcatgactctcaagactaaatacagacataccttggagattttgcaggttcagttccagaacacttcagtaaagcaaatatcacaataaagtaagtcacacaagtgttttggttttctagtacatataagttatgtttactctataatgtagtctagtaagtgtgcaacagcattatgtcttaaaaaacaatgtacataccttaatttaaaatactttattgttaaaaaagctaacgatcacctgagccttcagccagtaatgatccttttgctggtggagggtcttgcctcgatgttgatggctgcacagcatggtggttgctgaaggttggggtggctgtggcaatttcttaaaataagacaacaatgaagactgccactcagttgactcttccttttgtgaaagatttctctgtagaatgtgatactatctcatgaaaccacttactttgctcatccataagtagcaactccctatccattaaagtttgatcatgaaattgcagcaattcagccatatcttcacgccccacttgtgatttcaattttcttcctgtttccactacatctgcagttacatcctccactgaagtcttgaacccctgacagtcatccatgagggttggaatcaacgtcttccaaactcctggtaatgttgatattttgacgacctcctatcaatcacaaatgttcttaatggcatcaagaatcacttccagagattttttttttttttttttttgagacacagtcttgctatgttgtccaggctggagtgcagtggcgtgatctaggctcactgcaacctctgccttcctgggttcaagtgattcttctgcctcagcttcccgagtagctgggactacaggcgtgtgccactacgcccggctaatttttgtatttttagtagagacggggtttcaccattttggccaggctggtctcaaactcctgacctcatgatccacctgcctcggcctcccaaagtgctgggattacagccgtgagccaccacacctgacttccagagattttccatttactttgcccagatccatcagaggaatcactgtctatgtcaagctatagccttacaaaatatttctcaactaataagagttgaaagtcacaattttttcttaatccttgggctacagaatggatgttgtgtaagcgggcatgaaaacgtgaatctctttgtacatctccatccaagcttttgggtgacaaggtgcattgtcagtgagcagttatattttgaaaggaaacctattttgaacactaggtcttacagtgagcttgaaatattcagtaaaccatgccgtaaacagatacgctgtcatccaagctttgtttttccatttatacagcacaggcaaagtagatttcacataattccttttttttttttccttccaagacggagtcttgctctgtcacccaggctggagtgcagtggtacgatcttggctcactgcaacctccacctcccgggttcaagcaattctcctgcctcagcctcctgagtagctgggattacaggcgtctgccaccacacctggttaatttttgtatttttagtggagacggggtttcaccatgttggccaggctggtctccaactcctgacctcgtgatctgcccgcctcagcctcccaaagtgctgggattacaggcatgagccactgtgcccggcctgatttcacataattcttaagggccctgtgatttcagaatggtagatgagcattggcttcaacttagtcaccagctgcattaggccctactaagagatacagcctgtccattgaagctttgaaggcagtcattgatttctcctctagagctatgaaagtcctagatagtatcacctttaaatagaaggctgtttcatctatgttgaaaatctgttgttcgttgtagccaccttcatccatgaccttagcttcatctggaaaacttggctgcagcttctgcatcaatgcttgctgcttcatcttgcaccttaatgttatggatatggcttgtttccttaagcttcttgaagcaacctctactagcttccaacttttcttctgcagcttcctcatctcttttagccttcatagaattgaagggagttaaggttttgctctggattaggctttggcttaaagaaatgttgtggctagtttgatcttctattcagagcactcaaactttctccatatcaggaataaggctgttttactttcttatcatttgtgtgctcgcagggtagtacttttaatttccttcattaacttttcctttgcattcacaacttgactgtttggcatgagaggcctagctttcagtctgtctcatctttcaacatgctttcctcactaagctcaatcattaatagcttctgatgtaaagtgacagaggtatggctctttcttcccttgaacacttagaggccattgtagggttattaattaccctgattttaatattgttgtgtctcagaacaggaaggccagaggagagggaaagagatgggggaacagctggtcggtggagcagtcagaacacgtatgacgttgatcaattaagtttgccatcttatgtgggtgtggttagttgcaccccaaaacaatttcagtagtaacatcaacgattactgatcacgattcaccataatagatataaaaataatgacaaatttgaaatattgagggaattttcaaaacgagacacagacccaaagtgagcacatgctgctggaaaaatgtccatagacatgctcaacacaggattgccacaaaccttcagtttgtaaacaatgcaattttcacaaagtgcaatacagcaaagtgcaatttaatgagatgagcctgtaatgagcctctttaaagcaggaactgtcttcctcatctttgtcaccagtgcctggtgcatggtagcctctgaaaaaataattgttcattgaatgaagcacagtagagcaagggagagtgattttgctcgggaggaaaacaaataccactcaagaagatggaaagatacagatgagggttttctaaggcggattattaaactggcaagatggaactctggagagatggagttctttccagaaagtagaagataaagcctcaaagtaattaaaatagggaatatcagttaagttgtagattttattggcaatttgttatcttagcaaaaccaagtgaactgctattctggaattaattttgccctaaaaggaataattaattgataaggagaaataagacccgtaaaaagtgtcactatggattcagaatttatatgacaaagaaaggaaacactgaacacaatttgatgtgctgatggcctcgttcgttcattggtttcctgcttcagtaaacatttaagagcgtgccatgtattttcaaactttagggcaacaggctaaaaatatcaaggagaaaaacgtttactgagggtatagaagtttttatgatcttacttttattgaacattaaaacatggatgttcattctagaaattttagaaggtgaagtgcaaaaacaaaatgaaaatcacctcacatctcagtacccagaaatagccactatttacattttaaaagattgcttccggtcttctttcctatgcatttttatatagttgtttgagataatagaatgtttaaagtgttgtatcctactgtaatcataagtcttctcttattcttagttcctcagagatgttatttttcgctagttgcagtttattggggtaccacttttgtaaaaaaatatttcccaatttttgaaaattgtgacaaagaaaagtcaaattcgtgttgaatttatggaaggaaatctttaagaatctggaggcttattactaacaagcttctgagaagaaagccaagtaaagtgttataataccttctgtccaacaagctacttatgtataagtgatgttacagaataaagtcagtgtggtcaaaaacagacagtcagttatcagaaagttgataagtaacatttatcctatgaaaaatatagctatgaatttaaatcaatagttttctaccacaaatatcttaatggataaaattttctttaccaaatatgtatggtgtcaaggtgacaaggcaagtatccttgtaaactttccgaattacaggaacaactttgcccttcttagcaagcaattttatacagaaactcaactttatgatgggtttctgtaagttttaatttttataataactgatatgtaaatatttagttacctttaacttatctctccaggtagaatggctagcagactgttttatcttctcaaaacatttgtgtgtacagttcccatgttcttttcaaggttcttgcttctaactgtcagttaaggcttttgtagcctcttacttcagttacattttctggccaagacgcaattaaagaatatagagctgataattatttccatagtcgtttccaatttttctactgttccacgtaagactttgaggaacacctttatgcataacacctttctacatttgattcatgtaagtggaatcactgagtcaaatggtgttaatgtttctaagcttcttggaatgcactgcctgaaactttctcaaaaggctgtagccatttacactcataatacttcaaagtgccaatctaaccatgtccttcccagcatggagtattatttttacttttgctattgtaacaaggaaaattaaaccatctcattgttaatatttgtgtattttttatttctagtgaccacaaatgttttcttttaaatatctgctgggtgtttttcttcttttttgagtaatgtgaaaacaaaacgaagttaaccaaacacaactcttccaaacttttctgatataatacacacttttttgtgtgttatgttgaggggctctagttggtaacagcctcctggttacataaatactgtacagtttaattttttttcagctaaataagccttatccctttatccatccttagtggatctattatctacccattaaattaaattttattctctataccaactcctgtttcttcacattttttaaatatatgcagagccctaaattacagtggctgtcctaataaaaggctattcagttattaacagaaaaggaagattgcttcctgcctcttgggtgaggaagactcatgtataccatagatatggtcagtttacatttacagttttctgtgaggcattgatttttttcccccataaatatggagtacttagaatgttcaaaacctttctctgggtaatagaatgcacaaaagtataaggcatgatccctgttcattgcccaagctggcgtgactctggtcatgcagcggacttcatgatgtgatagaattccttgcctatgagagtgaaggagatggtaccaggtctacttgtggccggtggtggaacacttacattattctaagtcctttctgtctgtagaacccaaatgacaaccatattattttatcttctcttattgctagtggtatcgtttattaatgccaacgtatacccattttgcttttcaaggttactttagatgtcttaggttggaatgactgaaggcttatacattcaaatttatatatgacacacacacacacacacacacacacacacacacatatcttattgttgcctgctatctttctacctgttgtataagaaatcctttgaaaaaagcctatgtcagcttcacaaaagatgttactgtgttttgggggaaataaaattgggaagtaataaaacagttaataaatgttacaagaccgtgtacaccaacttaaataagattaaggtcaaacgtatggtaccttatataggtaggaagagcagtattaattagaataattagggagagttgtttggagagtggaaaaaaacattgttctaggaagaaattttgtaatactcaggtaaagtaaaatgtagggccaagatattccagatagtgtagcagcataaacaaaggtatgaaagactggcttgtttgcgagtcagtgaagacattgttctctgagaatctactccagatttttttttttttttttttttttttttttgctttttgagacagggtctcactttgtcgcccaggctggggtgcagtggtgcgaacatggctcactggtgccacaacctcctgggctcaagtgattctcctgcctcagccccccaggcagctgggactacaggcacacaccgccatacctggctaatttttgtatttttggtagagacagggttttgccatgttatccaggctgttctcaactcttgagctcaagccatctgcccatctcggcttcctaaagtgctgggattacaagaatgagccaccgcgcctggccactccagatttttaaaagggaaatctgattcagtgcccctggggtgaactaagtgccttaaattatagagtgagaaatttacattgcatttgattggcaatgggaaaaacattgttaaatcttcagaaaagagaaataatgaagtccgtcttctgtgttttggaataggaatttggtgggtgagtttaaggacagttagagaggggagagattatttcgttttgttttgaggtaattgacatgatgagggtcttaggatagcaatgggggaaggaaaagggaacgtgactccagaggtttttcttaacaaggtagaattgccagaaggtaatcacagattggacaggttttaaagaaaaagggagttatatgtcttcaaaatttgaaggcgtggtgacacagagaatggtgataccattgaggaaaagaggaaattgcaaactgagcggagcaacagggaatagatatgaatttgattgaattacatacttatgggtttatttacaatttctcttcttagaaaaatttatttttggtggctcatataaatgtatgtgctgccataccataagcatatatttctcattaatcctttcaaaaaccctgtaaaagatatttgtatctccattgtgcagatgaggctcagagaaaataggtaattttctcacattgcaaagcagggatttacgtgtacttttaactcctaaaccagcgatttagcccctcagctatactttcttcctgagaggggacagtggcattttgaagaggaaatactctaaagccatttgaaaaggggaaccgaagaaagagtttggtccacagcatgataaaaatattacttgcacttttattatactttataacaagaagtacaggggcagagaaaggttcctaacttttactgagcaagtatatatccaagatacatctcctctttggagcttttgagatacactatctctcttagttttgcaacagccctaggaataggtactattactgttccctttaaaaatgaacaaaaaaaaaatgaagcttaggaaagttaaggttactagaccaagcttattgggagaccatagtgatgaagaggaagggctttagggtcaaatggatttgaattttacttcttaggcctttggtttccttatttataaaatgggattgaaataatgatatcacagttgaaggtaattatatgagaatttatgttatttattgcaaacatagggtaagcacctaataaatgataacctgagaatttatgttatttattgcaaacatagggtaagcacctaataaatgataaccattattactattattttacagcaaagacataaatagagcccattaagttttcttctctacccagtagtttttccattgtacaatagtactctcctgaaggacagcgggtgaagctaagaatttggaagaaatcccagatagagaaatcttgaaaagaagatagatagatttaatactcaatcattaaaaaaagtgcacatgactttaagaaatcaaacattgtaagaggatagtattgaaaagtaagtctccaaccactcttggtatcaatcccctaattttacttcctagagacaattaacagtatagtttttatgtttgcttctgtaaatatttttgcatatacaaacatacacataaaaatatgcccatttttgcacattgagagtataataggcacaatgttctgttctttgatgctattaccttttacataattaacctggagttttttttttcctgtagcgcaatagactgacagatggtgaatgaaaacttgcactatggagagttatgtcagtgttttaataagacaggaacccagaaataaatgtacgaagtttaacatcagcatctcgtggcctttaagtcaaattggacaaccattcaaagcttcataaatgctaactgcttctcatgacttcagaagcaaacaaaaaaatcattattcaaatgggaaattaagctgatcatcagaagtacagagaggatgtcctttcttaaaggcggcacgtctaagggagtgtctgagacctggcttcttcattcaggatggaggctgctgctactctttaaaagaaatgttcacatccttacttcctgacttccttctataacacagtctgcttcacaacactatgactttatatgtcagagcgggttaggaggagctgaatcttaaaaatttaagaagatgccaaggtctagaaaccactcttaacaggggaaaattagaccctgcttgcttttgggaaaatttgttttccagtcagatgtttgtcaaggttaaagaaattcacgggccctctgttcgaattgggagcaattgggagcccttaagctgaatgagtagacttgaagtcccacttagaatgagcctttatatttttgttctgtggcttgctcagggaagggatacacacttggggagaaaaagacttggattctagttgatgtttttctcctagctgactagggaattcagaacaagttactaagagctttctagtccttagttctctcatttggaaaatgaaaattttaaattagagattctatttctaaggcaccatgtatttcattttcttaataaaaagtatatatattcccctaaagaatactcataagaaaaaggtagagttaaaatttcccaaattatttaattcctggttgcccagtaaccattaaatttctcagcagtcaggcaagaaccacattcccaccttgagacaagatttaggcctttccaaacttaccctcgggctctgttccaagtttatttgtaagtcagttgcatacaatttggaatgaaatgtgttataaatggtggttaggtccctaagtcacagaatcttagttaaccctcagagtgcctgatatactgcaccatgtaaatagaaagcagctgtatgtttctatgggagcaaaaaacttttgtaggaaaaatggtagaaactcgtactgcaggtgttgattattcagcaaacttctctagataaggaggactgggaacttcatcattattggtctagttacattcctggtcactccctcatcccattgactggtcagtttccctccctgtggtccttgtgcaagggtttctgcctcaccccataccctctgctccttgcccggtatcatggttcttctgagggtactactgcccattcacccttgtgctaattaggattacactgggtaaggaaagacatttgttctgtagcggagaagcggggaaggccatcagaggctttgagtgtcagaaagatttggtcttgaatgcaggctctgggatgcaaccgtagggaagttaccaaacatttgtgagcctcattttatctttaacaaagctgataatacagaactcagggccttgtaaggactcgatggtatcaggtacacacgacatttgcccttgagtgctcagcgaatgttagtattccttctgccatcggcctgtcacttccgtttttctctttggctctacagggaatacttgcatacaaaaagagctgaagtaagagtcacctacatcttaggaaaaaagggctgctttaggtttatcctcaagtagttttgtccaggattctgaggagaataaaagctgggtcagatccagtgtgttgaaaagaaagctgaggtgagaagtgagagaaacagagaggcagagaaagggggaatgagccctgtctgctatgaagtaggaggcaatccaaaagacaaggaatccgtggtcattgccactgagaggagaaagaaggcaaactcactcctgtgacttcagggccatccatgaggtgggcagaggaactcagagtctgcccgattcttggattgaatcttcaaattggtaaagctttatatcaagcaactcccaaatgcagcatagttttgaggtgataaagaagagtcttttcaaggctgggcacaatagttcacgcctgtaatctcagcactttgggaggccaaggcaggcagatcacttgaggtcgggagttcgagaccagcctggccagcatggtgaaacctcatctctactaaaaatatgaaaattagctgggcgtggtggtgggcacctgtaataccagctacttgggaggctgaggcacaagcatcacttgaacccaggaggcagaggttgcagtgagccgagatcatgccactgcattccagcctgggcgagagaatgagactccgtctaaaaaaaataaaaataaaataaaaagagtattttcccggagtaccggtaatattggttccagattcaaatgtattgtccagatacacagagggtaaacaggaacgcttcaggcatcctttattaaaagcacctcagtctatgtcagagggccaggcagtccattatctaatgaaaatctcctaccattgatttattttatcataactgcagctgctaagtaattttgtttaaggaatgatttacatattagtgtcttcagcaggatctcatcattagcatctagtctccagaaaagttaacacataacagtgaaaagaaaacattctctatcacatgcttctgcatgcatgggcaatttgagtcataccacctgttcccctcttctgttatgctagagtatacaaaaagcagagatacgcatagtttactatgatcctagatgcttaaatatcttgaattgtgttctatcttggactcattattcatgcataaagactcaacagattctcttcttgcacctctcaaacagcaacatcaacaaaacccaaacaatgtatctttcctaatgaggtgaaagcatgcataccagcctaagacagaaatgttgcaaaaatgttttttgcaagaaggtcagtttgcttttcccatggtaactaaggttaatttctactgtggttcattttggcatccattttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactgtcaaaacatatgattagttgaagttaccaaaactatttttttaaataacatttatcttaagagctataaataaagaggaaattttgcactagagatgaagttatgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctcacgtcatttctccaccgcaaggaggattgcgggggtggacgatgctccctatttagtcttctgcattttgttgcttacagttcaattaacatgtcagttagagatgacttttggttgcagttaataaaatatctgaccaattgtatcttaaacacagaggagttgatattttttgtagaacaagaagtctggaggcaggtagttgagagctatggaagagttccgtgatgtcatcagagacctgggccatggtttattctgctgtaccatttttaacgagtgactttggtcctgatggttccaagacgactgctgcttctcaggcaggaagaaagagaaaggacgttcagcctcagagtctctttgtctttccatttgggaagggaaatcctttcttgcagatatcttctcaagcattggccaaaactgtgtccacacagcttcccctggctggatcagggaattgagatcctccagcctttgtagcagagaaagaccaaggagaaagaatttgggaaggggtgttgagtgagccaacatacagttatctgccacaattaaatacagcggattcaccttgcaaataagcattctttttagaccatttattttctttctctctttgtcccaattcctttattccttaggaaagtcttgatatctttgtgaggtgtgtttcaaaaaagaagctccagctcaggttgtaaggagtaagcaaaaataataattccagtgattcagccatagaagtggaaaattatattatttgaagaaaaattagatgtaaaatcaatgtcatcgacagcttaaacctggtaaaagcaaggaagttcctttcagaatctaattttattccaaatacatttattgagcaccatcatttattgccctagatgccaaggataagtgaacacaacatgacctcttcagaagtctgcatttttctcatcttttttccctcaagtataagaatgaaaaataaagctatttctaattagttacatcagtcatttctatcagtattactatagattttatttttattgtatactggatatttaaactaaatttaagcctttgtgggcttagaaattactgtttcatgagtaacatggcttatgtaggaaatttccaatgccattaaccttaaaaatgttcattggaatactgcttatgtcatcttggaaactacctttgcggttgacatataaactgcacgatggtctattttcattatatgtttctgtatgtacataagcatcctcatgataaagattgtctacttgatcaaacttcagccagactcctgaaccttctcctaggcccacctgtgcacttctttgtaaaaatccagctgtagcgagaatcctgctaaatcagtttagcaagaaccaccttcctcttatgtatctgatcaggttcctcatcctccaccatcccccatgtgacgtctgatcaccctggcctgtgtcttcagcaaggttcctgttaagttttttttagctagaatcccccttacccccatgctttctcttagtagttttccatccaccaaaccccaccctgctccttggctatcaattcccacttgtccatgctgtattcagagttgagcccagttctatactgaggtctctttcccactattgcaatattcctgaataaaatctgtttttaccactttaccgtccatctctggtttttctttgacactcacataaccagagttttgtatgtgtgtgttgcttgacacatcacaaatacctgggatacgtgtactgattttttacagggtgaataatctttttgttttccccaatatcttagaaacctgaatctttaacccctgggcttagtacacagttaggcatataataggtgcttaagtaagcgtcaactgatgattttaaatgcagaagtaattgtcacttaatgaaatatagtcaggagactcatggattttggcctgtcttcctacctgttcttgtactgcaacagtaagtgtattaaggcaatatttttggcagcacaatcatttagtttgaatgcattagtaaaaggtggagtccaaagaattaatcgctggaaagttttgggaaaacccagtaacaactgtttccatagagtaatttgagtgacagccaggtaatagctacttattggagggactccacagtcagagccttgacagggacctgaaaaagagtgtaactgaagggtaaatgtaaaagcttttgggagaacaagggagtggtcaggctgaggcaaagatctgaaaagaaatgcctcctggggccaagctggtaatttgaatgactgaaggtgactgggtgggaactggggcaacctgaaaagcttctgttagggtaacagagcctccgttgcagctgactgttctatgagaatgtgagtctctattgtcaggtcttcaggttcttccagagaagcaagacaacgggaaatcaccagatttttaactaatggcgtatcattcaacaatttcaaaaaccattatgtgagcccaaactgaccaacgaatcaaacacacacacacacaaaaaaagagtctgcagactaaattcaaccagttggtgacctctggtctgtggttaccagagaagtaattgaaatggagttttgggagaaagatcatatgttgaaatcttgggagataagggcagagaaataagtaagccgagacggcggtaaggccaaggtagaaaaggtagcctttaggaaaattaagttaagactttttaaaacaggaaggggcaaaagatgaggttaaagcagatgaggaaatttactgttatttattttcatcattaaaatacgctttccacaaatttttcaactgtaagagagagtgataaattcaaaataggtaatgtcaaccatattatgaagagtatgtttttgcaatccaaaaaagctaaggcacaacattaaaaaaaaaaatctgtgaatttggctttgcaaaggtataagaattaagtcacatctgatcatttttagagtcttaccttttataacaaagaggaaaatttaattaaactggctctgccctggcgaatctgggatgtgtgttcacttatgaagagagactgttaagattcgttaattaatgaggttgagaatagagttgaaggagattggggtaaatttataagtttgtgtcattctgagagttctgtaagtagctgagttacccatgttgtgactgagaaaaacaggagagagcagtgactgaaggttctgagccaaaggaggagaatagtattgtttattccagcagccagagtggcctgtgtgactgtaagtcgcctgtcaagagggagactgcaaggaaagtgcattgatttgatttggagtagttgtaactgcagcatgaagaatatgatatatagggatgataattgaggaacaatttaatggctgcataccttgctgaagttgaagttccttctggagataaaggtggcaaaaaagaaagtgcttaggtagaagagctttttaaaatgagttaacagaaaacagcagactaaatatggaattgaggagtaggaaatgaaggaaatgaatttgaagatttactttctttcaggatgcagagctggtatgtaatccctctgtttccagtgccttctcccacttccaaatttcactgctcctcatgcgccctggtgtgtggtgcagcttcgagattaagcctccagccttctgtcaggatgaagcagcaggtggctgagatgctaggctccaagtgggggaggtgtttagggctctaaagactttcaaccagtccttgtattttcagccacatttcagtcttcagaggaacctggagcctttcatttctgagacttcttggctacataaactggcatgcgtcttgttagttcctcccactccctgccccaatctccttgtctccccaacatcattaattgagcttgggatttctctggtctcctaagttggttaccagcaggtcattttctaagccaccaaaatactggagctctgatctgttctcatctcctctcctgttttgttaattttcttttgggtaaatgccattttttattcctcttctatcaacctggtagagtttcagggataaagagagacaaatgagtctgctccatctgctgtgtttaactagaagtcccaacacccaaaatccttcacacgatgtgcagggctctgcagtgggcctccccctgcctacctgtcaggccttatctgtgcccactcttcctccttcctctctgagatttcagcaatattggccttctaaggattcttaaagccccaccttcttctctgcttcagagcttttttttttttttttttttttttttaacatgtgctgacctattacgctgctgtgttcttacctggcacgctcccatcatccttcaagtctttgcttcaatgtcaccttctccaagaagcctctcggacctatgtttccctatgtatacagtctcatcacttcctgtgtgtttccttcaccattttaccacagtacatatgaatatttgtttgttagtttgtttgagacggagttttgctcttgttgcccaggctggagtgcaacggcacaatctcggctcactgcagcctccacctcccaggttcaagcgattctcctgcctcagcctcccaggtagtagctgggattacaggtgcctgccgccgcatccagctaattttttgtatttttagtagagacggggtttcgccatgttggcccaggtggtctcgaacttctgacctcaggtgatctgcctgccttggcctcccaaaggctgggattacaggcgcgagccaccgcacctggcctacatatgaatatttgattattatccatctccttcgctacactgcaaagtcaataaaggcagagatttattttggttaccagtgtattccatgtacttggcatggttcttggcttatagtacatgcacaataaatattgaaaggatagatgaaaggattatggatagatgaatgtcttttaagcagttataaaacagttctgcctaaagagtcttttttaatcagtagtattacttcaaatacatatttaaatacacatatgttataaatatataaaatatgtatttaaatatgtcatttgtactattttaaatgtatttaaaataatatatgttatatattaaaataatactaatgatttttaaaagatcaggcaacactgctttgtagctttttagaagacatttatccttatggatccataattattatggattgtatgttttatatataatgaaggttttgggagttagagccctgatccttccgctcttgaagcttgatttaaaggagcatggcacagtggtgcctatatgagtcagccctccattatctggggcagaattcaggccccagaaatggtacttaagatacacagttctcccccagaaaactttatatcggccatttgttacagaaactgctttctcaacaaaccttttaccagggcagctaacaatgagcaaaactaatttgaatttcaactctgccattattacagtgttgctaagaagtagtgagattctgctgaggaaggccaagcaagaggagggagccagaaatgccttaaacaatccacagccaggattttgtgctatcttttatttcacagttgaacttctcagtattttttggttcataacctttttctcttttcctcaattctgagtcttccacatttgtgccatactaggtactttattgcttctctcccttttttttttttcttgagatggagtctcattctgtcgcccaggctgaagtgcagtggtgcgatctcagctcactacaacctccacctcctgggttcaagcaattatcctgcttcagcctcctgagtagctaggattacaggtgtgcaccaccatgcctggctaatttttttgtgtttttaatagagacggggtttcaccatgttggccaggctgctctcgaactcctgacctcgtgatccgcccgcctcgacctccataagtgctgggattacaggtgtgagccaccacacctggccctctccttcatttcttagaagagttttacaaagtcattggtgataaataagtaataccatttcacatctggaaacataacttgatagtaattataaattcacagactgtactttctgtacttatctaagtatgaatgcataattcctgtttatctgtgtgtaggtttatttttcccccatttaagtaaagctctatgttgatgatgaggtttttacgagttgagattttaagaggcctcaaatatatctaaaaaattatagaccaagtatgatgtgttagtgttcctcttctctcagctaattctttaaagatatgttccagaattcctggtctgttcttgaagatctcccaataattctagacttctgaagcctggatattttggcttaatttgctttcaagacagactggatttaaattactcaatttgtctgaagtctcattaagatccaaggttcttgtctgttctagtgagtttgagctggcaagaataatacttgtcatctgaaaagtccattagaatcctttggaggagtgagactggaaaattggagacatattattatattttaaaatatgccacctttctataataggagtatgtggggagactgccttgttttggcttcttgggaaaatttggaaaattagtaaaataggcaggcagtagtagttcaatgcgtattgtatgccaaacactgaatttagaacaatactcccccaaaagcatatgtgctctaaattttatttttcacttaccacctgggagatttggattaaatttcttctgggaaatagagttggtatgaagaaacaaagaccactataccaatttatctgttggaataatcatttagccgtacagctctttccactcataaagttaatgaggtcattattgttctttctagctaatagataggcatattgaaaccttaggcctttccaaaaagtctccataagccattggaaagatagactaaaacactccttgttttaaattctagacctcagttcagtcagagatagtaggatttttgcagtattattaaaaagacagaaaccagctataaaattgaaatgaagggacttaatgttttttttctgtaatatctttggaatgcttccatggctttaaaatgctgaggtgtttctcactatttttcaaaagcatgtaacatgtagatatgtgacgcaaacttgaccagttgttcctcttttctggtgaattttgacacctgctactattacacagagtaaaagtgaaagtcataaaacagaaatacttaccaaagtcaagaaaaatgcatagactaaacaaaggggcaagagaagcctattacttgtttcatgtttcaaaataaaagatgaatggcctatcacttcagtagttggaaattcaacttgagaaggtaggtggtttgatgtttgcccttgttccttacgtttctagatttctctatttataggctagaaccagccctggataaaataatacaagttatgaagagaaatgtgcagttcagcatttttacccttctgaagtgcgctttctcccagctgccatggaaacatggcgtaactggtttcttggatagtctcactcctcttgagttccggctgtgagagctagtgagctcattacaacttggatcagagtcctggaaagtcagctcccagggaaagtggaggacagtctctcatggggcacgggaatggggggctttagctttattaaactgcatacatactttcactacacagtcatcccaagctttagcccaggacagtgtcacattgttcacagctgtattgcatcttgaggtttctgtgtgcatcctacacactttcctaaggcagagacttatctcttccagctgtaagccggagggagtggtgctgcagactcctagcaacacatgcggactcaaacaacacaggcagttaactctcttgagtagtagacttgtagggcaccagaactccgttgcagttcactgacagttaccagatatacatttgtatggcttccgtagcattgtgatggaagctaaacgtttgccctgctactttcttttttttttttttttatttttttattttttttttattatactttaagttttagggtacatgtgcacattgtgcaggttagttacatatgtatacatgtgccatgctggtgcgctgcacccactaactcgtcatctagcattaggtatatcacccagtgctatcccccccactccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccacaatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccgcattgccaagtcagtcctaagccaaaagaacaaagctggaggcattccctgctactttcttctggtatgcctgaatcactgtttgagaatggattggactttggtgcgtggaaaactggtagcagaaggcttattcactgcagtgggttgggggtaggctgaaaagatgtcagggaggattaactagaggcagaatgtgtcatagttagaagtatttagaagggaagaaagtttgaactctgatactgttccacactaatattcatgccctgaaagaatcagatcattcttgcctctcccacttggatctctagctactggaatttgccaattcttgatatgaacgctaagatttggatggagcttgtgacctcatttagaccatttgttctaaatgctgaatagaaccaggaaaataggaaaagagggtagaattggggtcataagagaggaatcgtcgttctttgaaagaagaaagatgataggaaactaggcacatgagttacgaggcagtggagaaggaggattagaaagggaaaaaaagaagagaaactttatgccaatatcttctacaagatgtttggctggcacaaaactaacactcaatacttttgcataagtaaaggaatgagagaaaatttgggattggatgcttatcccctggaaactgctacaggctggtgttaatgggaaagggatctgtatttgaccaaaagtgcatttccacgtctctacatttctttttataaagagtcaaagggactcaatgatgagtgtgtgtgtaagggaactccacactagcaagtacaggaaaaatttgatggtactggtgaaggatgttgcaccaatctggaggggaggacaggaattggtttctcatggattgatgccgcaagacaattcataccatgagttggctgagaccacttaaaaaagtaagcagtgatgactgggcaaaagagacaaaggaagaaccacatcttttaggggagagagagagaaggacaattaaagggactcaactagatcaagttctgctcactaaaggacagcgtccaggcaaatgttaattatcttcaagaagcaatctgtatatatagcatttcaagatactccgagatgcttttaatttattgaatactttttattggtatttatcataaacaagagactcacaaatatatcccagaggggaggttttggtgtagttgactatagtagttattaaataatctattaataaaagcccacaaaatggaagatagaaagatagaaaaacaaaagacaacacaggatggtgttggtatacagaatttatacttgaagtttaacaacacggaacaagaaactttattaaaatattcatttaaagaacttccatatgaatcaccagaggctcttagtaaaatattgattcggattcacagatctgggtggggcctgagattctgcatttctcataagctccaagcagatactgatgctattcttcctcaaatcacactttgactaacaaggactcacacaggttctctgtaattggtgttggtagtcattcatggttagatgtagttgaggactgccctcttaactacctctcggctgccaggttataaagaaagcaagtctcagtacaagttctgtcacttaggagcatttattagccaatgggtacaaaacaatcttacagcctgtgccagagacacagtgaagtcacagttctgtcttttggggtgcttggtgtgagaggctcacagtctacacaggccacagtcctctattagagtggttctcaaagtgtggtccctggaccagcagcatcagcatcacctggaaacttgctagaaattcagattcccaggcccttcccatacctactgaattagaaaatctggaggtggggcctaggaaatctgcatctttaaactatccactccaggtgattctgatgtttgctcaagtctgaaaaccattgttctagcagcaggattccctcaaccatctaactgaattctggcaactaagaatccggtgaaccacagctggacattttggaattcagcctagggcaccatttctaaagatggagaacctactggattcttcttaaactcaatttaaaggcagggagtgtttctaaatgtttttcaacaatcttcatattttgcaaaccactaatatcactacacaggcccgtctaactattaattaggaaaattaatgaaacccctggtgtaataagagctaaatataactgaatcacttacagtggccgcctgtggcatgaggctttttgattaattgctagccaaccacccttggagttcactcctgattaagacaactgaccacctctacagtgtagcttaagctaacacacacatacatcagagtgtactgttcatgtgagggtttttaaagactcttaaaatttaccttatcagggcataatttaaacactataacatgtttccattttaagtgttcaggttagattttggcaaatgtatacactcgtgtaaccaccatgccaatcaagatataacatttcgatcacctagaaaacacccttgtgttcctttgaggtcagttacctactcccaccacaccccaggctaccatctggcatagtagctaagttttgcctgttctagaagttgatataagtgaaatcaaacagtatgtactgttttgtgcctggcttcttttacccagcttagtgtttttcagatcagttcacattgttgcattatcagtagttagttcctttttattgcactttgcacagtagtatcccactgaatgactttaccacaacttgtttatccattaccttactggttggtttccggtttttgactattatgaataaagctgctatggatattcatgtacacatctttttgtggacatacatttttttttattctgtgcaaatatccaggaaaagaatatttgagtcataatatacatgtgtgtttaatttcataagaaactgcctaactggtttcccaaagttgtcgtacattcccaacaagcagtgtctgagaattccagtcgctccatatcctcaccaacatttggtattccggtcttttaaacaaaattgtatgctgaatagtttaaattacagacattgttttctttcccctagttgaaattcaggcttttatgtttggtctctgcgatggccataaagctgaaaatgttgacccaagtgacttggatatggattgaattattgccctttcctaacacctcatcagaattggtttcgtaggtgtcatttgattatggcagtcatgtatgtcagtgtactttttctttctttcattcttttgtttattgattcagttggtcagtcggtccatgatctgtattaaaacagctttttcagagggcagttgcatattaagttgctaggaaaaatgacagaagtaggtgacagagttcttgtcttcaaggagctttttggagctgagttcctgaaataaatgtagcccagtatctatcaaggcttgtgcagacttgagtaagaacatcatctaaatatagcttcctgctaggtggcgtgagtcagggcttgatagaccggtgactgcagaaaccacagtaacatatattgttgttattctgtgctgaacattagaatgattgtaccttagaatatagagccaaatgtttattttattcctaattatatttttaaatacatatcacacacatagacacatatgttggataaaaaatactcaaaatgttaacagtgcttatttaaaaggtttatataaactttttttgtagagatgggatctcactatgttgcccaagctggtcttaagctcctggcctcaagcagtcctcccaccttggcctctcaaagcgttgggattacaggcatgagccactgaatccagccagttgtgcctatttttgagtttatgggcttgtggatgatttatttgattatatatgtatatgttaaatgtctaagttacccaaagtgagcatgtataacttctacagtcagaaaaaatgttatattgccacttgattgtttaaggtcttatagctatttaaataatgtatttcttgttctctttaatcttgtgcagaaaagattcactacagtagatccagattactttctagaaaaaaataatgcctgtccatctctttcctcttgggaacaggactacatgaatgcccttcaggctataccactttagtcttcacagaacttagccttcctggttgtcaaagggcaaaaggaattattttttcttttccccacgttaacagaattttcacctccgaaagcttggcgtatacacactatatgttttctaggctatttttgtggtggttgtagttattggcaaatcactgggcgtcgggggtgggttgtctgttatttctgatggaataacaaatgctctttgttttccctcttttcagctgacctgaataatgtcagattctcagcttataggactgccatgaaactccgaagactgcagaaggccctttgctgtaagtattggccagtatttgaagatcttgatactatgtctttgcttagaataaaaagtaggttgggtacatttttacttagagaggggagaaacagctgtcacaattcctgttgcaatgtataattcattctttaatgtatccttggcctagagtttgcctagaatgttttgttttatttttagaatcattcctgtcaccattcctcagctactgatgttgaattaagatattgagaatttttattttccaactactggcattggcatcggcatccataattacctttgtgaaacttgcacaatccttgttctacctttgtttttttttctttttacaaaatgtacttagtattagaagactatgactatctgatctaaaccaaacttcatagacatgtgtggtttattagcttgaatgctaacgtgcagatgaatgaagtggtagaggaaaaatgacagaattgctttcctccttttttatcatacatctgtggaaaaatcctgaagtgttacacagctctatcatgtcatcaaatagtttatgtataactctactattgtctgagggtctgtgtgcattgatgatatgcccatgaaacaggcacagtttctttttctttttttctgtttttttttttttttttttttttttgagatggagtcttgctctgttgcccaggctggagtgcagtggagtggcgcaatatgggctcactgcaacctccacctcccaggttcaagtgattctcctgcgtcagcctcccaggtagctgggattacaggcatgccccaccatgcccggctaatttttgttttttgtttgtttgtttgtttgttttgtttttttttgagacagagtctcgctctgtcaccctggctggagtgcagtggcgcgttctaggctcactgcagactccacctcccgggttcacgccattctcctggctcagcctccggagtagctgggactacaggcacccaccaccacgcctggctaattttgtttttgtaattttagtagaggcggggtttcaccgtgttagccaggatggtctcgatctcctgaccttgtgatccgccctcctcggcctcccaaagtgctgggattacaggcatgagccaccacgcccggcctaatttttgtattttttaatagagacggggtttcaccatgttggtcaggctggtctcgaactcctgacctcaggtgattcacccgcctcagcctcccaaagtgctgggattacaggcgtgagccaatgcgcccggcccaacaggcacagtttctgctctgatggaacttacagtctaacaagggataaccaggatgttcatgaaatttgtagacataagcaaatatatgtataatgtattaagaatgtctacagttggttaaaaaaataaagtgatcttgtctctatttccaagaccatttcaatgtcatatatttagttgtgcaacagtgggacaatggggtactatgtgaacagctaactgtgtggaatgagattcaaagaatgtttgtttgaagaggtgatgtctaagctaggtaactctagaagagtaagcagctctctctctaggaagagcgttctagtcagaaagaagagcatgtgctgaagggcccagagaaagcatgacacattcaggaactgaaaatatgtcagtatggctaaagcacagaattccaggggaaagatctattgtgaaataataggctggagagagaagcaggaagcagattgtgcaaggtttttaaaacccaagttaaggaatttagaggtcaggggatttggcctgggggtgacataatcagattgtcgcttagaaagatgattcttgctgtggaacagagtatggattggtgcgatgtgggagtgacaggagaaaaacctgttgcagtaatctaaaccagcaatgtggtggcttgaattagcagagtagtaagggagataagtggagagaatttagaaatatttaggaagtggatttgacaggcctcagtgattcatttgatgtggtgcagggatgtccaatcttttggcttctccgggccacagtggaagaagaattgtcttggaccccacataaaatacactaacgctaacggtagctgatgagctaaaaaaaaaaaaaaaaaaaaaaaaatcgcaaaaaaaaaaaaaaatgttttaggaaagtttacgaattcatttgggcctcattcaaagccatcctgggccacaggttggacaagcttgatgtggtgggtgaaagggagtcaaggaagacacttaggtgcttggcttggaatatcaggtgaatgtgggacttgtctggtaaggttagacacggagctgtggtgctcaggagaaatatacaaacaacgtttagggatcatgagcctgtaggtgctgcttgtaacgggggagaggattggatagctccaggaaagtgtagcgtgagaagggaagttatttaggacacaggataagcaacctacagaagggactgcaaaggaatggccaggaggaaagaaggaaaattccaagaggttatgatgccacatgctccatgggaagaaagaaagaacccgttaccagggtcagatgttgctgggatgtcagcataaagttgcggaaaatgcccattggacttagcaacaggaaggtccctagtaactttggtgagattttagaggcacagtggaagtggtgtggtgagttcaaaagtgaaccaaaagtggagaattagagaaggtatgaatgattcttggagaaatttacttatgaaggggagaagagtggggtggtagctagttggagggggctgaggagttaatggaaatgtatgtacagtcacgtgttgcttaacaatggggatatgttctaagaaatgtgttgttaggcaactttgttgttatgtcaatataggagagtactacacaaacttagatggtatagcctagtacacacctaggctgtatgggatagcctattgctcctaggctatacacctgtacagcacgtgactgttctgaatactgtaggcagttggaacacaatagtaagtattgtgtatcgaaacgtatttaaacatagaaagatacagtaaaaatatataatagtgtaatctcatgggctcgctgtcatataggcagtccattgttgactgaaatgtcattatgtggcacaatatgtgtatataagtgtgtgtgtgtgtgtgtgtgtgtatacattgatccttgaacaacatgggtttgaactgcttgggtcaacttacgtggatttttttcaatcaaatgcaggccaaacatatagtattcgtgggaatgtatttatatgagtatgagaagacagggtgagattacaattattggcccaagaggagatgataaataatgggtgttctcagagaatacgggcaggtaatccagagcccaagggagggaagagatacctctcttccactgtaatgggtggggtagagggaaggatctgggcaggtccaggtaactaagaaaccaggtagcagcaaggtgaaggatgtcttactataaaggcttccattttttgtatggagtggagagtccctgcaacgcagttaacagcaggagatgatgaagttgggcttatctttgtggagaataagagagagggcggagttgaaaaccagctgtgtgaacccagaggcggctgagtgtttcacggtagctccaatctgcaggggtgtggtatttccccaggcacgcttagcacttgggagccagatgcttctgtcctggggtagggagggaacagctgggcaagagaagtgaggatttgggcaaaagattgattaaaatgatactgacaagtccctgttgggtaggagaagctgtgaacgcatatggaaactggtaattaggaggtagagggatgaaaatgctaactcttcagggaggtaggggaagaagtagtaaaggaactgaaggtcaagaagttgtggtcagagagaatcatagatgaacattattttgaaggtggaacagtttcaggtgattagatctaggatatagccatttgagtaggtggcagaggtagagtggatgtgaatttccatggaggtgaaatagcaagttaaggaactgagaggctagaatgatgcatgagtcccccatgccaatgttgaaatcatgcagaattggagcgagaactgggcaaaagagaaggaccgtgaaccctggctgccaggtcttcagaaataaaggggttcaaccagaggatctgcagaggctagcaataagatagtcaaggagtcacttggcatatggttcttacacagagatagagaagaaatgccttagaagtggaattatttggaaagagagactaggccttttcccttcatcttggtatccccaatgcttagtacaaaacctggcacacagcatggttcaatatgttttcatgagatgaatgcatgaatgaaagtaaaccaaggcttccatttccttatagcccgaagttatcatttttcagctatatagttgccaagtttaactggtgtttaaagggctttccaggtcgagggtttccttaggacctgttaatacgtcatagctgggaaaaagtagtttgggatgggatcgagtcagggggctgaatagagaaagttttcttgcctctttttcttcacctgcccctgcccctgcccctgccccatcccagagctactgctttcctttaataaaggagtaattaggcactggttatcatgaagtgctagagaatattcctgtgagatcctaaaagttcagaagctaaccatttgttccagtttatactatggaaaaaaaaaaaaaagaaacccagaaatagaccagatggaaaaaccttataatgactgttcctttctataatgtccattttcaccctggatttaggcattattcgattttcctgctcaaaaaaaattccattcacatatgtgttttattgtctgtcatttcaacttataatttccaataaactttgggaaaatgggggaatttcataatatacaaaattttgtccatttgaggtgataaccttgtaataaaggtaagctccgaatgtagaataatttctttaaattttcacttttaaatcaatttgaaattctctgcatttcctttctgagcatggcttttctaatatgtgaaaaagattcaagtatgccaaaattaaggtgtatgtatctaaattaagtattgaattctcattaatgctaggagggtgccatatatagtaaaactatagaatgaagagttcaccccatccttttattgaacatatgtgtggtcacattacttactttcaatatatgatttaagaattttctcctaattttatatttgcttagatttagcttccaggcttttgtcatttctaagcctgcaaagccatgataaagagctattgtctgcggtacaggcaaataaaacttgccctggctagctttccctaccaaaggccacttctaccaactctaactttaaggaaaattaatgatgttatctcagtgatttcctggtgccagtgaagagtttgaattacagatgccttggaaatatgcacttccacctctattaagcacttgatcttatttttttttcacttccctatcaatgtttccgtattgcagaaagccaaataacccaattgtatccactatagagaattcactatttaagtggagagcatcaccgttggcctataatgtccccagtttgtaatcagttaagtgttgcatgactccttactgcctctcaacacattggaaatgaaaatgaaacttggtagaaaagcaggaacaaagataaaatcttggtaagaaggatttataaactgtttcatatagctgatactccattgaaagttatgaagaaggtaatttaagcattttctttctccctttgtagttctgatgacattctacaggtgtgaggcttctaaaattaaaaagccaacttgtaagagcagaaataaaaacgcacttaacaaagcaagtgtatttagtttattaataatgtgtggtgggttggagagagcccaaaccatagggctaaatatactgcagttgataagtgtgacaaatattctgcaaacagtaagaaatagagaacattttgcctctattcagcaactaaagcacacattatagagatttggtacaggctggagttgtgtgaatagtcacagtttctggactcgccctcaccatgacaaaccaggtgaaaaatgcaccgccttctctgtaaatgcacctcaccttttgatggtgcgctaagggtgacattagataggcttcagttgctaaagaagactctcaggacccacaataacatggcttacaaatccgcgctctattgccagaaaaggctacattacaagagcattactgtcaggatatggatccacagccacaggctgcctccacagcaagggggtctcgagaggccagtgtaattattttgccactgtcctacaaaaatctactttttctatataccatgtattatttttcacataggttagaggccatgtctctgttagttctgagtttaagacgtcttgaggacatggccaaactaattttctcagtttatatggtttgacagatattagtgcccaagagaggtctcataacatgacccatctatctcccaggggaaatactgtaatcttgtttagctgttacccactagggaaagaatggttttctctcagtcagatgctaaagagattaaagaacacctcgtaggttccgttttctagtaattattggttccattctccagctatcaaccttggcagcttgccatccctatccttcctcctggaattggatgcccttgaagtgcgcttcttgcactaggaagtctttctcgtcagtttatcatttctcattcaaagcaaattctacctggccaggtatctctagcccagttcctaattctcctaatagaagtttcttttatttcaagtggattcatgccccttggcccaccagacatgttgccattgagaaatagcagctttaatgggaaatacacatgagacacaaaaatgtgactaggctaaaatcatatgaatagtagtcactcctaaaaggactttggtttgggtatgtcacagaaatttctgtagccatccatatccaatttctagcttttcagtctcaggaaagtaggcccaccaaattcaacttaaatatctgtcactgattcaagctgtcccaattgtccctccacccactaatggctttccacacggagtaatggggcaaatagctatttttttaaacacataatgttatgacagatgaaacatacagcacgtaagccttctatcacatgcccaatacctttgttaaaccttcatcatcacaattgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggttttagcagagtcccccaccccaagaggcatctgagtctaagccaagggagcatattattctcttattttaaacctctccgtaggcagcaacattatattaggttttccctttaaaaaaaaaaaaaagtatcggctgggctcggtggctcacgcctgtaatcccagcacttcgggaggccgaggcaggcagatcacgaggtcaggagttcgaggccatcctggctaacacggtgaaaccccatctctactaaaaatacaaaaaattagccaggcgtgatggcgagcgactgtagtcccagctactcgggagtctgaggcaggagaatggcgtgaacctgggaggcggagcttgcagcgagccgagatcgcgccactgtcctccagcctgggtgacagagcaagactcggtctcaaaaaaaaaaaaaaaaaaaaaagaaaaaagaaataaaaaagtatctttggtggtttccttccccttgcaacaatctcacctttttccttttatcattaattttaagccaaacctcttccccagctacacacacacaccacacaatgcagacagtccccaacttgtgaagtttcaacttaacaattttttgatttcacagtgatgcaaagtgatatgcattcaatagaaactctacttctagatttgaattttgatcttttccaaggctagtaatatgcggtatgatactctctccccttgctgggcagcagcactgaacctcagctcccagtcagccacaagatcatgaggctaaacaactgacactttactgtgtaaggtgttgctagacagttttgcccaactgtaggccgatgtaagtgttgggagcacattgaaggtaggctaggctaagctgtgagtttcagttagttaggtgtattaaatgcatttgtgacttaagatattttcaacctatgatggggttgtgtgatagcttcaattaggcaaggcacaaggaaggagtaatccattccattgatccttgtggaatgcttgtgcttaagtaccaactaatagccatagtatcttattttggaatattaccagcctttgaaactcttaattgtagccccagttcagggactactaggtctggcatcaaaaaagaaacctgtagtgacatagggaatacctgtaagtgccccacttgaattatctttttaattgtaactggtctcacaggtgtagcccatttctcaaaaatgatagttgcttcagctttttggttgggactccacctgcaggccagagagggtgaagcccagtggaaagaaattctgaacttaacattagcttttggatttttttttagcagccttgccatcagtttgcaattgcctcctaatccattttgttagctccttaggttcaagttctctcacttccagattccactagaaagttacaccatcagtaaccaatttcaaagcctgtgttacttttcaaccaagcgtagcttgttgagcaacttcaaaggttctttttcatcccttttatcagaatcttctttttttctttctaaataatgcctcagtcatacttttagctaagaatgagttggaggtgttctaaacaatcttgcttctgacactcactgccctgacagtggaagttaaacagggttcaattgctaaagaggactcacaggaaccaaatgacagtgcttacgaatctagagttccttgcagaaaaaggatgcaatatacccacaacattaaaacaagaataagtgtcacagccacagcctgcctcacagcatagggtccagagaggacaggtgcaagctataattgccctctgtctgcaagagccacaccacgatgcattttctctcttggaacaagagctactgatgtgagcacagaacaccttggaaaccagggagcacaaattggagtttcagccagggtttcttatatcccgtgggtaacctaggcatactgttcctatgtaaccagcctcaaactcagtggcttccgttggtctgactgtgcccgggtaaaaatggtcaatgttactgttagcaataaacaatggtgataacctgcaacccatggctacacttcaacacagtaagtcactttgaaaagcaagtgctttgaccagggctctgcactgtgtagatattttagcaagtcatctcgtgccaactccagcctctctggaattaacccttactgcacagacaactacatcaaagtgcattgactttcttgaagtgcaaagatttgcttgggaggtccctcagccataagtgtaagttgcctgtagagtggcatgcctgggcaagaaaaatcagcaaacatacagcagttcttccaccattactcacctctttctgtttctgtgctaattagatcacagaattatttatacatcaacatagaatatacagattgacctataggatgaacttggggttatatgggcaccatgagactttttttttctccactaaccaactttttggtgcttctgttttatcctactgttgtcattagcatggaatgcagaatggttttcctgttctgtaaagtcagtaaggacaccttctgccacccacttttcccccttacaatatgtacctccatgagaaatcagaaaacctagatatcctgccataacacccagagtgagtctccatatctctggtctcagttgtctcaactgcaaaatgattttaaagcaaccttctggctctaagagtctatcactctgtaaaagacaaaaaaaatctgtcttacataggaaggaatagcaagagttagctactgtggcatacatagaaaggaaaagaatgagcttttgaagctagaaggttgagaagatgattaggcacaaccagagcctcaggaaccattagtgggatccctgtgttgaagtcctgcctgctcgccgccccccaaccgccactgtctgcttttcctgcacagcaaagaggatcctggagagtcagccatttcttttatcctgtccccaccctctctcacccccacagccctcatgcatagggtaccaccacatggtccctgttcttcaatggcttcaaagcctatagcatcctctactgtaaacataatttagaaagtgaagatgtattagaatacttgggtttttatgtagctttaaagatatatctactagtgaatacacacaaacacacacacacacacacacacatacacacacacatatatatatatatatatataatatatttaatggaaattcctagcttaaggaaacaatggtttcacacaactgtatctgctggttgcttattgagggtcctagaaagagctaatcattacatttaatgtttcatcaaaaagtctaggtgtgttctctaagatgctcattttgaaaagcatatgcatggcaattaaattgtccctattgatattctcacctccttttcgggtccatagcatggattgtgtatacctaaatggaaattttttcaaaatagctccatgaaagttgaattctgtttgacatgtttgtttagggaaatgtgctcttcagtcttctgtgatggattgttcttgtgtttaaccacatccagttttagcagagcacactgcacagtatttctctcctaactgtgtcatcttctgctcctgtaatttcagagcaattgctttgctcccctctggagctatttctactcaacatttgctgttctatgtgttacccattcacctgtacagagataagagcaggccccataaaatgaaatgcatgcagtttttctctgttcatttccatcacacggctaaataagactcttaatacaaaagtgattcgaaaaattttcactagttacttcttaaatgcctggatcagaggcaaaatatttatgatgactaaagcagagtaacaaaaaagaaaataattgaaaaacttcaaaccacccatagcttccttcagtatataaggaaacatgttgggaatattggtgtttggaagaaatccattcctctcttccagtaatggagctggcataccgtgtttctaagtgttcctactacgtgcacttgagtatgtgccctctgaggaaaacaagcacacagaagagagagagaagaaaagtttgagtcttttgtctctggacctcgctccagcctcccacgcagtcttctttcagccattccctcctcacgtcctcccgtcctcctgcctccttgcattgctttttaaaattctttattatttttctcacttgattcttcagataagtctcccaagttatcttccttcctcccactttaaagaaagtctcagcttccatgaaaagggtcatttctctatctttagagtatttcagagcaaaaacagaggggccttcccttccaagggaggagtgcagactcctgcttccaccaccatgtctgtttcatgcttctggggaaactccaggattttctgttttcctttttttaaaagagaaaaatgtgtgcgcaatataggtggaaaagtatttttgcacaaacctacataggtattaaccactatttttgtttttttcttaatatttaattagaactggccatgaataacttgtaaaatatactaaagccttaagtttgcatttctttattactgggaaaggtgtttactgagcgggatttacctctatttatgtgaactacatttataattgaattgccccttccccctagatgcatgagagatttacttaattagcattgattccttgcctcaaaggactgagaattccaaccagagcttaggtgtataaggtagtataaaagcaatgttgttgtgtttctagtttggctaataaattggctttagagaaatgcatcttttcatgacacttgggaataaagcttgtgatttgctgatgttggacaaggttgaagtttcacttttgttaaatttttgtccccagcataagattaaacacctcctcagatcaagggaattttcctccctcagccttataaagttgttagaggacttagaaagaatattatgaaatacaatttgaaggtgaaaggagaaataagcgagcctcaggtctgaaaactggatagattatgcaattactttagtttgcctatagaaaattttagtggagagtatttttttcacctaatattagggtagcagagagatgctgaggtgactgatatttcaaggagaaaagcgcttaatgattataaatgcatagctagaaatagagtttacacaaccttagccatacagattaatctaacagatcttctctaatgctaatacaagaaagtatcatcggatctctttaaaaatttctgctaaaacattttttttttcttattcaggtgacaattgactctgtttatgtagaacaggctaggtccccttaactctcagatattccccagtaatccaaggatgggaattatatctttgcccatatcttcacccaatgccagtgagatttaagaacaacttcagatcctgaatactgatcaaactcatcaacttagagtcgaggcataaaaataaaacacctttcaaagagagtgtggttcacgtttggtgtttattaaagggtatgagagagtcctagctaggattctcagaggaaaaaggacactgaaaggaaggttttactctttgagtcatttgtgattttatttgttttttgcagtggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgtacgtatggcatgtttttatttcccgggctctgtcacaggaggcttagcgtacagaatggtgaagtgtaattagcattacaacagggccctggaagctgtggacctaatgctcttcctgtgataaatcatttttgcatttatgacttgaaaaatattttgataagctaggagttaagagccagaatgtagattgctctcagattagaaaacaaacaaaaccctgagacactcattttgcaaatagtggaatgagtcgacatatagcctttggttctttccctttctcgcccatggattttggaattcttccatgcacttcaggggtggcttcctctcactggcggccatggctgtgctcctggagatactggcacacctgtctccagatcagaatggtcttagctgatacttaggacacttttgcagaagattatgaattgataggccaaacaaaatgaaaacaagcccttaatacagcaaacttagcttctcaaactgagaacatttttcgttttcttttgttttttaataagattttatgaagtttcagtttggcgcctccattcatcactctctcttagagaacaattgtttgttttggattgcacacaagggagatatccccagttctgatttttttttttcttgagcttaatgaagacaattgaagaagggagcagaaggaattggtcttaattttgcctaaattcttcttagatctcaaaattattacatgcctcatttcaccaatcaagaacatactcccatttggaaatctgggaaggttttctgaaaagagttgcaaaacaactgttttgccttttacctttgttgtagacttctactaccttttgaactaaaatttatacctttttttctttcttattttgataaggtattgctttttaaaatttcaggaccacctgactattacattcatcatagtcatctaccaagtccttgaacatgtcggatttcaattgtgaactacgttcacattagttttgataagagtttgtattcaggtttcccctcaaatatattttggcactgttttctttgcagatgacatgtgaatgcattctgaatgtataacttccttctacctgactgaaaagtatttggtgacaattttaactccttgaagacctgagttgctgtataaagtggatttgttaaattttgatctaccttttcttaagagggagaaagataagaaaattttccagtgataggaatttgtttagtccattagtgcccaggatttctttttgactgagggatttaataaattttagtagctggaagttgagcatattgttcaccgaaaataaccgccattgggacctatcctttgtgattttgaagtgctaataggcgaattattctgaaatattttctcctttttctttttaccaatatctaagggccagtagctttccgtaataaaataagaagccaaaaaactattgaaagacactttttaactttaattttaggtttcggggtattatgtgaaggtctgttacataggtaaactcacgtcacgggggtttgttgtacagattatttcatcactcaggtattaacccatttatgcctagtgttccattattggaacactaagcttgtgggaattattcctatcctactgctcaaggtcatcgccaaggtctgattttcacaaaaagtaatatgcagcctccagcataaatgggttaagcgcagtacccaacagttgtcttttctgctcctctccctccttccaccctccaccctcaagaccccagtatctgttgttcccttgtgttcgtgagctctcatcatttagcttccacttagaagtgagaacatgcagtatttacttttctgtttctgcattagtttgctaaggataatagtctccagctaatccgtgttcaaaagacatgatctcattcttttttatagctgcatggtattccatagtgtatatgtaccatatttctcattgatgggcattcatattgattccatgtcttgaaagacattttctacaaaatggaaaacttttcattcttatttttcctttttttcccccatggataaaattagcttattaataaatttgttatgtgaaatgctttatttcagttttctatatgcaaatatagaaaatgctatgcaaataaaagcaatctatattaaaacactgatatagcaacaggttatttataaatttattttttagatcatatatttgaatgttgtttaatagagtatgatatttttcttacggagataaacatttatattctatattatgtgttatgtggcctgaagtaattaattttctttcaataaggggcaatctgatgaagatctgagcatttaagagggctgagcagttagttgctggtaatttttttggcttccatgaccaaagtaggtaatttgctttagtaaccaaagtagattggtgaagattagtaattcttctgcttaccaacttaaaccaaggtggctttccataggtgaatagaatttttttttcttaatttatgtagaacttttgcagttcaaataagggtttttaggaattgaaacttggtaaacattcagtggtcaagttggttgaatttccattgcattgtaggtcatcagtcaaagagataatgaatttggaaaagttcaaaacaatcttaataaaacagtggtcaatagagttcacacatcattgagcactttactcctttatttttccttttcaaggctttattcttaactagaagtgtttaccctctaggaaagggtcagtaattgttttctgctttgattcttcataataggggacgaacagggaggatccgtgtcctgtcttttaaaactggcatcatttccctgtgtaaagcacatttggaagacaagtacagatgtaagtcgtgtatattaatgctgtattcttttattaatgttggctaattaccctagttctagatgggaaatgacagactgttcttatttgacagcagattcctcatgtaagatgtagaactgcttttagagtgtcataaaatttggtttgtgccattccttgtcaaacattaaattgcaggcatttaagtagagaatgaggattagcttttccagtccaggtattattttacattacattgactgtgtctgaataaaacacatgttcctaggggataaagtctgattttctaacctctttctgtaagtcggaaaaataagtgtgaagatttaatctctgcacttgtctagtctttgggttcttatttaaagaataccatgtgacattcatgttcaagaaacattgtttattttataatcatcttactgcaagttgtactgacacatccaattccgtgacgtgactaacattttattatttgagagacagatagcttgctgtttcttaaaggatagatacgtaccaccctacagaatttccttttgattacgcattgggttcttctgcttaaaaactgtaaaaccaaattaaaagccaatgctagaggagtgatggttcagatgaccaagtgaccatccattcatattgtgaaaggctgcagttggttttccccttgaaatgcttataagcaatcttttcagtaggaatattaaacaaattcagcctagcttgtcttttctctcttcccctgaggcctagccacacatgtgaggagatgtgctaagcttcaggacaggcaggagataaaagccactctgtctcctactgatcatttctccttcaggagtaagccacaaaatacacaaaccattttggccctcacttttatgtagtttccacttgagttttctcatcctcagaacgagagaaaaataactgaacagcttttgttaaccattttaaaatgtatttcggatgagatgggatacctgtgtgcttttctcctttaaatattgtagttacttagtataggttaggttctaatctaccgtatatatggtatagtgacagcacattgtaaatataatattaaattgaataattgaggaagctttgagttggtgtttcgaataactactaagagggaacatgtttttaggttggtgaaacaaaaatattaaatgcaaaatgagatgtttgaaagtaactcataactttgaaaataaacacctaggtatgtatatcggagagcagataaaaagctgtgcgtacaatctcaatttttagtgccatcttaggtatcctgttaaaacatttaatttcctagagtttaaagtgtgcttatgggtacagaaagctttcttggatttactttttttgaggggcaacttctaggtgaatataaggtatgattaaaattttatatctgagaacaaaacataacattgcaagcattcagtatgttcattcattctgttacatatattgggcacctactatccaccgggtactgccattctactgtagatacttctggcacacaactgaccaagatatggttccttccctcaaggggatataagtctcctgccaaaaacgatagacacatattgaatcaatgccagcataacatgatgtgagctattaattagaaatacgcagccaggcgcagtagctcacacctgtaatcccagcacttagggaggccgaggtaggaggatcacttgaggtcaggagttcaagaccagcctggccatcatggtgaaacacgtctccagtaaaaatacaaaaattagctgggtgtgatggcatgtgcctgtaatcgcagctactcaggcggctgaggcaggagaatggcttgaacccgggaggcagaggttgcggtgagcagagatcgcaccactgcactgcagcctgggcgacagagcaagactccgtctcaaaaaacaacaacaacaacaacaaactatgcacagtatcctgtgggaacacatacatgatggactagaagctcagtgatcttatgactccataaagaagtcccaactgtggtacatttttgaatctctggtgtccaaggagggtggtgctttgggccagttatatgtctcttaatgctaaaacacttattttttgatgtagttacatcctatatacaataattcccaaggattatgttctggcttagaagaaatttaagtgtcgagggtacgtgtaagcttgcgcttcttgcagtgacacagtttatgtaaaagttatcacacttcatatatatacagtgatcattaacttgattcataaaaataataaatatccagattagcacaaattagaagtaaccccactctgtggaaatactggctactcttgagaattgctactggaattgagttggatgtcaggttctgctggcatccatgggtgctgtgttttgactgttgcaattttcttcttcctttgtagaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgtaagttattcaccttctaggtaacatatttattctttcatattttagaaattaattaaaaaacccacagagcttcgttttctcatattagctcttcagtaggcagtaggtatgggatttgggatatttggaacctctgtaagtaagcagcttctggaactctaggttttgggaaagaagacagtgctgaggaaggaaaagaaatctccatctgcagcagggaccccacagttattgaggtgctagaggggaagaagttcagcaagggaggaaataagtctctagccacagaaatcctatgtatataagaaaatggcctttgtaggcgagtctcttagtctctgagtcctttctctaattctatcattatagcctcctttcaatggctgttggtaaattgttagcacagctgtccttttttttaaaactgtcctttgtagctttgacattcccctattattccaaagtctagaggtgtatactctctgctaatgtccatcactgactgaacacactcttgtccgttctctttcctatcctgtcccattgctttttctctgtcgtagtcagtgccccagaaacaccctcttcttcccaaatgcctgagcactccactggtagacattcatcttgttctaatttttttttctctttccttttttttttttttttcttttttgagttgcagtctcgctctgtcacccaggctggagtgcagtggtgagatctctgctcactgcaacctccacctcccgggttcaagtgattctgctacctcagcctcccgagtagctgggattacaggcgcccaccgccaccccaagctaatttttgtatttttagtagagacagggtttcaccaggttggccaggctggtctcaaactcctgacctcaggtgatccacctgcctcgaactcccaaagtgctcggattacaggcgtaagccaccgtgcctggcctctaatttttattaggtagatagtgctacaatgaacatccttatcgtttagcttttgtctttgaagctttctttataggatcaattctcaggcgtgtgattgccagacaaaataatataaacattttttgtggcctttcttcaaaagttgttctaattgtaacgctatcagtattgaaggagtaagatgctttcggtatcacattattcacagtgttcttatgtttttgtttttggttttttcaagtgctaagagctgtttttcttatgtagggtttctcaatccattctaattctattaacaatggctgagatttacaaaatggaactagctgtagaactaactgggttatatctgaagtctttgaccacagactaggatgaaactatagaaggtttcctgggcagatcactgtgaatatttaggtgtttaaagcagtttgagtatttatttaatagttagttggatagatttaccggatgcacacataataagttcatttatgtaaagtgggatatactgtttgaattattttgccaaaattatggcaaattagttgtaaatgtaaaatgcatgtggagaaataaatatcttttcctcctcatacccaaaccttccaaaatgcagatagatgatcaatccaatcaatcatcaaaatgtagacacaagtaacttccatacaatgaatattaatggccacaggcaatctaggttcattttgattttttaaaatccaattataaaacaacttgccataaacgcgagttatttcctaatcttttggttgtgtgttttttttgttttgttttgttttgagatggagtctccctctgtcgcccaggctggagtgcaatggcgcgatctcggctcactgcaacctccgcctccctggttcaagcaattgtcatgcctcagcctcccgagtagctgggattacagggtgcctgccaccatgcctggctaattttttgtggagacagggtttcaccatgttggccaggctgagctcaaactcctgatctcaagcaatccacctgcctcggcctcccaaagtgctgggattacaggtcctaatcatttttcccctttagtcaagtctcagttactctttgagttctagtgaaacacacacacgtgttcatatatagggatatataaacatatgtgtgtgcattgtgacttgggttaaaggtaaggctcagtgatggtccctgctgcaaagtaaactaggctgtattcagggccagctggattctttgttttctcgcccgagtactgactcatcaggaagccaccaccatcctcactgcagcctctggccctcttggatttggttgtcaggataagcggtggccatacagaagctctgctttccctgggctgccccccttatcaggagaccaacctattccatttctgcctgctacatccttttgctggataacctcctactcccctaagcccatgtctctggtttggttacatttctgtctctgtaataacaactctgtattctcagtctcaaagctttgaattcagtccatccttgcatatttgttgaatgcctcctggttggccagccagtctccaagctctttgaaatgtgaaatgtgttttgttttgttttcagaaggggtctaacttcgtcacccaggctggagtgcagtggcacgatcacagctcattgcagcctcgacctctgggctcaagtgatcctcccacctcagcctcctgagtagctgggactacaggcatggaccgccacgcctggcatttttttggtgtatgtgtgtgtgtgtgcgtgtgtgtgtgtgtgtgtgtgtgtgtgtgtgtgtgtgtgtacagggtctctcgccatgttgcctaggctggtctcgagctcttgggctcaagctgtccacccacctcagcctcccaaaatgttgggagtacaggcgtgagccacggcatccagccttgaaatgttttctatgagactggggggaaatcagtcaagatatgaatggtggtaacaggtggcttttgattttctctgtactatttttattttctgagttttcttctttgaacatttataattagaaaaaaaattagtaaagtgctgcctctttttttagggaaagaaacatgttttgtttgattgctttccattgccattcttacattgtttccaggccttctcatcattgcactggcttcctagcaagcctccacttcacactccagtccttttcattggtcttattgccctcatactagttttagagaaaagcatttcccatatgatgccgtccttgaaaatgtcagtatctttctgttgtctagtgaacaaatcctaattcctctatttaactctcagacctttcctactctggtttcataaccacccatagtttgctttcactatcatgaaacagcttctccttaccatttgtacctattatgcttataaataatattgttaccattgctactaacaaaactttgttcacatgaattctctcatttaatcctcaccaagtctttgaggggaacagaatagtcaggctttggagattttgcttttattattgtttaagtggatgaataatttatttgcgcccttaaagtccctcagctggtggaagggtttgattcctagtccagtatgcccaccgccacatttactacctcattcccaaatatgtagtttctgatacttctgctctccagcttcccaaggccaaacaacagctacttttcctgagtcctggatagaataagaaaaggtataacaagacaggggacccttgagggggaagaggaattagtttgaagtgctggcaaatgtagtatttctaatcagatgctagtaaattccatatgtatggcgaggctttcattacttagatttggggagcctctcagcgttttagcaatttgcaatcaggttgaatggatccattgtaaatacttaggaatacttaggaatccacgtcctggccctggcatgcttttcctcggccaggtgcactggcggtcaccttgcctttcattgtgccacgtgcataaaaatacaatgtttgctgtagggaaagataacaggagtgaaaatgtcctctgccctttgtttgaagtataggaccttcagaatgaggctgggctggttccttcagcaagcttgtgctcaaaggctgctatttctaccagcctgaggtaaacggtaataaagtacttgtttatcctacaagtgcattccttgcattgcagatttgatttcctttgatttcttgtcaccacctggaaaccttactttgtttcaggttggtacagttagaaaggtactgaatcttctgattcagacaagggcccagtagtggcaagaagagaggtacgtgtttgtgtgccacactctctggattatctattaaaggttttctcatatccctccccactaaccacttagaaaaggaaatcacctatcaggtctaaatgtaaaattttgcttatttaaaaatcactataggtcttccaaggaattatccattaagccaggaaatgaagtcacatccatggatatgaaaaaggaatagtcactgtaaatttatggctttgacagtggtatcttcgtagatactaaatgaggcaacaggatatgtttccacattaatagcatattgcagtcaacacatttactgggaaattgactcattttggtagtgatagaagtaaagttttgcaacgagtttaagagatacagctgtaattaatatattgccagcttgttcctttctcatattccatggaaacagccctgttgagagattagattgatttttacgaccttagtaaggccaagcctgccctggcagtgagtcacatagactgcctgaaggaaccttgaggattttctgcacctctcctttttcagatgagaaaacaggcccacagtggcacaatgaatctagtctacatcgtgcaatttacatcatgttatggcttcaaccagttcggagactagattgaaatgacagagtgttaatgtgtcaatgtgatcccctatatgaattttagattgtaatagaatgagatagataaataaacacccctcccccaaaacacatacatgcacacacacccatctttattgaaaatactctaatcccaacatagctgtttagtctatcttcagataaaaccaagtatcacttttaggtgggaaaactatacagtcatgtgctgaagaatgacgttttggtcaatgacaggccatatatactatggtggtcccataagatcaacgtaagaagagattataatggaactgaaaaattcgcattactttgtgacactgtagccattgtaacatcatagcacgaagaattatttcacaaacctgcactgccagtcatttaacaggtaaaaaagtatgttttaaaatatttttaattattatggacacataatagtactcatttatgggttacatgtgatattttgatacaagcatacaatgtgtagggtaacacaatcagagtaattggggtgtccatcatctcaaacattcatcatttctctggtaggaacattcccatttcactcttttagttattttgaaatatacaataaattattgttgccatgcatggtagcacgcacctgtaggaccagcgtttcaggaggctgaggtgggaggatcacttgcgcccaggaattcaaggctgtaatgcacaacaattgcacctgtgaatagtcactacactccaacatggacagcatagtgagaccctatctgtaaaaagatttaaaaatatattgattactatagtggccttattgtgctaccaaacactagatcatatttcttcttactgtatttttgtacccattaaccatcccttttttatcccccgatcttcactacatttcccagactctggtagtcatgattttactctatctccatgagttcaatttttttttttttttttttttttagctcccacacatgagtgagaacatgggatacttgtctttctgtgtgtggctgatctcaacataacgtcttccggttccgtacatgttgctgcaaataatgggatttcattttttatggctgaataatattccattatgtgtttatagtacattttctttatgcattcatccactgatgggcgcttaggttgattctatatcttggctattgtgaacaatgctgcagtcaacatgggagtgcagatatctttttgtggtttcgattttgtagtatcttcttcagtaaacattttaaggactttattgtttagataacgtcaagtataccaactttatattcaatatgcttcacctatgagagctggagtgtcaaaatctgtttattttacatctgttttctgcctcctgttgtacttagtattccaaatgagtaagttgcttttccatctatcttctgaatttctctatttgtatgacaaaaatgaataccatctatgcacagttgttgtaataatgtagaatgatatgaaaatgagaataaattacagtctcaactgttgagaacaagtatttctctgtgttagaaacattcccaattctactcttttagttattttgaaatatacaatgtattattgttgccatgcatggtggcatgcccctgtagtcccagctactcaggagactgaggtgggaggatcagtaacacataaatgagaaagcattccagaatatctggagaagtgactggcagagtggttaagtgcataggctttgaaaccgaactgtgcctgagtccaaatctgagctctgctatttgctggctgtgtgactgtggacacatttcttaaccttcctggcccctgaactcctggaggtgattgtgaggattaaatgaaccaatagaagcaaagcacttaagagctgtagtggatacatagaaggtgcccagtgaatgttagctatgattatctaaagtgtgttgtggcatgaaaatatcctgccaatgttaacagttgcttttatctataacaaaacatcatctgtggattgcattttagagattctggagattctgtttctctgcaaatgttaaaatgccatatcaggagacttttggctggttagacagcattccccgggtcaactgattacttttttttttttttttttttttttttttttttttttttttttttttttgagacagagtctcgctctgttgccaggctggagtccagtggtgccatctcggcacactgcaacctccacctcccaggttcaagtgattctcctgcctcagcctcccaagtagctgggactacaggcacgtgccaccacgcccagctaatttttgtatttttaatagagaaggtttcaccatgttggccaggatggtctcaatctcttgaccttgtgatccgcccacctcagcctcccaaagtgctgggattacaggcatgagccatcacacctggccgattccattttattaatagattttccatcctgaaagtaactcctaaaaaccctccttcacttaggtttcctttggctttttgtgtattaatcagactgtgggccctttggttccatagacattccttttacaccccttttggacggatgaatactcactagtaactaagtaattagtaagagttactacaatttggtatttataaagaggtggcctttcccagaattgaaggtagaccctaatagtccaatcagccttccatagagatagctggctgccatgaaaagctgagagatatcaccgacctcttactgggcctgctcatgaacagttagttaaaattcctgcaattttcagaaaagacccttatcagagtattatcagtattgtcttaagtttaatattggtttccagttgttatttttaaaaattttaagctaccgtgggttaagctttatgatgatctgtttaagtggtttgtttgattaacttctctattggagtaatggatgttttcttcaccagaattttgaagataggtttgtgttgtagttgaaacctgttttgtttatacacttactgctaaggaaaagcacatgtcattttgttttccatcttcatccttctaaagtagcacttcattgttatgaccaaatctttctttcttccttccttcctctcaccctgtcttttccttccttccttcctgccctccctcccgcctctcttcctttcctctcctctcctttcctttctttctttcttttctcttttctttcgttctctctctctccctccctccctctctctgtccccttctccttccctccttccttcctttcttccttccatttctatcacccctaaaattccatcatgctgtatcatctcactaagtcccaatctctggaaaccacagctctgttttctgttcctgtaattttgccttttcctgaactggattttaaaggattgtaggaggcagtagtggaagagctaactttatatcttgttcttttacataatgcgccctgatccacacttgggaaagtatattccatggtacctatagacagatatatgtgctttaccatgtatatgtgaaacttttctaatttaactttcctgttaaattagaactcggtagcataaattaatactgttgagtatacttagggatttgcatagatttaaaattgtgcatatgttccctagggccatggcgttaattggtttattagtcaggtggagtgcagagcctgaggtcaggacagttgtccttgaacatggaaatgaagagtggataatcaccatgtgttattgtttgggctgattttatctttaatgggtgattcagagtcctgattaatatttagagcagtgactgctggcctcctacctgctcattatcttcagaactttaaataaaatacttgatttctacccaagatggtagttatgggaagccttttacttcttcttgtctcacaaagacaactcttgacctctcaatccttaaacaaaaagttctgcttctgcgcatgtggggactcttaaactcattttcatgcctggagattcacatttagggatctaggaaaagcacatctaggcagagtcgatgaggagatgctttaagaaccgtgacaaggacaggaaggaaatcaattttgcgttaggtttgtatttttagagaaaacgaatcctggggaacttttcacactcattactattgacattaataccattgtcctgtccctttcacagttactaaaatcactcttgcccaccctcctgccttgcccacaacctattcccatgaaggggtgacttgggagaaataacggtttccaaccaacgttttattttggaaacatttcaagcacaaagagtagttgaaaggatagtctaaagaacactcatctgtgtcatacatctgttcaatccatggttgcttttcgctctacttacctcctccaccctctcagctctgtttatgtatgtgtctgtctgtgtacatacacacacaaacacattttcccctatgccatttaaaagtaaaggagcatcacaacataaacccctaaacacttcaccatacaccattttcttaaaggatgacattctctaacataactgcaatgctatcgttacacacaaatttaacagcaatccagcaataccctctgatatgcagtccacactgaactttccccagtgccccagaattgttccttatagccactgttttcttccagcatctagtcaaggtttttgtctgtcatgtctctgtaccttcatttagttttgaacagtctcccagcattttgttttcctttcatgacattgacttttttggtagggggacagagtctcgctctgtcacccaggctggagtgcagtggcgcaatctcggctcactgcaacctctgcttcccgagttcatgtgactctccacctcagcctcaggagtagctgggattacaggcatgcaccaccacacccggctgatttttgtatttttagtagagacagggtttcaccacgttggccaggctggtcttgaactcctgacctcaggtgatccacctgcctcggcctcccaaagtactggaattacaggtatcagccaccacgccgggctgacgttgacatttttgaagagttcagaccagttctcttgaagaatgtcccatactctgggcttttctgatggtttccttgtgattagattaatgttaacattttttggccaaaagacgataagatgatgctctgtacctaccactgtatcacaatctggaggaacaaaataacattttgttcctattggtatcactaagaatgttaaggtggtgtctacaagatactttccttgtaaaatatccttttccctttgtaatgagaaagtaattttttgatattttgacatattataatatccattccttaaccttttaccctatggttttagcatttatggatgatccttgtctaattcagttataatattggtggttgcataatggtggctttctaattctaccatactttctgcatgtattagaccattttcttatgtaaagaagagcttctacctctcccccgtctattcatgaatatcactgtggacatccaaggtggttctgagtgtacaaagaatgatatctctctttactgaactgccattggatactatttttgtcttggaattgtttaaaatggcagtgtatggaattgaaagtcctttctccagagagccacataaacagatgtctaataaatacatttccatattaaccaatccttttatgggaacaacacattgacataattaaaacacgtaacatgaaaactgtgctgaattgagaagctcatagagttttgtttcttttttttcctttttgccacttcaatatatatggacccgcacctgtcagtccaggtagctcatacatgccgtagcatctaatggtacgagggacatgtaatgctgaaaagaagggggaaaggagttgatcagatgagatataagtatgcatttatcagtgttgtggggtattcacttgcaccttccattggctctcgcagccatgttatcggcatataattcagttgaagatttatattcacctggaaattgtcctaagtgggccttgcttacttagctatcagactctagtactttcaaacaaattaaagattcaaaagattttggggatcgccttgctttttcccataggaaatcacttttgtcctgtctttttaagactattttaagcatatatttcagtattaaaatcgtagataatcttaagctgtttccttaacctctttgggccttttcttatctgtaacataaagttaaaacaggttatctcaaaagttacttatccctaagtgtctttgattctatgctaaatgttataaaggccgaaagggaaatggattattgtacttatttcaaagcttggccatgatcagcaaagtcttacctgatcttccgggtaacaactcttgtatcagagctataagatatagaaaacagtcttgtacatagagtgtggcatttcacatgagaccaagtgttctctgaatggaaacacacactaagagcaagatgtgaaaaaccattgtgtacaacctcatgtaaatgatcccttgcgtccgtacactatagtttcctcagtaactcaaaggtaaaacccaagtatcttgtgtctaagaggatcaaaatgtcaccttccttctgttttatttgttacatgcaggttttgtatagttttatagagtctttttatcactcatttgattttcataaaaattgggattgtttggaagaagagtcattaatattctttacagcttgttcttgttcctccttttatgttctctgctggtgcagacttctctcttatgtaaaatattccactgatgcccttggtagatttagaggttgttaaagaaattgtaataacagatcagggaacagtcagggactgcctgtcctatactgtctgaccctgactaaccgttctccttgtagttttaaatctttgtgtacagactgtaattcaaaaaacagtttttataaatttaaattcagcaaatctttccaaatgctaaggctttttataacgagggctagaaaagttgagttgtcagctattaatgccaatacctattaacaatggcaatgacattgaaatgattttttggatttatgaagggaacatgttactaatgaaaatagcaaatgaaaatggccactgtattagtccgttttcacgctgctgataaagacatacctgagatggggcaatttacaaaagagagagggtcattggacttaacagttccacgtggctggggaggcctcacaatcatggcagaaggcaaggaggagcaagtcacaacttacctggatggcagcaggcaaaaaaagagcttgtgcagagaaactcccgtttttaaaaccatcagatagtgtgagactcattcactatcacgagaacggcgcaggaaagaccaacccccataagtcaatcacctcccaccaggctcctcccacgacatgtgggaattgtgggagttataattcaagatgagatttgggtggggacacagccaaaccatatcagccacaaaggagagattaccctttttaaaaatctgtggtttgcccacaatgttttccataaatttacctttttctgtcaataaaaatgtttaggaattctatttatggatatgtatgtatttaatatttgcatatttagttcttattttttctctaaatggttatgacctgtactaagtaaaatcaaaacacacacacacacacacacacatacacattgtactagcagacctgctttaccttgcttgggataattatctgccatgattaaataaataaatttctgcaactgtttatcctggaatacactgcatagagttgtcagtttgagaagcaacttgatttcaaatctgagtctacaattttagcgtgtttccttgtgacttctagtttggggcttttaatttcccttttgctctctctaccctcagtttatgaacgagtgtggcatttcggcagttgaataggcctatggtagcctcccagtttctgtgttgtagaggatagttgccggcttattaaatgcccttgcaggactctcagggaagtctgttgtttagtgaatagtgatgaatcaatgtggatttcttagttttgacaagtgaaccatatggttatgtaagatgttaacattggggcagggtttctcaaccttggtgctactgatgctttggcccgaatcattctagttctttgttgtgggaagctgccctgtgtgctgctggatgttttgcagaatcctggcctctatctactaaatgctagtagcaccccctccccgccctccccctcccccccccccccccccccccgcccagttgtgacaaccaaaaatgtctcccgtaaaagataccaggatgaaatcactttttgtcagtcccaaactaactagagccagggcagcatgaaaggaggagggttcatggttacatgcctgagataaagactgtctcaaggactttctaaaatcgccccacaagaaattcctctgttaggactgcagcagtgcacgtaatatgctctcaaaagaacatctgcccagtaatggcatccccactaataaactgacaccagttctggcgttgagcatctgaaacgaactatgtttccaagcagcttatgtaaacttctgtttttaccaataaaagtttccctctacagtctcctcttcagatgcatcttgggttgtaatcctcatttctaattccaaaataaatttaacatatttggcgatgtttttctctgatgttttttggtcgacactccaaacattgttatatttcctctggggtacggcatcatttccggttgagaaccaccgacctagagaaaagctatctgcctgtgcagttcctttcaagggccccaagtgtgaattttgtgtatacctatattttaagccagatcattctgtacataccttctaagtccagatgaagtctgttagccttttatgtgtgataccatcacatagaaaccaacacaaggacatttactgtaatcgataaaggaaattttggacagtttgagaaagtaacttattttgtcttctgctctttataaaatctttacaagtgtatgtttttgctcttcaggatgactaggcagctttttaaaattctgacttcatacagattttataatcttccttttatttcttgcgatcatattgcagttgaattcccacccactgttcaattcagcagattttaacagagactccagaagtatagttcctgtctttaattaatctgcaatttaggaaagaaattaaggaggtatcgttctgtattgtttccaggatggtggtttcttgttatctgagaattactgggcacagtctcttgcccaatgtttacttctctatatagagttgacccttgaaaaacatagatttgaactgtgtgggtccacttataagtggatcgttttcaaccaaatgcgtatcgaaaatgcagtactcaagagatgtgaaacctgcggatatgcgttcagctgggcctactgtgggacttgcgtatgcgtggattttgctgtatctcaacagcaaaatccccgtgggagtggggctgcggcgggccaggaagcaacccctagcatatactgagggatgactgtactaattattgtagtttattaagtgttcacatggttttcacaaacctcacaattgaaatgccaattgccttctcctaaaaaatacaatgtacgtgttcatggtagctgggatgcagggcttgctgagaaatacttaattgcatttcttctgtagccatgaattgattttattaccttgagagaaaaatgagtattcaggtggacctcctggcaggcggttggcccttcagtgtccaaggatttatagaaagcacaacatcaaagaaatccaaaagttcttcggaaccccagcaactctcctacctccaaacttgccatgtaatgcccttttaaacttattatattgataggtaaatcggtttgctagaaattccagatattgagaattctttgtctgtgtaccttgttatatttgtataaaggtgatatttgtatgaagccaccctccagtgtgctgtaacagagcaatagtaatgacaactgattccttcccctagcttttctgttatggatagttgctggcaggtgaggaccaacagaaaaagaggagaaacccaacataattccaaactgtgaccatcataatggaaggagctgtgatagctttgctttctgtgtgtgcatgacatagaaggggaaaatggagttattgccaaaacaacagcaaaagcaaaacaaagccaacaaacaaaacaaaacccagggctaaatgacctttccaagagattttgcttgcatggcttgaaactggtgtttagagatgaggacaaggtcacccttgatactgagaggggattatatctgagacttatatgtatctcaacaaataatggtacttacaaagattatctcagtccagtgaatgccatcatacttatcttttgaccttaataacttcctgctattccaatctatccctatatatttttttctggaatgatcgaaatgtaattttagctgggtttaattctagttctgttaggtctttacagaagcttgcctggcttttaattctttccttcttcattgccagacaaaaggagagggaatataccactaggatacagagtagtttgtcataaaaatgaaagattgaaacagaatgagaacgtgaatccccgtaccttgtcttcagtctgtcagttggcgtaggtgagcagttttaaaagagccaacatgatggatcttgcatcttaggggctagaaatttgagaatgttcaacctttaagcatagaagaatctatagttttttgaaagagtagaacattctacagcctcccttggtaattcacactaatgctttaacaactttcagcatcaggaaattcttccatatgagctacagcctaaattcttcatgctgcttaagtctgtttcttcttgttctgtcctcagtggagagatcgaacagctggtcacaggcccctatgcgagagccattcacataattgaaaactgttattaaatcgccccttcagaagtcactcttgcttgttctctctctctctctctctctctctctctctctctctctctctctctctctctctctctctctctctctctgagaatctgggaagattccagagctgattaacatgttgctttactgatgaccttctcagcttttaatatgttaacgtgctctaagaattttaagaggcagatataatgtgcactgtttctttcattaatttgaccttctcgtgaagcattttgctggacgattgatctgctggacatactgggaaacactgactcagagattttagttgagtaggaaccgtgtgtgagcctacggtacagaacaaaagaaagtaatccagttacactgtctggagaaatagaggtacattctccgcaatcatatttgaagaatagttttctaaatgacaatggcaaactaagccgtgtcatatgaagaagaagtaaaaagaataggaatgaagaggcatggacagataagacagctctggtaaaatatttaaagggctgttcaaagaccaagaacttctgggttgctggtcagatggataataataatgacaataacaatagcaaacatgattcttgctatgtgtcagacacggttccaattgcctttcatttgctgactcacgtaatcataaaataactctatgaggtaggcactattaatatttccagtttgtagcagagaaaaagtaagacacagagagataaagttattttcctaaggtcacacagccagtgagtggtgaactccagtggtttaactctggaacttctatatgctgtgctgatggatttcagctcaatgtgatgcagcacttttgacaggggtatctggacacaggtgttcaggatcaccttctaaggatgtttcccagctctctcacatgggtggtgtagtggctgtaagcacacactggcatgggtaagagtttggactcgatgaatgctgagtttggactcagtgaatcctgaaagtcttacagctctgtggtgccatgccaaaaggatgaatggacttgcatgatctttttcatttttagattgcataattctttataaacttttttttccacaaagtacctctgtgatggaactctacacagagaaaagtgctcagcaacagctttttaaaatttaacttgtaagttcaggggtacctgtctaggtttcttatgaggtaaacttgtgtcatgggggtttgttgtacagattattttgtcacccaagtattaagcctaatacccattagttattttcctgatcttctccctcctcccaccctccatcctctgataagccacagtgtgtgtttttcccctctatctgcccatgtgttctcatcatttaactcccacttataagtgaaaacatgcaatacttggttttctgttcctgcattagtttgctaaggataatggcctccagctccatccatgttcctgcaaagaacatgatctcattcttttttctggctccggagtattccagggtgtatatgtaccacgttttctttattcagtcttccattggtgggcatttagattgattctaggtctttggtaaacagtagcatttgatcggaagtttgaactgataccattttgcagctaggaaatccaaagttaaacagtttattatagtgttgctaaatttagaattaggggtaatgactggagtgctgttgaggtgatcagtgttataagccaaatgacctgtcagtctaaaccctcctgcctttctatctgaaatgtggatatgtcctttattaggaaaccacattacaagagaagcaacttggctttgcagctcaaatacccatgacttgtgtgatactaagtattcccatgtcatatattcaactgaaattggctgtggaataagtaatgcttcttggttcttggcaaaagcaaaggagaatcatctctggagaaagcacttttattctaggctcaagcttttatttatctctagaaaatattggtaaggtcagtttagtacgtggtaaaaaaaaaaaacaaaaaacatattaagcacacaagaaatcaaggtggaaaaagaaagaaatcaaggtgaatgagaaccagaagaaatagcaaaccatagaagcagacctacgataacatcatattccagaattattagacagattattttcttaattgtgtttatgcagttagaaaaataaaaaacaacattgaaaaatatctacagggaaccacaaacctgagaagttaccttaaaaatgaccaagtagtatttctagatgtcaaaagtacaataatcaaaatttaaaactgtatgggtttacagcagaccggcaagagaaatggatacccagacagtaaggcagaaggaattaataagaatgaagcacagaaggatgttttaaaaagatgtggggcagagaggggggaactagggaagtcctgttcagagaaatatagattgaagaagagtaacatttatgtaacagagttctgaaagtagaatggagagggaatggagaagaggcactatttgttgagagaatgacggagaagattccacagctgattaaagactctaaatcacaggtttaagaagtccagtgaatcctaagcagtctaaatcaaatcctagaaacagcacaagatagaaaacagatagattatctttattttttttattttatttttattatactttaagttttagggtacatgtgcacaatgtgcaggttagttacatatgtatacatgtgccatgctggtgtgctgcacccactaactcgtcatctagcattaggtatatctcctaatgctatccctcccccctccccccaccccacaacagtccccagagtgtgatgttccccttcctatgtccatgtgttctcattgttccattcccacctatgagtgagaacatgcggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcaaaggagcaacagtcatctttactattgacttctcagcagcaacagagatagacgaaagtggagtaatatttcagtattcaaaaacaaaataaaaacaagaccccaaaacctttcaatcaaaaattttatacttgggccaggcgcagtggctcacgcctgttatcccagcactttgggaggccgaggcgggtggatcattttaagtcaggagttcgagacctgcctagtcaacatggtgaaaccccatctctactaaaaatacaaaaagtagccgggtggggtggcgtgtgcccatggtcccagctacttgggaggctgaggcatgagaatcacttgaacccaggaggcggagattgcaggagccgagatcacgccactgcactccagcctgggcaatagagatagagtcagtctcaaaaaaaaaaaaaattgtatttaatgaagataactatcaggaatatggattttttttttaaaaaaaggaggtattttcagacaaacagagcttgagaaatgcaccaccaacagctaaaggaaattctaagggacatatttcaggcagaactaatcccagatggaagatttgagatgaaagaaagcaatgaagagcaaaaaagtagtcaatatataggtcaatctatctaataatataaaaaattaaaacaatcctatagggttgaaaaaaacaaggtataattaaaattcatgaatatagtaacatataaatcaaatggtggtattttgagattgttgagatcattgtcctgtctgggatgaattgtatttcttacatttagactttgaaagagagagaaatagagaggcagacagaatcaacagggcatcatgaaaacagcgctaagccaggaggtttggattctattatcagctctgctgctagctgtatggcctttgaaaagctccttttctggtctacaaaatcagtttgcttgtctgttagatgaggctttggaaccagatgaattttaaagcccctcattatgattctatgagaaacagattctctagaaaaaaaaatcagttgtccccctcctttgaaattttatcagtaaacacctgcatttcacttctggctaacttttatgtatcagttcaaaaattaaagctaaataaagtctcgctcaggtgtgtagtttgcttacctttctcgtttgttggttttgttttcttttcttgtcatctagtagccaaaaagagtaatggcagtttaccaaagccttaggagtgggtagctctttggatatcagggagcatttgcagaaacaagctgtgaaaagccagcctagctttgcaaccattgttctttctatcttttctgtttaacttattaatcgaactgatatacacctcctttgccatcttgccttctttcctttcatccttttgccctccttctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtattaggaaccaaaaaaaaaatgtcatttttttctcatcatttttcacctttttatgacttgatcttttatctcctgtgccagttgctgttagttcgtaccgtctccaaagtgggagagaaggtgattgggctggaacatcgatcattcctgtcaccctcctgatcgctaggttattttggtggatctcacttattaggctggtgtcccttaccaccttcactcttcagctcttcggagccacatttttggttgagcaggccaaagtgcgtgtcttcacggaggtattacagatgaactgtacctcctccttcctggaaccaaaacatttttaccatctttcctttttcacggtctttcctgtttatagaaacttcccaagaatcagttataaaactgagagatgattctattctgggaggaaccataatagtagctcagtctctcattcactttgcaccatttttttttctcccttaagtaacaagaattgttttcagcatcttagaacttgcttctttatctgtgaatctgattacattctttgtatagtatcccagtgaacttctaaaggaataaaaagtaggcaagtaaatggaagattcacaaagcagctaaaaaacaaccagtccttatacatttagaagtgaaagagataggaaacgtagcaggttattctgatagtcttaaaatatcatggaaaacaaggccaaataaatctttagccctgctgacctgtttggggagacaggatttttttttaaatgaattaatctcacttaacattaatcctaaatcctaattctgaaactgcgatgtccttaaatgtgtgaatcaacatcaaggtttctatagtgatgaataagccacaaagttgtaaactagctctatggtctatgcctgtgcagaatccacttagcagcaaagtaaacactcttttccagttacgtgtgaactggttttgttactttattttctaataactaccttgtactgttgcgtgctttttattcatagtgcttttttacttttggtgtttattgttccatagtcatgctgtttacaaagaggttttacaaaaacttttagaggtttctgaagcctagatagacaacagtgagtaggtactgcttgcaaaggtcaccttctttccttcccggtttcttggcaggtaaaaatgataccatgggggtggggagtggggaagggaagccacagtgactgcattagatttctaagctaccttttctctgcttccttagctagtgggctttgtatacaagggaaatttttataaaataaagaagaagaatgccttggaggatctgaaagagcactttcaccttcaattcttttgcccttatcatattatattattttaggacccagcacttctcattcctcctgtccccctcttgaaagatggctggaatctaaaaaagatagctttccttcccacttccccatatgtgacataagaaatatgtttatttgaattggctaaggttcttatctgagaaagcaaaaggcaggagagtatgaaacaaagaatatcgcattctgataatggaggaaatgtaccaactagtatttacagattataaattcttccatctaatccaaatttcatgttctcttggggcttcagttatcatttgtaggtaatggggtgagagatttctgaagagatagagataaaagagttcattcgagtaactgtttgaagatgaatcgtatcagtcaattagaaaacattattaaagcgagacttgttttaattgaaagttcttgttcacatttcttttgtcttgtgaaattgctttatcttgacaatgttttgaaaataattgcttcagaaaacttttgtcccatgatgggtaaggggcatgcacagcgtaagtctgtcgctcctggaagttcttttaaatttgagtatttggttttcaaaagactggaaattttccagtaccttcctacttaatctcaaagagttcctagtggagtttaaataaaagctgagtttttcttccctccttccatatgtttataggataatctttctgccaaaatgttttggtactgtaggagaggcaccggaaaaatctggaggcagaaagttaatcacttaccttgtgggactaatgaacattgctttctgtttctcaaattagaacgtggtagaaggtttattaaagagtgttctttgggaatttgattcgaagaaatacatacgtgtttgtttttgctctttatcaggtacaggagtctaaagcactttaattatgacatctgccaaagctgctttttttctggtcgagttgcaaaaggccataaaatgcactatcccatggtggaatattgcactccggtaagtttgacgccagcctgacgtgagagttagttcacctgggataaatttcagttttgtacaatactgcagatcatgtataatgctgtgatttgtcacttccccagatgttccccagctaaagtggctctcaactgtaggcttcaggatttaccctatccctggtgcctaggggagtgcctggcacatatggaacatgatagaccctcaataaatattgttggatgaataaatagggttttcattctgtgtgcatggttgtattgaagacgttttcacgtttattttgcacagccttagaggttgtgtggggcgatcttatggccatgaggcatgttgagtatgggggatggttctaggttcccccaaattcataaactaccacttttaatcaatgttgctcacctattatctgtcctgtatactagtgacattttaaaaatccattttatatgctaacacttactaaatgctaggcatttaccttttaaactaccctgtgtaaaataagtactatgatttttatcccctctatacagatgaggaccctgaggtcctgaggttaaataatttactcaaggttctataagtaagagttgaagccatctcctaagatgttattttaggaaaatgttaagtggccaatagaactgtgaaaaatcactagggaaatggcaaggatgtagacttggtggccagacagacctgagtacaaatctgcctaagaattaaagacaggctcctctcaggtttgttttttctaaaataaacctgtccctgttgactgtagagccacccttcgtgtttctcttctctttctttaattcttacagtctcctcttctctaaactttgcatgcttgctattcaagatacggtctgttgactaatcatcatatgtctattggcattaccttggtctttattagaaatgtgaaaccacaggccccaactcctgatgctctaaatcaaaacccacattttagcgagatctgcagctggttcccatacacaacaaagtatgagaagctctgctttagagcatctctctcttccatcatcagagtgatcctcccagatatttgcctgtctcacttttattcctcttatagagatggtcagtgattgagaatgtaccatgctatgaatagaccgaaatttagtgggtgaagcatgctatcattttgtactaagtagtttttaaaataccataaagtgtggtaaaatttaatgtcacctttttgaccttaagacctataaactaccatttattgagtagcctagtaagcttgtatgtttcttttatttatcataacaacgtgttgaggtgttgttgctcccattttactgatgatcagagcctctgagaagtaaataactcagccaaattagtacatgccaggcctggtttcagagccccatttgtctgattccaaagcctttgctcacaaccacaacactctccttaattacaaaacaagtgtcatggggcagaagactggagtggtcattagttttgaaatcatcctgtcctaaatctgatctcaccatgatctcccttttagactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttcatacttaattggctggattttatttattttgacctttcagtaaatttttttgcggctgagtttgcgtgtgtctccttcaccacctcattttttgttttgcagtcccgttactctgatcaacttctggccagtagattctgcgtgagtactttttttgctgaagggtgctgctaccaccaacacattcgctcgcttggttctcttttgttctgtttatttgtttgttttcttttgttttgttttgttttatggacatattaattccccttccttcatttcagtttttttttttcttttcttgatgagactttgaaagtaccatctacacagatcaggagaatcagagtgggttttttggttcctccaccaggtgaaattcaaaccagcagaaatcctggcttgaattcaaattataatcaaagaagttattggagttttagctgtattcctgggagacatgtttatatatttcttcatataaaagcaaggaagaagcttctgattacataataacattctttagccatatttcttgagattcgatgctttttagaatctttagggtctgttataagtggactattaaaaatcagcagaattcgttttaaagtatgatgctgagtttggttgaataattttaatgaggtgtgcggactgtttatcaggttatgccatgctatttgactaatcattatatacaagggtttctaaattttgaactaaactcactttgctctcctctccaagctaaatattcagctcataaacaattatacatttgctctaggaggaaagtatttctttgttattactattggtgtgtattaataatactgagcttagataccagcagatgatttatctcagagtttataatgctagaaaactcttttttggggcctgtgatttctatattagcaaacaaagtgcctattttaaaactacattatgtagggttgttataacaaacttttggtatttcaaagtatgctttattaaaatatttattgaaaatcagacagctctgttatggataaaggggaaatgaccaattcggaagataagcttgtgtaagaattcaatttctttttattaaatcttttttattgttccaccatataatttaatctaaactagatccttttttaaaaaccctgtcgtgataaatgcatattattaattgaggtttattttcagtctttaataggcctaaaggaagtggaaggctatgctttcctttttaaaacttcgttattgcgccccttaattttgagatatggtagctataagtagtatattatctgatttatttaatcatcatgcttaaagaacttagggagttatttaggttcagttatgtcctctgcctcttggaaattgtgtttcctaacccaggtagtctgttatagaagttacaaccgttcataaataagaaacttttaaagagttgatacactacagtttcagcttgattggatcctgataagggaatggatttactctatgtggaaataagtttaaccgagtaagaaatccaaacgacaaatatgctaaagaacagttgttacaaatacatagataaaagtagcaccaaataataaacaaagagtaattaatagtccttgaaaggcaaaaaggagctacacgtaagctaatgagaaaaacattatgacaatcagattaacttattttaagtagaagattttgtctgtcttaaacgttgaaagactttaaaattaataacatcttttatttaaaaatattttctaacaactaaaacacacctcccaatttgcctttttatgaagagttggttagattattcagaaatagtgggaagttttaattttgaggaagaaaacaaatctagcagactgaagtctgtgttttctttaatagcagtaattgtatttaaagtatttattcataggattataaatactgtataaaatatattacaaagccatcctattcaggcataagagccaggtcctaacgtgtttcattttgcaagacttgtatctaatgttaacaaatcctatgatgattacaatatttgatccatttgatatggatcacagaatttgaaagtttccagagatacagaccgtttggttttccttagactaaactcttatttgcttgtgtttgtcatattactttaaaactaaagctaacataggcctttacgttgtctgtccataagtgagccagtcaaacgatattctttgagcgattctgcattgaaacctaaatgaatgtcagcttttaattaatagagttttcataaaagagaaggtggtggtgggtgggatggaattgaccaagtaggtcattaactcttatagtaagtaatccttctgggtatatggttttgtgtttaggaagtgggaagcggggaacagtattattaccttcttttggaagtgttttagaaggctttgcacttagttttgtttgtggactaagtggctttgtattttcactaattcttggtttttaaatgattcatctctgaccagtactcccttttggctcattttctggtttaataaatgtctcttttagtgtatattttttaagatttctggttattgtaagttcttgtgcttatgcatgctgtgataggcgccactgatattaataagaaaaataacatggaattatccttgaggcaaagaattaaagctctgtataagattttctgtataaaatggtattaaagtattttggatttatatgcctacttttcttggtgtacttatgctccaaggtcttaggctttcattcttgtacacacttccaggatagcaactattacaagggaaaacactactaatgtattttccctgatggtaggctttttgcttattaaaaaaatatgtaattgaaagactggtctgttccaaaagatagttcttataatacaaataatccaagtattaatttatcttgatctgcagtgaagatttcaaaacagaccttagcatttttctaataatgggctatgccagggttctagaagattaacagattaactctccaaaactatagtgaagtttcacatggaaatctttggatctgcttattaaattgagtagtcatcgttttgtttcctcttgacaatttaaacgtctttataactcatttcaatttgattatgattacacttgacctagatgacattggtttcataaataagacctttctctctcagggaagaattccatttccctagttatttgctatagtgtgtcgtaattatcttactgtagtatattaagaaatatgaatttctggcacattttctaatgcaagcttagctactggtaactgcatctttttcttttttaatgtaagaagaaacaaacacattctccttagtgtttcaaccaagtccttcaacgctacttggacactgggctaaaccagggtcctctctgaattacattatcgttgacttttggatttatgcctttacctaagggctttctgtgtcagcagagaaatggaagagaccttttgtgctattccaattaaaagaaaaagtccaagcctaaactggttttcagaacagatggttttttttcctaaggttaatccaaaagatactataaaaacttcaaggataattaatagatcagatatgaaaggatgaaaaaatgttaaccctaccagaattctagcctatggagataagaaaagataggtgtttatatacaaaaagcatatagactattcctgctaatgatctcctcttattttctcacctatgttttagcacacagtatctctaagaaatatttcagatatcatgacgttctatgaaatttagtcattcttttttaaaacctcacaatataatccagggtcattctattttgtgctagaaattagtggtatagtcttgctgctgaattggaagatacatttcttctttacaaaattgcatagatcaagacatcttgatacatggagttttaagaagtcttgtactagagtagcctctttgaagctaaaataattgtaagtatctaggcagatatacagctttgatccaataagaagatagcctataaatggcgcaggtgtaaactatttaaaattttaaaccacatagggctaacacaatttcggaattataggatgtgagaaattacaaagtaggaggacaaaatgcttcctagaaactgtctcccccaaccttttctacgatgggaattttccagagaagattttggcctctcttcatggcttttaataaaagcagaagtatgagaaatcatctctcaatcctggattttaaaatacttgataatatttaagatataggagcaactaaatgtatacattatccatagaattagaataaaagcattctaggccatgtgtataacataactgtgtggtgggttttttctccattaatggatggtatctgtgactaatcacattttctgccttataggcctgcctcgtcccctcagctttcacacgatgatactcattcacgcattgaacattatgctagcaggtatgagactagttgtatgccaggcaaatattgattgaaataactaaccaaggaaagctaacctatgatattttaaacaaatcttttctttttttccccaaacttgtctgattcctactaatcaacttgccctctaacgtgcatgccgttccactgcatgttgtttttggtcaccaacaagagcattagtccagaataatcttccctaaccctggcttttaaacatttccggtagccttgctatgtttttttatactgagcacatttactaaattggcttacaaatagtttaacctccttagaaaactgctagaccagacattcatatatgaaaaaatgatactatattatatggagaatatgaaagcatcagctttccgtttgtgtatttattttacatgatatgctgtaaagaagagaataattaattttcctaatccttggacttttctgtctcaccttctttgtgtttgagatgatttttatacctaaaaactgaattactaattttaaaatattttatgcttgttaaatccgtaagagtttggttaacttttttagttgtaaaaaaacaaacaaacaaacaaacaaaaaaccccctgtataattgcctgaggtgaagaagattttaaaggtaaaaattggtggcagaatgtttagagagcttactgtgcatccatcctttgtcaatattctaactgctggacatgtttaccaatcgtgaaaagcattagctagctgtgtaagtctgtcatcagtggaaagtagtaattgtcctaaaagacaaggggtagtgtaaggtagggagtgcacttattgttagggaagcttttcttctgaaaacaaagacctgttctcagtgaaagcaagactgatctgtagggggaaaacagtgaaatataactttccttagaatttctatcataaatgtagtgctactaactagctgtggtctaccacacactgcctcaaatggttaagccaacacacacatcctttaatttgaaggattcctttctcttcttgccatgatttatcctttagttttcaggaatgttcgattaggtcttgaatagattctaagacgtcacataagttttaatgagcttttacgttttttatcaggctagcagaaatggaaaacagcaatggatcttatctaaatgatagcatctctcctaatgagagcatgtaagtatcccatctctttttacaaaatgttcctgacaatgaaattgctttgagggatttagaggtaggatagcacaggatataggaattagcatcatattcatttgatcttttaaggagccattcatttacttttttcctttaattcttaatgccctggcatggaatgagctcatccaaattctggcattattagtattcagagtagcaaaaatagtttgccttactcttatttgaacttatttcataccatatgattacaaattgcagagtcccaagtatttatagtaatgcttaatctttgaccaaacctgccagatatttaaagggataggatattaattttaaagtcatggctaagtactattttctccactcatggggagtggaaacgtgatcttggtatagcatggctattcacatatggtaggttagttgggcattttccttcagaaatccaaagaagtagatttttgtgatttagcatcttcacaagataaataaagtgaggcaatcttatgaagagtttccagaggagaagtaccaattcaggttgcaggttgttagcaggatgataagccaaccctgttaaactttaaggacggagatagagcggtgctaagagcagcagggaacacagctatggcagggaaacaggcttcattatagagtgagggcagtgttcacaatacagagcacaaaggaacattgccatgaaccaagtaaatgctgaccggggcttgaggtagagagagcagacattgaagcaaatatgaaggaaaaaataaggatttgccaagtgaataaataacataaagagaagaaatctagtcaaagtattacgatgcctttttagtttgataaagtaaggatatctcacccatcttggagaatatagacaaagggaagaatggtaaatttatcatatgtagttggtgtggcaacacaaagtcatgctcagatgagaaaagaaccttcataaggattaggccaaaagaaatagtatcaaagtggcatatatataactagttattgaagacatgagaataaataatctcatctggtacataaacgatcaagctaataataaagaatcaagtcaaccctcagtcatttgtatatgacttacttccttcaaacaaacaaacaaaaaagcctttccccaaccataactgtgatgccttatctttcttagctatgggaaaaagtattaatggtactaatatataagatacttcaacagtaaaatgtgtggccaaagaatcagccaaatgtaaatagcttgtgcttctttggctcactgattttggtattagaagctctagcacattcagattaattcgagttgtatctacgtaacagtggctgtcattcattgactgcctaagagaacaggaagaaaagtgtagttacaactctaggttataattaaacatgggaagttctagcagtacaacttcagaatttggaatgagtgtgataaattaggtggtaaaactgcttttgttttattttaaaataagctttagcttattctgaggacataaaatccattttgactcaatgttggatggcaaaaactcatggcattttaggggcaggtttggggaagtggtttggtggattggttgacttcacttaaatgtgtgtttttaatacccaataattatttttagtcagcttttcacatctaaaccaggtaactggcttgataaacaaaaataattcaaatgagaaggactttttcctaaatttctgatatttttcaacttaagtgggtatggagaggagaatattagcgtatcatcttaatgatatctaaccagaaacaatgagctttagcctgtcattacggacagaagaaaattcttataacttggaggtaaacaggcctttccggagcttggagcaatgcattcagaaaaaagtttgtcctgtgtattagagagttcctagtttccaggaaagattgtagctgcctccccaaatagaagcctttttgcctccttttcccgcaagattagtccttaaaaccattatgtataaatttaaaaataaataaaacttgtatttaaaaaaactctgccccgaggaatgagatgttcagtcttcttttaatcagtcaccttaatgtcttttttccccttaattttcgttcttctgtctaaacaataactgaatgaaacaatcatgtatctccagtttaattgttgttgtcattctgcctcaatgacttatataagttaaaactgacttactgaagcaatactttttggttacattgccttccacttaataaaatatttcctctgttacttttagagctgcaaggtattttttcctactcagtacaacaatagcgtgggttagtgaacagattatcttgacaggcttggtggccaaagcattatacagccattattatatcttttaatattttttagctattgactaacatcaacgtagagtcccagtatttctgtaattctgcctttcatttatccgtgtaaataggccaatcaatttcatttgaaaatctgagcaagaaaacactttgaattggtaccagtagaatggtagatcacaacctcagcagtatcaaaaggtctttagaagcaggaaaaaaggtctaattaattgttaagagcaaataaatgtttctattttcaaatacactcctgagtccctaacccccaaagcaaaataagggggggaaaaaaccaaaacctttgattttattttccagagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggtgagttttctttctagctttgtcattggtatgcagagtgcatacacttgcacacatagaaaagtgccaggaatcttcacttagagtcattttatgtctaattgttttctaaaataatctgtttagctccatttgcagattctctctctcttttttttttttgttatctgaaagaagacaatggatgcaatagtatgatgaagaactcatattttaggtgtgaaggagttaatgctgatggtggtatttgacttgttgcatgtgtctccaaggctttgattttatatttcagaatagaatttaagaaaaaagtaggttatttaattttatgattatatgattttttttacatgtgtttggccatattatctacctcaaacatttaagaaagtagggttattggcttggtcatattgggaaaccaattgtttcatcttatttttcatcatcaaatgcagaaattattatttatgctcaccatcatagcaggttagtgagacaattccaattgtcagccatcacctgtaaaagacagtcatgtaaaaatagcagaaattgtagaagagaaaaaggctaaagaactctcataatgactgcagggaggacaaagatgtaaacatctggggtactgtattgtgtcaggataatgcaaatcattggactttcagttctgtattacatttattatgtcacaggtcccttggtttaaaaagtcttctcacatgatcacttctaactcacaatgtgccttcttcagacagatgccaccaagcaaggatttaaagtagatgttgctcagatttgtgggtcttaagtactttcatctctttggttgagcccaaggcaccaaaagctcttaacgtaggcaacgcagtgtgtctgagatcagtgccctcgggagtatgccacttcaggatgaaaaaacaaactgccactcttccattgcttcctgctgccactgcgagccttctagctcttaacaccttttacctatggccatagctccttatctggttggcttccctttagtctctttcccacccttgcaataaatcctccatactgactctacttgtacatcttgccagaaccaagacccatcatggcattcccctttcactggatttctgcatgtagaaaaaaatcaagcttcttagtggggcgttcaaacccttccacaatattctcttgacttgctttttctatgccatcttcttttgttctccctgtgttctggctatgctgttgtagctagtatttctgaatacatcctgctctcatctacctttggggtcaagctcaagcttgagtctcagcctaactgctaacctctaacccaccactgccgtatctgacaaaggaatcccacctatcctccatcacactgctcaaaataactttccccatggagccctgctagatccctgcagttggaagaaatctgtcttttgcctctattcccagagcactttggacctttctcagaaaattccttgacagttttcctttttatcagttattaccagtgcctctctttaatgagctagtgtgtgtctttggggcatggactgtatcttaatcatcttcatatcctccagagtacttagcatggtttgaatatttaatggctactcaggaaatgtttgctaaaaacctgaaaatacagcaagaacatcacatgagtaccatccacgagataatattgaactttttttgttgttttaatgatagctttatttttggccgtacttttgagatcatttgtcagtgaagaccatggtagagaaaacatttctactttattgagaataatcagtaatatccatttatgttaaatctgtaattattgtaggggtcaaagtcaaatcggaataaaaagttggaactgacactgtaaatagaatttgatgttaccaaggagtaaatatatttttgaagtatatgatcgtgtaatatatcttttgagctcattggtcaagagccctgcctcgtttgtggttagcatagtctttctccgtaccattgcacccgggtcaaagaatgtttgtaaagagtactgataactatcatttatttatcattttatcattttgagtgcacttttacatattttagatcatttaatcttcttacaaacgctatggagaagagactgtcgcctttctgtgaatgagacacaggttcttagaggttcacacagcttgccccagatttcccagtcagccagtggtagaactgaattgaaatccagatttttctgactctaaataggcaactctgccttcaaccagataataaagaagagtaagtctctgtgaatgtcatttacatagaattgcggcatattccccagaatgtgccttaacttgagggactatctatgaggactgagtgtcccggaataaacctgttcatctacttgtggcacagcgataaccgctttaccctggaagatatccaagaccattctccaagaatgggatggtttgttctctaaaagaacaaaaaacataacaccaggcctacttagagctccaaaatgaggactctggggttgatgcaaatctttgtgtaagttaccttgaccttcacgaaatgatcaggatgagcttccttcattgtcccttcattttgtcctatttgaccttctaccaaattccaaagaaatgtctccacagagttcccttcctgaaaacagcccgtgtgttttctttgatctgccctgtcctgtcttcttgcagttctgcgcaaggagcttcagagccctagatttgccttcgctacccttgaattcagtgttgcttaaggagcctttaatttgccatttcctgttgagaaaacccaggaattctttagatgccctctctgtgcatgtctagctggctatgtcctaagtcagcattgggctacgcaatctgacaaatacgagcatacttttagagaaaataagaaagtatatttaaaattgagattgccccaagtcctttggatgtgtacttattgatctgttaatatatatattttatgttcctttagctgtgatttatctccaaataacagcaaaagagagaggcctggagagccccattcctgactagatatttattaaattccattaattgttcttattcatgacacctccctacaaccccctagaaaaacagaggatggctgtttgagaagtgtctcagaggtatcttatctctgcctttagaattccatttctcctggttgttgcacatagtattcaataaatatttgttgaatgcattaatgaataaatgaattgaagctgaatttattttaattgtagcatacatgcatgcacttttgactaaagttcttttacaaacctaatttcgtagagaaaagcctttcaaagactttgttttctgcttgcttttcaaaattctcccctttttcaaactgccttgattagcaccaggcatggctttgtcataaatttagaatgttaagaacccgttttccaaatcacaggcactgtatgtatcccacattggtgttctctgattcttggttgatgccacagagataaggctaaagctctgagtaaaagctaaatctgactgagtttttcccatagtgcctcccataagtttggatgactaatggtgttagtgagatatctaatctttaatatttcgcttctgcatcatatttctccctcattaccacatataattcagatacatctttatttggcaaagagccactggatcttgggtttttgccccattgtgtgtccttagcattgcagactcaaggtttacttttttttcttgcgttgattaaagccttcagtctcctgacttaagcctgtagtgttcaaatacagagatgtatttgtctctgcactgtctaaataaaccaagacttgctctgaaattcaaggtatgatcctagcaatgaaaaggtagcctttctgagagacaaagacattgtcgttctactacctgcagagcaaattgattagattgttctcaagtcaacaaggtggctaaatattaacctaattcaccataaagtctaaagttaaagttgttagtagatgttatataacacgagggaactctgtagattcttaatacctactcaggacctttcatatgtcttgttgggcagtaagaccttatgaagccaaaatttgagttttctctttttcctttaaattcctccagtgattgtgcaagattattattgttacagtcaaagaagttctagatcagttactgataccactgaattaaagtagctggaaatcatgatcccgttgctttactttgtaattgacttgatgactttggacctagtctagtagctatcaatcttcatagctacgggaaatctttattcaatgttctttcattaggtctttgtgcaagtctccaatgatggtgaaaagatggccaaaatgaagggaatctgaagaggttaggaatgggcattcctatggaatataaacaaaggtgtcagggtgaggaatggcagagtttgtttgagggaaactgcagttgtattaccttttttaagaaggcaaagaatgagaggagatgaggctgaccaggtcagcaagggcaggtcgggaagggtgtggtacccactgcagagttgctgcctccgtgcctagtctagggagcaactcaagggtgtgatccaggagtcaggccatgatattgacatgaatatacgccacacaggcagctgtgcggagggtaactttgaaaagagcgatgctggaacgaggaaatcaagctggggggagtcacatgggagcccaggaaagagatgattagagccttaagtaaggtgatagaaatgaagtagacaggctgatctgagtgatatttcgggggaggatagagctgtttgattcggtagttctgtgggactagggtatgaaggaatgattcccagggctggtaactacaaaacaagatgatagtagttatttgcagctgggactgataattcaggaggagttgcagcaggtccatcctttaatgcagcagtgtttattagaggtccttcctgaagggctgagtagctggaaggtgataaatgaggtatggaagaggtcgagttgaggtcctggtgacatctccatgtgtaaatgtctgacagtctgagagatagaactctgatgcttgtagaaaggatataagcctgagatattaggactgtgagtcgccagctcacaggtggtagttgaaaccgtgagaatgaatttatatatcccgggagcatgtagcagaaggagaacactggatttggtagaactccggaagatgtgaacattaaagtgtgtatttaattacttttatttttagtagagaatacatgtatattattatacaaaatccaaagggttcaaaaagacatatagagaaaagtgaatccttctccaaccttctcccctggctgtggtgtttccagctctggaggctgccatctttcttggtttcttgtgtttccttccaaacatgctctctacatatgcaaatatttgcaaacatatttatggttgttggggttacttcacacagtgtcgtgcagtgttcactctggttttctctttttacttaaaaatctctaattttcacatgctggagaaatgtgccagaagaagaggagggcagagcttgggaatgatgggagcattttcccacaggaggcaggagagagaagggttagggaactaaagtatgggaggaggcgtgaccttgaatgagaggaaggactgcctctgaagacaaagtggtaggtaaggaatttagggtaaggaagggaggaaagaagcataatggaatgaatgttaaaatgtccagtagacatcactggaaataattcaagactgattcctacggctgttcccacatgtttttaaagttggagtggagaggaaagcgtggtatatgatacatttaacgaaactaggcattcaagttacttggtgtattagtccattttcatacggggcaatttacaaagaaaaagaggtttaatggactcacagttccgtgtggctgggaaggcctcacaatcatggcagaaggtgaaggaggaggaaaggcatgtcttacacggtggcaggcaagagagcatgtgcaggagaactgccctttttaaaaccatcagatctcatgagagttactatcacaaaaacagcatgggaaaaccccacccccatgattcagttacctcccactgggttcctcccatgatatgtgcggattatgagagctataattcaagatcagatttgggtggagatccagccaaactatatcatttggtgacatgggccccaaaacaaagggctacagagcccttcttgagacaaagggagctagtttgatcacagaaatcagaaagccaagaccttttatggcaaggatgaataagagctgaagggcatacatgccacatttaagaagctgtgtaagaatggggtcaaccatctcagctctactcaggcagggaggacaggaacatggtagaagtggaatcaccattattcacagactcagtttctaactagcagggccagtgtaactaaatttccttcagtttatccaaagttaattgaagtctgaggggactgattcatagtatgcagttcatggcagtgaatggataacccagaatgaaagtttatttctccctttatcctaattatctctctttttaactgccttgtattaaaatgttatcaaggttgccttaaagcttttttaggaggagacagcatctggtttaagtgcaaatactagatctattaaaatgaggaatatattcattttttcggcacacagcatcctgtgtcttagaatccagtgtcttaggaatcacaataaaaatcaaattgtgttctggtgagcctagaatcttggcatctaaaattggatgtttgtgaggactgcttcatactacaaaaaaattgaagcacccctctggcgattagaatattcacatcttacaagtacagctgccatctccctagaacatgctggataagagtttatgttcttacaatccaatttcccttttttttttttttttttttttagatttttcatgaagaccctcatcctcctgttggccttcatttgccaattgtccctctacagtagaattgattatggtcatgagtttctttagctactttccaggcctgaggatgtaattctgttcaattctgcagatagttactgagtgcttaatgtaattttaaaattatgagactacaaagatgaataagccttggttcttaccctcatggagctcaaaatttattttaaaaaagttaaaatagaaacaactacttatatcctactgttacaagtgctctgggggcacagaggtgaatgatttattctatcagagggagtagagaggcctttacaaagagagtttaagagttgaagactgaatgggagttttccagtctgagagatgggggaaggatgagttttccagactggtggaccagtgagtaatgtgtggcttggaatgaggagaataagagggcagtgggatggtaggtggggactactgtttaaaggactttgtgcatcatactaaggagtttgggttttatcctataagcaggtgaacagtgatggctttttgacgggggggaggattgagaaaaataactgacctggcagaaagctaaagccatgaagattggtagaagcacagtggaatagtccattaaaagatgccaggttcttaactaaggatgtcttaggcaagtgaagaaggggatggagaaattagaaggtcactgaatgaatgagaccaagggaaaatggagagggggaggcatctggtgttacggaaagttttaatttgggaactgggaaatgatcattgaaaaacaaacaaaagcaacctagtgcacccaggaaaaactcctgatttgcaaagggttagtgcatggagagaaagagctacgtatcagacatactgaattctatttgcccaaggacatttcaagtggaaatttcctatgttgattttacgtattcagttttcagaaaggattctttaaaaagtcatagcaatacaattcctgcaatataaataatagatcaatgaacatcatagggattagcatagttgatttgactaagcttcagattcagtttgagcttccctgtagccagggagataataggaaacaaagatttgtctgtctcttaatattgaattaaagaagcacgcagcatcctaaagaaacatcattgttttcctggctctacgtaataataataataacaaaaatagctgtcctttgagtgattgctatggacaggaactgttctgagtacatatgaactcctatttaatccttaaaacaaccctatgaaagagaggctgtttccagaggattacgtggcacagagtattaaggacacttcatatggccagcaagtaataggacctgtattcaaacttgggtggtggtcctgaactcttaagcagcgttacacttgaagtgattattggctagtgtccttatcaacatttttataacaaatcccaagggaaattatatgtggctgtttctcatggcctttgataattgtggaaagcttaacattaaaacaccaaagatagggtgacagttctccaaggataaaggtcactgttgcctaaaatgtattctgcagaataccactgagatactctgagaaaaaaaggattccaaggacagtaaaactttgaaagcactcatactggaaagtcatcattacgttagcatttgcactgaggagtttggaagtgaagaaacctgattagctttgtctaacctcatgttgctcccacttacttgacctcgagcccaactgcaatgttatatggaacacactttggtaaagaaattcaagtctgaagtaaactttgaaaaccagtctaggagatagcatagttgactctctactgtagttgttgagaagcctatccgttgtgtctctgggaacatcagaagataaagctataacaggtgcccacgtaggaagcctggatttttcgcacaaaagtaacttttcatatgctctagtggtgaagcagttaccctgtagacccagaagccagaatgatttagtctgaaaaatctaaagataggtattaaattaactctcatgatcatagaaaattctttgcaccatttttgtagaatatcccaccgaataacttggcttttcacccaaaccaccaagaaaaattgccaccagtgacttgatgcaattaacttgctatcgggagttctttcttgtgaaatgattgaactttgaaagatgtttaccaaagacagcacctttagcttcatcacaattactgtggaatctttctttgtaagtagttagatgcaaaggccagttgttgcttgaggcctctcctggattgtgattttaaagtgtatcatcaacacatgggaagatatttctccctctttatcttatgacagaaatgcaggtatagctttcatctcaaagtaagattaaggtataagttacaaagatgtgtagctactatatggtcctgtgtaatgctacttgaggaaggctgttcctttcctggcactgaaattttagagcttgcataatcagtatatcaacctcgtgtggcttggtgcttagcaagtttcagcttctagagcccatggctaatggagccatccaggagaatgttggagagataggtctgaagccttagaagagaagtcttgattaaggagtaatgagttgcgggaaggggtcatggttgtggcggagatggaagcctggggagaggacagagacctcctaggaagagagtttgtgtaagaagaagaccaaggacctcctgatgtacttgattgtaattgggcatgagcagcccagttagaaatggtttcctgttggtattacatatgtacatggatggcttctgcagatggctaaactcacccattttatttttttactatcttaatagttaaaatatgaccttttcttgtgtctccaaattctgagttaccttatggtgctagtctgtctgttgtaactacaagtcataagtaaatccatatgattcttttcctgtaatttcctggtaaatcaaggcgataatttcaaagataaaaatctgtatttttagctttagcagtgagcatgattcccagtctttttgccttcgagtaaggtttgtttccatggtggaagtaaacaatatcccacactctagaatgtgagctcttcaagggtaagggacagtgtcctacatatatctttatctccacagcactgggtacataaatgtgtcataaaaatgaatgggtaaatatcctttggagtttttctgttacttgatgggtttttggggttgattttcaggtatctcccttgtttttctcatttcttacattattttctttcccaaaatcccttaatatacctgtttagtttgtgatgtcattttccattagactgaaaccatccaagttgtttaggctaacccagacttaagcattttctgggcttatttttggactctttttaaaactcatcatctgaaaatatttaatgtccacacggataattctgaagacatgtgcataccatttttcttttatgtacatgggttaaaccttgatttttccatagtaggagaaagcattataagattttattgttttcactggggtaatatcttttgtgctataagaaataaaattttgaatctagaacttagttttttataagacctttattgagatataattctcgtaccataggagttacccatttacagtgtattagtcactgattattagttaataggttaaccagtattagtaatcactggttattaattacagagttgtgcaaccatcagcgcacaattttagaacatttttatcaccccccaaaagaaatcccatccccattttcaagtcactcctcgtttctcctgcaactactcttttcagccctagcagtagacaatccctgatctactttctgtctctatggatttgcttattctggactgttaatgtaaatgaaataatacaatataaagtcttttgtgactggcttctttcacatagcgtaatcttttaaaatggtatctatattatagcccgtattagtatttcattctttctttaatgctgagtaacatttcattgtatggatataccacattttttaatctattcattacttgatggacatttgggctatttctacttattgtctgttatggataatgcagctatgaacattcatgtacaagtaccggtaattattttaaagaagttattctgggctgggcatggtggctcacacctgtaaacccaacactttggcaggctgaggtgggaggatcacttgagaccaagaatttgagaccagcctgggcaacatggggagataccgtctctacaatttttttttttaattagccaggcatggtggctcatgcctgtagtcccaactactcaagaggctggggctggaggatcacttgagcccaggaattcaaggttacagtgagctatgattacaccactgcactccagcctgggtgacagagcaaggccctgtctcaaaaaaagaaaaaaaaaaaaaagattctatagtttctgtcattgtaatagaggaggccataggatcatatatggcaagagtatatagcagtgcatgccagggagtgaaaaataggccatcaaattgaagttactgggagaacttaagactaagtctaactacgcatgagggattgaagccgggacacacaaagcttaaaattatgattcttctagagactgttacggctttttgctgaccacagacaatgaaagtttgatattttgctgtatttgtctgaaaatggaaacacacttttcccaatggcagtattcctgaggactagagttcttcacctctaaaacctctccaatcctagtttttccttttggctgatgatgaccagccactgccatttttgtcttaggttttgttagtctgtcttatttccagttataagtggttaaaatttcttatgaattcttcttgtgttgaacttttgattaatacatttagtctatagacagtaatgaattagcatctgatcaggaatttgtgaaaaacatctcagtcattaaagattaagaaactgaagccaattaatattgtcatgttctgtctcttggaacttgagcaagatacagatctacgtgtcaatgacatatccagaaaatagactccacctagatacattaaccctgtacccttggtccacatattttatttcagcaatgatccatggacatattataatttgacagtttcatcacatacctagcgtattgggtcaaatcaaggaaatctcatcctagtgatcttaactcagtgatttcattttgcccagatgttcagctgtgataaactttactaaggcacagatgatggatgatacacaataattccaaaatttgggggtggctacaatgtggctaggggctagaactcaggtatctacaggacaaatactgagtgattagtcactttctaagcgctagatatgcatatgttctgccaagctcagtaggtctaagtagattgcttccatttcagataattaagtgctttctttttataggaagtttttagcacatctgaggttctaaatccaaaaagtaaataatatatagagaaagaagtaataacaataataatagtaaccaacatttattgaacacagtatgggctgggcatggttcaaagaaagtttgacatatagaatgtcgaccatactggcttaataatcctcataactgaattagtgcttaagtcagttgcccagcctcagcaagcagcagaggcaagtaagtcataaatcaagatcttctgaatccaagaccatctctcaagccttgttctaattctctcctcagccatggatggtgaaaggcaccacaaaggcagcgtgtcaaaaagtggcattgttcaacctttcccctgatggggcaaagcttttatttttttcctttacgttctttgacatctgttttaaaatgcagatatcactagaagaaatgacaactttattataaaatcccagtaaaatgtaaatgtcttatataaaacctttatactgagcaaatttcagtaggaaagggcttggaagtaaggctctgaatgttttaaagggggacagtgctaagaaatgattagaaacaagagcctggaggggtcctgccatttttactgttttgcttaaggctgacctaaaatatgcatagtcttacttctcaccctgtgagcttatccttattaatgtctttttccacctagtttaggggtatttttgaatttgtgtttgataaagatgtctaaagctgtactgtaaaattttattgtcacttttttttttaaatggagtctccctctgttacccagcttggagtgcagtggcatgatcatggctcactgcagcctcaacctcccagactcaagcggtcctcccaccccagcctcctcctcctgagtagctgagactacaggcatgtgtcacgacatatggctaatttttttcaatttttttgtaaagatggtgggggtgtctccctatgttgcccaggctggtcttgaactcctgagctcaagtgatcctcccacctcaacctcccaaagtgctgggattacaggtgtgagccattgcactgagctttattgtaatttcaagggctcaatgcaatttccagtttttaaagttcatcttgcttgcagaatttgtctttcatttaaaaaaaaactgctgattggctacatttatagctgctgtaatagttctgtatgatttactacatttgcctgaatttagattggtggatatgatttagctgcttttaatattatatgagggtaaagccagatttctttggatctattccttttagatggcaatctttgtagttgttctactttacaaaataatccctgtgtgtgctcatgctttggtatacagttaaatgtatgatactgttaagaaaacattgatcactggaaagtgaccttcatttctttatttcataaatatcattatacaactatataactacacgtagtagggaagctccatttaaagagtagatgacttacactgaaatcatttgacctttgtaaattagtttaaattacacagagattgttgtaatgttctttatcatacataatagttacgattgctagagaggcactcataaatcattgctaaaagggccagctgctttcatgttttcagcaggttgagttaagggaacaagccttgccaatttgattaatctcttatgtccattagttggttgggaagtttttttgagtgtaaatttgtatgtagacaacagagtttatattctttatgacataaaattaatcagatatatctacatatttgtagaatggggggattcttagctctatagagaataagaaatactggatggaagactttttttaggatgactggctacaggaagaaattgtagtgacagaagccatgtgtattgaatttgaattaatgttccttagggagctaccagagaaatataatttacaagataatcaagaacgtaaatagattctctgtggagtcgttgtctgatcactgacatatattcatctgtattgaaatgacttcatgactacattctaacaattagagaatcattaggggtgagatgtacgtgtataccttcaagaaaagcaaaatatgtattggtaataattgacagctgttaaaacgagtgcattgtgtacttgttaaacattagaggctgggcatgttggctcacacctgtaatcccagcactttgggaggccgaggcaggcggatcacgaggtcaggagatggagaccatcctggctaacacggtgaaaccctgtctctactaaaaatacaaaaaaaaaaagccgggcgtggtggcgggcacctgtagtcccagtgactctggaggctgaggcaggagaatgtgaacccaggaggcagagcttgcagtgagctgagatcgcaccactgcactccagcatgggcgacagagcgagattccgtctcaaaaaataaaaaataaaaaaataaaaaaaaaacattagaataacttaccttggaacagtaactctgagggaaccttgatcatttatgagaatgatctcccctacgttaatactgcatcaaaactaacattatggtatacctcaaaaagtattggcatagatgtttttaaatataagaaaattcaaatgcgtaattgataagggctaaatggctcaatttcccaacccctaacaaaaatatgccctaacacagctctgtgactatgactgcatttattagaaaacatttagtaaaaatcatctctagttcaaaccctccagcatcagttcttcttgataattctcatgaacatttagaaataccttaaaagagaattcagactcaaatcaaaaaaccttatttcatttggttgcaggccaagatacctcttttaaccatttctggcttttagaatccttatcatgacagcttgtcctatctcagagcttcaggaggaaaaactagtccctcaaaatcaagtttgctattgagcttaataagaggtttctgtatgtcatatgtttgtttagaagaaaagcacttgttcgactcatttaatcctggcctgatgaattaaggcttgaattaatactgagggaaccttgactatacatctacaaaatcaatgtgtcctggtaggcttctgattaagataacattagctcttgcttgaaggcatctttctctgctcctaccatttatccagtggtagataatatatggagtgaaaaatgaaaaagacatagctgggctttaaagcaagatgaacatctctgtgaaccagaaatgtgaaagaaaaaaaaaaaagtaagtggggctaaattagtgggctttcagctcgtgctgtagtaacagggattaaaattctccttacaaggtagtggcccaaagccaggattactatttgaaatcagagccccacaaaaacacacctagagagagacacatacacacttacacttaaaagcaacatgaaaagaaacagtttgctgcaagggtctacagcttatatgcagctatggccctaatgcatagagccgagggaagaggcaaagattcgcagttgggaaagagagcatcacagccttgaaaccaggacctgaaccaatctacctactgcctggcaatgaaatgagtgatatctctgtatcactcagtgtaggagctgcaaactaccaacagatgtggctctaaactctaagcccctgggtatggctgggagaagccataaaaccacctgagagagagataatgagtttaaaaagagaggaaaatattaaagtacacacacatgagaataatagaaaacatacacatgcatatgtatgcacatgcaaaacatcccttgcaaaatttgtctccaaatcacgatccaaaatacatgaagaaatgggatagcaccccccacccaagttaaacatcaaaaagtgaattaggctgggaacagtggctcacacctgtaatcctatcactttgggaggccaaggtgggaggactgcttgtgcccaggtgtttgagactagccagggcaatgtagtgaggtgccatctttacaaaaaataatttaaaatatattagccaggagtggtggtacatgcctgtagtcccaactactcaggaggctgagataggaggatcgcttgagcccaggaggatgaggctgcattgagccataattgtgccactgcactccatcctgggcaacagagtgagaccctatctcaaaaaaaaaaaaagatgaattaattctagaagaaagcaaaataatacactagtacaacaaagatttttacttacatttaagatgctcagaccaggtgcagtggctcacgcctgtaatcccagcactctgggaggctgagatgggtggatcacctgaggtcaggagttcaagaacagcctgcccaacatggtgaaaccctgcctctactaaaaatacaaaaattagctgggcatggtggcaggcacctgtaatcccagctactcaggaggctgaggcaggagagtcgcttgaacccaggaggtggtggttgcagtgagcggagatcgtgccactgcaccccagcctccatctcaaaaaaaaaaaaaaagatgcttaaaggcataaataaggggtaccactcgctaaaataacaagaaactaagaaacagagatggatgaaatgtaactaggtctgaaaacaaagatatctttgccaaaaaaactagtcattgaagttactaaactcaatatacaggataaattctagactttgtcctgtcagagaaggcaagggaattagaagatgatgctgagaatgttactgtgtacaacactcacagaaaaagataagaaatataaatgagcaattaggagaaatggagaattgaccacaggctctacaatataccttactagaatttagaggtttgtttaggagtgtatttgagaggtttcagaagaaaatggaggaaatggtagagaagtaatatttgaagctgtcatagctgagaatcttccagaattgaagaaggatgtgagtcttgaaggaaatgtgctcccaagagaaatttcaaacatctgggaaggaaagaaaggcctgcattgagcaattgatattctttacagctcagctttggctgattaaaatgagccttttctgttttcactggaaaccaccaaaacagaaatgtaatgtgttgtatataccaaaccatgcctcttgaacaagggtccttataaataaatcataaaagaagagccctgtggacaactaaacccacaggatcaagataccaaggaagatctctctagaaaaggcagtctcctgtcagcacctttgtgaaaaataggtgggaagacagtaatggcttgttgtaccatcttgaggtccatgtctaaaaactgttttcaaaaggaacaccatggctgccccaatctggtagaaagaaaaatttgaataggattctacataaaaagtgttgccagttagaacattttgttgaagttttcttttaatgaagagggaaaaatagaaagtaattcctatggaatgagaccttgtgaacattggatactgcttcaagttcacagaaacattgaactgattgccagttaagttctcagaaattagatttaattaatgtggacagttacatacatcggtgcacacccagaagacccgtgtgcagaatctgactgaaggtgtacttacttcgatgaatctcttctcatcactgctttgtcaaagcagattgctatgaaataaactatacaaacaactacccttgaaggctgatagcaataggatttcaatcagtacagataggagattctatttctgtagatgaaaaagatcatacattgattttctgtgtgactttaaataaattcctggaaaccttgtaatgttaggtactaggtagaatgaaaaaaatgaagcaaaacaaaacaaagaaaaaaaccagagtagattgggttttctttctgcttccatgtggagatctagccttttgaaactgagcattttggaagacatgccgtcccctgtggaatgttcattccgagtatgggacaacagaaaatatttagcagacctggtgatgagatgatcttgctttctcaaactggacaatgggaaaactcttcttggctactcactacttacatttcatctcttttctcattgatatagatctcccacatttgtggataggaatttctctcacctgatgaaatatcatctgtgaacaacagaaatctgtcatcttattttggtatttatcacaagtagaagaaagatgtcaagagttctaatcagtcactggatatcaaatatcagaaatgtcctcaattggaattgtattctcagtaaatcctaaagcatttgggaccttcacatgtgctaatactgtttatatttatttggaaattaaccaaatataaccaaaagacagtggaataaccatagaaacctttaaatggaataaaatttatggcaatcaacattattaggaagaaaaagtatactacctagaaacagtgcaagaacaacgaggatcttctgtgcatctaactatataggtctagaaatatataaagtgaattatgatagaattaaaaggagaaactaacaaatccataattatatctcaacactcatctaacaaaaattgatagctacaaataatcaaaaattaataaagatatggacaattttaacaacaaaatcagcacactatgtatttagagactccatctttccaatggaaaaatacacattatttcaagtactcaatgaacatttttagaaagtgactgtgaactaggtcacaaaaagaagtattgctaaatttcaaaggatcagtatcatacaggggttctctgattgaaacgcaattaaattagaaatgcactaagaagtgaaaatggaaatataaccactgtgctcctaaatgactatgggttaagttaaaagaaatcacagtaagaattacaaaacataaggcactgaattgaatcaggtgatgtatataaaaacttttggtatataattaaagtggtaccaaggaggaaatgtataaccctaaatgtgttcattaaaaataaaaaatcaatgacttattcaacctgtaaagcaagaggaaaaaaaagagtaacaagtaaaacattattaatggacataaaatgagaccatagtaagtaaggagcttcactgcattcttggatgtgaagactcaattattatgaacttagttcttcccagtttaacctatgaattcaatgtaattcaaactcaaaatttcaacaagcattttcataaaatcagaaaaccaaacactaaaatcatggagaagatcaaaggggtcagaatagtcaagacaattttgaggaaaaacaaagtgggctgagaaggcctatcagacatcaattgatttaaagctggagtgtgggatctaccagggatatgcagatagaaccacagactagaatacagagctcagaagcacacctgtatatttatggacacttgatgttttgcggaagcatcgttagagatcagtgggaaatagatggaccatacaatgaatgaggctggcttcatagtttatccatgggggaaaagtaaaattagatcgcatgttcacggcaagcacaaaaatagattctgggtaaattcaagtcctaaatgtgaaaaaccaaattttaaactttaaaatgtaggtgtaagaaaagattttcgtgaacaaaacataaaaagcagagaacatacagggatatgttaaaatttacatcttttataccataggatgccataagcaaagttaaagataagctacactaagataagggtagaagatcatatttgccatgcacataactaacaatggattagcatctagaacatatccaaaggtttaaaaagaaaaagacaatccagcaggaaaatgggtaaaggaagcatgaaaagccagttaacatggaagaagtctaaccttgccagtaatccgggatgtatgtgcaaattaaaatgcacccatcaggttaactaaaacttgaatgtctgataacaccaagtatttggtgaggaggtgggccaaatggaaaacctcattcactactgaagcgagagtaaattggtaaaagcaccgatttgtcacccagagcgattcggtgacatgtagcaatgttgaagatgttgctaagatccaacaattccacatcaaactatattctgtaaagaatctcttcaacaggtatccaaggagataggtataaaaaagaatttcattgtatcattgtttataatagtgaaaagttggaaacaacctaaatgtccatggacaggaaaatgttggcatattcaagcaacagaataataataccttatggcagttaaaatagcaaactattatgtatcgacctggagaaatctccaaaatggtgttgaaggcaaaaagcaactcttagaatggtatgtatattcttaaatgtgaagttcttaaatttaaagtttaaaaacatgcaaaataatgttattagattgaatcacataaaatgggtgtttttgtaggtgaaagaaaaatacaggcaaacatcagcatcttttttaagctcaacctagtatttgttgatacattcatggtaacactgggcatgaaattcagtgtggcattatctccttgagggcagcggggaggagagaatggtatggtgttgaggcgggcatgtgagggagcttctgctttggctgttaacttttctttcttcaaaaaacttttgaagaaaatatggcaaatgataaacttatcaaggggaggtgataggaacatgggtatacttactccattcttatacatttctgttgaaaatatttgctaatgtttagagcaaaccaaagtgttgatagaggtataaaatttttaatctcatgacattataaagaaatatttacaaagtgattaaatcctttgctgcttacttatctgaacataccagtcgcgaggcttttagtgtaacataaaaaattgaaaagcatggctcccttcacacaccaggcaaaagcttcaaattttgttttgttcttttagcactggtaagattgtcatcattaaaaccattcattagtgcctcttttgcttgctgttcttcggtggcagtcagatgcatctatctaccatggtatataaaatttggtgatgatattcaaattactttttttcttctttttctttttctttctttttttttcttttttacttttttgatgccaataggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaagtgaggagagagatgggatttttacaaacattcatttttccctcttaaacaaaactaaacctcagagagcactttttataggtgcaacaagcatcaattcttaagtgcttggtatgtgcctgcaaagtgatagtatcaaaggatagaagtagaggagatagaaaaactagtgtgtcttttttgtatttgtccaatattgtttcctaccaaaatggttttttcttgaccaatttgaaatacatcttggggaaaaaaacgcctaaaggtttccactagttctctaaaagtgaatatttcacttcttgaaatggaactatttcatttacaattagttatattttctggtatacctttgtgttttttttctcctaatccctaacacatagttctttaagcctccatcgaaaacctagcaagatactgcattgtaagaggacctacctggacatagttctggctttctgggaattttaaatttttcaattatgttctctctatcttgttacttaatacttcacaaagatatgaatcttccattacagttttgagatctcacatagtctcatcattcacacatgaccttctaaatcttccagttatttaatgtaatgatgtatagtctcattccagtgtagctctgatttttttctcaaatttataagggagcacaattcagatacaaagacagtttctatggattatatcaacagtgaaatatcccaaattaaacaatctttgggagggcttctaaagtaggaagggtcaaaatttatgagtcctgagtgtgtatcatattttgaaatttatacatttgtatgtttattatgaaaagtaattctgttttcttttggatgacttagccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggcgaaaaaagtctaaaaagaaaattctaaaaaggtgtattctggcagctctatctggcccacagaaaacttgtataggtgagaagaccagttaggaggcaattgccaaggccaagattggtgagttctgagggcctgcacttgagagatgtgggaggagaggactgtgagactattctataaaaatagacttgccagggggctgggcgtggaggctcacgcctgtaatcccagcactttgggagggtgaggtgggcggatcacaaggttaggagttgaagaccagcccggccaatatggtgaaaccctgtctctactaaaaatagaaaaattagccaggcatggtggtgggcgcctatagtcccagctactcgggaggatgaggcaggagaatcgcttgagcccaggaggcggaggttgcagtgagccaagatggcaccattgcactccagcctgggcgacagagcaagactgtgtctcaaaaaaaaaaaaaaaaaatagagttcccagggtctggggactgagtgcaaattgtaagaagaggaatgaagggagaggatttggttggaagaagatagtgaaacttctgattgtggacataatgtgtttgagaaattgacaggtcttctaagtcatgtcccaaaagaaattaagatacagatctatacttgaagtaagtgggcaaactggagagatttgagaatgagtttcatagaattgattgctgaagggtgtgagatgagaaatctataaaatctataacacaggtgcttcgatccagtgccttggaaaagacctccatttgggtaatgggatagtaaaggatggataagtagggaggttcaaggaagatgtgacaaaaaggtgaaatgctaaagagagctcaatggaaattaaaataaatcacagtccattgggtcactataaatgcattgggtaattttgagaaaccattttaggccaagagaagggaaggtggaaaacttctgtttcaatgaaatgaaagactaggtaatcttaaaatgaatgaggattaaggaaagtgaagacaattttgaaacattaccaagtaagaaggaagccttaggcaaaagttggatgaatttgttgaggaaatggtccacatgttctgttctcattcttagcaatgttctctgcctaggactaggttctaagaaaggtggagctgatgaggcataaatgatcaaaggtcaaaacaagagtagggcattttacagtggtaatgaatggctaggacaggggttcctagccagctgctcattggtttttcctgctgtgtctggctagacaatagagggttttatgaaggccacaaatacttggtcccccttcctcatttctctttctctgtaaaggcccagtaggagtcagctccatcctctctccttacttttccctgggacctaaactggttatatacttggtcctctcaaatcttacctcacagaatagaaaagacctgtgactccttgattccatacacttacagctctattgcctgatatgatgatgtgttcaggaattcatttcatacttgagctcttccatgagggtagaataaagggaggcaaagtgccttaaccaaaatggataggacagaaaggaaaagtcaggggtgtgggtgagttttatggcgaaaaatttggagatcacagtcgggaaaattcaaaagttggatatcatggaagtaaaatactttcaagcaatttctacatctaacatggtgcctcccagcgagctgctgaagattttacttggagatcactgaggggtagggagtacagttcatggagttgatgagaccaacgttgctgagcttatcagcagaggggtgaggtccagatcctgacgacagtggtagatcaggatggaaaagatgttgaagaagatggacgagggctctgaggagatgaacatttctgaggaaagagacagggtagttgaaataaatgtgatgaagttcaagaacctggagcagtgggaagaggcacatcctcctctggagaagccaaatcttgtaggaaagccaggttttgatttttttgagaaggaaaaggatatgtttgaggttattttcctgaatttactacacctccatgatttaaggcaatctctgtgtcagattatctccctccacctgagatctgaatatagctaataaactgttgggattgtaaatgacaacacactacatgaaaaacaactgtatgcatttgcaaagtctgtaaattctgaaaacaactgagctttagtacctcttatttttttctacttcaggattttcccccttttttaagtaagtaaagcatatgaaactaagttacatattttagtggtcagattcagagccctgggtgcttagaagcattaataattatttaggtcgttgacaatggcgaataggcagcatactcgttaaagcactcaaattaaagtgcacattaggatgtggtcctgatgatctgtggagctaaaaagatcatggtagaactgaataccaggacaaaagtgctatattccaatggctaagctaagagataacttgctggcataaaatggataagctgtgttaaatttgtcctctgaaagaaaagactgaattcaagggtactttttcttgaactgtgtattaatctgttttcacactgctataaagaactacctgagactgggtaatttatgaagaaagaggtttattgactcagttccacaaggctggggaggcctcaggaaacttacaatcatgggggaaggtgaaggggaagcaaggcatgtgctacatagcggcaggagagagaaagcgaggggagaactgccacacttttaaaccatcagatcttatgcgaactcactatcatgagaacagcatgggggaaaccgccgccatgatccagtcacctcccaccggacccctcccgcagcacatggggattacaattcaacatgagatttggatggggacacagaaccaaaccatatcgaactgcataagctaacttcatttaaaaaggaaaaaagccttaccgtcttcttgaaggatgcacacaggtgtttaaataaatgcagtgtatatacttgggctttgaaggtttgagatacaaggctgggatctgctgaaccacattctggatagagctgcattctttaaatatgcaaccccgatgactgattttcttttaagtgaaacatgagacaagtcatattaggtgatgtgtctaaagagtcaacatatttcctcaagccatgaaatacttatcactgagtctctatgtaccatttgtattctgtacagttcttactgagacaatgtgctaatgaaacgtacattctattggaggaagcaaatacagaacaaaatagcaattaacaatgtttatcccctattggctctcatgggctccatatacaaatctgtgatgtccagacaactccttatctctgatgactcctaactttccaccagattactgttttttgaagcattttatattttattgatttaaaaattaaactgttcctttgctttttaaaaaatttatcatgtacatttgaggtttatgacataatggctccctagctttttatttagaacaatttcaaacttatggcaaaactgcaattaattcaacagtttgccacatttgctttatagctatttatttatgtacttttacattcatgtgttgttaaatggattgcatatatttagattaacatgtatatctgtatgttaacatatttttatatactgtatatgtttatattttatgtgcatatttaatcatattcatgcgtgtatatagtttgtggatttttttttcactgatccactcaatggttaggtttcatacataacacttcacccctaaacacttgaacacgtgccttctaaaatgaaagatattcttgcataagcacaattatcatgctcaaaaagaacaatactgttatataatgtagaatttaaattcaaatacctccaattctgccaattaatattcttcatagcgatattttacattcaggatcagtgatgtccctgtagtctcctttaatctgaagcactttcccagcctctttaaatctttcatgacattgatatattagaagaggtcgggctagatgttttgtagaatgtcccccaatttgaatttgtctgcttgtatccaagtgattgggttcgggttaaatgttttatgccagattaccatataggtaaggtatcctcagtacatcacatcaaggttttcctcaagattctccatccccttcaccgttcttcactctccctgggcgctccttccatactttggcttctgctatgctgacaactcttaagtcaagatttccagcccagacctcccacctgagcatcttctggataaaattataaataaaaatatagcctaatctgaaatcatgatcaacctttggagcatctcttccaatttcccaatctatacaaagtcattttctaccccttcttcctttacctgccttccttagctatgttccaccaccatcaatccagtcaccaaggtcagtgtgttttgctacttatgaaaaagagcaaaattcttcaattcagctacttctgcccaaatttagccctcatcatgtgttacctgaacagacaatatgaatactttcctaattggttcctctgcctttggtctctctccctttctaagctatcttccagaaacttcagttcctcttctaccattcaaattatatcatattattcccctctttaagcattttatgccttctgtttgacaacagaataaatgtgctctttggccttgagtacattatgttcttaacctgaaatatagcatcctttcttttcactcagtgagttttcttttggaacttaatcatgcattatatcattctggttttgttgttgttgttgttgttgttgttgttgttgtttcttttgtgtgagacggagtctcgctttattgcccaggctggagtgcagtggtgcgatctcagctcattgcaacctccacctcctgggttcaagcgattctcctgcctcaccctcctgagtagctgggattacaggctcgccaccatgcctggctactttttcttgtatttttagtagagacagggtttcaccatgttggccaggctgttcttgaactcccaacctcaagcaatccacccgcctcagcctcccaaagtgctgggattaaaggcatgagccaccacacccagccatgttttcagccagttactagtacttctttcttctgcctacaactccctagaacttaagctccttaaggacaggatgtaagtcttgctcattgtcgttactgtatgaggatactctgtgcaacaaacaatcagtaaagtgcttgttgagttaatattttagaaatcaagcataatacattcttgtgtacacatggaacagcccacacgtttaggaaatttagctactagtttcagtatctttcaccaccattcacaactgatcagctaataatcagcaacaacattgtacaccataatatgttaaaggtgttacacacagaatttatgtgtgaaattgaaagcatcggtcctatatcatatggaaaaaaattaattgtagccaaatgttgggtattggatacatcagtgtgctttttcttctaaaaaatactggagaaaggcaggaaatacacaagtactaagataataacacatcaagtcggaaactggttaaaatccaaagaaaaatgttggtgggcgtatttgttcatacacagccccctttatgagaaaaaataatttcttgtacacagctcctttttaaaaaaaagagaaaataatttgtttagattcagacaaaaacacaggagtaattcttgtgtctattctgcataggctgcgtaggttctggctaaaatcactttttaagcagatagaaccattatcagcgtttgaatcaaagggaagtgagtcagatgggatatcttcccttcaagaaagggatctgaaaccatcgttatatttcagaagactgaagaatatcttgccatggcaaagcattccttttcttttttctcggattaaattgagtcatcccacttcttttttcttcacttcagcagtgattaaaggagactatcatattttgctatatcacggtactatttaactttgactatgtctttccttattttaaaaaatgtttcagtgatttatttggaccacaatcagacaagccaggaagaccaaatagctaataatccaaaaaacattatttttctctttttattatttcagtagttttcagggaacccaggtggtgtttggttacatgaataagttcttcggtggtgatttctgacatttgggtgcatccatcacctgagcagtgtacactgtacccaacgtgtagtcttttatccttcacccccctcccacccttccccccaagtccccagagtccatggtatcattctcatgcctttgcatccgcatagcttagctcccacttataagtgagaaagtacaatgtttggttgtctattcctgagttactttacttagagtaatggtctccaactccatccaggttgctgtgaatgccattatttcattcctttcatgactaatattccatggcgtgtgtgtgtgtgtgtgtgtgtgtgtgtgtgtgtatataaacaccacgtacatactgcattttctttatccactcgttggttgatgggcatttaagctagttccgtatttctgcaattatgaattgcgctgctataatcttggtatgcaagtatatttttcacataatgacttcctttcctttgggtagatatccagtagtgggactgctggatcaaatggtagttctacattttagttctttaaggagcctccatagtgttttccatagtggttgtcctagtttacattcccaccagcagtgtaaaagtgttctgttttcaccacatccacactgacatctattatttatgcatgtttgtggaaatcaccttggagtagagtcaagtttaagtgttaaagcattgccatcaactaagtttaaaatcccccaaagactagcaatatgctatttgagcaggcaatgaatctgtgaagtagggataagggctgtgcaggtctctagtgtgcaactggaactcagtattttcttgttgaataagtgaaaaaagtgaaaaggtgtttttgtttttggtgatgaggggcttgtgatgacaggtattattgttagagtcagaaatattttgaggttgcctattaatatggtttggctctgtgttcccacctaaatctcatctcaaattgtaatccccacgtgtcaggggagggacctgatgggaggtgactggatcatgaagaagttttcccccatgctgttctcgtgatagtgagtgagttctcaggagagctgatggtttttaaagtgtgtggcacttcccccttctctctctctctctctctctctctctctctctctctctctctctctctctctctctctctctcctgctgccatgtaagaggtgccttgcttcccctttgccttccaccatgattctaaacttataatcatgaggcctcctgaggcctcctcacgcatctggaactgtgagtcaattaaacctctttcctttataaattacccagtctcaggtagtatctctatagcagtgtgaaaatggattaatacacctattatgttgtagctacatagtgtatgattagacaagccataaatattatatctggcttgtttcatgcccataatagtgtatcagtcagctgttgctgcataacaaataaccacaaaattctcaagttgcatatttctcattcacgcatctgttgtttggctgaacttttgctggcaatcagctggacttgacaccaagttgtggtttgggttcaggtctgttcaacatgtctctcatccttcttgggctagcaagctacctgggccatatgcttcttgtgcacataaacacaagcgggcaaccccaaccagtcaaagacattctaagcctctacttttgtcatgcccgcttacattccattttccaaagcaggttatgtggccaaatccgaatccccaggccagggaagtactgttttcccagctcttgttcactctgctttatctacattagacttcttgctgtgcttgaggaagccagtcacactctcctctcagagtctttgcatttgccaatccttctgtctggagcacttttccctcaaatacttgtgcaactcataccctccagttcttaaagcttttgctcaactgcatctcatcaatgaggacttccaagactccactttctgatgactctcattgtcccttgctagccctctcctcagagtgttcatcaccactcaagatacctatatagtttacttatttacttgttaagcctgtgtgcctccttatgaatgcgagtttcacagagagagtgtgtgggtggggtttgtttgcttattgctatatcttcagtgaacaatatgccaggcactgttcaaccatttgaacagtgcctggcatatatagttggattttaataaatatttgaataaataaatgaatcttactgtttttaaacttttgtggtttttaaaaggcattttaaaaatctgggttagtatcaaatattacaatggtattactttaacttcaggtttcatttagctgttttaacttttacaatatattctgacacagaaaatattaggcattaagcatttttcaatgagttgattcacttctactcatgcacatatgtgatgtctgatttcgattcttaaaaagagatgagcctgggcgtggtggctcacgcctgtaatcccagcactttgggaggccgaggcaggtggatcacgaggtcaggagattgagactattctggctaacacggtgaaaccctgtctctactaaaaaatataaaaaattagccaggcgtggtggcacgcgcctgtagtcccagctactcaggaggctgaggcaggagaatcacttgaacccggaaggcagaggttgcagctagccgagattccaccactgcactccagcctgggtgacagagcaagactccatctcaaaaaaaaagaaaaagagaaaaaaagcaatgcattaaaaccatcttgagaaatcatgaaaatatggagaaaagaagaaaacaagattatactctacttgtttttatactacctagaatgtaataggcactcaaaaaaatgtctgaatggatacaattatcactgccttaaaagttttccattaaagcaaagaagccaattttacatttgtattatacttggacactcatattaaagactcacagagagtttatctggaaaaataaacttggctgacatcattaggtttatactttataatttgatctttgaaataattcaggaacaggaatgccagtcacttcattgaactgtacctgaattttaacacagtacaattgagttcctagagctccaatatgatgtaattaaactgtcagaaatattaacatcgatgttcatgagcgtcgttcatgatgttctcttggttctgatttattcagtgaggcatactgtcactgaagtggacttactgccattaaaaatgcctcatgtttcccagttccgcaaaaatttgcatcagtaatgaaacagagagatgtaatcagccctgcagttgtcaggatcttgatcctcttggtagtatttcattcatttcatcttcaccagataatggtagtttaaaaccgcaagaaaaatgaaactaaaaatagtgaatttcacttctttttctaaaggcataaacttaagcaaatagtgcatgtgtgtgaggggggaggaagagagagagaaagaggagagagagagtttgtaactattccttttctgctttgtgaccttaattcttcagcacccatttcctgtacttaatattgcaaagaggtttcctgtggtatgttaccaggagactcatgtagtctgaggctttttatctaccttacgttcttatccctccattctaataaaaatatgaagcctcacatccacctagaatatgattttgtcttaatggttagcattggcaatgattcttttagcttctgctgttaaaaaaaaaaaaaggaataaatgcaggattctaatcaaacatgaaaatccaagtggcatagaccaaagggaatgagaagcatatttaagtcatttagtcactggcttccgaagcagttccaagtcagatgtaaacctgaggttgtccctaattaagttcattatggttgacttgctaaagcaaggtcttgttttagatggaagtgacaatgtgcaaaacaaacagagcttgaatagaagttattttcactattggaagattgtatattatgaaaagttagtttcaaaggacctttaaagtttaattttgtttgcacctaagaaatttccctttaacttgcaaatgctgtttgaagtgtatttctttaacacatgaacaaacaatacagacacagattcacaaaatctacaaggagatttccattcccagtgaatatcatccatccataggtttctttgcttccagatcatcattctctcctcacataaacagtcaaaatgtttgtaatgtcttctttataaaacccaaaacataattatgataaagtagtcccaagtaacagaggaaaggaccataactctccaatatatgccatatctacagtttttagaatattcatatttcattacctatataggatatatactatttttatttctattacattggagtttaaaggtacttgagtttcgtttgtatttttggttaaatgtcaaaacaaagagtgaaaaaaagacctcagtgtctcaactcccttcttaccttcatgaagtgactgcaaagtgttcaattcttactcttttgtgttgaggagacagcactgcaagtgtgcagtaatacttattttattacatagaacaaagtttcacatttgtgaatggggcacaaaagagagcttgtcagttttacctttttcaattgactttttcttttattctttttaacttttaaatttattttttgtttttttgtttttttgtttttaaatagagacagggtctcactatgttgcccaagctgctctcaaattcctggcagcaaacaatcctcccacctcggcttcccaaagggctgggattacaggcatgagcgaccgcacccagcctgttttttactgtagtataatatttgtacatatttatggagtgcatttgatattttgttgcatacacagaatgtgttaatgatcaagtcagggtatttagagtattcattatctcatgtatttatcatttctatgtgcggggcacatttcaagtaactagtcaacttttaaaaagatacgcagtaggctgggcgtgttggctcacgcctgtaatcccagcactttgggaggctgaggtgggcagatcatgaggtcaggagttcgagaccagcctggccaatatggtgaaaccctgtctctactaaaaatacaaaaattagctggacgtgttggcgcatgcctgtagtcccagctactcgggaggctgaggcagaagaatcgtttgaacctgggaggcggaggttgcagtgagccaagatcgtgccactgcactccagcctgggtgacagagcaagactccatctcaaaaaaaaaaaaaaaaaaagatatacagtttttttttctccaagggtaatgatatagataaactactgtatggatttcttcttccctttaaagaattacttcctcattattaagcttgagggttttctttgttatttatgagcaagtgaaatgaatttataatggtgttaaaaatgtaatcatggccctttaatatctgttttctataaatgtaattttccattatttgtttttgcttttattaaggtgaggaagatcttctcagtcctccccaggacacaagcacagggttagaggaggtgatggagcaactcaacaactccttccctagttcaagaggtaagctccaatacctagaagggactcagatttgctgggatcaggccactcgcttccctacccaactggtgtgtgtattttccatatggaagccaacacgcagtatcagaatggcaatttgggtccatggtgaaaagatttgatttttaagtgtgaatttgtggtttagagtactctgaattcaaatacccgtgagggcaacatgtttccaaaaataagaataccaccctctatttgtcaagtattttacttgcttcacacattagtctgaagagttaattatgaggtgccctttactgaagagcaattattatgtgacttttacagatgaggaaattaatgccctgatagtgcctttgccagggacatatggctactacgtgctacagcaaggcctagaacaatgcctactgattggtagtggtagagattctgacttgccatctgatgccctttatatttaaaaattgtatcttactccatcatttaaatatagggacaattaaatcttcatagagtagttggttattttttacttcgatagaggaaatacaggcttagcaaagaaagacattaatatttttctttttcttcatcactttggccttgcgtattttacccccatacaaaaacagcattttaccctgcagaattttcccactggcttgcatgagcttcagatgtcttgcttcatccaagatgatgttttgctgctactgttcgtttctgggggcatttatttggtttattgccctcacataaaacaaagtcactctctcgccttccttcaacgaataaaaaggatggtggcagtcacctgtgatcaaatagaagaaaagcctagagaaacaaaagggagaaaacacaaggctttgtggccagtgattggcacctctaatgggtagcctgggagggacgggcagcaggaaatctgggctgtttgttcctctccataagggcaatgaggagggtgtattgagtagtgtgtttttcctatctttttgttcagtgtcagttaacaatggccatttcctagctatttgatgtgcaagtaaacgttgtgcagtgcacattaaaagcaataatgttctggtagagcgttgctaaggaaccgtcaggggaagctaattttaaatgtctgcaccagccatcttttcactgctgagcgccactgaagtgatgattttaacagataaaaatcttatctgtcttccacccacctccacatcccccaccgccacccgcatccccattctgactatcttaggtatctccttcttctagatgtcataattcataatgagaagatcatacacaggcttgacagaatcaggtgctttcacgtgtctcctcattactttgtcctgcttgcttttactagcacctactacgtaccagtggaggtagtagggatggaaagaagaaatgacaaattccttgccttcaaggtacttatggtcaattgcagatacagaactccaaagaaattcaaatcacagtacaatcattgattactgtatgatcctggccccttgaactggcagcttgcttacctgctctggaaagttgctggctgccctgttggcaccctgggcatttcttccacatctaaacaagaggttagtagagaagaagctacagcaaggctcatgactctgcttcttcataggcagccttgacttcctagactcctttttgtacctgagtttctggtccaccctaattagctgtaaggtgaaatcctttgcaccatctccctgtgtcccgcttttagagtccttaaagctagataccacatgggtgtagaagcttcctggaagacaagaaatatacctcctctgatatggtatttagcagtcagtatctctgatgttgatttacttacttgtatggaaacttgggaaactcaattcaggccacctggatagtgtttactaaattagtgcttacggaagaatttcaggccttaagggctgatttaagttctcaaatgtgggagaaggaagccttgtccgataccaattccattaacttaagttccggcttactcagtggtacccttgtggcctgagaaaataaattcacattcttaaaaaacaaaacaattaaatacacaaaaaacacaagagagtagctaaggtattggaaaatctggcctatcattctgtaataccatgatcttggcatttcctcacgttttgctactttcagctaactcaggctttcttacaggcctttttctccccaaattcaagtggataaaaagtttcattattgtaaaaattaggctaattattgatgcactcaaaaaagtggtttttggatgctttctttccaactaaaagcacttttgttttttaattttgaaaaatggcatatgtgtgtgtacacacacatataccgtcaagtttggcgggaacatcttaccagttggtagatgtgttcagctgatattaagcagaaattcttgagaatcttaacatcttgggattacaaagtctttcaaatggaagagccttgaaaggtcattttaacacttttgacatccaggacagtgatttctgactctgttttgatggttatccatatcagaggaacattttacatcacaaactggggtaaagatataaaataaattgtacatgtgtttatgtacacacatgtatatatacacccaccatatgtacacacacacatttacagtgtcatatgcatacaaagatcagaaacaaaagtttcatcaagtgatgccttccatactacatacagtgcatgctgtttttctattttatttatttaaaaacaaaatgctggttgcaacccactaaatggattttctgaaccagtggtttaaaaatactaatctatgtgatctcagtttttcttgcctggttgaattatctttcaaaaaaatttaaattttgagatttttgccgtggaagtttctgccaagacgttgctaatgtctcagagacctttatagttttattctaacactaccatccatgttctcattgttgtgttacaaaaaacaaagttcatgattgctacagctgttttggacagctgtttgagtaactcaaaacagatgtgagagccagaggtctgacatttagtggaaatgtgctattaaataccaccgcgtggtttacttaaccctgctagataattgcccacagaggaaaagccgtttttaaaaaacttatgctcttcataaacataaagtatatagataggtaagctattatgtacctcaaatttacaacttttctgttgccccttgccacagagttggtcctgaaggtgtcagctaacctttctttatcttttattttcacaaagagtacctggaagccaagaaaagtcaagtgccttatttatggccattcagcaggttaagttaggcttctaatcttatcttaatggctttgctaaactgttatcaaaattaataaatgagtggcatgcttctccatttagtgataaaccgatggccaacactatcctgcataataggcaatataagcaggagcatattcaagatatgaatgtgtaaacattcagctttgtgattatatctttctggttggtctctagatatacttagttgttcacaaacacttgggagatttgagtggctcagtgtatatttgaacactgaatattagccaatttctatctaatctgtctatctctaatctcttcctttgtaagtatatgtgtagaaattgaattatagtgtaataagtcattatctactttactataaggtactctctaaagctctgccattctataggaaaactacatgggtacaataaacaaacgtaatttaaaaaataaccccattaagtgatttgtccataagtctctgatcatttagcagactaacaaagatatttttatatgtatgtgcattgatgaaagaaacgctctcctagtcagtagtatggtattaggctctctaaaatgtggtaccactttatatagatgaatgaataataggagccaagataagctcttaatgcagtaaaacaatccagaaagcagttagcagtgctactatttctgctacctgtacaatctcttgcctactgacctgtgccacattatctccaccagcccatgccatcctctttttttcataccatcccctctcaaataagcccgcgtacattctatcaaatacccctaaattaccaacccaacagctttgtaaaacctaccgtcttttaaaattaaaatcttattctgtggttcttttatggaagagcaacataaagaacaaaggcagatagaaatatggtgtgccctttttcaggcaccattctgtttcctgtatgctcccacaaaggatttgagcggttatccctttaatccaggactagcaaactacatacagcccaaatgccaaatctggcccaatacctgtttttataaagctttattggaacacagccatacccattcatttacatgttgcctatagttgctttctcattaccagggcagagtagttgcagcagtgctgaatagctggtccagagaccgtgggcttgcaaagcctgaaatatttactatctggccctttatggggaaaatttgccaatccctgctttacgctattatttcgttgtccattctgactcattacatgtatagagtcacaggcttctgtgctgatcaactttcagctgaacaagattattgagctgaaattgaattgatttatagatttatattcatattcaccaaagagcctgcaagtgtggccatttgaatttttttgacttataaaataacagaaatcctaaaaagggacttattcttccttaagtattttaaatagtcagtgaattaatataaaagaggctaaaagcacccagaaacagtactgtcctgcaattccaactctaaaataatgaattacaatcaataatgtcaattttatagtgcccgaggaaattagacttctcgggacctgaccaagccctttatttagactcaggactgccccagcacacttcccttttgtcttgattcatttcctgacaacacatcacattgccagatggacactgtaactgaaggtctacagaaactcatttccaaaaaaaaataaatgtttagaaaatgaaacatatctgaaactttatttatcggtcaagaacttttaaaaatgttgtaatcaagtagcctctgttttgtcagcgtagaactagtccttttacagtagaaaatatcatttgtttttaactttttctaaagtgaaaaaaaggaccttccttttgtaatgtgttaatgagtacgtggggacccaagtgatgagggaggattttagaagagattagagttagcttggctctgggaggtccattttcataaaatatggtttctgaagaaggatctggaacataacacaagtcatttgctgctacatattaagaaataatcaattgataactgagttctgaatatggcttagtgtagaattactaaagatatgtatcattaagcattcaaagaatcatcgttacattctgaagtacataaccataattacattctaaatcacatggctttctaacaacactgtccttcctaaagatctcaagttttcaaaactagaccaaagttacatgccgaaacaagttacccacctttggcatccaaactaaagtgtgccagtgaagggcaagttacttataacacagaaggactcctcttggtcatgacccaactactactttaccaattcacttcagccagtatttatcaaataccaaaagtgtgtatatacggtacagggcattgggcatagagaggtggatgagcaacatgtggaccccgtcctcaagaggcttatagtcttacaggggaagggaattaattctgccaccagacagtattatgaaacataaagatacttttttaaaaaaaccttgctaaaggaatcaaaaagaaggggtgagtgattcatactgggatttcagccatcaaggaaagaatgatgttctcctccccaaatgatgggaacatcatttggtatggatctcccactagtgacacccacagctgaggagctagtacccatttttctccctcttttccctggcttgaggagcatcttaaatacctggcccttacgtggtcaagctgaaaatctgatactcctaagaaatcgctgagtcatgtaggaaattcagaaggaagagaggaagggagagaaggagaaagggagggaagaaagagaaggagagagggaagaaaaacttagaaactatccttaaatgtatactagaagttttgaaccctaaccttgagtgagttttgaaaggtttctattggtgtcgtagctccatacctcttcattccagactagtagttctcaaattgtttcagggagtttttagtcttcttggagccactgagaatgatgggtggaggggaaagggagatgctgtacaggatctctcacagctctgctttgaactgctcaaaatattggaattccatataagattgttttaggagatgtcccattgctatagttaaaacagtttgaaaaccaagattttaaaggaaattgcatgcccaagacaggctattgacatgtatggacagaagtccctacttttctgtccaattatgacttatcatagaacactttctcatcagagtctacttttgaaatacaaataaatgcatacagatgtaggaatctatgaatcaaggccagtgggtctttagccattgcctcgtaaggctcctgatatttgctgaattggggaggaagtggaaagctcattcctggatctggctctgtggcttgcccattactgggacttacctcttcccctcatctgttctttctgttttctcaaatgcctccaatttcatcatggaaatgctcagcttctatcagatagaacaaattctcccaagaggatggagtccagcctctatgtcgggttctaccttgcatttgatgtgcagactttgggcacacagagtcaactactgtttatgtttcaatgtgctgattgtcaagagtgaagagattctgagactttttttaacattaagtttgagttgtccttgaaaacaatgcccaatttgtcagatttctattctgtgccagttttcatccagtttaatgcgtgaactctatggattttacaaatgacgtcttctggatcatgttatctgtttacactgatcttaagtgtatgtaaaggttatttgactagatgtgtcttttgggttttttgtttctgtttttttttttttttttttttccagcagagaataaatggtcatctcaacatttgtttggtaaaagaagcaaattggtatgaaattgtatatttatgcatgttttttttccctttctgatatctctgcctcttcctctctctattattaaaggaagaaatacccctggaaagccaatgagagaggttagtgagattcaggctcacggccatggcttctgtctgtctcatcctgctttttatgtttggcgtttgtgtaagaattgtgtgtgtgcacgcgcatgtgtgtattacacattgtgtcatcatgtaaggatggtagtcacctctccacttgcagctcatgaggaacattcctcaaatgttcattgccgttgtcatcaccatgacgacaagactggggttgggagcaagaatctctttaaaatggcaatcctttgtagtccctaggttggaatcctgccgttcatcatctgttgccatttgcaacactaacaaaatcttcaaaataaatttagccttgaacataactgatgagtcataaagctttcttccacttccaggaccttagcattttctgccagcgcccttagtttttattcttctgggatgacttcattttgcttttgtttccttttttcttggttcctacgctctttctctcccattttagcgaacattttttgagcacttactgtgtgccaagcattgttctcagcacttgccatctttttcatcatgtcatcttcatgacaaacctgtgaggtaggtactcttattaaccccgttttacagataaggagactgagtcaatgagagagtaagcagtgtgtcccaggtgacagagccaaggatttggatccaggcagtctggctccagacccacactcttaactctcatttgaaaggcttacatcatctcaacgtacccttcagaagatgatcttttttatttggtatttgaagccacacagaacaataaccaattcgattaaaaaattaaatattggagttttgagaggtttttaaaatgcctatttatgggttgaaagggatagggtgcagtcttatcactgaatgtggtttcaggttttacggtgaaagatgcttcttactcctattccaccaggaatattgtctgaatatcgaattacctaattaagtgactgttggatgacaaagtgttaactgacagcccaagtaaaatcaaggttgtctttaccaagaatttaatctgaaggaggagagaaggaaagctctcccatgggatgacagtgttctgggagacaggctggatgggtggagagtccttcttaaatgagaagattctggattccttagcaacaggatggactggagagaccactgattcatttaaacacaggagtcgtaatgaaaactctgccaacatcatgccatacaagtctaatcaatttaatgattcttcagtgtgtctgtgccagtgcctccttccaaggctttgggcagtggggccagggagggaatggtaggctgggaggagaaattgaggaaacctgacttggtgaagcattgaatgcccctgacggtttgcctggttcatgtacttcgtatgtgagacttcttgggttcattcttatggtaagtgccccttaaaatttattcattttaactttttgtagaaaaatgcaccataattttgaccaccttaaacatgtttcactcacaaatgaatttcagaaaaggctagcacatgtaattgaagttatataggcatttgcagacttgactacctgaggtgtatggtgttcagacaagtttccagaagccaaagaatcaaaacaataatgaccttttttaatgctatgaaaatatcccaaatgtacgtaaagcagatttttttcagagattaaattatagagaagaaaagataagcaaatttccctgtagtattccggctttcctttggacaactgaatgctaacaatttatttgggaattgtatttttaaaaaatagagcaccagattgctattgaggtcttggatctttgccagaaagtctcaattccaatcgctgtggaaaacaattccctcaggcagtggtgacgtgtgagactaaatgtgttgcagttagcgccaacttgaaaaacatacaactgccctaatgttcaaggcatagtgcctttgtgttcaataatccttaagaatggattaaatcaatactttctatagacatagttttctgtcaccttgtgcctgaaggtgattgcaaatgcctgaatcctggctgcttttcagtacctctcatacttcatagtatgagattgtaattttgactttagaaaaatctgtcaggtaacattaatgacctcccgaatgctctgccttacacacatggataatagaactaggatacaaatctactttctatagtcatgtcacagtgcagtcttacccctccaacggattaaagtatgattctttagggcagtagtttgtaaaaagagattgacttcttttttctggatctaatgaaaaactccatggaaagaaattagaattatttattctggtaaagcaggtatttagtgaagtaaccaaaggcataatatagatgatgaggtgactctaaaagttctttatttttatagcacaaagatggccacaaggtcatttgtgaaaatgcagcagtgtaaaccggttaaaggccacccaactttttgtcggagtgtgcatggcacattaagaataatgaacctgttttccctggcaaatctttaaatagcagatacccctagaacttatgcttcttgagagactcaagaattttccttccagttagtaactgaacaccatttcaaggaagagaagcaccacttggctatataatccataaatgcatttatttgttttattatattttgaactgccatctacatcccctagcacacagcctaaaaagaaagacactttgtgattatcgataagctgacaggaaaaaaaatgagttttctccccttttcgttgatgttttgtaatatgttttctagctactaggtggactacatactatagtcacatgtgggccatgagaaatacttcgaattacattcaggcaccatgttgtaaaggtcctggactttgtttttactgattttgttaaccgtaaagatcgctagtaattaaaaattggcagttagtccatctatcttcaatttatgcatgaataattatgcagatttcccagggttgctggacagccaaaaatagatacaggggaagccctccaacttgatagcagcagttatatatttgtactctgagctctaaggagcagcaaaggccccactgtgtcgtcttcctgtggtttttatggcacagaaagccaaaaatgatttcagttcttcactgagggctgccaaactattggcccactttatgaatagttgcatatgctttgttaaaaaatttttatacttgcagtctcagccaaaatccaaagtgattttctaaaatataattaatactccatgaaattctttgcactaataaagcacaaaaagatagatatacaaacttggtcaccttaatagaaatgcctgaatgacattaaacttttaataagtaagtcttcagttgatctggtgccatcactgtttaagtgcctgcccgtgaatccgcttcattttgtagagaagctatatctcttgaaataaatattaaaacaaaatactctccctagtctatagctttaatttttattgggatatctttaatttttattggtatttttaacaattattatgggaatctgtaaagttgatacatggcaaggtagtaatagcctagtaaagcatttcagttccaaagacaatacttgaatagtggaaggatttaccaatgtgcaataattaaaattagccatgtaaaactatgggacatagacgaaaaggcaagccataaagtaagtctcagattatcttactctaaatctgaattttgctacgaagtacccagggacattgtgctgttctttttctccgtgctgggagattcgtgctaggtcgtgctgcattattagtaaaaggctattgtgatagttaaccctcatttaggaggagctctaagatggattcacaaaatacccaaatgcatacaatacatgtgggtcaccttataattagggtctagagtaatttggaatgtaaagcaatttttattctgaggtttcctaattcaaatgttaatagtgcaccaaaaggtcaattcaagagtttattattattatttttcaacccaagtaaaagcagagagaaaatagccacctccaccatagcctcagaagcaagccaacagcctgaaacagctttgaaatgaaaagttggtgtggcggtgatggtggcagtgataatggtgacgatggttgggtgctggtgatggtagtggtagttgtgaaggtggtgatggtggtttgattgatagtaaaaaaaatgttcgttaatacaagtagagagtaagtaatcaatcaatcactcatagccaaggtggaaaagatgtatcccatcatggaatattcctgttctgatagaaatcttgtgcttatctatggaattcttttgatatatatttacattgggaacctgaatgtagcttgacatttttccatgtaaacaccagtagcctgatccaacattaagctgatactaacaaacaacgtgtaatggcttcattaataaggctttgcttcttcctggaaactggtgaaaaatcaaaccttgttgtgtacaccctcgatgcagcttctgtgttgtcttcacccagaaatggggaatgatttcccaaatggcaaagaaacagagtgatgctatctatctgcaccttttgtaaagtctgtctttctttctctttgttttccaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtattgactggactgcagtactttgtttttattttaatttagttgttgttacttacttacttactttttaaataggtaatacatgcatatgagtaaaaaactataatccagaaagacagtgaaaacactcctaactaccccttcccccatatcaatcaatcatcctcattgctctatgagtagacattattaatttcttatttagtcttccagagggtctttctttattaattattatataagcagttaaaataatatatatgttcctatttatttttttcctattattatttcataggatatagcattctctgcacccagttatgcaccttacttgtttgtttgtttaaatttaaatatggactcaagaaatcttttcatttaaatatataaaatgctttctcattcttttttatagctgtataatatttcattatatgttcataggatattttatttaagcagttccctttggtgggatatgtagtctgttgtcagtctttcttttgctataacaaacaatattgcacatttctcattacatcatttcatttgtgcataaacaaacaaatctgtgggatacttcctagaagtgagattgctggatcaaagggggtaagcatttgtagactgggagatgatacattttgtgcagtgattgattgattgatagtcatagtgtttgtttgtttgttgtgttttttgttttaataatgacaagtatattaattaagtcagtttgcagttcatactttgcttctcaagagaatttcatatcacttctattcttaatgtcaccatctaagaggatgcatgagtgagtagtaagaaagagacacctaaaatgatgtctcacaactggttctggggaagaagaatcccttaccatagtcaaccaccaccatggggagaacctctcctttgcccctgccctgctctgtttcttgccctagctgcaaaggaagctgagaaagtgggtagcaatgtcagcacttcttagggagaggctatctatctttacctattcccaaggttcatggatggggtgggcggggttccccaacagtgttcagatactggtgagccaaaggaataacataagtccaccaggtgcagcctatcctagtgattttggaaataataggagatgagatgatccatctcattagaaatgatgtttgttagtagatgtggcatctctgctgtgaatcaatcacttgctaattttttgaaagtagggtgatgatgctgacctaagtgactaccacattgaaacacttcccttgacatccacacataccaagaaaaattttcatcctatttaaataaacaaatcatttatccttcccaccattacccgaacctacctttgtttgaaacacccagactggctgttttggtgacacttaaggaggtaactgaggaatcttcaatacttcaccacgtctaagacaactgtgtgtggatgactctgaggagggcatttggttttccattccatacttggcacacactagaagagacagaattaattcagttaaaaattaaaatgaatcgagctggcacagattatgcaccggcaagcaaaatgtgtgtttgtttgggagaaagcaccaagactaatggatgtgttctgtagagctgcgatgggatttccctgaatttgtaatgctctaatggtggaatgaatacaaaggcaggcactggcgcacttgcaaagactttgccttcaaattaagtgtaggaaggacacaaatcaaattctttcccacagtagcaaagccattggagtaggaactataaatatgttcttcaatgccccttgcacgtcagtgtactgtgatctcatggacttagctgacaacacaagagtggcagcatgcccaacattccataataaacaatattgtgtgaatgtgtaaagtttggggatgtttgtttgagagtagcttttgtgtacagaaaaggttacctacagtaacttgaggtttaaatgttatatgtacatatgtgtgtatgtacatgtgtgtattttatatacattcaggattttagctcttccataactttattttgaaataattcaaacaagaaaaactgaaacaaaagaaaaattgcaagaacagtacaaagaaagaacccacatataccctttacccaggttaatgaattgtttacattttgcttcatttactttatcgttctctcaatgaatagatgatagtttttcctgaaccattttaagaataagttgtagacatcatgcctccttacatttaaatacatcatgtacatttcctaatatctaggacagtctcttgtataaccatagtacaattatcaaaataaaaaaattatatatagctatcatctactccacagtccatattcaaccaaatattgtcaattgtgccaatgatgtctttcatcattatatatatttccctagtctggactctaattcatgatttcatgacatttagttgtcatatctctttaatcacctttgatccggaacagtgtctctgcctttctctgtcttcaaagaccttcacatttttaagagtacaagacagttactttgtaggatgtgcatcaatttgggtttgtctgatgtgttctcatggtttagattcagggtatgcatttttgtcaggaatactacacaaacaatgatgtgtcctcagcatgtgataccaggaggcatattcccattcttggtgctgttaacactgatcatttggtaaaggtggtgtctgccaggtttctccacttggtatacattttaaaacctaagttttcataaatctttaggttcaacttagaaatttcatttttagatatataaatgtagacaatttgtatgaagtaagaacagtcacttttagtgagcagacttagccacgttgagtagtctgaattttttcgttctaagctgtatttatacacttaatgtgctttattttcaagcctatctaatatctcacagggaagaccaacgccaaccaacagcacctccaccatacctaactcacatatatcgagacaaacatataaatatagtgaatctcaagtcctctgaaacattccaatagcatatactgtatgagctgagtccaactttttttattcattttgaaataataacatgtgtaaaattacacattttacattggaacctaagacatctctccaatttgctaatatgtcaaattgccacaaacatcttaagcactttaaacgaacacagattatgcctaaattcaacataaaagtattaaaaccaagggttaggtttactccaccatctctttgtttcattttaaaacttcctaggctttcaagacttatttgataaggtgtatattaaaatgtgacccaggtgtgttaaagtctttgaatctcatagttttgagggtggccacatgaggtctgtagccttcagcctcctgcagttaatcaaggatgcccttcaattgataataaatgtatctgtgtgccacaacgtgaaaacatttgggaaactctgcacgaagagaatacttttatcatcacaacaagagttgaggttactggctcaacaattcctatccatactaaaattaagcatcctgggcatgttgacaatttttatcagccaaaaatttgtgactggactgagtaactcttttgatgccacagaaggataagcactcaattcctttttaaagtcagtacgacaattgggggactccaagcctgtactttccagatacgattgatttcacaccctgtgttcctgggttcaatttccccctttatacctgtgtgggtagctgcaagctcctatactaggactcccctaagtcctagtgtgcctgcttcattgatggctacatctttcatcatgacatcattatcaatagcaccctttcaatctcaaaaatgcccttcttagtaggtacacctaatgtctttcaaacacactgtttctcaatagaaatgttgttggtatttgggttgggacaattcttcattatgcacaactgtccctcactttgtagttctcccagtcattttgatgacaaacctgcctcaatacattcccaaatgcctcctagggaagcagtagaaaattgctgattctctttactgcctgaatacaggctgtgttcttttcatactctccctaactggcaagctccagctcttagagatattttaatggcattagttcttgcatacttttcctattttgtccagccctccagtcacttctctaaagtaatttaatgatactacgctagctgaaaacattgaccatgagataaaagccagcaaataaaagtatttttcgacagtagagaaagaagctatccccattcatttgcattcatttaaatgtaacatctggactcttggtgcgttttgagcttgtagatacaccccagccacatcccctcttgtcttcagagacagtgcatccatgccctcgcttctgggaatatcagctgctgatggctcacaactgtgtccctctccggacacccc

SEQ ID NO: 4469 - DNA, 808295 bp, human
aactggaggacccgtgcttgtaagtgctcccataagcccagaagagcaagataaacttgaaaataagctcaagcagacaaatctccagtggataaaggttagacattaaccatctcttccgtcacatgtgttaaatgttgcaagtatttgtatgtattttgtttcctgggtgcttcattggtcggggaggaggctggtatgtggattgttgttttgttttgtttttttaacctgaccgtttgctttggctatatgttttgttgtggctagaaaaaatgatgatggtgaatggctttacattaatgaccaaatgccaaaatttataccacaattttttgcataaattattctgaagaatcagactgaagaaatggcgaagtatttaattcagtggccaggcatgtactgacagtatttaagctgaaaggacgtggtctggttctagttaaacaagtgtcataaatcaaaattaattattcacacctgtggtatggacttaataattaatgtacactaacgttcgccacaagtttatttatttacttacctactgatttattaacttgtgagttttcatctttccaccttgcatactatataaatctaacagtaatactatttattaaattaatacatatttattttatataaagcaagtggtacatatgaatttatagtaaaaagcaacatcaattgatccagcactattcattcaaagacaatcatttccccactgtattttcatggcatctttgtcataaatcaagagaacttgtatgtatgaatctgcttctggattctgtatcctcttccatttgattaaatctgtactttaacaacagtacttcactggcttaattacaatcttttttttaaaacaatcctaccgagctataattcacataccattaaactcatttaaagtgaacaattcaatcgtatttcggtgttacttttttaaggtgtgataaaatatataacataaaaaattgtcattttagtcatttcgtgtgtccagctcagtggcatttattacaaccatcaccacagtttatgccccacccccaatttttttttttcttttttggagacagagtctcgctgtgtcgctcaggctggagtgcagtggcgcgatctcggctcactgcaacttccgcctcccaggttcaagtggttctcctgcctcagcctccctagtagctgggattacaggcacctgccagcatgcccagctaagtttttgtatttttagtagagatggggttttgccatgttggccaggctggtctcaaactcctgacctcaggtgatccgcccaccttggactcccaaagtcctgggattacagcgtgagccaccgcgcccagcctccaaaattttttattactccaaccagacagtctgtaaccattaagcaatagttcccctttctctctcttcccatccgctagtagcctctggactactttctgtttctatgaatttggctattctagatcttttatataattggaattatatatttgccactttgtgtctgccttacttccctcagcataatattttcaaggttcatctatgttgtagcatgtgtcagaacttcattcctttttatgactgaataatattccattgtatgtatatacgcaatcattttatttaaacattttggatctggttgtgtaaaccttccactttgttcttcctattcaagattgccttggctacttttggttctttgaataaattttagaactatattgtctatttttacataaagccttccaggatattgattgaaattttgtgaatctggagctcagtcaacatctttacgatactgagtcatctaatttgtgaacattttgaattgtgtcaggttatttattgtattttttaaattggtgatgctgacattctaataacagatcatttacacgactgataaaatatttaggaactaaaataagtaccaattttatgacattaaaaccataatgtgcgcttaagtgtctctatttcaagcaggtagttatttgaaaaaaaaaaatcccttcttggtttctacctttaatgattgcaaaacatctgtgtaaagatacagacttttatgtatggagggaaggtggtgtcccagcaattaaattttatagctacataacaatacaaatgaaatcatccctcataaaaagagaacaaggaggaaggatacccaaaatgttctacaatatctcagtacatcttatgacaaaaagaagaacaaaaattataattgtaggaaatgtgagagaactatctaaaatatacaatagcagctttgtgggttgtgaaagagtcaaggttttatgtgtcctgcaacagaataaaaagtcaaatttttatgatagaaaattaaaactgaggttacgaacaccatcatgtatagacttatattactacagcatccataatatctgtttcctatgccaaaattataattttaatgcaatgtctttgccattaaatgccacaggatttggaattttattcattagtcatattaaaattatttaatcatcttttctccatccatatgcctctgtatccctgttagtttagatttagggatagaaagcaaatgatcagtaccagatttaggtaaataacacaagtttttttaaaagtaaaagaaaatggcttataacactggcagacagtcttgatcttcattaaatctcaagctcttacttattacaggagggtagaaataaagcggaccccctccctgtgtcctccagccctacccttcatccaaaggttagagtgggtgatataattggaactagtgggtcatagttactgtgacatgaatatgtcaattccttagtacatagtatctccaaacatatcctaatatcataatcagttggcaggtgactttctccacagctaactctaatatgctgcattctgcgtattgagccaactgaccccttactcttgtacctttattttatttttttttttatttattttttgagacagagtctcgctttgtcatccaggctgcagtgcagtggcacgatctcagctcactgcaacctccacctcccgggttcaagtgattcttctgcctcagcctctcgagtagctgggactacaggcgcgcaccaccacacccaactaatttttgtatttttagtagagatggagggttcgccatgtcggccaggctggtctcgaactcctgacctcatgatctgctcacctcagcctccgaaagtgcggggattacaggtgtgagccaccgcgcccggcctgtacatttatatttcattactgaagagagaaaacagcaggtgaagataatatagctatttctttaagggagtggtggacagggttgctttaaactgaatatagccattagcgtaaatttatgggtagcttcatgcaatgaaggctcatgaaatgatatcctcattcttgtctaatacataacttgaccttttacagcctttaacaatgatacccgtaagagccacaaagtggggatgttattaaagctagcctctgtgttcctctctctgatcatctcattctatgatcttcacccacacttctgactcaggtgtttttaatatttatccctcttcatatttctttgtattttctctgaacatgcatgtgggtgtaggaggctctctcgccatcatcatcactctcttcctctgtgtttctcacttttaggctaattttcatctatgaattgacacgtatattataggaatttatttttatatatttattaggaatcttctttttgttttttttttttttttgagacagagttttgctctgtcgcccaggctggagtgcaatggcacgatctccactcactgcaacctctgtctcctgggttcaagcgattctcctgcctcagcttcccgagtagctgggattacaggcatgcaccaccacgcctggctaatttttgtattttaagtagagacggggtttcaccacgttgatcaggctggtcttaaactcccgacctcaggtgatctgcccacctcggcctcccaaattgctgatattacaggcgtgagccaccgcacctggccatgaatctacttttctatttgcatatttgccactctttttctgccccagttgtttatgtaacacattctcttctgctctccttccctgaccccgttaatcccagtttcatctctttcatgtctttttattttgtgtcccctttcctcattcttcattgctctttgtatatgttatatgtgggtatttttttaactacccatttatttaaaaccaaaatatgctttatcattctttatttttgaacaccgagtcctagaaaggttatgtgacttatttgagaccatgtagctttctatttaaatataaaagtgattccaaaataaacagtaggggttttaaccttttggtgaagctcaagtgatttttatgtggataatatcctaatattaaaatggggatttattttcttttaaaaaaactatatgagtttttgctttggtttttgccctttttgagaactagatgctgtgttttaaaattactttctagaaccttctctgctgtggaacatttacagttgtgtaatatagcaaaacatgtttatgttgtttcagaattagttaaaatcctactatttttaatgtcaagtaattttacaggtggtgtacgttatgcattcctattagttttaataaatatgttgtcattttgttaaataagtttaaatttttcatcgcattttacatgtaaacagtaatttactatctacacataaaataccatttacaaataagatatactgtttatatgtaaatggtaaattactatttgaatttgttactgcccagacagtataaaatggtgcacataaagaaaaaagcattttggaaaacaattaagaaatttggctggaaagtgaattttagttaagtgcatcttattcactttaccgaggaaaaaggtaggtttacaaatacaacatatataacaaacctttaatatgggaataatttttgtaatattgataataatacaggtattattttcaaaaaatcaccaaataaaaattatgaaagtaaaaatacagtgcaactcctagcacaaactatcttccacaatatacagttggctgtatctaaatttccagaaatctggttcattttgtattaatctctaatcatgttgcttctaaatatgtatctgaggagtaaacatttcagatttattttcatttgtataaggtaaatgaatgtttagtctttttccagacgtatttgctatgtaatgacagtcattattagtcgtcagtataaatgtgaatagcaaaaaggagaaaattaaataaagctagagcttggctttccgactccttgctcaaaaatggacactttgtccaatcaatttcctatcacaagatgacgattaatagattgttctaatagttaccattcagtcctgcccttaacgtgatgttttttcaaccaaataatagaatcttcactggcattgttaccatattgactggtatttatggaaccccggaaaaaaaaatgctgtaaaatatatagtaggaagtataataatcattataggaaatcatttctctagctggaagtcttagcagggaccagatagttccactggagcttttatgtgctcatgattttctcccttgaagtgtatttgtaacacagttcacacagtttttaattttataaatctgtgtgctaaaacgctattatataagaaaacgggccgggtgtggtggctcacgcctgtaatcccagcactttgggaggcccaggcgggcagatcacaaggtcaggagatcgagaccatcccagccaacatggcaaaactccgtctctattaaaaatacaaaaattagctgagcgtggtggcatgtgtctgtaatcccagctatttgggaggctgaggcaggagaatcacttgaaccagggagtaggaggttgcagtgagccaagatcatgccgctatactccagcctggcgacagagcaagactctatctcaaaaaaaaaaaaaaaaaaaaaagggtgttcacctatttattgggcatatagtctgatagttcccagaaacccattatcttgaatgttttctttatgtaagttcctggaaatccattatttggatgttttctttatgtagttaataattacagcaaagctgtaattaaattatttattcaagagctatctattaaaggactactatgtgccacattctgttctaagcatatcataatcacttcccacccttcccttatttaaaggacatgcataattttatagggcttggcattataaatattcatatctctaatttatagttgctaaacagtttgaagctgagggttgggggaagggagtagtaatttaaagtttataacataagcatccttgactttgcctcctataatttcacactgacatgaggtttattactaggttgtgtgtcatgagtacatctcaatttgctctgactgttctggtttttgcctgttatcctatcataatttttaatagctccctctttcattgtcataagtattccactttagaagataaaatatatagagagggtcactctagttatgagaacaaacatcaggcttttagagctaggcttggtccagtgctcaataactattattatcatgattgcttttgttcttagtagcatcatcgtccttgtcatcatcatctaccttcctaatactttagttcagctgagaatttcggcctatccaagaaatctgattgccattattaccgaattaatcactctttaatgacaatagtatataagaatacgtgacatttaactttccaaattattgaaatgttacgctgtgtatggaaaattctttctaaccgtgttttttctctactctcaaatcgtaacaatcgtcaacacagaagaagacttttatgaccaaatttgtggaatttttttccccatacaccaaacagcaggcaccagctgggtgtctctaattcagtcctgacactatccacccagagatagtgtcagatcccatagattgagggctcagtaccgaggtctgcctcctctgcacccccctagcgcacgcgcgcgcacacacacacacacacacacacacacacaccagtctcaagtccaggcctctggaacttctgacccatgggcttcaagttggggttcccatgaccctctctttgggttcaactaacttgctggagcagctcacagaactcaggaaaacactcgctttcacctgtttatgataaaggatattgcaaaggacacagatgaagagatgcatagggtgaggtatggttggggtggagggacggaaaggggcatggagcttccatgccctccctgagtgcaccaccctctaggaatccccacctgttcagctacccggaagctcactggactctgtcctctttgttttttatggaagcttcatgacatcagcattccttccccaagggtatatggtgggaccctctaacaggaggtttttaagacctataatctgaaaggcgagggaacattaaagtgaaaggagagcaggagaaggtcagaggcctgcccctgagacccaacgcaaccaacattataacaaaaaactgtaacaagggctatgggtgttatgagccaggaacctggatagaaaccagtatgtactataataccatataggcaatgccaagaatatggatcagacactttacaaacaaggaaaaagtaaacaggagtgatgaggaggtaatttactgcaggcattaatgatgagattatgaattatggattccacttgctaccagctatgtgatcttatacctactctgtccatacctaagttataacatccataaaattcaaatactaaaagaagacacttccccaggttgtggtgaaaattcaatgaggtagtaaatgggaaatgtgtaacacagtatctggcatattgtaattgctcaaaaaatgttagattaaaaacagtaggagtaatactaaaatagaaaaatgcaaagagcaagcacaaaatcatctctgattctcacctccaaattctccaaaagtctcaccttcttaatcaaagttgtaaatatggctcttggggagaaagctgaactatgtgctactattatgaatgcaacaggtgaaggagaggagagttagaggcagcaagacaaccaaatggctctcgtggaaggcacagaggattttcagccactgctctcctattccgctgatattactttcattttctatgaccaactagcatttcagctaaaatgtgttggaaaatgatagatttttctcctcctattgcctaagaagcccaacaaagccagcattgttttcaaacaccagcattctcacttttaaagtatgaacataattcagaggacttttaattctgaacatcgtttttatcaatctattggcctgattgtaacccagaaatccaagcagaaagcaagtaaactttcacactgcttccccatcccttccccctacctttatttttgacatcagtttccctcattttggcaaagtaaaggaaaagcatttgtagaaggttacactgaagctagataattttctattaggaaacctcaccaaatacaagataatttgttcattccaatataataatgttttaaaaaatataacaaaaatccagcataaattgtgaagcactgatacttgtgtaacaactaatttccatagtgaaacttcattgttgccactatctacatactgaaaatgtatatcaagcatgtaaatgtgtcacttaagtatgctgtgccctagattttatttaaaagttaagctaattttcaactaaaaacaaattcgactattcttagcaatctctcctccccgttcatgatggatttaaaatgatgaagagtataaatgatgatgaaaagagaaaggaggagaaaaatttcataactctgcatcttcagtgtagcatttttaagtaactcctttattagcacaaaggtgtttgcctgaagcaatgacttctagaaaggagaagaaatgacataataaaaggggattttgctaatataaaatgttttttctttccttttgtttctgcaatgcttttacttacatagcaccaaccctgagactagagggagtttccttcctttctaataatttaataatcgtgaaatgatattaaatggaagttttcatatgccaactccttaaactgaggttaaataaggaacaaagattaaaggccatatttaagaccacatattgtaaattctaacccagtttcatttattatatcacctgcaaagccaatatgccatacaaaagtaaaataacagggtgatttttattaaagatcagaatcataccaaaaatgaacttttctgtcaaatctttatactcatacatcaagatgtgagtttatttatgtagctaaaataacttaatactaaatgctgactactatattcatgtcagctgacccctagtgcttcaaaccatagaaaagggataccaaatgctgggttggttgtgtattccatttttgccgtataccacctgccaaggcttataacagatctgtaatgggtttcttaccttttattgtgtagaaaatggattgttggattaggcctggggccagtgaaccatggaaccccaggtttgcaagaaagagtttatcaccctttgatgttatttctgtctcgtgtcagctgagaaggatgagctagattatctgaaagtaagctggatgccaaaatcagcattcccctcatttatccaccttatggttcggggcaagaccactgtatgggtaacaaaagggctgataagggcctgatggagaaatttggtttttctcccttttgattggcttgctgatattagaaccaattacaagacattgacgagagcatttcattgtttgttgctagagaaaatccatcaattttgttgtggaaatgaaagcatttgagctgaatgttgcacttataatttgtgaacattttcagttatcaccgggacaagtatagtccatctttggcatggttggccaagtgtggtgggaaaagagatggaccagcaaatgggccggaaaccaaagtcatcaaaagggtatttcaagaaaactctatttgttctgatggttacattctgcaggcaacctgtgactgatgactgatgcttatacctcaaatgcagtctaaaaatatttttttgtgaaagtgacacattctgactgtgatgtgggtgacatcaacagttttgaataggacagtacttcttggacttattgaaacttttataaaagaatgaacattctgaactcaattgcaatgtaaatgactatcatgaagattgcttctgttggtgctatgacttttgtgacaaattttagaccattgcagttatctcctagaggttgctttattgttttattttcatcagtgatgtgtattttatcagtgatgttagaatcactgagctgctggttaaggaagagaaaaaaattaatattcaggtgctatataggcccttattcattgagaacaaataaaggccaacacacaaaacaggaaaattaatagaaaagacactctatgggtaagatttcatatagtttgggagcagacaaaaactattttaattactaaaataattaagaaagatgttgaggctgggcacggtggctcacgcctgtaatcccagcactttgggaggccaaggagggcaggccacttgaggtcagagttcaagaccagcctggccaacattgtcaaaccctgtctctactaaaaatacaaaaattagctgggcgtggtggcacatgacttgaatcacagctacttgggaggctgaggcaggagaatcatttgaacccaggaggcggaggttgcagtgaaaggagatcacgccactgcattccagcctgggcaaccgagtgagactctgtctcaaacaaacaaaaaaaaaaagattaaaaaaaaagatgttgacattaacatgttcaagtctttatgctgaaactagaatgcagtatgattaaataatcatttctacttcgggtgaaggattagttttcttaaagatacccctttccagcttctcagttcgcgtgtggttaattcccaacgtggcctcaaatattctaatggtttgtgtaatgagtgccaccgttccaccttcttattctccatgcctcatctcagtcctggaaagatcactaaacttgcagttcataactcagtctagacccaggttcaacactcactaactcataactgtgggccacttatttaaatctcttagtgcctctagttcctcatttgtccaacagtgatgcattatgaagcatgtttgcccatctcccagcgtctagtgaggaactaaaaacacaatatatactatcatactttattacgaggagttaaattgtggttactattacaaagtaggttaccataaaattctaatagcagtggtaaggggtaaagatccacgtgccatcacgtagagcagaacttctcaaactttaatgtacggcaggtccttgaataatgttgtttcattgagcatcactgtgttataatattggcaagggaaaaaactgtatctcagctaggggggcactgtctatgtggggttttcttttgtctctgtgggttttcttctagtactctggtttcctcacatgtcccaaactgtgcacgttaggggaattggtgtgtctacattgtccccatgtgagtgtttatgtgtctacgactgtgccctgcgatagaatggcatccctgccagtgttggctcctgtctggtgctctgagttgccaggatgggctctggcctcccaagtccctgaactggaatacgtggcttggaaaatgaatgactgaattaatataaattactgtgaaataaaaattcatatagtattcaataatcataaagatgcgtgacaataattgatgctctacagaagtgctcagtgagctgccatattgattattgtttgtttttgaactttgtggtgagagaaggcaatcctggcagtttatgctttgcaaacatttattccttgaatgaaccaccgccactgcaaacactgtcactcactgattcaccaaaaactgggtaaataattttcctcctggtttttattaatctttctaaagtggatgtatatctcacatttatttctgagtttaatattagaagtgcttggggtctttatttagatgttggatcatgttttgtgaacacaggtatgcagtaggaacttaattcttgtttatcaattagcctatggtaagattggtttcattatatgtcattttgcctaagtcacagtttcccagaatctatcaacaacattaattgatgacttactgaaacaggaatcaccttgagatcttgttaaaatcaggttactgattcaatggctcttgcataggacctgaggttctgcatttccccccctaatttcaagatgctggttccctggtccccttgctctacttcttaaatggtagggaggtagagagtggctatcaagagtctgtgtaggagttgaccaccaatcccattcaatggaatgcatacagtgtgttctgagatactggaaaggcctttgcaaaaagattttgtctcttgatatttatgaagcacattcatccgaccacagaagatacatatcaactttgacagaaaatatgaacacattcaaatgatttatacctttgaaacatagatcgttgtggggttcataacccaagtataactttcccacagattcactcaatttccttcctctttctgtgcaatatattgtatattgcaagaagctcacctccactcaccttattcctcaggctttcttctcaactatcttctgtatagatttaaccagtgggaggcgttggcaggagattggagagcaggagaaggggagatttcagggtatttctttccctctttcactgctttgggcaacagctgatacagagtaagtggccaaaaaatactagctattattaggtcttctaataatgatcttctaaaatcactttttcagtggttacccccattgatttgccatgaatgtctcttcagacatctttgcaaagaattgagcctgactttagatactcattcaaaatcaaaatcagtaattttaggattgaggactctggtattatttaagaactcttaactgtaccaagcctcactcccatttctggctttcccctatatatcagttaagtaataactccaatagtgtaaaatttgcaatagtgttatgtaacaaatcaccctaaaacttattgacttaaaattatcaccatttataattgcacacagtctgtggggtcccgtgagctgttgtgttgttctggctcactcatacattttcagtcagctaatgggtgggctaggggctggcttatctagcataagcgcagctaggatgattcacctctgctccatatggtctctcatccttcggcaagcgctcctgggcttattctcatgcaagaaacaggattctaatagagaaggaaacaagacttcttgaagcttaagcttggagctggctcactcatttctaacacatttttttaaccaaagcaaatcacaaggcaggcccatattcagggattagggaaataggttacaactcctgatggtagcaactttaaaagtcacattgcaaaaagatgtgcatacagagaggtcaccagtgcaatctaccacaccttgcaatctattaagtttctcaccccctcacaagtaaggtattcagttaagatgcattcctatgtattcagatttctaatcaactaatcctgattctcacgtaatattgacacagtatcaatattctcaaaagccaatagtctagagggtcacaaagatcctcaaagatactttatgcaaaatcctaggagtatagaaacagtaccttggtttatgtatacattcagtatttattaagtgtttccaatatggtataatgttaaggaatgaggatagagttatgaacagacagacacttgtctttatggatcttacatttggagggggacaaacattaaaatggattatataattacaaatgcagccgttctcattgtcttttcagatttctcagggtgtagactgagctactataataaaaataccccaagtttccatgtttcaaacaatatagatatgtgtatctttcccacataaagtccagcctaggtacgtagtctctgctctaaaaaggaacacaggctagcaaggcagctatactattctcaatataatactgcatttcaaaatctccatgctggtcccacaaatatccatgcactctctttcttatcatcaagagaacacacagtgccttcccaagagagaccagtcaaagtctcattcacttactgcatccagctaaaagtccattgtctgtggatgatgcactgtcttctccatcagatcaagatatggttcctcatggtccagtgacctataaagtgaaagttatgctatctgctcctaccacaaccaattctctctttttaaaatttttttaaatttttgtgggtacatagtaggtgtatgtatttatggggtacttgagatgttttgacacaagcatgcaatgcataataatcacatcatggagaacgggggatccaccccctccagcattaatcttttgtgttacaaacaatccaattatactcttatttatttttaaatgtgcagttacattattttgacgatagtcaccctgttgtgctatcgaatactgggtattattcatttttcctaagtattttttgtacccattaaccatcccgctgccccctccccgactcctccactatccttcccagcctctggcaactacctttctactctctatgtccatgagttccattgttttgatttttagattctgcaaataagtgagaacatgagatgtttttctgtgcttggcttattttgcttaagataatgacctccatttccatccatgttgttgcaaatgacaggatctcaatcttttctatggcagaatagtactccatttgtgtatatgtaccacgttttctttatccattcatttgttgatggacacttaaattttttccaaaccttggctattgtgaatagagctgcaataaacatgggaatgcagatatttcgtcaatatactgatttcctttctttgggtatatacccagcagtgggattgctggatcatagggaagctctatttttacttttttgaggaacctccaaactgttctctatagtggttgtactaatttatattcctaccaacagtgtgcaaggttttccttttctccacattctctccagcccaggcacaaagacagcagtaagtgctggacgaccacctatgcaagacctagactataaatccagtacttctctccctctccacacccccatacccaccactccattctgagttttcaaatgtaagctaagctaaatgattcaataaagctttttgaagtcaaggatgagaaaaatcgttgctttttatgtaatcccaccatcaaagtaataattgcttagttcaaattgtggtgatgcaaacaaggaaagcaagagagcataaaacgggtggatctgacgcagtccagaagtggaggcaatggttgtttttagataattattagagaagatactgtgatttggtttgaaggcaaagctcactgaagttctctagttctagatacacctatcgaaaaattcttacccaaataaatgtctcagtgataagagcagcctttccccaaatgcctaagtgtttttgttttgtttttgttttgttttgttttgttttgttttgtttttgtttttgttttttttcaaaatcttcctctggaatggatgctgaccttgtcattgacttattcttcaccacaactcagtcatattaatcttgaaagagacagagaggccactatctctgctaataatttacataattgtttttctacaatttggtgctaattaaaatgtgaaaggggtagtgatgatataggtaaatgtaataaggtcattctttgttcctgagagcaaagataatgtcaccagaaaggattgtctgtatattcacataagagcaggaaacaggaagagagacacagtaaggtaaaatagcatactagtatatcacgtagtctggtatagccaatgtagaatatttatttcaaaaaacaaataaagataaagttctgcttcactttgagaagctgttttttttaatcctgtatagttagttcgacatgttactactctgcctggttcaaattttgatttcactctgttccagttatatatgctatgcaacaaaccactctaaaagttactggcttaaaataagatagttttacgatttctcataattctgagagttgactatgatattcatctgcttcacctgatatcaaccaagacactgggaaagctggaaagtccaaaatggcctcactcacatgactggcagttggtgctgcctaccagctgagaactcagctaaagctattggccatgagcctcagtttgtttccattgtcttctccatgtgtctcctttggcttccccacagcttggtggttgagttctgtgaagaagccttccaaaagaacaagcaccaatcttcaaagacttatcaagcttctgtttgtatcacacttgctactatcccattggccaaagccaggcatatggccaagttcagaatcaaaatgagaagggactacacaaaggcatgaatccaagaggcgtgattaattgtggggctgccaaataatcgccttccacaaattccttactagctgtgtcatctctctgtggtctcagttttctcacctggaaacaggaacaaaaatggccctacaaaaatggactgagatatattaggttggtgcaaaagaaattgcagtttgggaccgtgaattttaaatcattataactaggctcaagcacatctttattaatcaaagtaggaaccgttacagtcaacacatttttgccaagaagaaataagtgtgtttattcctgtagcataaaaattcatgctttgggattcaatgaactcttggaaagcattttcttcatcctgctagttgtggaagcattttccctgtaaaaagttgtcgagatgcttgaagaagtggtagtcagttggttgagaggtcaggtaaatatggcagatgaggcaaaacttcctagcccgattcattcaacttgtgaagcgttggttgtgcgacgtgcggtcgggcgttgtcacagagaagaattgggccctttctgttgaccactgctggctgcaggcatggcagtttttgatgtatctcatcaatttactgagcatacttctcaaatgtagtggtttcgccgggattcagaaagcggtagtgggtcaggccagcaggagaccagtgaacagtgaccatgacttttggtacaagtttggctttggaaagtgctttggagcttcttctcagtccagccactgaactgggcatcgccagttgtcgtttaaaatccactttttgttgcacgttacaatccgatcaagaaatggtttgttgttgttggcgtagaataagagaagatggcacttcaaaatgacgatacttttattttcgctctgcttatgaggcacccacttatcgagttttttcgcctttccaatttgcttcaaatgctgaacaactgtgaaatggttgacattgagttcctcggcaacttctcgtgtagttgtaagaggatcagcttcgatgattggtctcaatcggtcattgtcaacttctgatggccagccactacgcccctcatcttcaagactcttatctcctttgaaaaacttcttgaaccaccactgcactgtgcgtttgttagcagtaacttggccaaatgtgtttttgacattgcgagttgcctctgcttctttacaatccattttgaactcgaataagaaaaacgctcgaatttgctttttgtctaacatcatttccatagtctaaaataaacataaaataaacagcaagtaataagtcattagcaaaaaaaaaaaaagtgagaaatgctcattaaaatgatgtataacataatcacatttatttaagaatgtatttcaatatcaaatggcaagttccatgaatgtgaaaacaacacttacttttgtagtcacctaatgacacatttaagaagctgaaacctgagctcagcacatggtaagacatcagtaagtattagttatcataatttttttagtaattttcctacagagctataaataaaatgaaatactttccaaacagtgataaaactataaagcagcaatacattataagcttctatcctaatctgccttcccctcagggccttaaaatgtgtcatttctgtaaatgttacctctgacatgaaagcaccaacacactgttcagcaattacaagttgattgtgacaagagcctcactctccctatttctttttctcttcctgtcttgctttcccttttccccatcctttcactcactttgataaggcaaactgccatgtagtcacaaaatcctagacaaacaagtctgtacctatgtgggcgatgctgtggatttagtaagggaaacagttccttgataaatttctcctttagccctgggtttccaacccctgtgtcattcagctatagaaatcttctgatattttctcccactggtcattttcactcaggctgccatcaaaatgagactacccaatgttctttccatttgttctgttttcttcctcgcctctgattccctgcctggtccacttagaaagtctaccttttttccttctctcttaataccaccaatctctaaatctgacttctcctttctaatcccatagagcctgccttgtcatctccaaacaagatccatcttggcctcctgttatcctcagcccacagcagtatttcacttacaacgttcgttagtttctacctcagatgtgtcaggcatttagtttgtaccaatattttatttctttttatatctacaccaagcctgcactagacggtccaaggagaaatttaactgattcctgttttgaagtcctccccactccttgggagagttaaagattcctcagtgtgttaggtaatgatagttaatatttattaataacttactgtgtatcgactgtattctaagtgctttgcactgttagaaggagaataacctaagactgtgccaaacagcagtctagaacaaagctgaattccttgcttgcctggcaagggagaatgtggtacatactaaaggattaatacatgttcactattaaattgattgattgtggtggtggtgacagtggtgatgacttttcaagtgtgggtaaagtaattttttccaacaaatccacatccacatatttaagaaaagagagacatttcattctatctttttgtgtgcctttgagaggacacccctggcacccaactcccaggcaaatgccaccatctgtgtgattttccttcatttgccaacgaaggcacagcaggtactactaggttaacctttgctttcgcaagtcttctctcaaaatagtaaacacttcagctgttggaaagctctaatctcaaactgcaaatttaaaaatctctctctggagttcaaaaaatagaaagaaaaaataaaaatctctctcttctggaacataatgtttgaactgttacatattattcacactatttcacattatgggattatgaaatatggttttaggtgttagaaaaacgaaagaaaactattatttgttaacactaaccgagagatttttatgatattcaagtaaaatgatagaatgaattattttaaaaatgcatgaatcttcaccttctgtgaagtgtcatggaggattagttctaactaatatgcctgtaagtaactgacttaatgcgtctattggttctcttaatgctgtaagtgacagaaaactggtctcaaactgatttaaacaataaatatgatcaaggttccggttttttgtttcttgttttttttttttttttttcacatttctctgggttctatttttctgtgttgacctagcagcttcacctgacttccctcttggtgacaaaaatggcctgaagccgtttcagaacccacatctgcaaacttacttttgatgaaaatcatctctttagggaccttctttcccaaagcatccaggaaagactgctctgaaactgactggcctgaattaggtcacatgctcattcctgtactaaatcacacctcacttctacagctaaaagtcattaaatctcaaccaaactctacagctgcaccacaacaaaggtagagaagtaggtgcaaagttcctcaaaggaacgtaagggtgaaagatgattgactgataaacagacaggtagacagaatagatagatgaattaggaaaagataaccaaccaatatctgtcacattgctttgacttgattttttagtcaattaatgaaactgaatggtaattttgacattacaacaatactttccaaatgtaggcaggttgtggagatcatttaaggaaaaaatgtatgaggtgttgtagcagatactgtcggtgccccaccgatatccctttagcacttaccatttttatacgtgcttcttaatttccaacttcctgtacttgcatctctttgcttggggctatctctgctcattcttgggagagagcagaaatgtagcagttatgcccctgtagagcagcagttgatagatcaataccctgtcccccttgcccttcagatctaataactccaagcttaattccctacatctttcatataagtatatatataagtatatatatatacttgaagttctagggtacatgtgcacaacgtgcaggtttgttacataggtatgcgtgggccatgctggtgtgctgcacccattaactcgtcatttacattagctatttctcctaatgctatccctccccagccccccaccccacgacaggccccagtgtgtgatgttgcctgcgctgtgtccaagtgttttcattgttcaattcccacctatgagtgaggacatgcggtgtttggttttctgtccttgtgatagtttgctcagaatgttggtttccagcttcatccatgtcccttcaaaggacataaacaactcatccttttttatggttgcgtagtattccatggtgtgtatgtgccacattttcttaatccagtctatcactgatggacatttgggttggttccaagtctttgctattgtgaatagtgccgcaataaacatacgtgtgcatgtgtctttatagcagcatgatttataatcctttgggtatatacccagtaatgggatggccgggtcaaatggtatttctagttctagatccttgaggaatcgccacactgtcttccacaatggttgaactagtttacagtcccaccaacggtgtgaaagtgttcctgtttctccacatcctctccagcatctgttgtttcctgactttttaatgatcaccattctaactggagtgagatggtatctcattgtggttttgatttgcatttctctgatgaccagtgatgatgagcattttttcatgtgtctgttagctgcataaatgtcttcttttgagaagtgtctgttcctatccttggccgacttttcgatgaggttggtttttttcttgtaaatttgtttaagttctttgtagattctcgatattagccctttgtcagatgggtagattgcaaaaattttctcccattatgtaggttgcttgttcactctgatggtactttcttttgctgtgcagaagctctttcgtttaattagatcccatttgtcaattttggcttctgttgccattgcttttggtgttttcatcatgaagtccttgcccatgcctttgtcctgaatggtattgcctaggttttcttctagggttttatggttttaggtctaacatgtaagtctttaatccatcttgaattaattaatttttgtataaggtgtaaggaagggatccagtttcagctttctacatatggctagccagttttcccagcaccatttattaaatagggaatcctttccccatttcttgttttttgtcaggtttgtcaaagatcagatagttgtagatgtgtggtattatttctgaggcttccgttctgttccattggtctatatctctgttttggtaccagtaccatgctgttttggttacagtagccttagtttcctacatcttcttttagggataacagggagtattaagattcagttgttcacattgatgacttgcatgataatataccctttattggctatcttccctatttcacttcttctcaccctgttgatgtgtcctggaatcacatcccaaaactacttgagctcaaatttttatttctgggtttgctactgggagacccaaatcaagacagttggcttcagtactcaggtacttacaaggagatcatggatatcaattgaatcagaattccatgtcatagcttttcaaatttatatcacaataagttgaaaagatgttgattcttccttccacagtattttctgtttctgtgtgtcttacattctggtgtctcaaaacatggctgcaaccagggaaggaattgaaatttggagtaaatgtcctattttagtaggtctacatttaagacatggacctgaaattgagatcataaacaaaagtagatgtgagcataaagtagaaggtgaggttggagggggaaattgtttggatttactgtaaccaatggagctgcttagtctagtcaaggaatttcaatcatttctgtggagactagatgacttatgttatacaaggatatctctggaaaattcactgtacagttttactaaatctggctgataatatgttcactcaatgttatgatgtcaataatagaatggatattgcctttaaagacaattttaaagtaaatatctcacatattcctactcatttatcaagggctgtgtcattcatggcaatataagataattcttttcactttcaaaatcttccagatgcagaaactttccaatatttgctgtagatgaaagtgtacaatttcacaattcaatgggacaaaaagaattaggaaaaatatgtttcagagagtttatttggtatcatctacaagacctggtatgagacctggttggtgttgtatggaatgaaatatatcagtctgttctcacactgctaataaagacatacctgagactgggtaatttataaaggaaagtgatttaattgactcacagttcagcatggctggggaggcctcaggaaacttacaatcatggcagatggggaagcaaacaccttcttcttcacatggcagcaggaaggaggagaatgagcaaaagagggaaaagccccttataaaaccatcagacctcgtgagaactcactgtcacaagaacagcatgagggtaaccgcccgccgtgattcaattatctccacctgatccctcccaggacgtgtgggggttatgggaacaacagcttaagatgagcttttggtacagacacagccaaaccatatcatagagtttcgaatctgaaaaacaaaagaagctaatttagtttcagaaagctgagatttcatgaaccatttaaaaattcactttataatttttcatgcattttgaagcctttatcctttaaatggaaatggaatagaactattattcgtcatttctaaactgtgcattcatcaacaattttcagaagttaattccaacatgtcttcatcaactctatattacatgttagtacactacatctctattttcatgctataattttttactttttcctcacactttcatctcaccctctcaagatgtgttaatcccctttgctcttttccccatctcgtctctgttgcctttctccccccttcctttttttttaatttctgttctcttttacctgaaatctccctcttcatcttttgctaccaattatgttcttaattggttgaagtgagcaaggtaggaaattctccattttgattccattctctcacatggtttatctttaatatgttttaataaacagtttaacataaatcttacttccaatttaacatgtaaaatttagaaaattggtgaaaaatatgcctgctttttcacccccaaagaaccaagtttaaaaagttttgtgactttgaggcatccttttccctaaaagcaagcttaacagattcttagcattcgtctctgtgtgaaattgtggaaactttaaaaaaactatttgaagtaccaacaactcaaagataaattgtctgttttaaatgcaaggtgctaaaataaaactagaagattgacaatattattcatctttatcactgttctacttaaaatttgaaaattaatgttagaaatgtgagagggtgcatgaaaccttaatggttttatcatttcatctgagtatatatttgatttcttctttctgacattgaaactttaaaattcgccactatttttcagtaactcgttaaaatatggtccgttcttatatttgcaatactcctatactgaaaaccctacaacttcaccattatttaatttttatgttactatatttgtttcttaaaaagattataatattatgtattagttgtctattgctgcataacaattactacaaagataggggcttaaaactgtatctttagagtatcaggatacatatgggtcagaagtctaggcatagattatccatattctttgcttcggggtctctcacaaaggctgcacactaggtgttggccagggctagggtctcatttgaaagcttgccttggaaggacctgcttccaaactcacctgttgttggtaagtttcagttccatgtgggttattggactgtagtcttccttttcttgttggctgatggccacgtttagttccttcggtctctaacatggcaatttgcctcatcaaaatcagtgagagaaagtgggggaggggggaaagagacagagaaagagtgaaattgctagcaagacaaaagtcccaatcttatgtagcctaattggagaagtgatatccttttgtctttgacatattctgcttgtcagaagcaagtcaaaagtcttgaccactctcaaggggaggaaattattaaaggactcaaatactaggagacagagatcactgagtgccattttagagtcttcccaccacggattatttcccttcacctgctggcatttgaaaatgcagctaatactctgggattctccaaacctaatttttttgtataattagagaagtatttgtcataatctgttaagtgtagtaatatattaagaaattgaatttattccttcatatttcaaaaagtacatggggttgggggacagctatgttgtcataaactttaatacatacatgattggaatggattatgaaatatttttctctaagagatagtataaggctgcaaccactgaggctcccaaatacagatgattcatatgtatttagttttaatgcaaagcttctcatgctgatttaaactctcatattttcatatatggtgttttattttttatataatgaatgtctataaaattcctattattttttcaaaagtattgtggcaaatatttcctagtaaaatctaaagatatctttgacgtaatttttatgctctcatttatgttaagaactcaatattgaagtaatgttctttcttatttcctagtaactaaaatccttactatattcatgaagagctgtgcctctattaaaaagcttttattgcaaacagaaatgtcaaaatacagcaaaggtagagctatgtatgattcttcatctgtaatgtaattttaagtatacattttattgcataagcagagatttatacccacatttgctttcagtattcacagaagaattttcatatgtatttcttaaaataacaaaatggctgctttggtgtggggatagtatggtacagcatttattgtgaaaatgattcttatcttccatctttttcaaatggtgagttcagtatgtttaacattgctggttttataatattgcgaatatttttgagaggaagaaacaataagagactgataagaataattcatatttgctcaaagtttaatcagttttttatttgaacaaaaacttggacgaaatgtccaactttcctttgagatcagtgctctccaatgtggtaacaacagcctaccatatgagcatttgaaatatggctagtccccactgaaatgtgctgtaagtataaaacactcaccaaattacaaaacctaagtatgaaaaaaataaaatatctcattggtactttttatattgagtacaggttgaagtgacaacaatttggctatttaagttaaagaaaatataacattaaaattaatttgacctgttttttacttttgtaatgtgtagaaaattttaaattacatgtatcgctctcattataattttattggatgtcattgttctagataaacaatggcaatgttgagaggtgtcataatagggacaattgtctctgtgaagaagaaattatatgaaccctacaacatgtattagccgcagagttgcttagaattgacttactctgtcttgttgaaaataggttttcccttaaaatctctgcctgatgtagccaaccacgattcaatgagcaaacaaaaatcttaaaggggaaaaaatcattttttgagtctattttacacacccagtatcaaaaagaaaaatataaatccacaactaggattatacgggatgtaattcttggatttcttttggtcttataatgctttatacctaggagatgttcaacaaattattattgaatgattgtagtttaaccgtcagttacattttgcagcaatacatttattagtagcaaaatctgagtgtttactaattttcatcacctaatcagcaaattagtactgctcttatatcgctttgcctacgctctactcactggttcaatcagctaattttttcagaattttatggtttataaaccactatatgttgcacagtatttcctatacattagctcatttgagtcacagaagttataggaggtggatcttgtctttctttgttcagaaagagaaatccaggttcagcgaggttaactggccttgtttaagatcagcacgttgctaggtgacagaaggtgttcacttctcactgaactttgcatatcaaaagagatttaaagaattcactttggagagcgggagttatggggtgaatattttatcatgttgtccgtcttaataatcaccaatttgatactaaggctgctagtcatctctaacgaagagaagttactttgaagttggttgattgattgttgttgattgacagaagtattagttttcagaatgaactaattcattaaagaaataaaacattgggtttgttcattccataaataattgaacatttattatgtgtatgataccagcctaagcagatacctaaaaggaatggagattactatagttaataacaatgcattgtattcttgaaaattgccaagagattacattttaaacattctcaccataaaaaaatgataagaatgtggggtaatgcatatgttaattatctcaatttagccattccacagtgtatgcatatttcaaaacatgttgtacacaataaatacatacaatgttatgtgttaatttaaaaataaatacattagaaacggtaaaagtcactaggatcatggaaataaaaatgtttacatttatgtaaatattagtaatataatagagggcatatccaaaatatagtgtcatattaataagatgttgtatgattattatagactacaaaataataaaggaatagacagaatgtttctaaataaagaatagaaattacagtgaagcggaagagagagtaaccctaaacccttcataatcctccctttgcctcgtagtatagcttggaaagtaattatgtggaaagttgagattgcaacaaaggacggtagtacaggagttgcccaaggacagacaattattttctcaaataaactatagcagaagcaaaatggccttggaccacaaaagaaggccctcatgtagacattgttctattctgaagtagaatttgcagtactcaagagaagaggaaagattattataggtggagagactgtaaacaaaatattatggtaggattcctcctgaatagagcaaggtgattgtgtttgacattgaaaaggtatgtttgggcaagagtttgaaaacctttagccaccatgctaagagatcttaaatctttatctctgagtaagggcggtggttgtggttaatgatccttgagcacaactctgtcccattaaagacagtagattcaactgcttctagcattagtccatatcagggagtaaagtgatccgatacattattttcccccagtaaatggttcataaaggaaggccttggctctgccttgtatgtctacatgggagaatataccagaatgtctagaggagcatgggtagcgtaacctttccccatatgcacatacaacaaatactgataatccactcacaggggagggactcatttttaagaattaagttttattttagaagactcagtctgatggcaatgcaggggttgaattacagcaggtagagactggaggtctacaaactggtttgagatatatattttttccggtggcccagataataaggacttgaacagacttcttgctctgggaatgtaaaaggccaggctggatgtaagaggttaggaagttccaaactgtcccacattttcctttcttctgagccctccaaactgtaccagactctgcatgttacgcacttccaaagtcgcttccacattttcgggtgtcttttcagcagtgccccactctactggtaccaaattactgtattagtccattttcacactgcggataaagacatacccgagactgggcaatttacaaaagaaagaggtttaatggacttacggttccacttggctggggagacctcacaactatggcaccaggcaaggaggaacgagtcacatcttacgtggatgggcagcagtcaaagagagagcttttggagggaaactccgcttttcaaaaccatcagatctcatgagacttattcacaatcactagaacagcacaggaaagacctgcccccatgattaaattacctcccactgggtccctcccataacacatgggaattcaacatgagatttgggtggagacacagccaaaccgtatcagtgatgcaaaataaaagaagactgtggagtaaattacacatggagaaaaggaagaggaactaggaagtatagatactgtgagaattaactctctgttctacaaaagaagaaatgggcttaaagtggttccccccaaaactaaaatccaaaggcacataagtcataatgcacactgttacaccgagtccttccagctcttaacttacttgttttactgcactacacttgacttgagttttagacttagtaaatctgaggtaaatgcagattgagaatgagaacaaaatgttaaaaagagaagcagtctcattttcttactactaataggcattgcagtttgtgtgggctctagcagggatgtttgtaccactgggatctaagcatctatttctatattataaatagaaaaattaggttgagctatcgcgactccattacaaacttatggaattagattctctggtatggagcttggatatacatattaaaacaaaataaaacaaaaactcctacccaattgattctgctgtgtgctctagttaagactgttatggttaagaaaataaataatcgctgtatggaatgtatatcgtcctattttaaattaataaaaaaaattttgcaggccttcccaccttccaactcctagagacaacaaatccagatttgaaaatcagtcatattaaatagttgtatcgatatttaccctttgtttctacgttattattttcttcaattttcacacgtatttgttcatcagttggttatgatggacttcactttttttcagtcttacgaatgagatttctccctccaaaaatcaataggcacctgctgattttatttattccaacatgaagttgcagaaaatgaatatggccaaaaatggttaaaaaaaaaaaagcctgttcttcaaaagactagatcgtcagttgaagcagaaaattatattcagtgcactggatttatgcattgttttagccttctccaaccaatttagaaatgcattttcttataaaattgagattattacaaatcctgtgctaagcagctgaaataatgtgcctatgccaaggtcatatcttaaaagtttggaggagcacactgcaattgaatataagtttataaatgtattccacatacttttctgatatattttaataatttaatttttacattttacctatattgtcttcattttcactttacctttggtggtgtttcatacatattcattgtttggaagaaattaagcagacagtattctaaagtcaatactgagtctgctaatgaaaatggttaagttaattaactaaatggcaaccttcactgaacttattcaaagctatttcccctcatgatgtgttttcctgaagaaatgatgcataaaaactaaacccctgttattcgctattcttctgtatcagcctctaaattgtcactttacatgttacaacctgttgcatgatgattaattatgacaatttaatggcatgtaaagggtaaaaccctaaaggattactcaaaccatcattccttaagaaaagaaattgtaatgcctaggttatcttctagggtttttatggttttaggtctaacgtttaagtctttaatccatcttgaattgatttttgtataaggtgtaaggaagggatccagtttcagctttctacgtatggctagccaattttcccagcaccgtttattaaatagggaatcctttccccattgcttgtttttctcaggtttgtcaaagatcagatagttgtagatatgcggcgttacttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaaggcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacatcccttgtaagttggattcctaggcattttattctcttgaggcattaccattcaggacataggcatgggcaaggacttcatgtctaaaacaccaaaaccaatggcaacaaaagccaaaattgacaaatgggatctaattaaactaaggagcttctgcacagcaaaagaaactaccatcagagtgaacaggcaacctacaaaatgggagaaaattttcgcaacctactcatctgataaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggactataaatcatgctgctataaagacacatgcacacgtatgtttattgcggcgctattcacaatagcaaagacttggaaccaacccaaatgtccaacaatgatagactggattaagaaaatgtggcacatatacaccatgcaatactatgcagccataaaaaaggatgagttcatgtcctttgtaggcacatgggtgaaattggaaatcatcgttctcagtaaactgtcgcaagaacaaaaaaccaaacaccgcatgttctcactcataggtgggaattgaacaatgagaacacatggacacaggaaggggaacatcacactctggggactgttgtggggtgggggaaggggggagggatagcattgggagatatacccaatgctagatgacaagttagtgggtgcagcgcgccagcatggcacatgtatacatatgtaactaacctgcacaatgtgcacatgtaccctaaaacttaaagtacaataataaaagaaaaaaaaaagaaaaaagcaaagaaattgtaaaatgttgttctatcagaaactcggctaattatttttaaattttagatcaaaaactcaactagttttaatgtactacttataagtcagataaaatcattttttatttttgttttctttttgtttttacatctgttagaaacgatggggtcttcaaagtaaaagaagagatttgcaatgcctataccaaattagttattttaggatactgaatgaaatggttttctatactcaataaaggtaaaagaataagcagaggtagatctggttttctgaaacttgaagcacattctaatttggcagttttctttaagtcaaagaatataacaggacaaatataaaattaggtatgaacatgattatagaaagaaaggaaatcataacaaattatacgtttttaaaaagatgacagataaccacatacatcacaaaaattgaaaaaaataagcagaatgttttcttaataatgaaccatctctgcaatactagaatatacagtgtctgaaataattttttctatctttctggatgcatcctctttcagcacctcttcatgtgagagcatcagaaaataatttactctttcccccagcattgttgattaaaatttgacttctatcattgatagtttagaaaagtttattttacattttcaacttattattggtgatgtcacataaattattacaatttattgtccaatttaggaagaccctgccaagtttctttcacatatgaactgtaaaatttaaaagatcattcaagttatcttgtacaataactaatacatatttttcttttagtcatactaaaccctgatgctaaggatcacccaaactttttcagggaaagaagtagcttgcaaataaatcaaggaccatttatccttactttttggaagaaatggaaaaggataaagtgttagtttaaatacactcaagaacagaatgtaagacaagaaattggaagcagagaagttcatcctcaaatgtaagagtgaaagaatagggttaatgaaacaggaaaggggaaatccaagaaaaattatgccgcgctttagagaatctcctaagcacagagatattggcaatgtgcagatgaaatagctgtcacaggtcagccatgtcagaggtgattccagccactaagtatctactgcagattagatatttggaaagcagaatgagctctgttcatgccattactggggcttgacttcttaatggtttcaagtccccctttgactctaatccttctaaagtcaactttgtataaactcttttcaaaagtgtttatccctgtagaataagttcaaaactccatgtcatggcacacaaaactcttcaaatcatattcagctggtattgttttcttccacattccagtcataactaggatcccaagaattagcaaataaaaatatgaaacatccagaattctaagcataactatgtcccaaatactacaacaaaaaatactgaaaagtatcgattgcttatacaaaatgtaaatggtatcctgtattttataaggcaaccctagtcataagatctctttcttcttcctcacacactgtcaagcttgagccaacagagtaccttttaatgggctgcgcagaatagctttcgatagtttacccattaattaacagaaaattcaaatgagatatcctctgtgaaatcatccttctctcctgcctcctgtctctccattctttctccaggagacagaggccctccagactccatgactttgtagtgtattgtgtctgtctttattagagtattcatcacttggtaattgaattctgtgtttaaatacattttttttcttccagaataagtgttcatagaagggagggatgatttacctagcatactgcctggcatataaaaggccctaaataatttttcttttaaccagtaaccaactaaccaattcaacagttttttaaatgagtgaaaccactttttaaatttttttttaaattcatgcttcacctgtaaaaatatatagatgaattgcaatctggaactctgagtaatttatataaaagtgatgaaaaagaccatggcttcagatttgttgttttaattccagcttcagttcatacaaacattacaaagtcgcagtatctactgtgtaaaaagtttcatcccaatgaagaaattaaaatgtctgtctaatagagatgctctaatggacagcgatgtgtagacttcagaagaatctcctcacacagccttggaggcataagttgggaacagagcaagttctgtgtttgcctttcaaaggaatgttcctttccctttcattgacaaatattataaagatgccccaaaacttctgtgagtttcccccgggacgtaaggtcctctgcattttcctaacttgtttctcaaagcggtggttcccaaggcctgagaatagctgtgtctcagctctctcctggaaaccagagcctaaaatgttgccacatcatcgggaatgtagctgcatacttagccagagccaagagatgagccccactcgcaaagcccatgggctggacaaaattgttagccatttggtgtaggtcattgcactaggtccattacacaggttatctggcaggagtcccggctttggaggaaagacgtttaaatcctgtaaataaatggctggaacaccatggcagttgattgtgttaagccctcatccaaaattgctttgttaggttctattctattgctcattatcttgctgtgaagaaaattaagcttacatctgcttagggtgacagggtatcctgttgtcacaggattttccacattttaggcctatgtcacaagctcccaataaaccctcagagaagatcttttgtgttcacaggcatccaggtgtcaggcagacacagtctttgtcttcttgaagctcagtgacacgttcagggctgtgtatactcctccattccctgccagagacaaaatgtttgtggaacagtcaagctagaagggacctcagaattaatctgatcaaatgtctgcatttttcagttccaaggatactcagggaaggccctcggattctataagtagcggtagaggtggtattagaagtcaggttgcctgacttccaaacctctgttagttactgtcccttcccctgcatgcagcactagtgtaatccctcaactctcacttccctttttcgccacatgcctctctctctttccttcccttgattaccctgcctatccctcctacaagggaaactaccaccaggcatcctcatctgagacccgggaatggaggccaggtcttttccctccctccctccctttcccctttttttgtgtgacagtaacattattcaagtacagctcttccttttttcagtaccttccccctcagaccagaagttaatgaaaaatagggttgcgtgatatgcagcctgggggccaaaaatgtaggacaagcagtgtgcttcagacaaaactgtagggttctggtttcatgcacaaccttggaggacggtggctagaggccctagtatgagagatcaattaaacatggaggccagaaattaaccacatgggattaacatacgtaaggttgcttcttttcaatgagtctaggaaacacactggggacaccttgttcaagacaagctactatttgatgctccttcatacgcttgcttaaaatatttgttcagcatttatttagtgggggcaagaaaaattgatgttatgttaataagaaaacctctttacctcttaccttttattaaaataatcaacttagaagatatactaaaactcacatgacttttgacatctatggatgatctttcatttaatatttttctgctattcctactatagaataaaagctgctattgcattattacagagcgtaatgtgagccacatatgttattttaatcttaatggccacattaaaatagtaaaaataaacaggtgaaatttatttggattatatgttttatttaacccagtgtatctaaaattgtatcattttgacgttgcaatcagtgcaaaaatacagtcatgctatgtgtaatgaggttttggtccatgataaactatatatacactggtgatctaataggattataatacagtaggtttaccatacctttttctatgtttaggtatgtttagatgcacgagtacttgccactatgttagaatttcctgtagtattcagtacagtcacgtgctgcacaaatttgcagcccaggagcattaggctatatcatgtagcctaggtgtgtagtaggctatatgtaccacctaggtttgtgtaggtacacactatgatgtttgcataaggataaaatcacctaatgacacatctctcagaatgtattcctgtcattaagtgatgcatggatgaattaaaatattttggattctttttttttttcagtactatgccttcggaatccaatatgtattttacagcatatgtctattccaaataggcatattctgggctgggtgctcaatagctacatgtggttagtggctaccatattaaccggtgaagttctatgcccatcaaggctacacgtaatttacagggtataatagtattttaaaaattaatttttttctggcttttatgttgacatatcgtttccattttttaaatttttgttttattttctttcactgctttggaaacgcacaacttcttggaatgcaaattaaaagatatcaaataatgatgtagataatttgttattgctaaatgtctaccacttgaaatattcaagtttcaaatttcagctaactgcgattgcaagcttcagctagctggtcccagatggatggcccagctaaatcagacatttgtacatactggctacaaagtgtcccaaaaacagaccaggagggtcgtggatttaaaaaaatttccaccaaaggatgctgtcttgtccattttccaatttgggtaaattaatggatactgcatttaaaagtttttttatttctcgtacattgaagccctgtactgcactcaccaactcacccgttaaagcggctctgaaatacaggcaggaccaagacttagatggactggaggttgggccacaactccttgaacacctagagcagaggtcagcaaactttctataacggtccagatggtaaatgttttaggctttgcaggccaataggtctctgccacgactacttaacaccgctattgtggatcaaaagcagccctaatacgtaactacacataaacgaatgggcatggctgtgtcccgtgacaatttacttggggacacaaatttgaatttcatataatattcatgtctcacccatttattaattattttcagtttcttcaaatgttaaaacaattgttagttctcaaactgtacaaagacatatggtggctgaatgtgacccataagccatagtttgctgccctctgcccaagtctcctgttgaaatggggttatggcaacaatcctcgcagaatataaaactattttggcacctgacttttgccctgatttttttattgtttccagagaaatcaagtatttttctttttcaaatttatatccatattctctttttttctttgctctcttctcttctggccagcaggaagagaccaacccatctttgaattgtattcactttcctcataccgtcacacagctagtaaagctacaacttcacatatgccaatgccaactcttcccgatgttgtgttcaaaacctttctaagcatcaccattcccaggagtagcaattctatatgatattattattttacttgttggtaaggttaaaagttccagggatactgattttcttctttgttagccatgtttcattgagtggataagcaatatgcatttgcttcatagtataaataacaataatgcatcaaattgcaacaatatgaatattacacatagaaaagataaatgtgagttatgtaggtcatgccatttgatagaaaattttttttatatttatatgtttaaacatgacaataaaatgattccattcagatgaaggcaaaggaataggatttcttttcagtgtggtggttttctatttttgttttgttttgttttgttttttagagaatgagttttggagaaaaacaagctttctagacagaaaatattgaaattaaaaccagcaattcatggtcatattattgaaactatcaaattggtatatatatttgaacactactgattattttctaaaatgttacgctttcaaaaaatcatgaagattggcaagttttttagatgcataagcaaatagtgtagtacggcttgtaacactgttcaagataacttttttataatgagtatggtctttctctgccctgtctaatacaatgtgggttttgagcattggaaatgtggtaagtgcaactaaggaactgatatttaaattgtatttaagtttaatacatttaaatttaaagttacattttgataaattgctttgtttttcttttttctttctttctttcttcttctttttttttttgttttgttttttttgaaacaacaatctcactatgttgcctcccaggctggtatccaactcctgggctcaagcagtcctccttcctcggcctcccaaagtgctaggattataggcaggcaccaccatccccagctaaattgtttcttaaatgaaacttctgaatttgaggatacgtgattatgtggtgtagttttccctttctttccccccctgaaatccatattctgaagtacagtgatttatataaaagtaaaaagaaggagactgttttttttttttaaattctattaagaaaccaaattttaacagacacctcagggcctaaataaatatcaagttattgttatttgttatggttcttgttgcttgggtaaaactgtacagatcatgacttagttttccttgaatttttatcaaacaaatgaacaaaatgagcaaacaaaaatattaaaaatgatatttcctacgaatccaagggacatttttctgtatcagccaggctgatgctaaggtccttcaagcaaataagatcaaagatttctgattggagagtgtgggaataaagtagcccttgtttagtgctactttgtagagcctttgtttagagtacggctgggagggagggagagagggagaaaaatacggggttaatttgtaacaacacattctgtggtgtgcgtgtgtgtgtgtgtgtgtgtgtgtgtgtgtgtgtgagagagagagagagagagagagagagacagagagagagattaaattacatttaacttctttaaattttattgtcctcagggtttaaacagtatgtgaccaaaatcacattatttagtgaagagtttgtgggtaggtggatagttagatgggtataaatccctataaaatccattttagaactattgaggtttgagcaaatcaatgtcacctattcacttcatttgtctaatgcctccaggagccattaaagggcttgttacctaactttagggtaggtttagatcaaggtgaacagtcagaaaatattatccatgtactcacgtatattattaagtattctttgaccatggagttagatgcttatactgcaaacaaataaattaatgaataacagtgctgctcatgaacaccaaagtttactgaaaagtcaatatggttttagtgtggtaataagggcagagttctccaaggactgccaacctatttattgtacatcaaattttactgactttgaaatcttgctagaaatgttcatttacctcgtaatgtattatatgtttgaggtcttgagaaaaataacaaaatccatgtgtggtaatgaagtggttatgcaataaaactaacatacactgtgatttgacacaggggacttcactgttatcagatacttaaaactggaaacaatgtaggaaatatagatgtataagcatcgtaagtaaaatccacatgctttaaaaaggaaatccacttacttttaaagtaatattccgagagctatgccactgggggctgaatgtcataaaaatgatttgtaattagtcacttttacattgtatatggatttatagttttaaaatatctggtggcatataaccacaatgtatttttcagtcatatattcatcattattttattaaatttccagagggaaagaaaataaatgacctcctagtgagggatattttaccacgagaccagttgtaaaaataatcgagttttgtgcctgggaagatatctttgctaagtctagttctccagtgacattaatttattgttgttaagaaatgtgtgaggcaaaatgaactctccaaatatttcatactacgtgcattttatccaaaagaagataatggtttacatgaattatttaattggtattactaatttgggggaggtgatttttggttgggggcaacagaatatttgcctaaaatgcattcagagtgcgctgttatttagctattttcaaggtagagggatattggcattggagacttacacgtagccatacaatggccaacttcagtcaactacagaagcaatacagggcagcggctggaacaaaatagctactaggtaaatattgattgaattaattacacggatattaccactagtcctgcaattaattaatacctagccctgtctccagccccagaatccatgacatcaagctaactaacagaaaacatatcaagaattttattccttagtcctcttgactgaccctcaagagggtctaccctcttctactctgtattcctcacatcaaatttcactagtccagccgccaagtaacacctgttctgactgtgctagtgaacttggatattcacacatagcctaaaatgggaaacagagttggaaatgtcatgtataaggacataagcgttttcaaagtgtacaagaacataagcgtttttaggagatttaccttctcttttctgttttattagcgaatgattgattgttttgtatgattgttcatttaacaaatgctatatcatgtaagaaaagttactaacggtatataaagatgtaaaattcaattgtggctgtgtgtatgtgtgagtattctagcttttggggagagacaagagaagaaagaagacataagttggaagagaacagtaaaataaagaaaaaagtaataactgacggtgtctaatgaagtagcccaggtaattaatgctagagtttattagatagaatcattatttccttccagagggattaagcaatcttctctgaggaggtggaacttttattacccaaaacatgaaggattgggaagagttttatatgtgtcgataaggaaaagagatattttattgagggaaaagaagacattttaatggcagagtacacaatgtcagaggaacagaccaaaagaagtgctttgttattaggaagatttgaagaatggaagatagcgtcagattgttaagaaccattttttagataaaggcaggctaaagaagttggaggctattggaaatcagtcacacaattttaagcaagagaatcaatgagtggcagttttgaaaactgaatttgatagtggcaaggaaaatagggctctatcatcccacttactttcaaagttatgaagaaattgtagtaagctccagtcagtacctaaaggaatttattttgtgaaattgtgtaaacaaaaagcaaaccttcttttgcactcatatagtatattttctcaaagtcatatagctaaagggaatgagaggtaaaatagtacagtggttaacaggataggcttcaaagcctaacttcttgggttcaaatcctagcttggttaccatttcacagctatctgaccttgtacaagtcacatgcgtacactgggaacaataatactacctgtattatagagttgttattagatgttgttgatagatatgttgggcacattttaggcactacatacataaacctctttctatagaagtatacatgtgtacctatatttaaaataatgattttcttttttaaaagaagcacatattcattgcagaaaatttttttgaaattttaaaagtaaaatctctggtctaagtgcactaaaatgttttagactttagatatgaactacaaaaacctacctcatcgacacccaaccccactcccagagatatttcattttatttgcttgctatcagtaatgagaagacccaattcaccacacaatttctgttgtatgagactattgtattgcagtgcaagatagtgttttaaatctttgttaaatcaataggtgcaatattacacctccctgtttgaattttcctagtgaagtcaaacaattttaataggcctatacataggtcagttatagttctttcctaaatggtctattcctcattatcctttttaattgagtatttgtctttttttctactgatttgtgagaatgtttttatcttaagagtgtcaaaaagatgaattgtttttgcctttttctttggcttgtttgattttttatgtaaagaaattttatactgctatgaatgtaagtcattactttatggcttttaaattaaaattataagaatagcctcccatattttcattacttttatagttcaatttttttacatgtaacatttcattcatctggtatttagttaggaattgtgtgagataggattttaaaattaagttaaaattcaatcaagtctttattttttaagtacagaagtttccgaattcagcatttacattaaattttttgaaaataatgctaaaatatcatgtaaattattacttattggaattgaaaattccctattattatttttaatctttataacaacttatgttatctatgcttctattataaaataaatgacaagccaaccaaaatagagaagatgcttatcacaattatatcatgataatttaaacatgattttggattaatcataatccaaaaatgcatttgataagcattctaactgttcttctagtccccataaaattaacaaatggcaaacagtaatgttttaattttcaaaatattcatattaatattcattttcaaaatatgtttacttgcatgcatttcatttatattatttcttattgaagttgacttctcaatgtatattgctttaatgatactaagtattaagggtatagattgtactcacacaaataactattgaaaagcataagtttaaatagatccatttatcaaatgatgtctttttttttcttttttttttttttttttttttttttgtgagacggagtctcgctctgtcgcccaggcaggagtgcagtggcgcgatctcggctcactgcaaactccacctcctaagttcacaccattctcctgcctcagcctccagagtagctgggactacaggtgcccaccaccatgcccggctaattttttgtatttttagtagagacggggtttcaccgtgttagccaggatggtctcgatctcctgaccttatgatccgcccgcctcggcctccccaaagtgctgggattacaggcgtgagccaccgcgcccggcccagatgatgtcaattttgaaagatactggaaagtatgttttgggagggaagagggaaggaaagagtagaatatgaagtcagtaaaacctggatatttagtgccatctttgttacttactagtaaccttatgaatattatttatattgttgatccttaatatcctcacttgataattttagaaaatgttatgtacttcataggatcatgggtagaataagaaagtgaatataagtaaaatccatcatgaagtacctgaaatatgttgtaaacctaagttataatagtaattttattgttgctaatatttcagaggaatagccaccaaaccagtactacttattatttatttctatttaacatataaaacatataatattctttctgagtggtaactttgaaaagggacaaaaatattaaaaattacattaaaatcatgtataatttataatactcctttcaaggttactaaagtgtgcatgtatttctaatcattcacaaatatgaaaatctatgtgtaaatttttaaattttctaaaaaattgacaaataaaaattgtattattgtcatggtgtacaatgtgatattgtgaaatatcacatattgtgaaataaacattgcggaatgactaaatcaagctatagaacatattcattaccttacatacttattattttttgtggtaagaacacttaaaatctacttttagtaatttccaagtatacgttattgttactaacagtagtcaccctgagttacaacagataactaggatttattcctcctgtcaaactgaaattgtgtatcttttcatcaatatctcccaaatcaccccacccccaggatctaataaccaccatttttctctgtttctctgagtttgacatttttagatttcacatataagtgaaatcatacagtatttgcctttctttgcctagcttatttcacttgacatcatgtcttccagttcaatccgtgttgttgcaaatgacaggatttctttctttcctaaggctgaatagagttccattgtgtttatataccgcaatttctttaaccgttcatttattgatggacatttaggttgattccatatcttggctattgcaaatagtgccgcagtaaacatgagagggcagatatctcttcaaaatactgatttcagttcttttggatatatgcccagagataagattgctaaatcatatggtagttctatttttaatgttttgtggatcttccatactgttttccacaataattatactaatttacattcccatcaacattgtacaagggttctcttttctccacattctggccaacacttttcttttgtctttttgataatagtcattctaacaggtataagatgatatcttattttggctttgatttgcatttccctgctgattagtgaggttgatcatttttttttttcatatgcttgttagccatttgtatgtttgctttagagaaatatctattcatgtcctttgctgtgtgtcgatactgatatgtaaaatatgcatacaaaatcaaaaccataatttatttttaatatatttttaatatgtcattaatatttttcagtgtaataggatgtttttcataatatttactttaatggacgcaacatatttcattatgtaaaagcagtttattctatttggggagatttcgtttcactttttcgccagagtgacataattgaacattcttgtcataggtctctgtgtttatctctgatattcccctaggaaaattcatagaagtagcattttggagttgaagggaatgagtaatcttaaggcttttaaagtagttttatcaaattttctaaactgaagtataaagacacatagaaaagtacacaaatcataagaatagaaattcagggatttttaaaaaaaacttagtgtatccatgctactaccaccaagttcaagaattagaacattacctcaggagcccctctcatgttccctcccagttatgagcctctcccctgccaccaccctctcccaaagataagcactcttttgacttctaacacctagattagttttgactttgaaattactataaacagaatcatccagtatatgcccttgtatttgacatgtcctgctcaacattatttttgtgatattattctatgctattgcctgtgccatagttagtttagtttttctatgtatggtattctattgtgtgaatatgccacagtttatccattctgctaatcaatggacattgggctgtgtctattatggggctattaggaaaaatgctggtgtgatgttcctgtcctttgctgcatatatgtatatatttatttttaatatacgtggaagtacaatggctaggtcataagatgtgtacatttggctttggaatcaccaaaaaacagtttttcagtgtggtcatttcagttcattttcaccagcagtatataagacttctagttgatccacatattcatcaagagtatgtattttcaacctttatccttttaaccatttaggtgaatgtgaaatggtatttcattgtgttttaatttgcaatcacctgacgattagtgccatttttatatcctcttatgtgaagtcattatgcaaatcttttgcccattaaaaataatagttgtctttttcttactgatgtagaagttatttggatacaagtcctttgtcagatctatgcattgcgaatatctttttccaacctaaactttgctttatttttttctcttaacaatctttcctgataaatggagtttgatttatcagtcttttcctttatggctaatgctttttatgtcttgtttaaaaaataatacattaacctaaaattgttgagatttttttctatattttcttttgaaaactttatttttttgccttttacattgaggtctgcaaacaatctagaatttatgttttgtgtatgatgtggagagtcaaggttcatgtttttcaaatgactaatcagttaacttggtgctatttactgaaaagatcatccttttccaacttaagtgacaccatcgtataaattaggaaacgctatatagatgatttgttctcacttcaatcccacacaggcttaattataataaatattcatgtctggtggcaaacattcttaaacttcgtcgttcttcaaagttgccttggatattcttagccctttgcacttacatataaatcttaggattggcatgtcaatttctactaagaaatggttgctgcaattttgattgagattgcattgaatttatagattatttgaagagagggcagatatctttacagtattggactttctaattcatgaagaaggtagtcctctatttgtttacattttcttcactgtctcagtagtgtttgtagtttccagggtagaagcttaacttttcggtctgaattaccaaattactagcaacatatatagtcatgcatttcttaacaaatgagatatgttctgaaaaatgtgtcattaggtgattttgttgttgtataatcatagagtgtacttacacaaagatagatggtatagcctactgcacatccaggctatatggtacagcatattgctcctaggctacaaacctgtactgcatgtgactttactgaatactgtagtcaattgtcacacaacaatatttgtgtatctagacacagaaaatgtaccgtaaaaatacagtatacaaatgataaaaaatagtacagctgcatacggtatttaccatgaatggagcttgcaggactcaaagttgctctgggtgagtcggtgagtgagtggtagtggtgagcaaatgtgaaatctaagacattattgtacggtaccatacagtttacaaacactgtatagttaggctgcactaaatttatgaggacacatttttatcttttttttttttttttgtatttttagtagagatggggtttcaccgtgttagccaggatggtcccgatctcctgaccttgtgatccacccgcctcggcctcccaaagtgctgggattacaggcgtgagccaccgcgcctggcccatttattttcattaatgataagttaaccttagcttatagtaacttttttactttataaactttttttttaagtttttgactctgtaataacacttagcttaaaacatgaacacgttgaacacccgtacaaaaatattttatatccttattgtagcagctttcttatttttaatatttttgctgtttaagcttttctgttaaaaagtaaaacacaaacacgcacatgagcctaggcctacatgggtcaggatcatcaatatcactgtcttccacttccacatgctgtcccccactggaaggtcttcatgggcaatgaaacattcatgaaactatcatctcataggataacaatgccttcttttgaactaattaagaatatagtaaatacataaaccaataacagttgtttattatcattatcaagtattgcatactgtacatacttgtctgtgctgtatttttatataactggcagtgcagtaggtttgcttacaccagcatcaccacaaacgtgagagtaattcattgcactgtgacatcactaggtaataggaatttttcagctccattgtaatctcataggatcacagtcagtctgttgactgaaatgtggtgaatgactgtataatagggctccaaggaagatcataaaattgcttgttttccagaactttgacaaagaccttttacagaaactaatataatagataaataatagtataacattgctgttttcctttgcatttcattgattactaactgtctggattttttcttgtttattggctgtttacatttttgtcaatttctttttatgttctttatccagttttccagtagatttttcctttttttactcattaaaagatttttttatatgctaaaattattaccctgtgtctgatatatgctgcaaatattcccagttgtcatttgttttaattttgattagtggctttaatttataagtgaatacgcatattatattcaatctttttatattctttttttgcttctaaaaggcttccccacgccaatattttattccagttcttcttactatttttatgcttaacactttaatttttctaaaatgttttgtgttatgaaatccatcttaatatgtttatttctaaaacagacacttttgcttatcttaatattaaaacatatacatttgaaattaacattcagagattgaaagaataaggaaagtaatcttgtgtgaaattaggtcaagatgtgcttagatactaaattaacacataagggaattgaatgtgtttgttttctttcaccacagggaacatgttatatgaagagcatggttttataatacataaaaggattattagaaaaatgatgtattttaccggtcaggtgtttgtgtctatactttgatgtgaatgcaaaatagtaaatataaatgtaaattaatttaaaacacatagaatctgatacaaaccttaatctttttccacgttatacattactcacacctgttatatttttccgtgaagtatttggaatactctcgattcctggaaactgttttaaagtgcagaagagcacaaaaaaaatatgtgttaaaagttcttgatttccacccaaccattaagtgatattgccaaagaaaactcttcagagcatttttcactgatggctttagatatgttataccagaataataatgattcattattaaaatatgcaaagtgtaatttctcaacaacattttgtggtaggaagatgagctggtacagtagttttccttattaaataattttttacaaaagtaattgacatggtttggctgtgtccccacccaaatctcaccttgaattatggtaatccccacatgtcaagggtggagccaggtgcagataattgaatcatggaagaggatcccccatactgttctcctgataatcagtaagtttcacaagatctgatagttttataaatgtgagttcccctgagcaagctctcttccctgctgccatgtagaatgtgtttttgcttctcctttgccttctgccatgattgtgaggcccccccccgccatgtagaatggtgagtccattaaacctctttcctttataaatcacccagtctcagatatgtctttgttaacagtgtgagagcagactaatacagtaatgcatttacattgttcaaaatataaaaggtacagtaaaaaatatctcaccctacccatcatctgctctaccctcactgcacattaaccttaattctagaaacaaatctacaaaataaattcctgggaataaaatttccaggtcaaagtttacatgctttttatagatatggccaaactgccttccacaagaggtacacaaatgtatacttcccaccagccacgtagaagagtctgcattttcccacagccttggcagcatagtgtacctgcagacttgaatttttgccagtgcaatagatgaagctctaattttcatttctctcattattaccaaggctaagcttctgttcatgcttttaaaatcctttgtattttcttttctgtgaactgtccttatcttttgtccaattttcttttgggttgttggcctttttcttattactttgcagaaggtctttcatgtgttaggaaaattagtcccttagacatgagtcacaagcatttatttttcataattgttcatttgtttttgattttgcctatggctcttttggtcgtgcagaagcttttgattttttatatagtccagtttactgatatttttgtctgttaattaaagttatttaacttgaggatacaatttacatttttttgtggttgactactatagacatatactgcttcttacattgaaaaaataataatcctgaatttggaaattgtttttaacaaacttttggtgaaggtccatcatatttaggaacagagcttgtttgacccagaaatcaaaggtcagtgagaaggagcaatgtaaatagaaagttaaatagcatgaggtaaatgttatgatggtgggaaagacaagatctgagaggataaacctaaagcaacatcataattaagctgaaaatttcgtctcatgataagctatcatttcattattccagatattagtcaaatctgacccattacactgttttctgtcaggaattgttttacctctattacaaggaagggatagtatgggaggatgataaggaaaccagcagtcttagttaaatgttatacagatttctgtgcttatatatgaagcctaaatgaaacgtgaacaatttcatgatcagataaaaaggagttcatcgctcagttttagagattttaggaaaatatgatggctattatctcagtagcttcagagtctagaggcatttagatgttgttagttgaagctgtaaaacgctttttacatctacttgtgagtagaaaatgatccaataaaaataaaatgtttagttacctcctttaaaatgcttgaaaaataagttgaggacatcattagatcatgtattacagacgtaggagtatatttgtaacatcacctacatcacacatacctgtgtgcgcgcgtgcgtgcacacacacacacacacacacacacacaagagttcagcaccacaggtgtagttatggatgtgaactcacaaaacacaaatcaagcaaagagaacaatatctcaattcatgattcatggacattctgtgctatctgaaacacaatgcttcttttgcccaactctcacccacacagggaaaggctgccaggaatgagaggcaagaagtgtgcaggtcaccttcaacaggagccaccacctgtatttcccatcagtcttttacaccattgtagtcacgtggatccaaggactgtattccaactgacagctcctgcgatgaggtgcagttccacacgacaaagccaggcccaacatttcccattcatcttaaagttagtgtttccaaggaaacagtgctgtgggagcctagggtcagtcccagactgacctgcaacagcccaggctggatgttaatcctttgcttatacagtctcatgaatttttcacaacatatatacatgcatttacaagacgtttcactgtacatattgtttacgtatacaatcttgtttaaaattcatttttctgtacattaattgatttttttctcgacaactttctctttttcatctcctaactcttgcatccaattaaacaatgtactgttcattagtgacttattttaaaagtatctaaaacaattgttccaaagcatgtgacattgtttatgtgacacactggtatattatctagtttatttttaaaatcttctctattattattcataatatattattatggaacagatgtatattataaaattttattcatattgcagtgtaatattttgtattacagtggtattgttaatagtctcgtaaagagctatcattacaagtttaaattctttattctgggatgccagttttaactcttgatattctgaagaaaatagctttactcttgtttattctggctctgtttttttgttttgttttgttttgttttttgttttttttgttttttttttgtagagatgggagtgttgctatgttgtccaggctggcctcgaactcctgggctcaagcaatcctcctgcctcagcctcccaaagtgctgggattacaggcaagagctacagtgctcagcctatcctggctctttatttacatgtaagcttgagcaataatcactgctacttaataactttattgtcattcattatcatgcagagtattgctctaaggtatgttcagggatgacgttactgagtcctaacagtaatcctatgaagcaggtgctatcattgtccccaatctacagaggaggcattgagagttagagaaaacttggctaaaatgttaggcaagaactagaaccagaattgaaatccaagtggcctaactctagacctcacaatgcttaataccatgtcatgctgcttcctaacctatttaatgtttttttcaaccccaacgtcatcacccatgtgtgatagtgggatcataataatatctatgtcgtagcattgttggatggattaaggaagtctacaaatgtgaaacttccaaggatgatggttggcatatactgatctcttaataaaaataacctataatcattctgttacagtctactctaatccaaatgttctttttacttctcatctcaaccacctgcttctgtttactaggactcacaaactatagctcacaaaaacgcataacttaccaattttccttgtacatgaagggacttccttttacaatcttccatgacataaaagaaagctagaagcaagtatagtagaagaaatgattgctatacaaacaaaattatagttggtttggttttaattttaggatgcgcattgaataaaaatcactcatttgggatttagaagacctgtgttatatatctggtgctaatgctgaataacttggcttattcatttttataactgcaaaggaagcgcgtatggcatataatacacaacacaccagtatatttagtaactgagtgaataaatgaaagatgtatttctttactttatcagttgcagttggctatgcctttgtgtaaggtgtgtgttttgaaattccaaaaaggtattagtttctttaaagcaaagaatttttgtagcaggttaatgaataattttgaatacattggttaaatcccaacatgtaatatatgtaaataatcaatattatgctgctaaaataacacaaatcagtaagattctgtaatatttcatgataaataacttttgaaaatatatttttaaacattttggcttatgccttgagaattatttacctttttaaaatgtattttcctttcaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggtagggaactttttgctttaaatatttttgtcttttttaagaaaaatggcaatatcactgaattttctcatttggtatcattattaaagacaaaatattacttgttaaagtgtggtaaggaagactttattcaggataaccacaataggcacagggaccactgcaatggagtattacaggaggttggatagagagagattgggctcaactctaaatacagcacagtggaagtaggaatttatagccaaggagcagtgtaggagtcagtagatggaaaattattaagaggaaacatcaggggtaagtgggattctggctaaaccaacctcacaggattcttgctgaagataggccagggttatcttatcagacaacccttggggaatggtggagaatactgagggtgatcaggtaccaaggataaagggttcttgtaaaactgacaggcttctttgctgaacctggattttacaggggagtgcaaagatgagcccaggcgaaggttcagaagcctgactaaagtttagtcaagcagggaatctttgtcatcatcatcattgttgtcataatgataataattattattattttactagaatatgttgctttttcctcagcatttactagaaataaggtcttcattaaacttatgttactagaatgcctgcatcatatttgttactgtgattcattttctatccctgttttaattgtgcttaatacatattcatagattccttatccaaaattgaagttgtttatgagattaggttcctaaaatataatgtctgggctcttttgtagacattgtaaagccctctcagactgactacactttacctttctatcttctcattctgccagcaatctccccgtatagtctggccacatcaaattacctggtacctttccatccatgtaatttcatgtcatacctgtgatcttggttttctctcttctttaaatgacttctttcagtttattttgatataatgaattttcttccattctttaagaatgaattcaaagtcattgcgtcttccaagttttcttccgtaccccaagtagagttagaatccctgttaggatttcttataaacctttttattcatctcccattgttcatatgttgatttacacttaaattttatacacctgagtatttcattacacatctgcactgttctttgagtgcagagggcattctcttatttatctctgcttctccactcatatcatacacactcagcctaggatccagtaaatgatgcttacttgtgagtgtttttaagtcaatgaataaagacagtaccaagacacccagaatacgaatgagatactgcaggtaagcgtaaggcttcagacaatcctgccaattgaacaccactatctccttcttctagtgtccttgtaaatgctgattgatcttcttttctccctttcaaggaatctattccaaagattctttcaatatgctgccccgttttgcgtctccttatttgccaaaatctttaagtagccaatcaaataaaccgaatcgttgaaattacaatctattaatgaatgtattgttgggcaacttcagagtaaaaaggataagtaacatttttgagtagttttttcttttatttaattgactttaattgttaaatttatttactgtccagtattgtaaaaacctaacattttaatctccatttagctgttgttttgctggaactgagagcaaagggaaaaggaagtttgagaatattctagtgaagaggaagtaaaagtttcgggaagatgggcatgagtaacaaggagatagagggaagtttgctacaactaaaatgagttagattagcaaaatgttctcgactatgtttaccttacttcctcctgacacttatgtctaccattctgatagctactcctcaagagcagatggcactgtggaagtcacaagtagacatcatttcactagcacaaaactcagcctgctcagccagtggcacagtcttgggttcagtctgatgattaaatttacgagacataataggctttacccagtaacaaatttagttagctttaagaaattatacaggatgggtaacaacagcctgcacattaaaggcacagtggaagtcttgataccaagacgtggcttctgatgtcccatcaccctgaattttagtcatacatgatcacaaggggcaagactgggtgcgtacaaaacacatcatcgtctcagggaagccatcagttctaggatcctgaccatttctccacttagctagtacatattgtactcagaggtgtttgactagctcctattcaccagtacaattacatctcatgaatactgatttttcactgctcaataaacaaccccaacaagaaagtacagttacttggcccaatacacaataaccttagccaaattctcaattatcttatatccagtatattcttaaaaagtaactggcgtaatattgcgaagaggaaaggtcataaagtctttcctcccaaccagaaatagctttttgtagctcacggtaaaagcacattctactcttttaaatgcaatctttggttaaaatgtgcctctttattataatagtttaaaaaatactcaatgctagctatctctcttcctggaacacatttaagaaaagatttttttttgaatcccttggtacaaatagatcctgtttactcaatcaaaatgacttttgtcccagtctgtgccccccggaatggttttcaaataatgaaaacctgcattgtgtcttcgattgtctatggcccatagggctctgccaaatgggtccctgcagtttgaagtgaaagccatactcggctgtgttaatcacttttctttatcaaagctacaagtcaccactcactgctgtgtgtagtttctgagagtcatgatatttgcctcctgcagcttgttttaaatcactgaggggagagggagctgcttttttcctggcagaaaactccttggcttcagtcctctgagcacattccgagtttcttatctctggagtgcagacttcaaaaatactcttttagcctttttcttctgcttgtggctgtgttcaaggtggggggaggggaaacataaaatcatagatttgatgacttgagagtttctcccaaaaattctcaaacccccagcttataattaggaaatggtgacctgtgtgaataataatttaccttgttttttatccctctttgtctagcttccattcctttcactaataaatgatttattaagattgcacagtttttctgatttaagatataggatattagtccttacagcctgctgtattcctctgcttaaaggaattaaactatttttccattaaagaaagatgggacactagactttgctttacttagtttcaaactactgaacaccaaaaataaaatttttaaggagttttgagcacatgcccttttttttaacacaaggtaaaaaaaaaaaaacacctttactaaaatcttaagaaagagttaatgcaaaggaagtagatatacgaacagccacgcccctagctccaaatcctaaatgtaaagaaacttgccttgtctggccatggtggccatagctgcctcggaaacaaagggtctgaggccttgccattcgggtagtttgttttctctagtcaaactctgagcacacctgttagaaaaatatgtaataccctctctctgtgagcctcagttttgtctgcttggtacttcactcttattgatgaaatgcagctagctgtgtagtgaaacccagataaaaaaaagctttaagggctgtgttctaatacattgtttatgctggagtgaaaattgactgcacattgcttggtttgtgcaatttactcccgaaatattcctattcaggaaatcctgcaaatagcaatattcatcttgaaaatcacctcacagaacccttagcaagctgagaaacataatcaatgagatcgtgatgtagagggtgaaaattaggcgtaatcacagccctttcccatcagtcagcccactagaaggcatgcctttgaattttgattttcaaatatactctcaatttagacataaaatatgttgatttcagatttcagaaatgataattgaatgctaagatcccgggaccagtttagaatttctataaagggtcttatgtttttaacctttaatgaatgctttcaataatgagctagaggtatactatttatctgacataagactgactactgctttccaaactttttattaaaatatgaggtgtggcgggacacataattttatgttaaggcttagtgactgaaatactttcatcttaatcacagggagggggttttttcctcccctcaagaatcactttccttctgtggtttataaataaacatgacatgtggctctgctggctcttccttgcagtataaggagcataattgcccataatgtcaaatccacactaaaaactaccaaaggactcaattgtagtgactgaccattaaagtcactgaacactgtgtgtgttcacattgctgtgagtgttgtcaaagaaaaatagcactagacaacagacaagaaagactgtgttcaaaacttttgcaatagaggagacagattgaactcaattctgctgaaataaaaggcaggagagcctctaagtgctgagatgagttagtgagaaagtactagatatcaggagggaggttagtcaatgtgcttatttaggccatctgtgtttgctgattggcacttatcaaagttagattcctatcctcccaacagaagactagcagattggggcactatcttttttgatgattctatatcaaagtgctagctcccaagtccttgagaaagtttattcctgaggtataaaagtggcaagaggctaggagaatatttttgtctcaaaaaagtagagaaataatatataaagttttctagagtaaatgctctaagaaaaggaaggtcaggtctaaagtcaggaagaaatctgtctcaaatgtagtcaaactcagggtatttttaaagctttctttgtcaaccctccattttgttcaagggaaaccagttttcccattgaaaaacttaggaacgccagttcatctagttcatttcagcaggtttctgttgttgaaggactagctgaacgaactctgacacttggtagtaatcagacatttcatgaaggagatttccatgaaagttagaaggaagacgaagattaatggttgaagcagactgcaaactcagtttttgagtccagagggcagcaagtcaaaaagattcctagaagctgggctgtaggcattctcagatggtagagtgaggatggcagtagcaatccgatggatttcttggagcatggcacggaagaggttggagtttactgaactttttgcatggcctacaaagcagcagctccaggcatgaaagttgtctatacataatttgctgtggtggtgagtcctttgtagtttatagcaagtcatccagcttctgcttgcagggcttctttagatattgtggggaaatggcagctataagacaacctagagaagagagtccttatctcagtaataatatgggcagtcacgttttagttctcagtgtcaccaagtcaggatggtgggagaaaaatttgaaatgttaatttggagaatcgcagccagattgtaaaggaaataaactgaaaattggtaaggacggacaaaatgtgtaagacagcaggatccagatcaatttacaggtaggtaaaaaaaaaaaaaaaaaaatcatgtcgtttacaaagaaatgcaaaatagatcaaagacaatgaacaggactagaatctgataaccccaagggttactgaaactctatctctaccatcacccttttgatcagtgttaatcaaagtaagactttccttgtttataaaataagactggcctatttatttatataggggtagcaaaaatggtaatttaccaaataggctattttaagtgtgattagctggaagttttcatgaagaatcacaagctgaataagtttcagagatatactgtacagcatagtgcctatagttaacgatactgtactgtacaattagaaatttgctgagggcagagtttaagtgttcttaccacaaaatactactactctcttttaggagcagtggtacataaggtgagaggaaacttttggaggtaacgcataggtttatggcatagattgtggtattggttttgtatatatactttatctccaaactcatcaagttctatgcattaaatatgtacagctttctgtttgtcaatcatacctcaataaagtagtttaaaaaatatgaaacctcagatttgattttttaaaagtctccaaagtttaggaaggcaagtcaagaacttgacatcagattttacctgaagtaaaatacctatagattcagctgaagtgttctgttttccaggttcctaaaatacccttggtttcctgggtctcctaagaatagaccttccttactcagttgtaagattgggaattctgtaagccaggtaccgggacagttttcccaaaaggggcttatattagctccatatagtcaagagtagctccttaaaactggtcacatctgactctatgcacttaattctcaaatatgacattccagtcaaagccttggttatatatttttttcaattatgtcttgttacctaaatatatttattgagcctatgcaaataattatattgccatgaaaataagaatactcggtaagaatttctgaattttacagggatcaggcagggataaaaagattaatgtttcattctgtttacaaaagcatactctaaattctcatgagttatagataacttaagagaaaaaggaaaggcgtttcttgtatttagcaaacagaacattaaaacatgaggaatattttaaacaaaagccataatcaaatcttttatcagttcattcaggcccatgtagttaattcttgtcttgcttgatcttgagttagtagtttcatgaactcatcagcttcttcacagagtttcataaatcctgactttgtccaatggtataatctcgaagttatttaagcaatggcatcagaagtctgtgtcccagagtacctgtcgtagtacttcctatgggtctcaaagatggtcctgttttactgaagatgatgcattctgacctctaactgattgtaagagcactcagggaagcatcagcataaaccaaaaactatctgtgaacgacaaaagacttaaaatggccataattaaagatctgattcattcgacaagaaattttttttttccctggtgccatgccacattttaaaataacaactggagttaggactgatgacataatattattatcggataaagtagcaccaggatgtgtcatggacacctagagcacctagagcactaacaaagttctaaggatttattataatttttcaagtatttatactaataatagttgacccatacaactataacctagtcaaggttcagcatctcttcttgtcaaagctttttatgcaactcaacataccaaatgaacctagttatttttaacatccttcattttacaagggtgcaggaacaaatcctttgaaatttttcaaaccaatctgagattaaaaaaaattttatttaagaattgacctgggaaaagcaaaatatcaaaggttgtaaaatgacaaaaggtttgaatacttggctgaataggatcattgctcactatgaaagaatgcatggctacctatgtaaccaagatgacaataaaagatttcaaaaataaatgtagaaggccacatgacggtaaaagtttttagttctttccaaagagaaaacactactttctaaaaaaattcaaggacatacaaaatcaacacaggtacttattctgataagaaacaatatttgtttcctatacagattacccaaaatataaaaaaaaaaacaaattttgcaatctcttattaagagaagaccaatagaaaagatgaaaatgttaattagtttgaccgaaataattgttttgcaattttgtgtgtgcgtatatatatatatatatatcaaaatatgttgcatacttaagtatattcaattttatttcaaaagagcagaccaataatccaagaatattttatcattttttaacaaaaagaaactacaactcatttttgatcaatacactgttgatactaagggtcatttgtaagagtttacatacacataaatccattccgttttagccagcattggctattaacataagactctccttccacaaatcttctgccatttccaatgttcattcagattttgtcctataccttcctcttcctcattttcacagtcattttaatttaggacaaagttattctctttttccttaacaaaaacacatccaacataccttgtatattttgcatacaaagttgtttccctttacccctaatgtttctggaagttttatttacatatattgattatatttttaaccattagtaagtcttattttatagagaaaactaggaattagctaagtgtgaactgtttgtcatataccagtatttcatagccaactagcaaagcttatgaatacaagttaaattcacctactcaatatgagggctaaaagtttacatcaatatttgtggaggagccttttaagattttcttttgccctgatatgtaatttatggaggctgtgttctaaaatttgagtaaatgactgaggagatacctagtggccatctgggtatctccaaatcccatctgaacgtacacggtatccagtctgtttccaattagctttttcaacctcaggtggttgcttctggggtttgagttttccagagcccccagtagtggcagggagcataacgctttagagaccatagagagttgagagactggagtaggaagagaaaggtctgtcatggatggacaaagagatggagcaggtacgggtttgaagaggaatatgctgaaggatttaagggagctaaagggaagatcaaaagtagtcaaaggaagaaggaggaatggtggtgatgggaagggagaggtcttagatgagccagcttagggagtgcttatgttttcggaagaggccattgaagttcatctttagtaaaaatcaaactaacaagaagagaagcctagtttgtgccatagaggtgaagcatctaatcagcagtagtcttcagaggaggagaaacagaatagtgagaatgtctcctggaggaaagaggcaccgaaggaacagcaacaacaaaaaaaggaaacatgaatgaggtctctacaaacgtgatctgtacagaaaatgatttctctaaatactgaaaatctgaagttgaaccaaatgagatttcaataagaattttccatgttctaaaccaatgatgcttttcaaacaaagaagcctgggactctagactcaagaatatactcagattactgagaatcaaaatctgatgttaccatgcttccacgctttcgtgggtaaggagtcagacttaccaatggattcccaattaatcagtcaggagtgtactcaacattcacaaaattagctttgcagaggttaatgtcattaaattcactttagaatggataattcaaattcaaatagtaactcccttagatagatgtgtactagctcaagttcacctgttatctgatttcatttttaaaaaaaattttttaaaagtggtgttcgggaggtaaggaacaaggaagagacctttagaaaaaagtttcagtgttttatattggatatgaaaatatcagtggaatgtgtcctgaaaaacactggatgacagttactggacaaaaagacaaattattcccttttaccatgcaactgaacacagatttattgaatgtttttctcctgagtttaggttgcctctgggcaagagtataattctggcttgataacaccttgaagcgtgtttgtttaagtttgtggatagtttcatctattagtggaattaggcatctgcttctctttatgaacactgggtaccataatcttcctcttactttttgttttttctactcaactccaaaaaccattgctgagttgaagtagaataataaggggaaagaaacaaaagactaagtttgaatcccagtgctgacacttactggctttacgatattgtttaactcacttaccctttttaacctgaccttcttcttcactaaaaatgaaaaattgagtgaatttccctgggactctgttagataaggcaaaactaagatgggaacacatttcctaaggcgtagaaaaagacagtgaatgggacctttcttgttgtatcaggagttatggtaagaggtactaacaataaaaattaggctttcagccaggcatggtagctcacgtctgtaaccctaggactttgggaggccaaagcaggtggattgcctgagcttgggagtttgagatcagcctgggcaatatagcaaaaccccatctctactaaaaatagaaaaaattagccaggcatggtggcacgcacctgtagtcccagctacctgggaggctgaggcatgagaattgcttgaacccaggaggcggaggttgcagtgagccaagatcacaccactgcactccggcatggggaatagagcaagacttctttaaaaaaaaaaaaaaaaaaaaaaaaggccttcaaaatacccctacagcagcaagttggtaccagaaaaacactccaaaaaagggagtagatggtcatgagattttcatcgttcaccaacctaacttgcccatataaggaaaaggataaacttgagaacagtttcttgaatgagaattcctggaacagatcattcaaataggactaacaatttgttggacatgagaaaacttctatgacttttactgttccctttcttatgagggaggggagaagagtgcttttcctctttgccaagccaaggaagagggcttcaaagaacctctattatagtggcattcagaccattgtatttataaaaaataaaaatattttagaaaattgaatatctgcttgcacattttaaagatgacatctattttctgcccttgggatacagtaaatattgacattttaaaagggtttatagtacagtttagaatgtatcccgtggaatccaaataccattgcaatataatgtctaccatcatatacttaaaaatacatgaaaaagctcatatttaataaatagaagttttatattattcctttttatttaaatcatatttttcaacttccccaatgaattgtattctaatgtgataaatatgtgatacatatttatgctataaagttttattagccactctatcataattctttataaaattatatttatgtggacttaaattcaatttttaaaaacaatttcctgtgactacaaggctctaagtatttttaaaattctctagattgagtagtatttaaagtattaataataaatacacttagtaataaccaaataacctaaatatatgtaccttttgataaataattattaaacatactcagtggatagttattgaaaatgaatctattatgagatggatgggtatttgatggtaccttgagtaaagaaggatttcagtcgctaatattttgaattgtacttttatttggcataaatgtatcttgactacaatgcaccagtgggataggtcagagaggtgtgcttttattttgtaaagcggaagaaagtctgtcattaaccaaaaagtgggcaagaaaattggaatgaagtgcctaccacaggaacaaatccagtcaaatcttttttttgtttgtttgtttgagacggagtcttgctcagtcgcccaggctggagtgcagtggcgtgatctcagctcactgcaagctccgcctcctgggttcacgccattctcctgcgtcatcctcccgagcagctgggactacaggcgcccgccaccacgcccggctaattttgtgtatttttagtagaggcggggtttcaccatgttagccaggatggtctcgatctcctgacctcatgatctgcccgcctcggcctcccagagtgctgggattacaggcgtgagccacctcacccggccgcaacatgctgttttaatgagcgcctgggtgcgggcagcctcaggcctaaaatggcgttagccccaagtgaggactggacaaaggttttatagtctcctgtaaacaggaagtctcctggcctgacgtaactgctgcattgtacccggatggcctctttctcgatcttcagaggtacttgtcttctggccggctctcttcctgcttctgctatttcgccggtgcatgctgctcaggcaagtagccttgtgccttaggaatgggcctgagaaaggaggagttactcatctccttaagctttcaggcccgggagagaatcttacaacccactgatgagttatgaaatccatttaatgggtaaaataaaatagaataagatagcatagggtaccaaagaatataacgcaggttattacattgtgttacgtgtggtatgcttaagtgttgttttctggaactgttgttatcatttgtattgtacttcatttttgtttcgaattttaagataatctgcacagttttatagaaaatgagttaattagtactgtatcagtgatgtcatactgggttaattattacaaagttgggggtaaatttatccctgtataacagactttaaagataatataaataggccaggcgcaatggctcacacctgtactcccagcactttgggaggctgaggcaggtggatcacgaggtcaggagttccagaccagcctggccaaggtgatgaaaccccgtctccactaaaaatacaaaaattagctgggcatggtggtgagtgcctctaatcccagctactcgggaggctgaggcaggagaatcccttgaacctggaggcggaggttgcagtgagccgagattgcaccactgcactctagcctgggtgacagagcaagactccatctttaataataataataataattttgtttatttattgaatagatactttcttccagtacaaaattcaaaagcattgaaatcctctgttgcattgttgtctttcagccacacagtttctctccccatgtgctgccaaggttttcagtttcctgggtagccttccaagaataggatgtaggtgtgtgtgtgtgtgtgtgtgtgtgtgtgtatattattttctactcttgtcctcttaaaataaagccagctgttagaatactataaatactgtttctgcatccttcaaaagatggttcttttgaagcccttttccttggcttggcgagggcagaaggaaaagcactcttcttcctccttcataagaaaggaaagactaaaatgcctgtgtgtgtgtgtgtgtgtgtgtgtgtgtgtgtgtatagcactcttctccctcccttataagaaagggaagagtaaaatgctgtgtgtgtgtgtgtatatatatacacacacacacacacacacacacacacaggtgattattttctgtattagtagttaaagaactgtctctttttttttttttttacagttgcatactattctgttctaaggatataccataattcacttaagcagcactccaattagtgagcctttagtttgtttcgacttttggctaagataagaaaatgtataactttgtgcacatcattttacacgttgcaaatatatctatgtgataaattcctagccgtcgaatggctgcgtcaaactggcatttgtcttgttagtacattttgccaaattgctcttcatagaacatctcgtcagtattaggaaaggtttcttttccccatacccgtgcccactcagtgtgttatcaacctttttgatcttctaaacaagaaaaatggtgatatctgtcattttaatttgaattctttattcattttgtgagtgaatttgaattttttcatgtgttgcagaatcatttttatttccttttctatgcactgtttgctacttttttgttttttgccaatgttctcttttgggttattggtctctttcttactaaggcaaatatagtttacaacttgaagtaaaaacatggttttctatgataaaggttttaatgaatgttttctacaacagacagattctagtcttaaggttataacctgaaaacatcaaaactaacctttgaattgcataggaatggtctttgctcttcttagccatcaatcctggacagaagttcaacatgatgacaaattgtagcacaagtagagatttaaaaaatttttaactaatatgtaaatatttgctttcattttcttatttatctaacaatacattgatggctagaacagggtttgtctttgcaaagagcctgtgtcaactgactcccattctttcaaaatacattacctaaagaaggtttgtggcttctctttgcattgcattttctagccaaatctgaaataactatctggaagcttaacattttattcccacacttatttttccttgtgaaaatcaaaactgcactttcccagtcttcatgagtaaccacaatggtttgccatttgacttgccagttgtattagcatactgagatgtaatttatctgcatcaagagagttaattctgagcagctgggggctttctaatctctttacccatcttggacaccagttccctctcactgctatttgttttattctttgcagttagaataccattcctcttgacatacaagaaacaaacccaatagaaattaaaaggttccaatttctattttccattcaccaatattataccattttctcctaaagcagttctactctctcctagatcattctcttgcttttgaaataaaccttaaaaagtcattttgtcaccctaaatatgtttatactttcttgaaataatgcttttactgcatattagaattttagtttttacttagcagtccttcactactcctttagaaggaaatttagataatactttgaaggaagttatgagagaacgtcagaagccatgctatcagttttttttttttatgtactctaaagaaaactctgctctgcccatgggtgtcatctctttctgattctgtgtggaggagaaaaatgggaacacttccaatcattttcaaacaatttctgcttaagtggatgaatggaccacctggtttactaactataatgcccaggggatggctttgattggcagacagaacgcggtgcagaaacaatggaagttaaatgaggaaggttttaaacttgcaagttacctcccttggtggcattgactgttggtagaaaataacacgttgggatttcagatacattcagacatgctctgcacttgcaatttgcaatacttaaaacaacacaattcttctaatcataactttttaaaaaatttggccacctttctccattgtctcataaagctatattcatgaagctgtttattcacaaagtcgtatcatttaaagataagtgttatatccataagtatgtaaatgaattaaaatctgggaggctaacacttatccattccttattctactatatcctatctagagccatgcttcttaaaatttaatgtgaaactgttatttctggtctgtggaaccacagtttgaaaagcactgtcatagattcttaagtagatacattttcatgcatacaataaatatgcaggagaagttaaatgggtatgtccgggagtcaaatattgattctcagaatgaaaacttcttcatttatttctcagtgatcttcataaccctttcccatactgggcagtgagaaaaaattatcatctcactctgaaatagtgatttcaccagtctctttttatgggttgggacctcatggataatgaccagtcttttagatttccttgctctcctcctgctcctctccaaaatggcagctgggttgacagatgaggaagcattatacatgacctgagatctctatgcaggtacttgcagtctcctctgaccctctgctctctggaacagtgcctcttgtctgcctgataagtctctaccctgctgaccttgtggctctgagcttgtattttcatcaggaaatacggttctctgctgactatatcagttactaaagggattcttaaatctctgagttactgctgaagaacacttagaattctaaatttgtaattatgatacctctaaaaacaagcgtgattatccattatgtataaggatgccttccaaaaagttggagcaacttgaagccacttgttacattgtcatttagtggaggagggagtgaacttggtgtttacaggtagaactctctatcaggtgctgtgaggaaaaacaaaagcaagataaactgtggccataatctttgttactttatttcccaatggggagaaaaagacaaatatatatatttgtcaaaactgaacagatgttatttgaacattatactgtatatgccattataactataatgtatataatacatatatataaattattgaacactaaaaagaacactttaagaattatctattttattttttttattatactttaagttttagcattaggagaagtatctattttaaataaagctatttcactcttcagtttccatctcaagaactcataccaatttaaacttccactcatatttgagagttgagaaaaattaccaaatgataataatatattatctaaaaaataatttaaagatgcatgtctctaacaaaactatgtaacattctgaagggttttaagtaatacttcatatatcctaattcagaataaacttagatgttatcagtatgaaaatatatcataaagtaacatgattctctccaatgaagatgtaatcatccaaactttatgcgttgaatttacggcttagaaatgccatagcaatatgtcctcttgaatatacaattctatatactgagatttcacttagtatattaagttctgtatcactgaagagtatattatgattctaattaacaaatacaattctattttatataagtacccctatcatctactaggcaaagttagctgatgttactatgcatttttttgtcagctgtactcaacttataataactttgtattccaaatacttcaaaattgccatatgcttactgttttcctattcacatcattttcccccctattcttcctgaccctcctttgagcaatagtgtcagtgggattagactcatgcattcacatactgaatgaatgaatcagtatgtgattcatgatatagaaaatttaaattccttatatatttcatatatcatatatatgatatatgtatctgtgcatataggggatattaaacacttctctgtatatatctgacatatattttgaaaaggaaacaccgtagggccaagttaactgcttcaattattacttagtgtaaatgcattcagtttgttctgtaatttcaaaatgatacatataaaaaagtagagtttgcatgtttaatacatctgaagctacagtttccaaattctgaacactttggtgacccccttgacacaatgaatatttggcagttaccgaacataacagggcacaaataatatagttaatgaaaacatccataattatttaaattaggctattttaagaaaagttttaatttgaacattaaacagcttaaaatcatttataataattgattatgtaacatgctggtcattaaaatgagattggtattctctttttttttttttttttttttttttttttccgaggtggagtcttgctccatcacccaggctggagtgcagtgctgcgatctcagctcactgcagcctccgcctcctgggttcaagggattctcctgcctcagactgccaagtagctaggattactggtgcccaccaccacacccggctaatttttgtatttttagtagagacagggtttcaccatgttgaccaggctggtctcaaactcctgacctcaagtgatccgtcagcctcagcatccgaaagtgctgggattacaggcgtgagccaccatgcctggccaagattggtattcttgacattaataattttggtaagcattaagaaggcaaaacatggaagcactcacaataatgtataggatccaagtaaaattctccttactgaaacatgaaactacaaagccatgtgcgcatacttttaatttttaagatttgtttgaaggaacttttgtgaatgacaagtagagaaagtgtggatagatagcatctctgtctttaaaattatttgatgaaataggtgataagaaacacaaaaattaataattcatgtgacctttattacaatacgtcttctggtattagcatagtaataagtattagtgatttacataattggagagataacacaaatacaaattatgcacacacacatacatacatacacgttcctgtgcttcactcaaaactgaacagatgttatttggacattgtactgtgtatgccattgtaactaaagtccaatttgttagagatagtattgttattttattatctttagtatcttcaatgagtccattatgaatagtagcattaactttgcttatgactagcttaaatagaactttggactccataaaaatacgaacaaagatttttaatggctttagaatacagaagtaatctggtaaaagtattcttgattttaatagaaaccaaacaatcaatgtgcccgttagattaacagtgaataatcagattgttccagctcttcactaatgaacaatgctgaaacaacattctctgtaggtctcctcagatagacatatgagaacacctagaagtggaattgttacctcattagagtattcacatttttaattttatcatatattgcaaattgcttttccaccagcagcaagaagtggcaggaatttattattttaatttgcatatccctggttgaacaagttttcaagtttgttggacagatttttccttctgtgagttgactcttcatatatttaccccaattttccgttggattgtttactttctcttaccgattaatatgagttgtctgtatattctagattctagtagagttctggattatatgcacctaatatataagtctacaattccttatccaaaatcttatcgttgacttttcaggagactagtgaaaatggctacttagtggaacatatggaaatcatgagttataagtgtataaaggctaagtgcaacagtctaaagacctggtatcacagatgaagactgacatattgagtaaaccaggaattggctttattacataatgtgtcctttttcttgatttcagaaacccatatatttgctgtttcctgtacatgtttaggaagagtattcagaagagagaatgcagatatattgttgctgtttttttttaaaaaaatacgagtttaattcaattacccatttgattgcttgagtttattagttatggtagcacttagaaagagttgttttagataatgactatgattttggtacagaacctaatagtaaaaacaaaacatctttaattttatttaaagtgcatgtcagtcatgaagtcagaattgaattgctcttttctttgcttttaatgaaaattagcctaatggctgttttatctttaaaaagcaacttctagtgtttaataataacagatttaagtaaatattctgttaagacttaaagaaccatgtccaattactatatggataataacttagagatgctctatattggtttaaaataatgcaaatatcactggccactattcagagatatgtcaaaatcacttttgtttaatatgtgcctttctagtccttagatctactgtattccctaatccttttggggtatataatccagagatattaggacccattcagccagaaactgaaacatgccatgatggttagaattcatcagaaccacactcaaatgaatgttaagagacatagcgtgataaaagtgcatctgaaagagtatatgaacagatgacattacatacaatgttgtatataagagaaaggaaggaaagacattcatatcatgtcatattaattcatgtacactgaaaatacagaccgtgaacagacattctttcatttgttccttcatgtattcaataatagaatgcttctctaccacagatgattccaggggaatttggcaattgctggagatatttgtggttgtcacacatgggggaggagaaagtgctactggcatcttgtgcatagtgaccaggcatgctgcaaaacaccctgcagtacacagggtagctcccgacaagaaataattatccagtcccaaatggcaatagggctgaagctgagaaaccctgattgaaactcacattacatcctaatcgaaactactttgttccgttctgagccgtaggattcatcaaataaaacctactttttattggtacaatatttaaatccagagaccctgtagcatagtaattatgtatgcaggatttgcctcagaaagactagggttcaaatctcagattcaccatatgttaggttgtgccctaggcaagtttctgacctttcgtgactctagttttttaatctgaaaaaatggtaatagtattgctgagaggctctgcaatggagattgagattaattaagatgatttatgttaagtgcatagcagagtgtttgcacttagtcagtttccaacaaatggtagcagtattacctttacatgtactaaatcatttcatcctgacctactatgaaaagcctgatcactttccatattttactgtttttaagataccattgattagagtatgcattgttattttatttttcaccaagaaaaatgtgctgccgttttagactatgacacgctatcatttataaaacgtgtcccaatttcagagcagctaacctgttgaaataaaatgtgagtcttataattgattattgtaaaacacaacagtaagtcttctttgattaggtgcaactgaacaatactatgaccacattcagtagcaaaggcacttagaaggatataggaatatagcttagcaggaaggtagcatcgggtatctctctttagtaggatgagtatgcgtagcaatctctgaagcacccagggagccatccaagagctattcactttgcagcacctgtccactctctcatgacatctcaggtgcacaggaaggaaacaaatcgagatgctgggtcaaccctggcctagaagccttatgcatcccagaggccaatgccttgtaacatagtttccaaggtcctcaaaaaggacatgcttagttacaagaattgttgtacttggggacgccccacaattatggttttccattaggtatttatagttcatatgtagaacacctaaccaaggtgtaatttaccagtccccatcatttttttttttaatctgaagcaatgttgcctgctcacacatttgacattccaactttatcagttttctagggagaagggagctagaaagttgatcaaagtacaaattctcatacagatggacaaagggtgtttttaaccctttactcacagtaatatctgttagtttcatttattttatatttaaagatactgaaacctgaaacttagagcagttaaatgacttgccccaactcatgggctaataagcctagaacccagatgttcttatttctagactgattatttccaacaacactgtaatatcctaaagcaagagtcagcaaactatggtccaagggccacatttagtcctccacctattttcagaaataaagagttattggaacacagccacatttatttgttcatgtattagacctgactactttcatgccacattggcagaatttgagtttggcccacaaagtctaaaatatttactatatggtgttttatagaaaatgtttgctaacctctgctctaaagtataattacaaattggccaggtgcagtggctcacacctgtaatcccagcactttgagaggccgaaatgggtggatcacttgaggccaggagttcgagacgagcctggccaacatggcaaaaccccgtctgtactaaaaacacaaaaattagccaggcttggtggtgcatgcctgtaatctcagctactctggaggctgaggcacaagaaccgcttgagctggggaggcagaggttgcagtgagccgagatcatgccactgcactccagcctgggcgacagagcgagactgtgtcaaaatagtaaataaataaacaaataaattctaattataaattgtttaactctttctatgagtctatataaggagtttatagaaaagcatttgtttctaatgtttgattattaaaaatacccctgtattttttattttattttaattgacaaataataagtacatatatttatgaggtacaatgtgatgttttgatatatgtttacattgtggaataattatgcatacttgaaggattttagagccacagagcctgaacctaaccgtttctctacatcagtgttggccaacttttttctttaaaaggccaaatagaaaaatttcagtcagtttttgaggcttcatgggccatttggtctctgttggaaatagtcaattcatgctaggattggaacctagataaccagactcaagagcccatactcttcaccagtaaggacttaggaaggcagcaagacctgggagtaccagtttaaatgaatgttcttctaagcagtgtcctgtgctgctattaaaccagaccagagctttggcccttagttaagaactgtatgtataaagttttccaaaataatggcttcaggttttcacaaagtccttccatccaaacaatgcagattgtacccccttaagaatctgttcttaactgccatctgttctctgcattcttaaagtctaatcttaatacagcagccagaatgatctgtttaaaaataagtcagatcacatcactcctctgctgaaaactctcctatgcttcctaatctcactcaggataacagccaagatccttccaaagatgcaggacctatcctcctccatccccaactctatgactatcattcctactactctccccttgctcactagattccactcaccctggtgtccttttttttttaattgaacatacacatacactcctgccccagggcctttgcacttgctgtctctgcacagattgttctttcctgagatagctacttgaatcgttccctcacttccttcagatctttatttaaataccacctactcagtgaggctttccctgcaggcactttctaaactctccacatgccacctccctttgccccatacctaagtctcttattcctatccagtgctttacattttgttctttagcacttttcactctccaaagcaccttaatttctcttttactacacattatcaccattagaatgtaagttttatgaggacacaaaaagtttgtctgttttattcgctgttacatatctagtacctcaaacaatgtttagcagacaataagtaatctgtcaatatttatggaatgactcaagtgattttttggaagagttttggtaatatttcatttgccaaaagaattctgccaaaaagactttgaaacccccactttaaggtggagagcttccatagaggcttctggatgttacttgatggtcacacctatgcccactctttcactggccttgaacatttcaagtatgcagcttagtagattatatcttcacagtttcacaacactttccagtttaaaaatcaatgctgcattatgctttgtatatttggacagattatttttgaaatccataaatctctaagttttttttttttaagtctccctttggtgagctgcccttgattagttcaaaatgggaagagagaacctgtcattctttgtcaatcaggttggcacgtacttgacagcatgcagttatagtgaaagagagctgtgttgcagtggtctagcaaacctaattgtagttaagtaaaagaacagtcacccaacatgagaggaaagacaaagaaactcaactgaacaatgttgtgtttttccatccatcagccttcatttgtcagagtctgactgacaatctggactgcagaaatcaggctctaacacaatattgattccatttcatattttgtttcttgctacactttttagcaaacagtttctgtatggaatgagagatagtgcagtcaatatatgcgaccagggcacatttatattaaaggcttactttggtttttttgtcccagaaatcacatattgtttgtttgttttactataatattgtaattgtcagctcttgctgcagtaacaaacaatgacaaaattccagtgacatataacaacaaacatttattactcactcatgtgtctgcagatcagctgcagctttactccacactatgaatcaagttaaggtcttttcattctagaatatggatctgctctaaatgtcttctcatcccaggaccctagcggaaagagcagcttttatatggcatattattctctcatgatggaagataagaacaaggggaaccagcaaatcttgaactgcctttaaagttccagctaagagctgccacacagtcccttctgtctgtccatggtctattggtcaaaggtacacagtcaagcccaaagtcaatgggaagggaagtatattcactgcagggcagccatattaagagaggaaatgaataataatgaactgacaaatcaaccatagtatccacaaatgtcttaggatttcattgattcccaaatgcattttttagtatttcaacacctctgaacttgagatatatcgtacaatagataatgtttacaaagtgtaggtttttttgttttttggctttcttagtttacataacaatagtggcccttatcatcaatgatagattagatagaaaaactgttaattgtggggttgacaaaatagccaaatggtagaaggcactccttataagtaagtaagttatgagtgggagctaagtgatgagaacacatggacacatacaggggaacaacacacaatggggcctatcagagggtggaggttgggcggagggagagaaccagaaaaaataactaatgggtactaggcttaatatctgggtgacaacataatctgtacaacaggccctcatgacacaagtttacctatgtaacaaacttgcacgtgtacttaaaataaaagttaaaaaaaattaagtgaatggacacttaatgtttacaaaaaagttgtcatttttatcttgaatttcttttttctgtagcaatatttatatctcattcagatcagcttatttgattagaaaaccaagcattaatagtagatcttatgtctatttattcacatattcatataccttcatttataaatatatattcatatatatttagaagatcaattggaaaacataagtgccattcccttatttaaaactcttgtagcttctccactacagttctgagggtggtatacaagatccttcttttctctggcttttgctttctatttctactccattacttcccattcccctacgtgatagctccgtacttcttctgcttcctgtctttgcatgttccatgttccctcttggaatacattctctctgccgtccatccccttataatgaggtgcatgagctgtttctgctcccagcctttctgtcctgaccttcttgtctatcaaacacaaaagtgatcagttcctgctctgtgctccattatacattgcactttactagttgttatacctgacctgctctaaatgtagtatatatttgtgtgtctgcactccccattcctaccccagtgaaacatagtaagcactgaataaatgtttgtcgaatgagcaaataaataaataaataaataaataaatgtttgaacatacatggaaaggttgtttatgtcctccttataatgtgctttgagatatatattcttaatatatatataatcatatattctaaggttattagtaggtaaaatgaaaatttaaagaaattgagtacaagaaaggaaaacaaggaagaattttttcctttttgtactatttctaagaacaccaaatttctagttaaacacacgcacacacaatcggcatgatgtagaattagaaatatgttgaataaatcaattattagaaaatgtaaatatatattaatttgcctctgacttgctacttttaccctcaagggttttttttttctacctcttttcatcactaatctttgcttcactgcttgtcagatcagcaactgcccattattagtaatgccatttaataagagataaataaaagtaaaggtgcttagagttactccatttcaaaaacctatcagggctggatttcagaagagaccatgaaattctcctactgttattgaaccattactccctattacctaattaatacaagttattttcttaaaattatacctgacattgtagtgaactatcaatactatgaagaaaatcaaactctcctcgtatcataaggatcttaacacctggtacacaatcttgcattggaggggacattaagaataaggcatggaggaaaaaaaaaccttaatggaaatgttctgttattagaaatgagactttttggtggaaatcccatgacgactttcttgtctgaatgttctttgaagttgaacactttctccttacacaagccggccactataattagctatgtttccattttagtggtggccttcttcaccttatctgaaatcatataaagatgtgaggccatttgcgagataaaaggtttgctcaaaccagttctctgacctggatatcagaggtttggcaatcataaacccactaagagaaaccctcagagctattacaaggctatgtaaaactttatttcattttttgtgagaagggacaggattttctctcatttatattctggaagaatattgtagaatgtatttgagttcaagaggaggagaaataattaacataatattaagaaacgtcaattttggaaagaaataataagcatatatgcacatgtgcgtgtatgcacacacacacacagtatacacaacagattcagaaagaaggaaatagagatttggtgacacatacttcctggatataatctcaactctgccatttgcaagccacatggtcttggataattgacctaatctctctcaattgcagcatctgtgaaattagataaaactttctttgtaggagtgtatgtgtgtatgaaaagcacagtgtttgacatataataaatgttttagcaactgtagcttgttaatattatcacagcagttaatatcactatagcagttagttgccattttcagcacagctaataattttagtagcattttctgatctttccatctcatgtggtttctttggagttgtttcttgctttgttttttagcttttctatgtcacattttatttgcatggagaaataacaaattttacaatttatttcacatattctttaatttttaggataattgtcagtttcttacagtttattttccttatactcactgaagaaaatatgtacgaaagaatattttcagtgaagttaattggatttactacagttgacccttcaagcaatagtatcttgcccttaataactgacctatctttgaactaataaattcaacctgcaaataaatgtagtgaggtaaattgtagaaatttatcttcaaaatggtctttctaaagtgatctatcaaaggtgcatttaattagaggtccagttctccaaaaatgtgccaaggaaaagtagccacaaagaatttagagctgaaatgaattctttcacccattgctctgtttctatagaactgagaataaatctcatatgggtacttaaaatctgtactatgtcattgaaggatgaaaagatgacaatagtgatgatagaaggacacggtaataggaaacatttcaatagagggaaatgatgtgagtatgcaatgttcattcaccagaggactaaatctagggctattttggtgacttgaacagggaatattctacttcctgcaagtgaaaaatatggacatttcatttggcatgccacctgctcttcagtccatcatgtagcaagcacccacttagtactttggagctctaagtaatacttggactactcaaatgccagccttgttgccatttctgtttattcgccaataacaattttattaattaaaatttgtatgtggatgtcttaaggaaattccttgtagttgtcaaagcagactcctgatcctatctatctgccagtgccttctgagtagtggtatctattcttcatgatttttggaactatttatgggtgattgaagaatatggagtggatagagaaggatgctagtcatttggctgcacacaagaaacacagatgaaatttttgactatttctgttcattttctaaaggtacagaattttcactggattgtacttgtaagcaattttaaaggaagaaatatccagccttttgaatttgttacagtgttgcaagacttttttaaaatgttaagaatttttatcatataggatgaattaatactctcataattttaggtttgtttcttccataattaataactatccttaaagattgtgtgtgtgtgtgtgtgtgtgtgtgtgtgtgtgtgtatttcttgattttccagagcaaacgttcccattcatttgttttactcaccttgttatagttgctcccattgtaagatatatctagtaagtttactgttgttacctaaatctgtttgctgaattttaaaaatgggaacatgtagtaaatttgggggaccacgagctagtatttacaaagtaaaccgagaacattggatataaaaccttatttcatttaacctccaatgaaggatatattcagtattattatttgtattatttcttgagcttccttgcttatctgtaatatgtaacatggtggcaccccttttcatataattctctcctcacttctattttgggtttttacatgttcttgtttcagtctcttctgctctttctatcttttcttggttcaactttcttctcttatcctgtggaggcgaatacctaattctggctctatcctcttcagtcactctacaagtatcactgggacaatattgtccaactactatttttacctccaaacctgtattcttagccttacccctaatctgcacactacgcttctttttgcaattactttctgtacatttgcatcagtgttaatcacaggcatcttgactcatgtctccaacctgaaaacattattccttccatatagggacaggctcctctgtcttccctgtacccctagacagtttctcccaagttataaaatcttggtgattctgaaaattttctttttccccatcaagtcctgccagtcctttatccacaacataggaataatacttcctgaacatccgtgctgctcctgtttgttcaataagtactcggacctctaaaggcatttcctatgtttcttccaccagccccttatccttaaaatcttgcctccaatctgccgctagagttatcatcttaaaagagtcaaatcagggttggtatccaagaaatattacaaagtactaagctcttggtatatacaatcaacttgagagaaagagagggacgggaggagagggagagagagagagagagagagagagagagagagagagagagagagagagactttattctgtcctctataacacctgaatgattctgtacatatttatgttaacagagcattgtactacttcaaatccttatacaagcaaaactcctcaccgccttttggcaatggaacttgcttttccctctgcctgaaatagtcttcagtatgttgacatgactcatttcttcacttcattccatttcctgaagagaggagcagtcttctgtgctcacattgcctaaaatagagcccactgtcactctctacttactctttttaatctttcttcatagcatacatatacatatatatacacacatatacatatatatacacacatatacatatatatatatatatgtatacacatatacaggcatacctctgagacactgaaggttcagttccagaccaccataataaagtgagtcacatgaactttttggtttcctggtacatatagaagtcaggtgtacactacactgtaatctattaagtatacaatagtgtatgcctaaaaactaatgtacatgccttaatttaaaaatatgttattgcagtgttcaagctgagagccaaatcaagaatgcaaactatttacaataaccacaaaaaataaaatatctaggaatacatctaaccaaagaagtgaaagatctctacagggctaactacaaaacactgctgaaagaaaccatagataacacaaacaaatggagaaacattccatgttaatggaaaggaagaatcaatatcattaaaatggacatactgcttaaagcaatctacagattcaatgctattcctatcaaactagcaatgtcatttttcacagaattataaaaaactatcctaaaattcatatgaatctaaaaaacagtctgaagagtaaaaacaatgctaagtgaaaagaataaagcatgatattaaccaacttcaaactatactataaggctacagttacccaaagagaatgggacttctacaaaaacagaaacttggaccagtagaacagaatagagaactcagaaataaagccgcatacctacagccatctgatctttaacaaagtaaacaaaaaaaaaaaaaatggggaaaggactccctactcaataaacggtgctgggatagctggctaaccgtatccagaggaatgaaactggactcctacctttcactatatacaaaaattaactcaagatggattaaagatttaaaaaaataaaatctcagccaggtgcggtggctcacgcctgtaatcccagcactttgggaggctgaagcaggtggatcacgaggtcaggagattgacaccatcctggccaacatggtgaaaccccgtctctactaaaaatacaaaaaaattagctgggcatgctggcgcatccctgtaatcccagctacttgggaggctgaggcaggagaaccgcttgagccagggagtcggaggttgcagtgagcccagattgcactgcgccactgcacttcagcctgacaacagagcgagactccgtccctaaataaatacaatacaatacaataaaatctcaaactagaagaatcgcagaagaaaacctaggaaatactattctggacatcagccttcagaaagaattcatgactaagtccttaaaagcaaatgtaacaaaaccaaaaattaacaagtgggatctaattaaactaaagagcttctacacagcaaaagaaactatcaacagagtaaacagacaacccacaagatgagagaaaatatacacaaactatccatcagacaaagatctaatatccataatctatagggaacttaacaagcaaaacgcagataaccccatgtaaaaagtgggcaaaagacatgaatatatagatacttctcaaaagaagacaaacgggtggctaacagatatgaaaaaatgctccacatcactcatcattagagaaatgcaaatcaaaaccacaatgagataccatctcacaccagtcagaatgcctattatcaaaaactcaaaacacaatagatgttggtgaggctgcagagaaaagggaacattatacgctgttggtgggagtgtacattagttcacccactgtggaaagcagtttggggatttctcaacttaaaatgcactgtcattcaacccagcaatcccattactgagtatatatccaaaagtaaataaatcattctaccaaaaagacacatgcacttgtatgttcactgcagcactattcacaatagaaaagccaaggaatcaacctagatgaccatcaatggtggactggatgaagaaaatgtggtacacatacaatatgaaatactacacaaccattaaaaagaatgaaattatgtcctttgtagcaacatgcatgcaactggaggccattatcgtaaatgaattagtaggaacagaaaaccaaataccactttgttctcacttataagtgggcctaaacattgggcactcatggacataaagatggcaacagtacatactggaaactagtaggggaagagataaggaaggggcaagagttgaaaaactaactattagatacggtgcgcactatctcagtgacaggatccatcatactccaaacctcagtatcacccaataaatatataaatgtaacaaacctgcacatgtaccccttaaatctaaaacaatagttgaaattatttaaaaaaatactttgttgctaaagcttgctagcagtcatctgagccttcaatgagtcttaatctttttgctgatggagggtcttgccttgacggagatagctgctgaccgatcagagtagtaactgttgaaaggttggagtgactatgccaatttcttagaataaaacaaccatgaggtttgctatgttggttgatttttttcacaaaagatttttatgtagtgtgtgatgttatttgataacattttacccacagtagatctttcaaaaatgaggtcaaggctctcataccctgctgctgctttaccaactaagtttacagaatattctaaaccctttgttgtcatttcaacattgtttacagcgtcttcaccaggagtagattctgtctcatgaaaacactttgttttgctcatctataagtagcaactcttcatccattgaagtttcattatgagatgacggccattcagttacaccttcaggctccactttattctagttctcttgcaattttctccacatccagtgacttcccctactaaagtcttggaccctcataggcattcatgagggttggaataaacttcttccaaacaccttgtaatgttgatatttacctctttctatgaatcacaaattttcttaatggcatctggaatggtgagtcctttccagaagattttcagtttacccagatccatcagaggaatcgctacctagggcagctatagccttacaaaatgtactttttaaagaataagacttgagagctgaaatgactcctttgtccaaggactgcagaatggatgttgtgttagcaggcataaaaacaaaatctcttggtacatcttcatcagacctcttggctgaccaggtgcattatcaacaagcagtaatatattgaaagagattttttcttctgtgcaataggtatggccagtgggcctaaaatattcagtaagtaaaccatgctgtaaagagatgtgctatcatccaggctttgttgttccctttatagagcataggcagagtctattagcataatcttaagggccctaggatttttggaatagtaaatgagcattgtcttcaattgaaagtcatcaattgcattagcccctcaaaagagagtcagcctgtcctttgaactttcgaagccaggcattgacttctctctagctatgaaagtcctagatggcatctttttccaatagaagactgcttcatctacactgaaaatctgttgtttagtgtagctaccttcatcatcttagatattagcttgatcttctggatagtttgctgcagcttctccatcagcacttgttgctccacctttcacttttatgttacggagagggcttcgtcctaaagcctcatgaacaaacctctgctggcttccaacttttcttctacaatttcctcacctctctcagcattcatacaactgaacagaattgggccttgctctggattaggctttggcttaggagaatgttgtggctgttttgatcttctgtccagaccactaagacattctccatattaacaataaggctgttctgctttgttatcatttgcatgttcactagactggcacttttaattttcttcaagaatttttcctttgcattcacaacttagctaacgggcacaagaggcctagcttccagcctctcttggctttcgacatgccttcctaaccaagcttaatcatttctagcttttgatttaaagtgagagacatgcaactcttgttttcccttgaacatttagaggccatagtacggttattaactggcataatttcaatattgttgtgtctcagaatagggaggcccaaggagaggaagagaggtagggggatgactggtcagtggagcgttcagaatacatacattaatggattaagtttgccatcctatatgggcactgtttgtggcaccctgaaactattaaaatagtaacatcaaagattactgattacccatcaccataacagttataaaaatattgaaaaagcttgaaatattgtgagaattatcaaattgtgacacagagacatgaagtaagcacatggtgttggaaatgttgctgatagacttgcttgatgcagggttgctacaaaccttcagtttgtaaaaaaaaaaaaaaaaaaaaagcagtatctgcagagccaataaggcaaaactcagtaaaatgaggtatacctgtacatatacatacatgtgtctatatatccactcacacatatgtgtatgtgtattatatgtgcatattatacatatatgttgatatgtgtatttatcatatctaatacacatatatgtatatacatgtatatcacacacatatattcatattgtaaattgaaaattttctagtgctgtatcccaatctctagcttataaatatattgaatagatgatgcagcaggtatcttttgaatacgcactccaattttagaaatataaatcttttttaaaggttggaataatataagtagtttggtgttcagtgcaaaaggttttaatgtataaatactatgaaaacaaaagttagatcaaatgtatcaaatacaaatgatctgtattgggggacagagggacacattaaatttaagggaatatgaggagaatattgacttcctatgctcgatgagtgaaaaagaaaagtgaagtgggagtgtttgaaaggaaagatgagcttttccatgctagtacatcacaggttttaatactcatagaagtttttagatttgtataggaaatatgatcctccagcctttccaagtttactcttctactggaattacaaatcaaaactaataaatgtttactatgcttcaagtgcaatagttataaagtacctgattagaggtcccacattcagatgttggttatataaaatattcatgctaaatcatataaatgctaaaacatttgtatttgtgatgttctcttggattgctagatggagattaaattatacaaattcagctaagaagaaaaatgtgggataaatggaattttagtttaaaggaagtcaatgaaaggattaattaagtataaaataatcccattttaatttgtcatagaaatgagttttctgagacattgttgtaatcaataacgtgaagatgtaaaattttgcaaaaaaaatcattacgggaaatccaaaagcagaagagtagactctgtatttaactctagcagattatttagaaagaaaatagtctatgccatgaacctttcgactgtctgcgtgaacaaatgtctctagtaatacacactcttaactcaattcccataggctcaaagttgcaacagtatttatttgcccgttcaacggttttttgtttagcacttactatgtgttaggcacttccagggatatgagtgaacaaggtagttatgggtcttactctcatagaggataattctttaggaatggtcaaaactatacatatacacataatgtgattaattgtgatgtgttttgaaggaggaagcaaaggagttggaacagtttaaataagactgtaggttggcagtgggaacaatggtctttgctatcatttttcaaaaattccaatgaatgggaatgacgactgttgcattaagttgcctgtctccctctgacccatagtgattctctattatcagagaggtagggcatgtttttcagcatatgtgataatatcaaacagattcagatggtgaaagtaaaatttcttaatgcttagaaataacataatttgatcaaatcatttggatatgttattaagttgttgtaagatatgaagacgtagctgttactactgccaatagtataaactttggattcagacctagctgtgtttgaatattaactctcccacatcccacgaggttgtgggcaagctattcacatcattgtcactaccgtcactactatcccacccacccttgcttcattttcttatctgtaaagtggcaatctgttggaatcagggttggggaaggcaaatagtagtcattatacgaatggtaactatgctatcatcaataatatagtctacagctatgatgaagctaatcagaaaacattgtctattaccagtaattagctatatcaataactatcacaagaaaagtcccagctgtcagtgaataaatagaaaatagtgctttgtcttagagaaacacatacaaaatgaatggtggtgacagtgctttaagttaacttgtcagtttatatgtgtaatgcatatataatttcaaatgtataatttagacattgtacatgtatatttggcctggtaatttatggtatacataaatgataaatgtataggttgaaaattcagttactttttttccttttcttaaatcatttttaccttgctgaagatatgctcttttctctacttccttagaataatatattttattttctcttaaagtattttgagaccatatcaccatttactacaccaaaatgtttttttgcaaatgcggtattcaagggtgaatttatagtggctggggacctatttggaattcagtaagtaaaactagattttccttattcctcatctgagatcagagctatttctacctctagcaaagacatacagtcattccgggtgctgcattttcagggaacaatgtgttttcttggcaaggggcagtaagaccatcaattaatagttcttcatgtaaagtagctaaactactgttataaaggaagtgaaatttgcatacataaccattaacacatgaggttagttatgtacaattttgaccaaagtgcctgtttgctgctggtatttattataataagaactggaaaaaaatagtctatctcaagagcatgtgctgagcacccgtaaattgcaagagactgtactgggcagtatgagattatagtaatttgggatttcctactaatgaactgagagggaacaggtacaaacacagtatacgaaggaaacagtggcacggagacacttaaacacagcagtgctgggaggctccggggtaggggagggaggaagagagatacgggttaatcaggagctgctctctggggaagattgcccaggccctgactgatgcctgacattgattaattgatactctatcctagtgtttaacaagtgttccatccaaaaagtcttctgtaatatttaacttcacttccttcagcttcaatttctgcacaattcttttgtcgtctcatcaagagagctagtcagcagacagtaacaaaatgcttatattcatatacctgaaggatttttttttgtcatgcttcagccttctccagactgaagaaaagcaaataataaacaaaattaatcgttcttcagaaggcctgtttgactcattaataaataataagctttgatactgtgctttaagtgtttaccctttggaaagaaaataattttgacagtgatgtagaaataattatttgatatttatttcaaaacaaaatttatatccaatactaaacacagaattttgtaaaacaataagtgtataaagtaaaatgaacattaggattattgagattattgtagctaaaactagtgtttattcatataaattatgttaataaattgtattgtcattattgcattttacttttttgaaaagtagttaatgcctgtgtttctatatgagtattatataattcaagaagatattggatgaattttttttaagtttaatgtgtttcacatctctgtttcttttctctgcaccaaaagctacatttttgtgcccttatgtaccaggcagaaattgatctgcaatacatgtggagtctccaagggtatatttaaatttagtaattttattgctaactgtgaagttaatctgcactatatgggttcttttccccaggaaactgaaatagcagttcaagctaaacaaccggatgtggaagagattttgtctaaagggcagcatttgtacaaggaaaaaccagccactcagccagtgaaggtaatgaagcaacctctagcaatatccattacctcataatgggttatgcttcccctgttgtacatttgccattgacgtggactatttataatcagtgaaataacttgtaaggaaatactggccatactgtaatagcagaggcaaagctgtctttttgatcagcatatcctatttatatattgtgatcttaaggctattaacgagtcattgctttaaaggactcatttctgtcctggtgtgctgccatcaatacaaaagtagtcccaccttcaaggtagattaaattctttggggctttattgctttgcttgccagccttgatgcttttcatattgtttggtttaattcaaatcaagctactgcatcatagtgtctgtctccaacagctgtaaagaatcacaatatggtccgtgacctttcttttctttgttgctctttcttataaaagagtaaaatcggcattgaggcttcagtattttattgggtcaagaatttttagtgaaatgtcatgtaattgcttatttctttggcaaaaagctggcctgggataaacctttctacttttttttcttctccatatccatgttgaagtctaggtcacatttattcacaggctattacataaggagggagatggaaagccaggtcagttttcaaaaaatagctaatcaatggcttccatttgcaaatgagagtccagtgctaaatatacgttagcagtaggttacctgattctctgtacctgaccagaattataatggctcccattatgatgaaggttcctgagatcctgtaatcatggctgtttattgatcagtcttggtttctcagttaatgttgcaggcttggatacaatgaacctcgtcctcatgtttaaaactgcttgaaaacagttcaggtcaataacctcattatacagaaccagtttgtccttgcaaacaacattaccatgacttagattctgtctctaaggtcgctgcttagtttcccttgcgcttggcccaagcttcatttctagaagattgtttgttttccttacagcttacaagagacttttccttaggtagagttgaagtttgcacctgagcttaatgtccaaacaccagacactgaaaatcacaggtttctctgtagatatcaacatacttttattcagaaatatattgcaaccactccaaaaatctagaaaagtagtttgtatccagttcaagcccagtataatcatttttcataagctaacaatgtgctcagtatttagttggaagagctaggcaaagtcctgaaagcagcaaatttcagagtttccgttgatgttctgaagaaagccagccctcagagcagttaatatggtgactttcattgtagcaagccatgcagtgcacaaatggacaattgcatacgtttctatctactctttgttgatcctcaaagactttatgccttatggtgtatgactatgaattaaggtttgtcactaattgttagagatcacaaaggtacatgtaatttggcttttacttttgtgcctttgtaaaagagagagagagagatcttaattaaaagccactgagaaaatttttgctttcattatgtataaaacaatccaaatgcttgatgctaacttatcgcacctccacccacacactcaactactgggccacttggagatcagaactgggatctgccatgcctgagcatatctgcttcctgctgatgcattagtgatgtaaaaggagaattacttttctgaaataaaaagaaagaaccaggagctgttgctttccttctctttcacaacccttaaaaccatttttgtagcagacagcactgtttttttccttcctttttttttttctccttccctgtttccctattttctctcaatttgacacattgggagaagctgaacttaagggaaaatttattcctgtcttcccatttctcccttggatttggagaaaaatcaacatatcaagttggctgggcatggtggctcatgcctataatcccagcactttgcgaggccgaggcaggcggatcacctgaggtcaggagttcgagacctgcctggccaacatggtgaaaccctgtctctactaaaaatatgaaaatgagccagctgtggtggcaggcgcctgtaatcccagctacttgggaggctgaggcaggagaatcacttgaacccgagaggcagaagttgcagtgagccgagatcgcgctgttgcactccagcctgggcgacacgagcgaaactccgtctcaaaatatatatatatcaagttgataggggcaaaaatgcaagaatgatttgagaattatggggtttaaaaaaatagttgactcacgcacaacttttgctgtggaccatgaccttggaaacatctgaagattagctggggtttgcggtagcctgaaacacctagaggctcaaaaaatgacctcacagttttgaacatgacacccagcaatacaaggcagaaagctgtgagggctgtttaaatctctgcatggatcaaaaatttatttttaaaggttagagatgatttttctgaaggacactccattgctctgatagaacgtgaacaaagcctttttaaactttgagtccatatatcaaaatttaaaatttgtcctatttataatgcctcttcttcactctgggtcttgttacctcttaatagaagaggaaatgagtctgagtagcctgcagcacattttcatgagagaattgtgtttctgtttttgttttttgggggaggtgcatttggaaactgtaataattatgaagaaaatgatattctttaaaaagaaaatgaaaatctctcacgatgtatatgcaagatctagtatttaaatgcataattagtgtgtccaccgcttacaaacattctaattaaagacacatcagggagcaattctgtttcttaggaaattgacttgtctattggcacctccgcattctgcatcagacagcctgtctgtccagctcctacgctcacctcccaagctgagttctgattggaagctgggttcatccctgctcagtttctttcctctttcttctttccttcacttcgtcaacttctttaagatttcttttattttcaaagatggtatatttctggtttcttttttaaaatctctgactaaccaacttctttattttctttgaggacttcctgtaaaaggtcaaatacatattatgaaatgataatactaatgacgtataggtagtactaatctctgctgcaaaataactggaaaaatcttaggatcgtatgatcaaatacctctccatctttgtttagcacttcaactctctttctctctctctgtctctctctctctctctctctctttccctccctccctctccactctctccctctctccctctctccctctctccctctctccctctctccctctctctctctctctctcccccttcctcccccatctacacacatacttttatttatttgtatgttatttcttcatcttaacttcagaaattactgaagactgactatatgagttatataaattgtttaaaattttgctaaagttatagttttggtataatatattacattaatgccatagatgaaatagtctttaatgtgttccatttttccacacagtaataactaggtcctcaatagcaccccatttagcagtttaaaagcagcaaaaacaactgctatcagtaacaacaatataaactacaaaagaagccatttgttatttgatttttattataaaattgtatttttaactgtcttgagcttaagcatttaggtgccattttcttgtattcatactcatttttaacttaagttggaaaactacactttcagttaacttttaaaaatatgtttatgtactttcaatgcttacatcacctgccatgtattagaactgagagcattaatggaattttaaatgtcttggttactttctaaagtgataaaatgaagccagctggtttgctttgctaactttttatattatcaaaaaatgttacttacacaaacctagtaatatgttttacttactgctcttgaattatttttcaatgtaacagaaaaaggtgtgaggaactttctgtatttggccaaagcgttccatcccaacctttaacacaaaataattgctgtagacaaatggtcaagagggcaattataatcttccaggcatcatttcctcagatatgaactgcaaaatgacagcatcattagtcattttcaattacagtcagtcacaaccagggatgattcattttcccagctgttttgttgttaattaactagatgaagctgtttttttttctcccaatgagtttgttctactgccaacatcaacatcttaacatttttaaaaacttccttagggtttattttttgcctaacaatctttaatatattactcacaaaagatgtgcatctcaagatttatccacggtatagcaggtcaaatggtatttcattggtcgaaatgttgccgaaataaatataattacacttaaaacaatacttggatttcataaatcatctgccatgcgtacaatctcatttacctggtgtaacttcacttgtagcaacagaaatcaatagagagataacagacaaaaattgtcccctgaaatgaacaagtctattttgactgactcatttattgagcacaatttccatgccaataacaccagaataagttgggagaggacttctagaaagaagataacaatattagaggcatttaataatttataagtaaatgcatagcaacattttatttttttaaattacaagtttgcgactgggcgcggtggctcgcgcctgtaataccagcactttgggaggccaaggtgggcggatcacaaagtcaggagatcgagaccatcctggctaacatggtgaaaccccatctctactaaaaatacaaaaacaaaattagccgggcttggtggcaggcatctgtagtcccagctactcgggaggctgaggcaggagaatggcatgaacccgggaggcagagcttgcagtgagctgagatcacgccactgcactccagcctgggtgacagagtgagactccatctcataaataaataaataaatacaagtttgctttacaactgaaaaaaaagtcttggagtataagaggttgaataaatgctaatcccaatgcataaacttgaggagagcttcactttcccaatgagaagagaaaaaatttataatagatttttgggcaacttgtaaacataaacatttagaaatatggatgagattgtcaaatgtctaattatattcaatttcttaattgagtagcatttccatatttgcagtcttacattttataaaataacacactcatttagaaatacctggcacatttatattttatgaaacaatttcattcaaacccttcgtatgtatattctagaattgtagagctcatcaccttgctaagttatttgtaatatggcattgtttgaatccctacataatactctgaaagccctctggccaagattacaagcaacatatctgtaatcaaaaaattaagaatatttaccttattgcagcaagagcgtaaaacacttcagagtgtgggcatctcagtaagagggcattggaaaaagcttcttacagagttcagctggctgcatgattctaaggaggaattcagaaagtagaagccatttctggattagatgctttcaagaaacagagtcaatgtagtgattaggtatcttagtgtttatctagaagatgagattaaagtagggctagacacgtcgttggtaaaggagcagcaatgcctcatattagtcatttctgtgatagcagaaaggccttgtctctgtcttgtttcaaacacggccatggggtggccttgtgtctgcctagtttatttctatgagtgttttttaacatccagctgggaccatcatggcctagctagctgccagctgccagctatcagcagagctatttttcacgttctcaatgctgtcgctgaaatttttatcccaaacttcaatacccattcacaaaatattaggaaaactgtttttttcatttttcttagatatgattttggttgtttgtttgtttttgagacggagtttcgctcttgttgcccaggctggagtgcggtggcgcgatctcggctcaccgcaacctacacctcccaggttcaagcgattctcctgcctcagccttccaagtagctgggattacaggcgcccaccaccatgcccagctaattttgtatttttagtagagatggggtttctccacgttggtcaagctggtctcgaactcccgacctcaggtgatcaggctgcctcggcctcccaaagtcctgggattacaggcgtgagccactgcacccagccagatgtgatcttttaaaaattcccaatagactaacatattctttctgctttttaagttgtttggctttttaacaaattctttgaaagactcgtttacaatgatctctgccacgagtgattgtgaagctatacattaggaatgattgctaaagatttatcaactttctttgcctccctttttaattaagcaaattctgtcagaatacttatgtaagcatcacatctcttgaggttatttcaggctaatatacaacattgtggttccgaataaaataattgagacataagagatagtataaagtcttgaatatgagccaactttcttttctgagagaatatttgagtgaaaagtctcatgtactcagtagctcatgctgaaattagggaagcattttagagatttgaatttcacctcttgtcctcagttgtattagttacacttaaagagagagacaaagagacatagatgtttcagttacaatattcgaatgtatgcctgtatatatacagccgtaggtagagtcctttatttattcagtagatattaattgcatgccaaccattgacacaagatatatttttaaattttgaaaatctcaaactcaaatagagtttaaaactatattctagtttacttttttaaacaaatgattttttatgattgtattaaacaaatacattatttttccttacttattctacatcaaataatatctatttctagaaggcttttttccttgtcttaatgatagaaaacataaaaatcatttaatattttttaaatatccaaaaaatatgaggcaagaaagcagccacaattgtagctaccttaggaaacttaattaaaaaatttttttttatttttaattttatatgtgtataattgtacatatttatttgtgcggtacaagttatattttgcttattttttataatttcagtagttttgggggtataggtggtttttggttacatggatgagttctatagtggcgaattctgaaattttttatgtatccatttcctgagtactatatactgtacccaataaatagtcttttatcccttacctcactcccaagctccccacttagagtccccaaagtccattgtatcactccgtatgtctttgtatcctcatagcttagctcccacttacgagtgagaacatatggtatttagttttccgttcctgagttactttacttggaatagtggctgccagctccattcaagttgctgcaaaagagattcttttttatggctgagtaatattccatggtatatagataccacattttctttatccattcattggtcgatggacacttgggttggttccatatcttgcaattgcaaattgtgctgctatttttgtgctgctgctttcttttttgttatttccttttctggttttggtattagggtgatactgacttcatagaatgatttagggaggattccctctttatcttttgaaatagtttcattataattggtaccaattcttctttgaatgtctggtagaattcagctgtgaatccatctggtcctggacttttttttggcaatttttaaattactgatattcaaccttgctgctcgttactggtatgttcagggtttctttcttttttttttttttttttgagatggagttttgctctttcacctaggctttagtgctgtggcatgatcttggctcactgcaacctccaccttccagtttcaagtaattctcctgcctcagcctcccaagtagctgagattacaggtgcccaccaccacgcccagctaatttttgtatttttagtagagtcggagtttcactgtgttggccaggcaggtctcgaactcctgacctagtgatccacctgcctcagcctcccaaagtgctaaaatcacagacgtgagccaccgcgcccagccaaagcgttcagggtttctatttcttcttgatttaaactaggagggttgtgtgtttccaggaatgtatccatttcctctagattttctagtttgtgtgcataaaggtgttcatagtagtagtgaatgatcttttgtatttttgtgatgtaggttgtagtgtttccagtttcatttctacttgagcttatttgaatcttctctcttctttccttggttaatcttgctaatggtctatcaattttgtttatcttttcaaagaactatttgtttcatttatattttgtatttttttgtttcaacttcatttagttctgctttgatctttgttatttcttttcttctgctggatttgagtttagtttgttcttgtttctctagttccttgaaatgtgacattaggttgtcaatttgtgctctttcagaatttttgatgtagtatttaacactatgaactttcctcttagcactgtttttgctgtatctcagaggttttgataaattgtgtcactattaatcatttcaaaaaatattttaatttccatctcaatttcattgttaaccccaaaatcattcaagagcagatttcttaatttccatgtgtttgtatagttttgagggttccttttggagttgatttttagttttattccactgtggtctgagaagatacttgatatgattttgattttcctaaatttattaagactttgtggtctcttgtatgacctgtcttggagaatggtccatctgctgataagaatgtatattctataattgttaggaagaatgttctgtaaatatctgttaagtccatttgttctagggtgtaatttaagtccattgtttctttgttaagtttttgtttcagtgacctgtctagtgctgtaaatggagtattgaagtcccccactattattgcattgctgtctatctcatttcttaggtctagtactattgttttataaagctaggagcaccagtgttaggtgcatataaattgagtactgtagtaaatatcttcttgttggactaatccttttatcattatacaatgtctttctttatcttttatttacggttattgctttaaagcccattttgtctgatataagaatagctactcctgcttgcttttggttcccatttgcatggagtatctttttccgtccttttaccacaagtgatattttgatacaagcatataatatataatgatcaaatcagagtgattgcagtatctatcaccttaaatatttatccattttaaattttaaaaggaaagctatattcagaaatcactttttcttgtaactaattcctgttcttcataaagcagaaatttcatagtttgatatagttgtcttaacatttaatgaatattttcaagcaaagtatatacaatggagaataatgctcagctgcaaaagtcacctataataaatctgatttttccatttacaaacaaaagaattcccaaagtttatccattttggtagaacacgaattcactctgttgagtttggagctcttgtgcggaaaaccttggacctgcaatttagttagcatattcaaagttttaaaattatggagatgtagtcaagaataggacttgataactattatcccactgatacgctatttaaataagttgggatttaagtacttatttgatttccttaaatttgcttatagatgattaacatgtattgcaaattgttaccttttacagatttctattgagcactgcttaaattttattatatgatgaacacctgactagttgctacagccaaacattttttgttatgcaaatgaattttacagcttaattggaatgatgagagaattgaaaatatgggcaaatgccagagaagtgaaaagcaaaatgaagcaaaacaaaaaagaacttgtataatatataaataatccatttcaactctacagtacaccaaactcttgaaaaagtagcaagattgtttttgtgaacagccaaatcaaaaactgtagtcatttcataagtatttgctaataattataaaagattggaaattatacagttctgagcttattgaacctttgacccattgcagtgtcctcagacatttgtgatacattggtagtgccatttaattttaaaaatccacctctacattagagattatagtaacccctcatttacctatctggaaataagagtgggaaagataatattagagtaaatggacagactatttagagtttatgtattaataaaagagaaattgcatgtacaaacatgttattttctaggtaactaaaacctagtcctttaataaagcactgaaaaaaattttatcgtaactattttaatgagaacttttcttgaatatcttctgttttgcttcattgagcagcgcataatatctaaccaacaaatttatagtgctttgtagttcacagcatttttaccatataaaatatctcgtttagtttctccaacaaagctatgagttaggtggtattattatatccatgtttcaaggatgataaatcttagtgacccatctcattttccaaggatcacacaaccagtagtagtgaattaggaacgaaacctaagacttctgattctaaatcacaatgtaaattaacttttcttaattttcaggggtgtcgttatcacatcaatttttgctctgtttagtgatacagtgttatatgaggaacatgaaattcaaagcaccctttcttcagttgagacccagttgaagtggttaatttgcttttagaagctagactgtaagataaatacatacctttaagtattaaagctaactcaaatcactgagatacttacaccatgagaagagagtggaacctaagtcaactggtagaaacatagaaacagcaaactttgatctctctttatcctcattctgaggggcaatatgcttactgagtggaaagatgggcatacccccagcagtatttaaatcaatccctaatctatcactatctctccttttctctctatctcagcacatataggtgatttcctataaattaaatggtgtaggatgagatttcatcccatgttgaaaggtcatttcattgataaatgactaagattaccacatttctcagttttaagtttttcatgttcattgtctcctattgctactttctgttatcagaatgattacttctcattgcttttagtattctgtctttgtagggttacagaaacttcacagggaaaccagaagatcaaatatattactcactagtctcttagaatatttaatttttagtgtttaggttctgatgtcaggacaggaaaatatcttccgtgagtgatgacttccaagggtggttttcctgactaatcagaggcattattttttgtttgcttttgggttcaagactgatttttaataaataaaaaagttacatttattgatatgctagtaaatatttacatcatgcattctggataaaaacattgaaagccttgatttgacttgatgtcagacacaatagacatagtctcaagagcactgatgatagttaaattaggaagtgatgaattcttactatatattatcttttgttcttagcacagtttattttatatttataaaatttaatttatattaatggttatgtttaataaccgattagcaaaattactgaaatgtgacaataatatctctattcctgtttctttcctgctttatccttttaaaatatattatttataagtatattttaaatttataaaagctacattgtgctataaatcttgtttcttagcttttctaacattcataattgtgttttaaagatccacccatggccgggcgcagtggctcatgcctgcaatcccagcacattgggaggccaagatgggcagatcatctgaggtcaggagttcaaggcagcctggccaacatggtgaaatacaaaatacaaaaattacccgggtgtggtggtgcgagcctgtaatcccagctaccgggaggctgaggcaggagaatcacttgaacccaggaggcaaaggttgcagtgagccaagatctcaccactgcattccagccagggcaacaacagtgaaactccatctaaaaaaaaaaaagaaaaaaatccatccacattgctctacatatacccttatccatttctttcacatacatacccatgttggcctcaattccccacaatgcagcaacaaactttcttgtacttccttatgaccttaagaatgtgagagaaacttctccggtatacactggtgagggaatatgatcagcagggttttttgtttgtttttctgtgttttgctttttaacttatgcccacctttctgttggcagtcagcagccacatctgaagttatagctctctgatttagacaaggcttattcttccctttgttacaacctagtccctatagggacctgaatttgtgaccctagtctatgagattactttttaaatacagtttggttcaggatttataaaagcctaataaggctgggtgtggtggctcacacctgtaattccagcgctttgggaggctgggatgggcagatcactggagtccaggagtttgagaccagcctgggcaacatggcaaaaccccgtctctacataaaaatgtatgtactcagtagtactactcagtagtagtactgagtagctactcaggaggctgaggtgggaggattgcctaggaagtcgaggctgcagtgagccgagatcttgccactgctctcccgcctgggtgacagagtgagaccctgtctcaaaagaaaaaataagcctaataaaatgattgcacgcctggaaaacctacataggctccttcaagtcccatatatatataaagtcatccatggtatgtagttcacattgaagtcaagttgggggaaaagaaacttatttatctctttctcttttcctttattcaagtagcaattttcatttaattttattcaattcagaaatatttactgaactcctcttattaggaagcactagactggatataaagaaaacatcgtacaaggcatagaggactcagtcctgccttgcgaagggcacatagtctgactggaaagacacatgctgacagggtagactgtgttaggaataatgctcaaaatcctgaggacattgaacactcgaacaaaggattcttagcaaagcaattttacttctgcacagaggggtgcctccttggccagttgccatgagagcacacctgaacaaaggggcatgagagcctttattcctgacgcaagtcctgcccctgtaccctttccccccattggctggggttgggtcgtacaatctaaactaatcccagttggctaaacatttgatttttttagatagggtgggcacgtaaaatcaagtggagaggaaggggaaggggcgtctgtaatgagctagaaagttagtcctctttccaaataaggaaatgaatgtgagctggtactgaggtgtgcctgggcatctaacaaaggtaaaaaggaaaaaggagaaaaatcagggggtactatgaattaaagaataaaagattgatcagattatttgaagagaaacctcatcatatcccacaactggaagaaacaatttgatggcaagtttctcttcgtcgtttaccagctcaaaatctcaactatcaaaggcaagaaaaatacacacacacacacacacacacacacacacacacacacacacacacacccctctgcctttttctgtatggccaaagccttcagtccagctgaccacttcccactccagttaccatgttagcctcccaacttgtatctctgcacccttctgataaagcctccacaatgcaaaacacgaatcgtatcatatggctcttcttctctaaacacttccatctactctgtggttttagaagagaatgtaatagtcccacattacaaggtcttaataaattgcattcttgcagctctgtatcattacttgtaaacactgtagtctagatagccaggacacactgcatttcttttttaaggctcgatacctcttgccattttgcacgtagttttccttctgtctgaaatgccctttttccacctggcgcttgaatggccccttctgaaaacttcctagtcgtctttcaaaataaattcaaatgttagcttttgtgggtaacctattgacctctccaggctgagttaagctgttcccccgaggtgtcttgttgaaatcattattttttcctaaaatctctgttctaatttacttacatgtctgtgaatgcttagaggttacgaacttcagttttgtaagcttagtaactggcacaaagtctggcacagagtagcacctgaacaattatttttctggaataaataaagtaatggtttcattgaaatgattcgcattaaattaatgattagcattaaactacaacgtgtatatgaaacattccagttaggttgggttcattccattcctatttaaagagtttgtagtttctggctcttttccaactctgattcttcagactagaaatgcaatttctgctaatgtatttattttaaccaaacccgacatcaatcaagttatttgtattcctcataaggtaagcataggaatttacagtgatacaaaaacgcagctattatctcttataggcactggtaaagcttttgtgactagtgctactatactggtaaggtattgctgcttgtaatgaactaaatatttcagtggcttaacacaataggagttcttttcttgctcacatgacaacccagcgtatgttttcctagtcaagcagctttcttacatatgttattgcagaaacctaggtcctgttcatcttcttcctctgcctgccattcccttggtagcttttctctgctcgggtttcgcaagaggatgaaatcctattgaaaatgatctgagggtctattatgttctcaagaatggtacatatctagtctatgataaatgctcaggtaactgattaggtgtaatagatatcttaggattttgtcatgaacaatcagcatcaacaccacctggaaaattgttaaaaatgcaaattattgggctccacccagtatctactaaatccagaactccggggctaccatgcagcaattagcaaggtctccaggtgattctgttgatcctaaagtatgagaacaactgccctagggcgttaggacttaattctctcctcagtaagttgtaaagatttgccgtaggacctaagagtcttctgcttccagcaatagaaaggaaaaaaaatgtggaaacctcactaaatttttcaaagcctcagccccaaactgacaaacaacacttctgctcacattctgctggctataaattatcgtatagctagctgcccagtgaagtggaaccagctcaggacggcctactgttatattgccaggcattttttgagccacttgatgttatcttcttggtaatttaaatttaaccgtggtaggaatatttacaccacagaaattggcaaacactaaaaacaaggtgtttttaaacaccctgagatcagagatccagttgatatacatctaccagcacaccactggccatatacaggcttgccttatgccacggggagctctgcagctgaagtagcccttcaaacttgtcctgctttgagccaaattaggcctctatactttcaccttcatcagtcactgaatgagggctgcctggggaaaggcatgaacttggacaaggcagctctctgcagctcaggcagtccctgaagggactgacagttgaagaatgtctactgacatcatttccatcatctagaacaagagtctttctttgaagggggctctgagtagcatattcccgtgtccactgcagcccctccctttaagagactctgatataattgactgggggtgagccagtacattaggattttcctaaagttatctggataattttagtatgcaaccacaatagatactcttcaagaattaagctagttgctgagagggaactgttttttgttggtttgttttcactaatgtttgcactctacttcctttaaataaaattatgcctggagaaagggtttttgtatggagcaattgataaatatttgtagggtggttggctaaaataattataattcctttaaaagaaattctacccactaaagttaatttagaagtaaaatataatagaaatccaataatatattcaccaaatggattaagatgttcatgaattatcttcaaagtgttaatcgaataagtaatgtgtatgcttttctgttaaagaggaagttagaagatctgagctctgagtggaaggcggtaaaccgtttacttcaagagctgagggcaaagcagcctgacctagctcctggactgaccactattggagcctgtaagtatactggatcccattctctttggctctagctatttgttcaaaagtgcaactatgaagtgatgactgggtgagagagaaaatttgtttcaattctaaagatagagataaacctttgtgttattgactgtgcaaaaagtcttagagtacattccttggaaattgactctgattcaaagtgttgcatgacaacgggatatggggagtgttctctggagatacacccacaaggaagagaagagcacaagggagattgtgggagagtctgaaatgtgatttgtctgcagcagaggcctaagccagtctcgcaggagccctacatctgggctggctgtgcagagctgtcctgaattgcaggcagtgggcctggcccttgtattcctgatccagccagccattggccaggggctggctgctgcctgagagtggaaggacaacttggacaagttttctgaggccgaaggcaattcttagtaaggaacaccattaacaaccaatattcctagcatccagggatgtgtgcattgttcctgaagagggacaagtatgtctacaaaaatcacagaaaccacagaaacacacacagtcctactagcacctctccctgtcccatttgcaaacaatttaagagctctcccatttttagttcaagaaaaagaaaaatggattgggaggaccacaagctgacttgggggaggaatatttcctcatttagctgtagttttaacttttgttttcactgcatattttcagtctattttattttctttcctcttcagttgttgatagaaggtattcataaattctcatggcaatgttaatgctggctttgactctcaggggaaagaggccagaaaacttctttgctgtaccattccataattaggcagaactaaaaacatctttgggtgttgttttttgtttttgtttttttttttgccttgtctgcttttcaaagatcaaatgattgaagcattaaagcatggtgactggttcttcaggtaaagttgatttttattttatgtcaagtagaaaaatactgaactggaagaatcacagctggggtagcacaatcataattcattagaaggcataaatagtgcttggattaaaagaagccctacaatctggggacagtgcatctcatgtgccctctgggattactcggcagtcatcagagttagatttaacgactttggagacttaagcattatggttttttttttttgtcaatctgggacactgaaattgctgtatcagggttatactcaactgtgtcaggtttatttgtttttatgagctgtaatttttggttccctcagcgcatatgcatagtttgttcctatgttatcatttattggtgtctgttttctggctgtctctggtaggttcagcctcagactctgtaactccatgaagagattatgttccaatgatgttttataagtttgttaaactctgaactcatgagtttatgtcccatataagccacgttacacatggtaggaaggctccaaaaccagggcgccgaaatccatttaacgtgtaacttacctaaatgtaacaatgtttataagaaaaatacattggaagttccagttttgacttccagcaacatatataattcatccactttatttattaacttccatgtgttgagcatcatactggtgctgcgagtacagcatagaataaaagtctctcctttcataaaacatatattgtaattgaaagagaaagacaataaactaatgaagaaaatatatactgtctcaataattataagtgctgtagagtgtagtctacagattgatgtcaatgggtatttgttagacacacagaatctgaggcccctatcctagacccactgaatcacaatctgcattttaatagaatccccaggtgaatcctgtgcacactgacatttgagaaacaccattacagagaacaactaagcagggagatgggatgagggtattattgtctatagtgtggtcagggaagcttgtctgttaagagaacatcagaaaactgatgtaagtgaggaagtgagcctggtgtatttctgggaaaattattccaggcagggagagaaaagactgagcaacgatactgaagtaggaacaagatgacggaatattaaggagatcagtgagactagaggagtgggtcaggggaagtgtgatggaagccatgagagatactcatctttcatagcactgccctacttccttctccccaacatgagggtctcatcaccccccaccactcttgtcttctcctatgtcctccacattgctgccagtatggagagtctgggaatgccctcagctcaaagctgtttggtgatagctggcagagttgtggtagtagctaaaaaagaattaagggaaagaggaattttctcaaaagcaggtgcttttcatcctctttagcaaaccgaaacagatctgagcattaagtcaagatgttaaatacacaaatgttgaatgaaaaaaaaaacaaaaggtagtcatttaaattcagagctgcttttattaaaataagattttcttttttctttactgtggtagttcaaatatcagaataaagaattgtttctattcccgacttcctgacttgcaggaagttaatcagaaataaatgcaatataaaaaaagaaaatctaatttgtattatgcttcttgtatatgtttattatttcatgtactgtattacaatgtaatagaatttataattcattatagcagattgtttccattgcattcctactattaaatatgtagaagctacacatatacttgtagctttaacatatatgtctttatcctcaaaataactgcaaagaacatatagataatttttaaagattaaggagcctgaggtttagaggggagatagctagattaaggccacacagctagaaagcaagcaagcaagggtttcagtccacatgtcaagctccacagcctgtgttttgttttgtggctgtgctttacactatctctctgtccaagaacctaatggaaaattacagatacagatgcagctggccagcagttaatataatttaactcaatcttaaatttatctggagtaaaagtgatacaagtttccgtgttttttcttttctttctttcttttttctttgtgtgtgtgtgtgtgtgtgtgtgtgtgacagaatcttgctctgttgcccaggctggagtgcagtggtgcgatctcggtttactacaacctctgcctttcaggttcaagcgattctcctgcctcagcctcccaagtagctgggatacaggtgcgcaccaccatgcccagctaatttttgtagttttagtaaagacggggttgctccatgttgatcaggctggtcttaaactcctgacctcaagtgatccgcctgcctcagcctctcaaagtgctgggattacaggcatgagccaccttgactggcctgtttctgtgttttttctacttaagaagtagaaaaaattggttcactctatttgaatttcttagaaccatagaaatccaaacttggaataattattgcaattattatctagttgagtattcttcttttatagatgtagaagctgaggcctaaagttgcttgttttgttttatgaacactaaaccaaactaccttgtggctgcttacttaaattataaattataatggggtggccttgcctgagctgtataaattgttttaattatcaggacaaatcaacatactggaaaaaaaaagcaaaacttgcaattgttgttgcttagacacctgtccatatcagtttctattgttgcatagaagcaccccaaaacttaacagttcaaaacgagtgatttattgctcataattctgtgtgtctgaagtttgctctgtgattagctggatagttattctgatggtcttgcttggtgttacttatgtggatgcagttatctagcaagtgaacaggagctagatggtctaaaatgcactctctcagatatctgacagctggctgttggttgcagaaccttgattcttcataaggccactcatcatcctgtaggctagattaggcttcattacatggtattctcagggcagttttccaagagagggcgggtggaagctacaagaccttctgatgcctaggctttgaaacgtgtaggttacttctgctaagttatattggtcaaagcacctcaaaagatcagcccagattcaagagatgaggaaattacttcatctcgtgaaaggaggagatgccacatcgcatatcaaaggggtatgcatattggggatagaaggttttattgtcaccgtatttatacacaaatcactacattggggaaaaggagggaaactggagatcaaaagtgttggtcttaatccaacttaattctcaaaaattaccatgcgttagaaccacccagttcttcgcaaagtatagattactgggcttcaaccccagagtttctgatttactagctctggggtgagacctgcatctctctctctctctttttttttgagactgagtcttgctctgtcacccaggctggagtgcagtggtgcaatctcggctcacagcaacctctgcctcctgggttgaagcggttctcctgcctcagcctcctgagtagctaggattataggcacccgccaccacgcctggctaatttttgtatttttagtagagacagggtttcaccatgttggtcaggctggtctcgaactcctgacctcaggtgatccacctgcctcagcctcccatagtgctgggattacaggcgtgagccactgtgcccagccaagacttgcatctctgaaaagttcctaggttatgctgatgctggcctatgctttgagaactactaccacagacatacagtgagtggggaagaataaattcatcccttctgctgtgtgcagcaaggagtgggattccaatgagatccagtgctgtgaatgctaaagggaaatccatcttattttagcacctctactccccatctccccaccccgaggatgttatagcttagaagttcaaggagatggacaacacactaaaccaggcagtatttgccctgcagagctgttcagtgttcctggatgagacctctgagaagaaaagccataagttcctctagagactttcacaatcatttaggtagacaggactttgcatgggtctgaaggcttgcatggcagatggaggcaaagagccagcaaatctggttgtaaatgtcaatgtgaatcctttcttatccacaagctgctgggcctgagaacattaatgttctacaatacccgatttagcatttttgaaagaaattgcatatagacatgcttaatgtgaagactccaaatcaggatatttgattcaaatgtctcttggtaataactatggaatgaataacccattgtatatggacatatagaagagccagttaacagagttttctttttttttttttttttttttttttttttttttgagacggagtctcactctgtcgcccaggctggagtgcagtggcgcgatctcggctcactgcaagctccgcctcccgggttcacgccattctcctgcctcagcctcccccgtagctgggactacaggcgcccgccaccacgcccggctaatttttttgtgttttttagtagagacggggtttcactgtgttagccaggatggtctcgatctcctgacctcgtgatccgcccgcctcggccttccaaagtgctgggattacaggcgtgagccaccgcgcccggcccagagttttctagttgattaaacactggtaaaatcatctcttcctgtaattaagtttggagagagcaagtctcaagtgtaattaggaaagcacagtattggaggtcaagaagcctaaattctgatatctcagttgtgctaccaactatataagggatcaacagactgtttctgcaaaggaccgatactagatattttctgctttatgggtcatgtggtcaactctgtcattgtatactaaaagccacagacaatacctaaataaagggacatggctgtgctccagtgacactttatttacagaaacgaggcaggtaagatagatttgacccttagtgggctacccatttccccttagcactcagccttcctataaaccatgaagcgtctaactacaagtacctgtgagtcttcctgagtcctttctctgcctgtaggagtagctctcccacttgcagagcaggctggaagctggggaggagattatctctggaatagcacttaaccaatggacaaaagctgggggataaaggtgttggtcttcatagttttcatactgctatgaagaaatacccgagactggataatttatacaggaaaaagaagtttaatggactcacagttccacatggctggagaggcctcacaatcatggcagaaggcgaaggaagagcagaggcacttcttacatgacagcaggcaagagagcatgtgcagggaaactgctctttataaaaccatcagatctcatgagacttattcactatcaggagaacagcacaggaaaaccccacccccatgattcagttacctcccacatggtccctcccacaacacgtggggattattggagttacaattcaagatgagatttgggtgagaacacagccaaaccatatcaataaatatcccaccttcttctccccttgggtaggacacctccaatgcatgttccacactaaaaatctccagtgaattgggcagttgaccacaatgataagcatacttattagcatgcctcgtataggcttccttccgatgtgtaggctttcttcccattttggcagaatctggacccaaccccacatctcctgagtttgatttcagtcctcttcagtattctcatatatctcaactttgttccctgctgagatacaactgacagatatatatgtatcttcagctctgcagctctatcttctcttctaccatggctttctgggatcagctcccaattgaattatttgtatttaaatccttgtctcagggtctacttctgagcaaacctaaattaatacaagtcttagaattagtgccacagttataccttttgagtaagttatgttgcaattcccattttatagatgagataaccaagggtcagaaaggttaaataatttgtccaaggttacagagctagtcagtgacagagtgggtattcaaaaataagtctctatgattccagagcttatgctattaatcagtgcaccatgtatcaagcagtgatttagttatcttcatttgaattttttgaagtctctatttaaattgaatatcaaatcctcacatataaggttatttatacctttttatttgttttatttatttatttatttttgcttaacttttttttattatactttaagttttagggtacatgtgcacaatgtgcaggtctgttacatatatatacatgtgccatgttggtgtgctgcacccattaactcgtcattgaacattaggtatatctcctaatgctatccctcccccctccccccaccccacagcaggccccagtgtgtgatgttccccttcctgtgaccatgtgttctcattgttcaattcccacctgtgagtgagaatatgcggtgtttggttttttgtccttgcgatagtttgctgagaatgatggtttacagcttcatccatatccctacaaaggacatgaactcatcattttttatggctgcatagtattccatggtgatttatacattttaatttgaacttcactcacctctacaaagttaaataaagcattccatttccatttcaataatactttaaatatctaggcagttaaagcatgaggttacttggcacttaaatgtactcttgtcatactacttttgttggcttaaattgcaaaaaaaaaaaatggttaatttattgtgacaataccctacatttatctgcagtgatcattttttttgtgaaaatggccttcgtttatctgcagcaaaggaaaaagaggatggcaattagttcttgcattcttattcctctcttgggtcctgatccttctcattaatagaaacatggcaggggaggggtatataacccacaccctttcctgttgtggttatgtttccactgttgattctgcttcaggtgaacctttaggattaggcaaataaatttccgtgaggccaaatctttttcttcctcattaacagatgatttctctgctaaaaacacttacgacatggctatactattgccggttttatagttacaggctctaaaccttgaaaacttcctcaaagtctaatacgtcaggagcaagcttttgtacaaaaaatgtgaagacccttaatcagttccaataacaaaataaatccattttaaaccctatcccaagatactgcaaggccttggagcagctggagagactccttaactcttgacattaattaattaatttaaaaattcatatttgtatgtatcagtgaggtaagagtgcttgaaatataatgagatgtgtcacactgtagaaaggggagtgacaacagaaagccctggctggtgaggccccagcacttctcacactcatcagaaggaagtctttccatgaaggcagtagggggtccctggtcccaggccaggtccttcaacaatgctcactggttaacaggaaaggcactacagtggcatcattgttaacatccaagacagtgatagaatgtgaaacttctactgtttagtatttagtattcagcatttagatgttaattatccattttgtgatgaagttccctttcttctccctctcttaaccttttggtagttttattgcatggttaccatttccagttagggttgtgctttggggtctgaactgatgaaggaagagaaactctagttcatcatttctaggaaaaagagaaggctaacatcaattctgatgattagagattttttgattacctatgtcctgcattttaacagaaataaaatgttaattacagtaaacttactttaaccttcttatgctatttaacactcttcaagaaaggacttttgcttgaaatcactacagagtataccataatcttgactgtcatactctgaccaagaaaccagaactatttaggcatatttatgagagtaagtaccctaccgctcaaaatggaaggcttcaacatgtattcctaatatttcctaaaacttcactgaatagttttaaaattgaatataactttaccttcagagagaaacaagatttcgaaaggaaattgtagcagttttgtacttcaattgtcgattttaagattgtggtctgaaaagtatttgaacagtcattctttcttttccactatctcaggaaaggctctcattctattagaagcaatcttagaagcgtaactgccaactctcttcttaaaaagtgaagagcagatggagttctaccaatctgctatacttgacagtttttcaactacctaacctaagttccagttactgtctaaattatttttattcgaataggaaaaatacatttatgcttactgtacatttcgacagtgttcattctttgaggtctgttatttaatctccttcccacttttcttttctatcttaaatcagatgagtccccatggtctggcaacaaaacagctgtttctcaaatttttaacgtctctgtggccctcctcctacccttccaagtgttttccatactatttttctgttgtgggcttcagaattggatgctgttccataattactggtcttcccatgactctgtcacatcataaagtctatatatacccttttcctacgtttacatgccaaataccaggtgtgtctagctttaattcaatgactagcatatggtaggtattgcactaatattttttggtcaagtgaacatatattttacagatagatcaaatacatcaaccttcccatgtaataataataataccaagaagattaaatgatcgcgtgcttgaccagctgtttagtggcagaatctggacccaaccccacatctcctgagtttaatttcagtgctcttcagcattcttatatatctcaactttgttccctgctgagacacagctgacagatatatatatatatcttcacaatctcagtagtaagccctatttttttaagattacagtgctgatcaaagagggatattctatggcattgatgcaaatcttccaggccagatataacccctatctccttaaaccctcattcttgactgtgtcttgaaatcaaatttgagaacctctgctttacatgctaccttcctcttaaaattcataaggtttattccttctctcatcttcagtatttttatgaaaatatgttttactcttatttccaaagtgcttgccagcccatgctgagttcattagacaaacaatctaggtatcctaatatttaggtaaaattgctagcagcactaactataccagtacccacttaaattgcaatataaacctacaataggaaaaaaaaagtcaaaattatactactttcaattcctacttctggaataattatcacaccttcaaaaaaactcataattgttctccaatattaaaaaccaggaactaaattacatcactatatatatatagctatatagacatataactgtatatagtttatatatatattacatgtcactatatatggttatatatacagatagctatatctctatatagtttttatataggaaactatatatataaactcatatatatttatatataaactcatatatatataaactcatatatatttatatataaactcatatatatttatatataaactcatatatatataagagattttatatgtatatatgagagacaatattgaaataaaacaaactagccaatctccaatgtcccttcattttcccaggactcttctttattctcaaagaaatgtatgaatacacaatataaataaatgttctataatgttcattatggattataatagttttcttgtcatactgaagtgaatgggaattgtttcttcgattattagcatacttttcataactatgtgatttggtgataggcacttttgcttactaagttcagcatgatcaaaacagaactcctattatttttattgttgattcttatttctttaaggtaaaatatgcccttttcctttgaacctgcacactgtttaacaaataagcacataactcaggattgaattgtacacttcgatttgagcttttttttcaaggtcaggacccagtttcacaagaagttttattttttccaatacaactgacatccactcccaccagctgaaagacaagaaaaacttgtctaataaagctttcagattcaatttgctgcctgcatacagcttgaggaatctctggaggtcactcacagcatgtgttgcaaccccaacagggagaagtaatgaaaagattctagttaaaaagctgacactgccccttccaacctctttgaatgtgaatataataagccagtttacagacgcaaatctctatgattctggggatttccatcttgatctctgactccaaggaacatttgaatgcatggatttgtatccattatctgggtgaataaatgcttcatattgaaaaaaggggtgctttaacaacataagtctgatgtaaatcaggcaaaacaacattgtcacttcatgtttaactctcctggagggtctctaaggtctcacagtttggttctattccagtaatatataggcctatcatagccattttcaaaaataatacctgctttcatttcgattattccccctagcttttgcattgacccgaacatacctaatatttatcttagggctaacacgcattaatgccttgctctgtaccaggcattttgccaagtattctttgtgcatttttctgtttaatcttacagcagccttatgaaataggtactacattattattatttttcaccatgagaggaaatgaaagcctagagagaatggttatccaaaaacacccagctactaagtgggcacagcatggccttgaacctgagtctttataaagttcatgcctgtcttttacctttatgttaaacatactgaatcttggtcatgcagtctatgaatgaagactccatatactctaggaccaattctaccatattgtgcatgcttttgtacatattttccaaatgaaattaaacaacaatactctctcttcccctttcttttccgttttgcatgacatctaaatcttttattaaatctccgtgggtggaattgggccttaagtagtagtacctttgaagcttaatactataacctcagagttacggaagtggtttcaatatgaagaaatatatacgttcttttcttttcttttcttttctttttttggctcctctagaatagaaggcaatcaggagagaaaaagacattaagatgataggcttgattctcccacagtgttactacttagctttatttattctcccacatctgtaactgtcaattcaaggtcaaaaagccagtacagcagcagaattacaaaaagtagatctggaaaatctatagggtaccatagtccagcaccctgctgcaagtcaaaatcaattaaataaatatgtttaaacagcacttcatttaatcttaagggcaccacgactcccttggaaaattcttttttgtgttcagacctgattctctgaaagtattttctagtgttttctttgttcggtggctgtggtgaataagtggacccaattgcctacagcatgaaatcgtagaaatgaatatgggctggaacttcaatcaatcacacaaaccagaaacatagagttcatcacctcttctggaaagcgtccccttcggccgtcaaaagggtagagtttcctccaacatatgttcatacttccctttgcctcccatctgcaatttcaaccagtctgttgctctcgccctttttaggcttcacataccggatttcttcttaggagctcacttgaaaaaagggttgtatgctttaaaaatactaaaagtcactggactagatgataataaaatttctgtaaaataaaaagggagttaacagaggtgttaccacttatcataatggatattgttgacctttcctctagccagtgtcccacttaagcatgcttcttggctggaatttatttttctcatctggataaatctgaagcattatagtaaaacccagtgtgagcaaggccatggatgcaagtggattgagatgaatgagtggatagacctgcgtgggcagaaataatgaggtcagcaataagccataccaagggatgcacactcaaggaataaattggaggtagcagaataactgaacaaatgatacatttgatcagactgtcacatgaatatcaactgaaacaagttatgactgtagttagtgaaccctagagtgaagaaaacaaaatattgaaatccatctgatcaaaaaataataaaattgtttacatgtatatattatctaaaatttcccttaagaatgaagattataaattcccgcagttgaggaaactgaataagaggagaatcaggacagaatcttttctcttcgtattcctagtccatttttcttctaactacagtagtgagaacaagaatttattcaccaaatcataatacattgcaattaggggatgccatttgaatcttggaagacacgatttgaggcaaataaaaaatccatatttataaagtcaattattggtttatataatttactgtttcagcgggaggtataggttagtaatgtaagtcacttcaagaaggttttggtcgaagttttgccaattttttctgtaaaaagccagatagtaaatattttgggttttacaagccagaagatctttgttgaagttactcaactctgctaatgaggtgcaaagcagccataggcagtttgtaaatgcataagtgtggctgtgttccaataaaagtgtgtttgcaagaacaggcagttggttggatttggcccacaagccgtagttcactgacccctgttttagataaatactagtcaatagattccttgtagctaataaagggaatatagattgtttaatgtgtttccctaatcttcttaaggcttcctccaggggaaaaaatatttcttatcatcagcagtgttattaatgcttactcagaacaaagaataccacttacttagcatagaatggacatttataaagccactcatggaaagaataaagagatgtgaaatacctggtacaactcttaagagtgttccactatcatttgaaaaaatgatgagtagtagttatataaaaggactcgagcctaaaacatttgttctcactttggataacgttttcctatctcagcatcaaaaaatacaaagaaaggggataactaggtcttagattttctaaattctcatgactataagtcccatatatttagatattgaagtacccttaaatatacctaagtagaagtaataatttcgatattatgggaaatctaattactgctcatagttctcgagattaaaatgttatacaccacatctcagctttctttgaaacttgaaatggcatacttgtacaaaggtagaatggtctcccaaagcagcgtcatagattagcagaaaagagctatgataatgccacttcaactgactatcatttaaataatgaattagttaggaagagttaaattatatagttacaggcagcaggagatgtcaccatcagggggataagaagccattttccagtacactatttgacttaactggtgcagttccttctttaactgtaggttactcatttgtatccttaatttatcaatatactaatctgacaaataatttattaaggattactgtgtgccctcctgtgtgttagattctagggatacaatatggatcaagataagcgtgattcctagactcctagaaagtaagaaaactaaataactgtacgtgacaaatactaggatgtagaatactagggaagaatcaggaagaatcacctcacccagtctggagtattgcaacagagcgatgtcagaggaaaaattctggaaaaaaaaaaaaaaaaggaaatttgaagatgagacttgaaggataagtaggtgtacctaggcaaacaagtaggggagagtgttccaggcaagagaaacaagtaacagttggaggcaaaatggagcctagcacgttttaaaaatatcagtatggctgaagcactgagttggggttgggaatgggtgaggagcgatgtgtcagggaggacattccagatgatgctggaaatgcatgcatgttcgcaaactgcattttaagacatgttagagaaatcaaacacattttatttgaagggtaattgaaagccactgaagcattgtagagagactagtgacatgagcatatttgggttttagagggattactctggctgaagaataggtaactgattggataagagcaactttggaggctattccagtggttcaggtgatagataataatgacctaaactaaagaagtaataaagggaatggagacaaagtagacagattcaagtgatacttggcacgtggaaacaacaggccctggtaactgattggacataaaatggagagatacagagaacgcgaatagaacacccaggcatttggcttgataaaccgagtagaccgtggtagaaattactaaactatggagtattttagggttcaggggaactgtgagttcaattttagacatctagttttgcaaggccactgaggtaactgagcatatgagtcaggagagaagtttaggctaaaaatatggatgccagagttaaccagcgttatgataaaacaaagctgaagtctcgagggtaagaacacctaaacatctaggctggagaaggcagcaggtaaaaagtaaaaggagaggccaggcacggtggctcacgcctgtaatcccaacactttggggggccgaggtgggtggatcacctgaggtcgggagtttgagaccagcctgaccaacatggagaaaccgtgtctctactaaaaatacaaaatcagccaggcatggtggcgcatgcctgtaatcccagctactcgggaggctgaggcaggagaatcgcttgaacccaggaggtggaggttgcggtgagccaagattgtgccattgcgctccagcctgggcaacaagagtgaaactccgtctcaaaaaataaaaagaaagagagagagagagagagagagagaaacagagaaagagagagaggaagacaaagaaaggaaggaagggagggagggagggagggagggagggaaagaaaagaaaaggagaaaaattcaggagaatggttacttccagggagatggaggcgattgtgctgtggggaacacaagggtggggtcaaggtattagcagtattctatttcttgattggggttgtatttacataaagtgttgctttataattattcttcacactttatgtgtacgttctatgtaatcatctatagataagacagatttcactgtaaaagaaaataaaagcttccaaaagattatcatcacaattgtaacagattcccctggtgcctggagtcacacgccattttcctgcactgcagttgcagctgcagtggacagccctgtgtgagttcagacttgcctttagctgacagcatcccatgtcaagggaatggctcccatttttctactttctatctaagggacttctctgacatcccaggagcccacagattttgtgagctttctcacccttgaagttttagtgagtgagcaaccttcaaccaatggagatgggagcccatggatatatttttaaccactattccttccgggggcaaggggaattctctgtgattctcaggaacatacaaaagttctgtcaaaatacagtccccatggtccataagcattaccttgatgataatacatttgattggcatttcctccccctctgtctcactcttttggtttttcattcttgcttcctagggatcagcttccaaatgagctatctgtacccaagtcctcatccaggccctgttttcaggggacccaaagacaacaataagaaaaatggaactgaaagaggagaagactttaaggcatgaaaaaagttcctctgtattccatactgcatatttaactgcctactcaacagttccacttagatgtctcaaaaataatctcatgatcttttactgctatgaaatgcatgaccttcccctgatatattcctttcttcaggttttgtagcaccacttagctatccagtaacaaaatcttgggggtcattcttaaaaccttcccacctcacccctgctggacatccaccactaagttcagttgatttttttgctcctaaatatttcttggttcagctttcatttttagatttatcctgcatacccctgtacaatctcatcatctctttcctggactgttacagtagtcttatattaggatgatcatagtcttgatttgcctagagaaaacatgctttatgtcattgcctcagagtgactaatagtcccacctttcacttgtaacactatgcaggttattgggttaaataatactgtcatccaaacctaatctctcctcattcatttcttctctcctatgcatcttagctgtgtgaaaattcaaaatataaatttgatgacagacagaactctgtttaaaatgctccagtaccttaccatttatctcaaaataaaaatttcaaaaaaagaaatgatatcccacaggatcttgtatagtgtgaccctttccatttcatcatccttataccagatactgtgaactacttactctcttatctccacattgacctccctcctagttttgttttgcttatgaaagtgcttattttctgttttttaaagccattgcacatattggtctctctgattgagacactatccttttgaatttttgacctcatacctactcacttttcaggtctcagctcaaatgttatactcaggaaagacgctccttacctcccaaactaggttagtgtaaatggcactatttatactcctcttccagagcacacaccaaatcttatatttatttgtgggacaatttgaattcatgttgttccccctactcaattgtgagcttcttgaggacatactctgcctcctccttacctagctttattgaagtataattgagaaataaaaactgtatgtattcaaggtatacaacatgatgattttatatgactatattgtgagatgattaccacaatcaaattaattaatacatctagcacaagaaatagttactattgtgtgtgtgttgggggggggggatgaggacacttaagatccagtcttgtagcaaatttcaagtaaacagtaaagtattattaactatagtaaccataatgtacattagatccccagacatcttataactgaaagtttgtgccctttgaccaatgatatggtttggctgtgtccccacccaaatctcaccttgaattgtaatccctgtaattcccatgtgttgtgggagggacccagggggaagtaattgaatcatgggtttgtttccccccatgctgttgtcgtgatagtgaatgagttctcatgagatctgatggttttataagcatctggcatttcccttgctggcactcattctctctcctatcaccctgtgaaaaggtgccttcctccatgattgtaagtttccggaggcctctgaagccatgcggaactgtgagtctattaaacctcttttctttataaattacccggtcttgggtatttcttcatagcagcatgagaacggactaatacagtaaattggtactgcagagagtggggtattgctgtaaatatacctgaaaatgtggaagtgacttggaactgggtaagaggcacaggttggaacagtttggagggctagaagatgacaggaaaatgtgggaaaatttgaaacttcctagagacttgttgaatggttttgaccaaaatgccgatggtgatgtggacgatgaagtccaggctgaggtggtctcagatggagattaggaacttcttgggaactggagcaaaggacactgttgctaagctttagcaaagagactggcagcattttcccctggcctagagatctgtggaaatttgaacttgagagagatgatctgaaattggaactttgttttaaagggaagcagagcatcaaagtttggaaaatctgcagcctaacaatgtgatagaaaagaaaaacccattttctgagaaatacaagctggctgcagaactttgcttaagtaaaggagccaaatgttaagcgccaagacaatggggaagatgtctccagggcatgtcagaggtcttaatggcagcccctcccatcacaagcccagaggcctaaaaggaaaacatggtttcacgggccaggcacagggccgtgctgctttgtggagtctcaggacttcgtgccctgcataccagctgtggctcaaagaagccaaagtacagctcaggctgttgcttcagagggtgcaggccttagtggcttacatgtggtgttgggcctggggttggacagaagtcaagaattgaggtttgcaacctctgcctagaattcagaggatgtatggaaaagcctaggtgtccaggcagaagtttgctgcaggggcagggccctcatggaaaacctctctgctgggacagtgcagaaggaaaatgtggggtcggagctccacacagagtccccactggggcactgcctagtggagctgtgagaagaggaccaccatcatccaaaccccagaatagtcagaaatgctgatagtttgaaccatgcatctagaaaagctgcagatactcagtgctagccatgatagcagctgggagggggctgtaccctgcaaagccacaagggcagagctgcccaaggccatgggagcccacctcttgcatcagcatgacctggatgtgagacatgtagtcaaaggagatcatttgggcagttcaaagtgtaatgactgccctattggatttaagacttgcatgtggcctgtaacccctttattttggccaatttctcccattcggaacaggtgtatttacccaatgcctgtaccccccattgtatcctggaagtaactaacttgttttggattttcaggctcataggcggatgggacttgctttgccttagatgaaactttggacttggacttttgggttaatgttggaatgagttaagactttgggtgactgttgggaaggcattattgtgttttgaaatgtgatgacatgagatttgggaggggccaggagcagaatgatatgttttggctgtgtccccacccaaatctcaccttgaattgtaatctccaaaatccccaggtgtcatgggagggacccagtgagaggtaattgaatcatggaggcagtttcccccatgctattctcatgatagtgggtgatttcacatgagatctgatggttttataagtgtctggcgtttcccctgctggcactcattctccctcctgccaccctgtgaagaggtgccttctgccatgattgtaagtttcctgaggcctccccagccatgcagaatggtgaatcaattaaaactgttttcttcataaattacccagtctcgggtatttcttcatagcagcatgagaacagactaatacaaccaacatcccctcttgtcgattttcattgaatccccattacctgggaatgaatgaggaaggcagaaatagaaatcagcgtattgttcaatatagaaatcctgaagttacacaagataattacgagcaagactcagtacagagaaggaacccttgagctggggatcagagtcttctggaaacaaggagtaccaaaggggagtgaaaaagagaagtggagaatgagtagtagcagtaaaagaggaagtatgtaaagaaatggaaataaagatgaaataaactgtcatcttgttccagagacaaagctagctaggggagctaaggaaatttagagggataaaaagtctcatccaaaccttcataatgagctaagggctagtttttcatagaccctagcccaacttgcaaccctctcactctcttacttttttcctggctctgttttgctttactgcctttcatataatctaaaatgatgttaaatgtatatttcctgtctcttttctatatcacaatataaattccatgaggccattgcctgtgccacatttaccactgtactcccagtgcctagaatggtgcccagatcaagtagactcccagagtgtctgttgtcaaatgattctcagtccagtgatgtttgcactacatggtgctgccacttttttttttttttttacttcattccatttggaatttggatcattttgccaactttagggtttattcctctttatttcccctgtgtttgctgaatatctgactatctatttttctcagctctcttctcctcacactttgcctccaacttcctctctgctacaaattatacttagcacaagactggagccacttttcattgattttgatgtcagtgcttgagtgacaactccatgtggagaactttcaacctcctgctgtctcgttgtttgctttgaaaaaaaaaaatactcatcttcttcctgaacccactgggtaaatttatgctcacaaaaaagacaaaacttctagaacaaaaactgtatgagcttcaaaagtattagttttcccttgattttgagactcaaaagtaccatagaaattttaaaagggggatgaagtaattttgtcattcaacccgatatattttacaatttgaatgtcagaaccatgaaatgtcttttcagtgtactatcatcctcactatttccacctataaaagaaaagcaaaaatattgtttgagaacaaaaaaatattgcagtagcggaaaaattcactttaagtctttttttggaggttgccacatcacgcctgtcttcagctcctctcactgaagattctttgttttcttgaaaccagttggtcacttccaattcttaccacctataaatcttcctggttctttatatttcactttatatgtcccttatctcctctgatttttgttccagtctttcattttttacattctttgtcatcctatatgtcagaaagaatctgccactccaaattccttaatatatttatctaccagtgtttatttgcctgtcacatgtactcttcagtaatccattgacttgaaaactttctactctgtctttcttactatagtttgcttcttgagttcaaattattaatatattaggtcaagtaattctatttttatgcacattttacctaacattcttggtaaatataattgttttttaaattgcatcacatggtgagtattaatttaagacgtaattagtattaatctactggacaagattttatttattaactgttttgccctttgctagggttctgtaatctcaccctcagtgcctttaaatagtcttacccaaggatcacctatccctcttcaatttaaattctctattgtgttagtttctgagattgcacattctctggtttggtttggtttttcagtgatctctgtggtcacttccaaccatttctacttagtttacttttttccctgttagccctcttcagtgttaatatcacctggaagttaacccattcctagtctgcattgctctatggccagcatcttggctgattggccatcacctatcctgtacttattgtcaatttttttaaattttttattgtggcaaacagcacataacggaaaatttaccatctgtctttgttcatgtatgttgctataaaggaatgccagagactgggcaatttataaagaatggaaggtttatttggctcatggttctgcaggctgtacaaaaaagcatggcaccactaccaacttctcatgagggcctcaggcttcttccattcatggtgaagggcaaaggggagctggtgtgtagagatcacatggttagagagcataaacaagagagagaggggaagtgccaggctgttatttggcaactagctcttgcagaacctaacagaatgagcagtcactcaacctgcccccaggaagggcattaagccattcaagaaggatccacccccatgaccccacacttcccgttaagccccacctccaatattgaggatcaaatttcaacatgagatttggaggggacaacatctgaactatagcattatcttaattcaaataattttactaccaattccatttattagagaatctaagattaagactactgaaactatgccaatgattatctctagttcaggcttctctcttcaattccaaactcatattttcacctgctgacaagctaccacgtagatgttccacaggtatttctaactcaggatatgtaaaattgatgttatcattattttctgaaaatctattcctcttactatattccctatttttgtgaatgacacaatctaatggactggccatgttaaaaatcaggaagtttttctggcactttctttattccttaatattaagccccacgataaattaccaatcctttcgatcttgttaagacaaataagcttgaaatttcttatctcttatttagcactgcaattttgttttctcattcattcagatagcatcttctacaaaacctcttcactagtttttctgtctctcagctcatcttgtacactgcaaatccattaaaactacactttttaacatgccaatcataatgtattagtaaaggttgtataatagttctctttctcttctaggataaaagctaaatttttcagcttggtacacaaggccgttcatggatttggtacctactagtctatctagggtatttcctacatcttccctcctctctcttgaaaaatcaagtaatactaaactatttgtaactccctaatcaccaattgctgcctttatactttaacatatattcttccttttgctagaaatacatttgtcataataggctctttggtaaacttaccattacattctcagtttataatattatttgtgtaagtaccttttttcctacttagtcctccaggggaatgcatgtgcttctctctccatattatcattttaaaatttactcctatttcagcaagtatcataatattttactgagattaattgttggcatatttatgttaccctggtgacatatttaatagttaagatgctttgggctgcaagaaagagaatgcactttcaaagtggcttcaaaaataagaataattcaactcacataactggaagttcagaggttaaagctggctccagatgaagtacaagcagagctctgtcactctttctctatgactttctttgtcctgatttttttctctgcgtcagctttgacctcctcactagttgccctccaggttccaagatgactgccagcaacaaatgggtaacataatttcttgttacagtgagagacataaacacttacctcacagattcagagatttcaccctcagataagaacaatcaaaattttaattgtgtatctactgtatcattagtatatgtattaggtattcatatatatctactattgtactaaagatgattcagaatggtttcataagctggttgatttaaacttttcttcctgaaccaagaggatgagattatcttgactggcttagaatcgaagatttaggtgaatctaaatccatctccagaactgaggatggattccgtagaaacttgaagacaattggaattctcctagaaagcagaatttcagagtgggtgtagggatatctttgaatggaagttgtttaagccaccaacaatattcactccattggggtgacactgggcccaaaggtacccagttaatatttgttcaacgaacctataggaagacaatattatctgcaagctatttataaactaaatgacaacgagaagtatttttagaaaagttaatcatatacaatttagtcattcacattgggaggctcttcctaaatttcgtttctgatccttatcttgatctttgacgcaatcatatcttggcctccatctaaaagccagtagaagcctctggccattttttaaacaattggtttaacaacattaattggaatctatatagctcaacttaaaaaaaaaaaaaagaggaactagcttatcataatacaatattgtcaaggcaagtgatacttccatgcagctattcagcatttggtgtattcttggtttctgcagacctaataaaaagagattatctcagcgtcctctaggtttaattttaaaaaacaagaaaccatgaacaatgaaaatgatttcaaaacatcttcactcacatctaaaatatgaaatagctagatcagaggttcttaataatttaatcggtgaagcataactgaaggatttagaaaaagtgcctaaactattaaaagattcttcagctgctgcttaatgttgatatcaagttattttttacactggcaaacagctaagccattccctggtcacatccacttttcagcatttagcgctcctctcaatcatcccgatcacagccccaggaatgtttcatggcatctccgcaataatagtatattactattgggtcctgaattttgaggtagtttatctttcagaaaggatatgaatagagcaataagtccaagtagagtgggctttattaatgatgcccaagattttagacgtatactataatcttcaatcaattttaacaccacttcccttaccctagttttagtctaaaccagtccaactgtgctgtagtctcagataatacaatgttagattttttttttcaagatatagaattgtcgggaaaacttgtatgtaacctataccaatctaaatttcttagcatttaactctaaagagtaaagcttttagcacttcctgtgtaatacaagggcaagtgctgatttctctgaatataattttcctttgttagcacatatgttcactgtttaataaaaataagaatgcttcaattatctccttttgtcaagggcctgagaaataaagaaatatacagagggtcccaatctaaaaatgttttgatttacaatggttcggcttaggatatttttattttacaatggtgtgaaagtaatatgcactcagtagaaatcatacttcaagtactcatacaactgttctgcttttcatgttcaatacagtattcaataaattacatgagatgttcaacacctttaataaaataggctttgtgttagatgattttgcccaactgtaggctaatgtaagtgttctgaccatgttgaaggtaggctaggctaagcaatgatgttcagtaggttaggtttattaaatgcatttttcaatttatgatgttttcaacttatgatgggtttttcaatttatgatgttttcaacgtatgatgggtttatcaggaaataatcccattgtacgttgaggagcacctgtatcaatataggcatttacacaactctcgtactgatagcggcaggaggcagagaagctctaggcagaaaagggatggtccccagcgaaaaccccaccctcaagccaaaaagcctgaaaccgcagctcaaagtgggaacttatatcccagttttcctgctcgaatgttgcctttttctaaaccacccatggccccaccccaccccatcctgtgcctataaaaaccccagactcagctggtagacaggactacagctggacatcagagagaagcagcttgacttcagagggacaacttgatggcataactttagagaagaatccggctggacttcaggggaagattacttgccacccccatccccttttcagctccccttcccactgagagccactttcatcggcagtacaatccctcacatttacaatccttcaatttgttcatgtgacctcattttccctagatgctggacaagagctcaggagccacaagtgtgaatacaaaaggccctttgcccttgctggtggagggcagctgcctcctgtgaaaagacaaatggcccactgagctgttaacgcctaagctgtccgtggatggcagagctaacagagcactgtaacacaccctctggggcttcaggggtcgcagacgcctccacctagatgctgctccagtgctcatgcactccagttcccacctcgtttgcttgcacactccctccagtgaggagttgagagcagtgggctaagtaaataaggcacccctgttgcgagttccacaaaggggtcagggaaatatcctgcttcgttactaagtaggtataaaccctttactaagttagtaattattcagtaataatacttaaatgaaagctattctgttagactaaattcagattatcaaagacacgacagaaaacagctttctcattcatgaacctattatttccttttgtaaaatatgttaaatgaaaatacagccgtcatgctaatttctaatggtagaacatattttgaaaactcctttatgtttggaagattttgctttagtgcagataatcagaatgatgtgatatactaagaaataatttttaaaatgagatgtgacatttctcataatctaaataagaaatggcaaaacattgtcctaagctaaataactcatatgaagtgataaaatattgctttctaaaggtccatgatatgtagtgatttctaatgtgtttaatagcattgatcctattgggtaattgggtggttctaacatgtaaggaaggcctccagtactaatttcatgtactgggaaactactgggcagggatgaatcccttaactcctaagtaagactatcagatcatataaatctgctttttgatttgcaaagactcttaggcatacctcttgagaatattaaacatctactaaattatatgtaaagcatttcagtctaagatttacaatgctcaaaggagaaagattttaaagttcagcattggaatttccataatttccttccaattgtagaattttacaattgagatagcaaataataatataaataaatatgtaagactgaaatcaacataggagtttggaaagaagactgtatgggttaactagagttgtcaacaaagacttcacagaagattgtgatcgtagacattagtaaggaataaaatgggtgcaaaaaaaagtctaagaaacaacaaggataaatttattttgtaaagagtgaaagcatattgggtattacataaagagactggctagtttgacacaatgtgtacttttggggtaagcagtgggaaatcactttctgtaagtaaagtggaagagaattcaggtattggatatggtcatataggatttttcaacctttgttttgcccccatccctatcctaccagtatcatcacagatgttggcaatattcactcacttgcctgaagatagatattcatgtcaggggctacagatatgtaaaggtgaatgaagttaaatagcaaaattcaagcacactagttctgactgtgcaccctctctcactcagaaaagcactttggaatgcgagagtactcttatattgacaacctttagttggttctaatttataaaaaaatataaaaatatttagacaatttggatattttatatctatgccacaacccattgtcaaatgattgagatatcattgtttggcaacaatgaaactgaaatcaactctaagagtaaagagtacgacttttaaagatatttggttaagagtaatgttgcaaggcagagaccaacattatagaagttctcaacctgtgtgctggatatagctaaaatttcccaggaccattgaaagaaattctcaaatccacaaccacctcaagtgttgtctgtgaatcaaaggagtgatgcattacccacaaacatgtagtagacattttttaagtgatgtagatgctactgcaattaataaatgcaaaattatattacaatattactgaattcagaataagttgattttgtcactatttttctcaatctacgcatgctagatataaagttattatatagagacgtaacatttttaatatttcagaagcatgctcatgatattgtaaaccaggcactgttaaaagatcactggattgggaattaataaacctgggatctagtcctcatttgatctcttgttggctatggtttgggggttttgggcaaactattcaaccttttctgccttggtttaattgataaatgatggtgttttcccagataaatcccttcccaacttaatattaccagatgtagcatctatggtttagaatgtacagtataaattaaccttcctgaagatcttcacaagttactataacctatattttcatggcactgaaaactaagtttttgatagcttacgtttttataaataatttacttactcatttttatcataataataaatctgattcactaatcaccaaaatatcatttttgaaaatagatgcatgaaaggatccgaacttgttatggttttatctgttcaagtcacctaattttggtagccacaggcccccattgtcaataggggaagattatccattttagcaatacagtctctgataacttcagcccatatgcccttcaattccacttttacgtcagattgaatgggaatgtgaggcccccagtagtaaactaaccctactttctctttggaaattggtctttctacctagctctttgcctctgttcacgttcttgtattccacagaaaatatatacattaggtgttaaaatcacaatgattaacaatttttaagtagaaatagttattaagtatagcataatcatgcctttgaattagtacaaaagtaggaaacagagctttagtgacttttttcattctttccaccatttacagggcaaaaatgaagaattttaccaattcaaaactatgcacatgtatagtttccaccagtatttagtagttatgtttctcaagatgtataattcctttcctttctgttttctgtagtttgataaaccctagataggagttaatgttgtttcagttaggtttattatttcttttatgtggtttaatttcatgcaataagctagagattttgtaacataacttgataaaaattttctcccttcgtatctttttgttttaaaataatggattaatatagattgtaattttacagtagaggaaatacattttacttttagttcttatctagatatcttaggaaaaaagaaacatcatttttaaggattattatttttctactaatgaaaaaaatagcatgattttccattctggactttgtaattaactttaccttggaataattgaatcttaaatataacttcattgaaaattttattttcaagtaacattttaaaatgcaaaatttgtgtgatctctactaaaaagaactctcacatcccaatgtgcttatagctacaataattggttaaaagagacaaattataaagaagatataggttgtgacattgaaattacaaaatgtggattagggaagtaagcgtgtagagttttgtatgcaatcaaagttaagttattaccagcttaaaaaacccttacgtaagatgtaaagaaaagcaaaaacctatagtagcaaaagcaaaaacctatagtagatatacaaaaggtaaaaagtaaggaatcaaagtatactactgagcaaaacagtcaaaccataaaagaagacaacaaaaaaaggcatatagaacaaaggatctacaaaacaattagaaaacaactttttaaatggcagtagtaaattcctacctatcaatatttactttgaatgtaaatggattaaattcaccagtctaaagatagagtggccaaatggattaaaacaacaagactcaactacatgctgcccataagagactcacgtcatcttttaggacacatgttgactgaaatagaagagatagaaaaagatattttggtttccatgcaaatggaaaccaaaagagaatggggatagccatacttctattagacaaaataggctttaaaaatcaaaaactaaaaagacacaaagaaggtcattaaataatgataaaaggatcaattcatcaagaaggtataacaattgtaaatatatatgcacccaacattggagtacctaaatatataaagcaaatataaagtgataaaaagaaagagacaaactacagtacaataatagtaggggacttctaccccaaattcaacaatagacagaaaatccacattaaaaaatcaataagaatgcattggactttatgctttagatcaaatagacctagcagacatatacagtacatctcatctaacagcaggagaatatacattcttatcaagtgcacaagaaacaattcttcagggtagatcatatgttaggccacaaaatgagtcctaacaaatttaacaagattgaaagcatgtattttatgtaaaacaacgccatcatggaaaaagtactagtgtaaacaaggtttaaatatgatttactgattgtttaaaaaggaattatcttagccctgatctgatgggatttcccctttgtaagcagcaaaaataagttcataatgaagcaactgtaataatacagcttcacagatctttctgaataaacagagttggatatgtttctacttcagaaaccatttactgtgggctcacagcttttccatacactctttacactcttaattttaaacccattcatcaaaaggattaagacaatgagattcaagtccaagacaataggaagtatgtgcatcaaaactgtcatgctaatgctctgaggaacattgttatttcaatagcataatttaaaaccactgaaaccatgttttatttatgattacctttcatacgttcaaaaagaatttgagatggtttggcagggatgtcttaaagaaacaaacaccaaatttttatttgttgtgcttctaacaagcaatttttcctacgtaagtgttacctgttttctccccttgattttgatctcttttgtatggttggtagttgtcgcacttctgggcatagtatggttttctacaagttaaataaaaacataaattgattttgatgtagctagttccactatttcagttagtgtgttttccatacctgcaattcataacatgtttactgacccagaacgttaaaactcaagtttagttcaatacagtcacttcaaaccaacttaagatagcagttacatttccaaggtcattatgaagacggagttcaagacttcagcagttgaatttgtcaagctcatgggtcttttagttacaggaagtgtgcatatttcacataagaaacagcaactctgatgatacattgaaactcaaatatacccaaggagtgtaaaactactttataagcccttaaacaataaatatgccaacaatcctctgcatactttttgtcattttttagagcattcaattgaattatataacatgtgataccaataaataattaactttttatttatttatttagagaatgattcttgctttgtctcccaggctggagtgcaatggcatgatctcagctcactgcaacctccacctcttagtttcaagtgattctcctgcctcagcctcccaagtagctgggattacagccatgcaccaccacgcctggctaattttgtacttttagtagagacagggtttcaccataatgatcaggctggccttgaactccggacctcaggtgttctaccacctcagcctcccaaagtgctggtattacaggcatgagccacagcgcctggcttataattaactttaaaaaatattctactatcgaatgcctgaaaaaatcatattacttctatgtattaaaaacaaactattacgtaaatagaccagagatacggtgtcagagatgagattccttggcaacagtctctgagacaaaaagttgcacacagaaagtattttgagaagtattgttgctatttataaggaagtgaaggaggcagtattgggcagagagaaaagctcatccacactgcagttgctactgaggcttcagcccatgtgacagggacactggagctgggatggtctttcagagttctaccaaattgaggcaaatgggcgagacttttgtatctttgcactagccaagagcaggcaccagggagaaatgcagctgtgatccttttgtagatattattattctggagtcaatgcaaccacaccacaaatactaggaataatattggtagtgtgggtgcatcgactccagaagaggatcttgatgaagcattacagtatccactacagagaggcactggcatattctgcttaccccacaaatattgcaatgaggatgcaagtaggagtagtgaggacataaaataaatcgattattttccactgggccttaatatatcagaaccattggaatttacaggatgatatttattatagtactcaaaaaaatctcttttaaatctccttaactcagaagggaattttaaaaagtccacaattcacctggtctatgaattcccttttaaaataaaatgtggtttaatcaaatttacaagaaaaaaacaaacaaccccatcaaaaagtgggggaaggatataaacagactcttctcaaaagaagacatttatgtggccaaaagacacatgaaaaaaagctcatcatcactggtcattagagaaatgcaaatcaaaaccgcaatgagataccatctcacatcagttagaaaggcgatcattaaaaagtcaggaaacaacagatgctggagaggatgtggagaaataggaacgcttttacactgttggtgggagtgtgaattacttcaaccattgtggaagaccgtgtggcgattcctcaaggatctacaaccagaaataccatttaactcagccatcccattactgggtatatacccaaaggattataaatcattctactgtaaagacacatgcacacgtacgtttgttgcagcactgtttacaatagcaaagacttggaaccaacccaaatgtccatcaataatagactggatacagaaaatgtggcacatatacaccatagaatactatgcagccataaaaaaggatgcgttcgtgtcctttgtaaggacatggatgaagctggaaaccatcattctcagcaaactaacacaggaacagaaaaccaaacaccgcatgttctcactcataagtgggagttgaacgatgagaacacatggagatgggggaggggaacatcacacaccagttgggggattggggggcagagggagggataacgttaggagaaatacctaatgtagatgaagggttgatgggtacagcaaaccaccatggcacgtgtatacctacgtagcaaacctgtacattctgcacatgtatcccagaacttaaagtataatttaaaaaatgtggttgaaaaacaaaacccacataatacaaactttgccagcttaactgttttatgtgtacaaaccagtagtgttaactatacatacattgttattcaacagatctctagaatgttttcatctctcaaatccgaaactccaaacccactgaagagctcccattgctccctgtaccccagcactggcaatatgaccactctactttctgtctctaaagagtttaactactttagatacatcatataaaaggaagcatgcagtatttgtcattttatgactggcttatttcacttagcataatgtcttcaaggtacacccatgttgtagcataggaaaggatttccttctttttttgtggccgagtaataatattccgttgtgtcctataccacattttttaatccgtttatcaatcaatggacattttagttacttcaatttttggctattgtgaattatgccgcagttaatatgagtgtgcaaatatctctttaagatcctgtttttaattcttttggatatacagatgctcattgatttacactgggattacatcccaatcagcccatcataagttgaaaatatcatgtcaaaaattaatttaatatgcctaagctaccaaacatcattgcttagtctagcatactttaaatgttatcagaacatgtagattacagtacatctgggcaaaatcatcttgcaacacagtacatagtagagtatcaattatttatcctcatgataaatatcatgctgcaacccaatatgtcagaagagagtatcatactgcatatttactagccctagaaaagatcaaaattcaaaatttgaagtatggtttcttaatgaatgcatatcgctttcacaccattgtaaagtccaaaaattacaagttagaccttagtaagttggggactaaccgtacacccagaaatgggattgctggattatatgataattctatttttattttttgaggactggattatatgataattctatttttatgttttgaggaacttccatacggttttccatagtggctacaccttttcacattcccaccaacaatgcagaagtgtttcagtttctccacatccttgccagcacatgttattttctgtttatgatcgtggtcatcctcatggttgtgaggtaatatctcattgtggttttcgttcttcatttgcatttccccgatgattgacgatgttgagtatgttttcagatgcttgttggctgtgtatatattttctttggagaaatgtctatttaaatccttgcccattttaaaatcaggttaattgtttttggtgaattccttattaattactcacctcagagcctttcttcttaaaatacagatttctcagaacctttcatctaatttactaaatgttgatcttgaagaagtattttaatttatctgaatttagtttcccgttctataaattgatagtaatcatgttttccctatccacaccagagtggtatgatgaggaaccaatgcagaaaatgactaaaaaggcatttttatgctgtccagatcttgtgcaaatatattataattgatttgaaccaaaagaatctacattttaagactatttaatattgtcgcatttacattgcactaatggttcctcttttttctcactgatgaagttctagattgaaactctgaggaaactgtaaatcacagttacataactctgttatattaatttatataacttctctgtctctctctaaatatatatatttagactatatatacatatgcatatatatatttagagagagaacgagattacacttaaggactctgcttagtacattgcaacttgcacctcattctaattgtgaaaacaacaacaaattttgattgagaccctgttatttttcagacctttggtcttgtgaggaaggaaaagatgattctgatacttatctcaaatagcttatcatctcctctggtggatgaggcttgtgagggcctgacacatggtagaggatcttattcattatataacaactttcaaaacacatcactaattatttttctgcttaaggtgaaaacgtagctctcccaaacaaataagagatttagactgaattctgtagaaaacactgcttacctcattttgcttagttttcactgcagagtcttgtctctaacattcaggtaggaggaactctattttaaaaaattgaataaacaaacccaaatcagaataaattatttaattcaggagttttttaaggtgctcagaattttggtagaatagcagtgtattttctgtaataagaactacacaatgttctctagctggttatactcaaatggttatatggattttattctgatatcagttttgcaattgatgaccacccttcatcaatagcgtggtctttattatggtttcatctggctttttcttcccttgtcttctgcactgggctgcctacttcttggctcttattattacatactctacttttttcatatacaaaggtcttagtgcattaatagtgagtttctgctaaaagtgttactttcttcaaatatcctgtcaaatgctggctgcctgatttattgacctcatagagtgactatgtgaatcttccattctctgtggaattccattccacattttaacttaaagactccgtcttttccagctgtgttctctctgctggataagcatttttcttttaatttctgtggtaatgggaagggaattttaaatcctgttttgcgtacaagtgtttaacaggtaaaaatggatgctgtgtcagctatctattgctgtgtaacaagctaccccaaatgtagagacttaaaataagaatcattttttttttttagctcatgattcttgattctgcttggggcttggttcatcgaggcgattcttttgctagactcagctgtgctcattcatgcactcgtggtcagctggtagttgatgaccacatgtggcattcatatgtctggtataactttttggttataagttgagacggtgtgggtgacaggatcacttgcctgtaattattcatcaggctagcatagttccatagcggtggaagagttccaagcatagcccaacacccaagcattgttaagcctctgcttatgtcatgtttgctgatacctcattagccgaaacaagtgacttgaccaatccatattcaaggagtggagaaacagactatggctcttaatgggagaatctggaatatctcttgacaaaagtgtagatgcaagaggagaatctgtggacatttactctccagcagagatgttgtcatttttgtcactaagacagttcctgtgtaatattatttattattccttggcagccataagtttgtggtttacttatggatacttcagtgcctgcccaatatcatgttggaaagagaagcccttaacaatttctcttaatttctacttctgaggaatgagaaaaaaaaaattggataggcataaatgatttccagcacaaattctaagcagctatttgagaggtgggtgggtagggagagatggaaaatccttttaattgagacatgctcaaccataagcaatttttctttcctcaggagacatttggtaatgtcaggagacatttttggttgtacatctaggagggagctctggccagagatactgacaagcaattctgatcctacaatgcacaggacagccactcacgacaaaaaattatctgggacaaaaatgtcaatagtgctgagattgagaaaccctgcttttcactgagcgcatgtagatgaattcatataatgttagttatagaagggcacttagatgatgccaactaaaacaggaaaaggcaatgattatttctctattcaagttagtgaaggaaggatatgtttaaagtcaggttggagatatttctcaagggtaatatttaagttgtgagtggatgccagatgcgcttgattgttacaatccatatttttatagctatatcaaatgatcttctctcccaaattaaaatggatattagatatatttcatggataccatatattataagctatagctcttagaagtatttgagtgattaataattcttgcatattgaatgagacatgtaagaaagatacctgatgtcctatgattcttagaaatatgtgcagtggttaagcacattgtcttggaaacatcacttgttaatgtgagatcctgaacaagtttcgttaccttggtaaaagggggatgataacatctaccctgaagatggtttggtaaaggtgaaataaaagagggtttatgaagaaccttgcctagcacataagaatcactgagtaaatgatgggggtgatggcagtgttggtggcaattatcttacttgtaagtagtagcaaatatttatttggattatatttttaatagcaagaaagaatctattaaaatgtaagcaaatagcaccattaagctttaaaaatccatagctcccaaacttaacatttttttttcttaaatccagaaatacaaatggttatcatgaatccttgagttccagtactccggccttgcctatgtagagtacaagcatttatttttctaaaatgagaattattgatgttaggtgtgtcatatattttatttactctttagagtgacagaaaagaaagcagacaaaaataagtgtttatgtgttcatagtgtttgtttctaattttccaacttgtatgtgcagactgtaaatatttagagggaagacatgaaattcttccttacctacacaatagattgtctttcttagaatctagacatgatttcaaattttcttcagaagttctcttgaattcttacggaattcattaatccaaatgccatcctttcaaatattcaaaaagaaaatattctccaatgttgcttacatggaggagagttattttatctactagtgagatggaagtcgctaacaatctttcttataccccatagtattaaatagtaatgcaatttgatcacatataacattgctctcctgttgacatggaatgataaggaggaagggaatatctaacagcactttttagatattctctcatagaattgttaatgtgagcccaataacttattttgtaagttgagtgatttttcaaatataaaagtgaagcaaacaaaaaaagttacccacattcattcaacaaagctagaaatagagtatgtgcttcttgctttcttatcaaccaaaggagacctgtgaattacaggaaaaccatgtgtgaatacttcaaaggaaatatgccaaacacattgtgtgtgtgttttaaaagatttagtagctcctttaaagctctaagtaaagctgttagtctgactaatcatgtacccctgaaaccaattaaattttcagactagagaagtgttcttcaaacacttgaaaaaaataagagttccttcctaaagccaacaccttttaattaacaaaatactcagagcaaagctgtggtttgcaatagtatattacacctactgttattcatgctaccattctggtgtgccaaactcaattcatttcaactattttgagcttgattttctgtctgcttaactatggagggaaaaccacaattttagtagagtcattttaattttctaatgaatgcatgagaaaggtattatgctacatagtatgtcctcagactattcagatgccctctctctctcttgctctgtctctgtctgtctctctttacacacacacacacacacacacacacacacacaatgtgtgtatctatctgtctacctagatatacagtttaattttgtacattgtaatacatctggttctggcataaggtgattgagcaaaaaacaaacaaacaaaacccacccaaatctgttactggaggaacctttaatagcataacatcagaaagactattttcagtaaggaccctaggcaggaaaagacaattcctccaatggacttgagaagaatacccttagtctctgaggtggttagagaggctgagatctgaaccagctaataccagagccagcttcttgtaacccaagataggggcataagaaacggggtgaatgcccaggcatgaacagacttggggttaagattaaatagggtacacgggaaaggatttccgccagctggaggggaagccatttcccatgctccttagggatgacaacaggagacccagcccagaacatcattgaaaattctatgtaataatttatatatcctaactctttacccgttcgttctagattatggattcaggcactcttagcaaaacaaatcctctttcagtcttttaaaatattgacttaacaggaaatatccttggcacaacaatacgaccctgcctgacccttagaactgtgaacaggttgctcagactgtacaaaaccactaacaaatctgaccagcctacacttcactgaaaaaggtgatttgcatatatttctagtactatgacatggtggaaaagaaagaaccgcatatgtgttagataaaggtaaacgcatctgaaagtgcagtaagaatcaatgtgatatatacaataaaataagataaataggccgggcatggtggctcatgcctgtaatcccagcactttgggaggccgaggcaggcagatcacgaggtcaggagatcgagaccatcctggccaacatggtgaaaccccgtctccactaaagtacaaaaaattagttgggcatggtggcaaatgcctgtagtcccagatactcaggaggctgaggcaggggaatcgcttgaacccgcgaggcagagattgcagtgagctgagatcacgccactgcactccagcctggcaacagagcaacactctgtctcaaaaaaaaaaaaaaaaaaaaaaaatttcaggacttcaaaacttctgtcctttgaaacactttgattaaaaaatgaaaaaaatatatacatgcctgaatccagaggcaagtctttttagaaaacataaaatattttaagtaatgtttttctgaacagaaatggctctaatgtgagaggtcgatgaagattagcctcttgcttctttatgttttaaagtatattccttgagacccaaagtttctgactttagaatccaactctcaactactatcagctatcctctagacactttcaaaatcctccaaaacctaatagtggtgcaagattttgtccttcctagtgataactagatttaagtaagaaaacgttaaagactaaaaagtgtttaggacccacaagaaaggtgtaattctgttcctcatggagatattttagttacacacttcttattctggtcctccccaaaacacagaaatctagagttgacatttaaagagaaaatgagatttttgtctggaaacaggagagaaaaagttttcaagaagtatagaaagcgtatgaaaggacacaggtttgaaatggcctgtgctcatgagagaatgcacaatagacatgggtgtggaggagcctggaaagaatggagagaggtaagtctggagggtcaaatctggttcagagtacagagcataaaatcccatacgaatgtagaacatgaggagccaataaccattgtgtgagaaatgcaggaaaaagaggaagaaaaaaatccacatagtgtacttacagtcagaacaatcctaggaggtgacttacatgtatgatgtcataaaatccgtaacacaattccattagattggtactgttttcatagttacacaggtgaaaacttttgagggtcaagatgttcattgtagcaggcatagtataattccttacctcaagatgcctccaatgtcagtgaacattacttttccaagattgtctatttaggaaaaagtaaggccagttgtctatgaaggaagtactattataatcgccactttacagaggagtaaatggagattcagagaggttaagtcatctgactatagttacacagctaaaaaaaaaaaaaattatagagcaaggattcaaatacaacaatctggtcctagaaagcctaaatattctacaccctgctttctgattcagagctatttcctgcttttctcccttcgataggaaaaaaaatgtatgtgtgtggggttgggggcaaataaattgactggctgtattttctctctttaatatttgatctttcattgtctgctccaagcagtgggtcttcctccattatcttctcgtgaaaatagctaaaatcacctaactagtaaaaacctaggcatgttttgtgttctagcctccattcttccattctaatgggtggctgttaaattttagtactcattgtatgtagaagacctctaagttcactaaagagcttactgcacattgacttttctttagattcaaagggaatcaattgagcacctcctatactccaggacatgtgcaagatgcaagagatagagcagtgagaaagtctgataaggtttcccctccctttcccagcagtgtacagatagatgttcttcaggtggtgcatgctggagaagagaagaccagaaatactggcctgacgggtctatagatgagattatctgcccatgactggcgcagggatggccgcattgctagacctctccatcatcctctgaatatgcttcagctaatttatcatcccaatggcatatttagtcatcatgaaccattctctctttttgagtctcaggccctggccttgcttttcaatagacttccaatagattccttcctccttccttcccttactgcctggcttcctgacttccttccttcctgccttcctgccttgtcttgccttgcttttcaatagattccctccctccctccctccctccttcctccctccctccctccctgactttcttctttccttcttcctttctgtctttttccaaacgtgcttttcaggaaacagtggtctgcttgttgaagtctgataattctctagttcctcatccttcactttattgaaatttagtgtgacatgatcatttccacctcattaggtacttctttcatggtcagaagtaagtctggagaaaaaaaaaaaatctcttgtctctgctcttatttgagggtcaaattttcaataagtcactttttaaaaaagcattttctgacacttcccataagcttgaaatcctcctaaattgctgtatattgcctcagtataccttgtgtatctattttaggaacactccatccacatttgccagtcagcctggtgttctgcagttagttcctacagtgatattttaatttagctctcttttcatcctcacacatgcatcctctctggatatttagctcctttcctggaatcccttttaagatttctagatctttttgcttccatgatttcttctcctggactgtgacacaaaatgctatttcttctttacattacatttaattctttctagaaagagcctcagagtagtcagatagctttgagaaacaaaactttttctttattgcctcactgttactgcctttcaatcattgtttcgtgacacaaatttttttattctctctgacaattaaaacactatttttttctgtctgcattgatcaaaattagttccttcattcatagaaaactcttggtgtccctgagaagcttgagagacaagaaacattcttccattctactcatcttcttctctaatgaggagacaaccttaaaagcacagttacatagccataaaaattaatgattggctacctcagaatgaaaattcaatgtctcatttttttttaatattcttagaatcgttcactggttgtccagtgtgagtctcctgttgagatgtcttttgcagctttccttgaaacctttcattccaaactacatagtccaataattttgccaccaatcttctggttatattatgctcttgagtctgttgtctataaacttgattaggcattccttcccctcaccactcacctctgataacccagctgtgtgttggtatttagtatcaattcacaccagcaagttcagccctcttcaatcaatatagggccacacacggacttttgactgactactccccaagtatttcacattttggggccttatctccagtttctcaccacagttgttcatcactgtgtttcttactagccaggcgtttataaaaacagtaatacctaacactattgatcacctactatagtgtcaggcgctgtaataatattattgtgatgatgatgattatgctgctctttctggcattgtcatacgtgtattgcttgtactactcactgaatctacacaactgcccttatgacatttaccctgttattattcctcttttaaggtaaatacatgaaaaatgcttcccactttgccttgcttactgcttattgctagtactgaacaaatgttagaactgaaacttagagaggttatgtggctttaccaaggtcccagagttcctagggcagagaacaggattgtctaccagacattttaattctagtactatgcatcttaaccattaccataggctgacttactctacagtgtccaacactattcatattaagatttatttaatgactttgaaacagtatttcatgtctaaatagaaaaactactaactcgcatttttaagaaaatattgtatcttggtttttcttcactgctggccagtttactaacaatctgaaataaaaagaaaaaaatatgataaactgctcccagtataaaatacagagctaagacaagaacgtttcattggctttgatttccctagggtccagcttcaaattaatttacttcctattcaagggaattttaaatcagaaagaagatcttatcccatcttgttttgcctttgttttttcttgaataaaaaaaaaataagtaaaatttatttccctggcaaggtctgaaaacttttgttttctttaccacttccacaatgtatatgattgttactgagaaggcttatttaacttaagttacttgtccaggcatgagaatgagcaaaatcgttttttaaaaaattgttaaatgtatattaatgaaaaggttgaatcttttcattttctaccatgtattgctaaacaaagtatccacattgttagaaaaagatatataatgtcatgaataagagtttggctcaaattgttactcttcaattaaatttgacttattgttattgaaattggctctttagcttgtgtttctaatttttctttttcttcttttttcctttttgcaaaaacccaaaatattttagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggtatgagaaaaaatgataaaagttggcagaagtttttctttaaaatgaagattttccaccaatcactttactctcctagaccatttcccaccagttcttaggcaactgtttctctctcagcaaacacattactctcactattcagcctaagtataatcaaggatataaattaatgcaaataacaaaagtagccatacattaaaaaggaaatatacaaaaaaaaaaaaaaaaaaaagcagaaaccttacaagaatagttgtctcagttaaatttactaaacaacctggtattttaaaaatctattttataccaaataagtcactcaactgagctatttacatttaaactgtttgttttggcactacgcagcccaacatattgcagaatcaaatataatagtctgggaattgattattatccactcttctaagttgtctgtgccaatttgccttctccaatgataaggataattgaaagagagctataacttaaaaagagaaaagtaacaaaacataagatatttaaaattaccctagatcttaaagttggcatttatgcaatgccatgttcaaatgaacatgtttttaatacaaatagtgcatttttcagcctcagtgtaatccatttggtaaaattatgacatcaactagaaacattagaatacattgatgtaaatatggtttacctagctagatcaaatatactatatatcttttatatttgtgaatgattaagaaaaataatgttggaattgttatacattaaagttttttcacttgtaacagctttcaagcctttctaaagaaatacaaagttgtgctgaaggtatttaggtattaaagtactaccttttgaaaaaacaagaagtgaggcagacagagtaaggggaatttctttgtaaaataaacttcaccaattccataggaataaaagtaatttgatagtaaacaacctgcatttaaaggccttgagcttgaatacagaagacctgaattcagtgccatttgcaaatgatgattgtggtcaagccatctctggatcttcgtttcctattctgagtacagagcatacagagtacacattcacattcacaatatagttatggatatggatgtatataaatatatgtaaatactacatatatgtacctaaaatttgttttacttctgctttaaaaaaagtaattatagccacatttttcagaaaaagtaactgaggctcatagatgtcaaattcccagtaagtagcagaacaaggattcaaatccaagtccatttgattcctaagcttgtgttattacttgctactgcagagagtatacgtagcaagtaatatatgtactgcaagcaatacatactattgctgcggtaataactgtaactgcagttactatttagtgatttgtatgtagatgtagatgtagtctatgtcagacactatgctgagcattttatggttgctatgtactgatacatacagaaacaagaggtacgttcttttacaataccatattgagttatataatactcccaggacttttatttaccaaaggaaacaatattttataatgtttaaagcccaggttttgaagttacattgtctgggttcaaagcttggctcccaagctgtgtgaccttgagtaagttattctgcctacctgagcccaagtttatctagctataaaatggggatagttgtactatctgccttgcagtttgtcatcaggattaagttggttggtacatgaaaaatgcttcccactttgccttgcttactgcttactgctagtattgaacaaatgttagtaattatatttggttccaccacgaactctagaaatctaaccaatgatggcatttgtattatgcaaactgtatatcacatcataatattatatggaaatgagagcttgtttccgcttctgtagcctagtctaccattgacatagcttcctgcagaagttaccagataatagattgggagagaaagtccacacttccttgtgacgggtttgtgagtccagcatttagggaagccattgatgtgctcagtagtctccagagttctctaaataaatgtgtccttttcagaaaggactactgatttgatgccccctcacagagatcgtctttaaatataggtcaaaaactaatgtagagggccaggtgcaatgtttcacgcctgcactcccagcgctttgggaggctgaggcaggtggatcacttgaggtcaggagtttgagaccagcctggtcaacatggccaaaccccatctctactgaaaataaaaaaattagctggtgtggtggcccatgcctataatcccagctactagggaggctgaggcaggagaatcacttgaatcctggaccagaggttccattgagctgagatcacaccattgcactccagactgagtgacagagtgagactccatctcagaaaaaaaaaaatttagggggaaaaatcaaaagccatttctgagacacaaaaatacaggatttataaattatatatggtatatataaaaatatttttaaaatagtatatatagcatattatatataatgatatgtaatgttcatatattacatatttataaaaaaatctaatctcccttctcttgcttgctgaatagggggatgctttgcctgcctcttcctcttatattaaaaaataattcttaaagacattgtcagttcttggcttttatagcctcaatcaccaaattgtcggtaaaatggccctaaataatcattaaacaaatgtgtgtgagaggggaaataagaaggataagtaagtatggggaggattttgttataatttcaggaaatcaatatcaattttatgtaaagttttaaataaagcaatcccaactttaatgtttgatgtgtgaaaaattaggcaaaattccaaaagggctttataaactgaaaaaaactttactaacacctatccatttttattattttaaccaacttctattgagctgccactaagtacctgggaaacataaagttgtacaacatagaatgtgcaggtaaaagaggttgaaggaagaaaataataacactatgatagagataaattttaggataatagctaacacatatgatatgccagtcattgatctaagtacttcacgtgaattctttaatgcttacaacattactgtgaggtagatagagaggcacagtaaggataataacctgcctgagatcgaggaagaaagacaatgatgagatgtgaactcaggcagtttggttccagagtcctctcccttaaacctcatagttttcaacttctctgatattgtgtgggtgatgctgttggggctttcttcagggaaaactaagccaggagagagaatggatgctagtgagatattcctgaagaaggaaaaacttaagccaggcattaaagaatgagttggaattacctagctagataaaacgagaagggcaatccaggcagagggaacagactgtgcttttcactgaggtggaaaaaaaacagagtatatcagaggaattgtgattccatatggctgaagttaagggtatatgatgaggaagaaattgatgaggttgaatagagaggactggggctaaataatgggaatcctttgttgccagactgaggaattttgatgatggcctacaggcagtggcaactctgaaaggattgtaaacaggaaaataaaatcatcacatatagtttagttgcctatcaattagagctctctggatgcaagcaacagaaatcattctctgattaaatcaggcagaaagtaaatgtgctgtaattagcacaaaggcattggaacaaaacttacaaaaggaaaaagaatctgagcatgcctttctgggcatgtggctagcaagaagtattccagtctgtttgtgatactctcttttctccatcctgtgtgtaactctgttcaaattttaaagtcttaaaagagagtccagttcaccttgtttgggtcacatgttaatacatgagctagaagggagcagaaaactttgatttaaatccctctcctcccaaagtctcaaaattagggaaaggcaattctcctgaatagaaactgggttctattgacaatagaagaaggaaatgattctgaccaaccactaaacaataattgtccactgaactcagtcaagaacatgtagaataagttggaggatagagcaaataaaggagatttgtaggaggtaattattatgatctaaagcaagcttgttcaactcatggcctgtgagccacatgcgtcccaggatggctttgaatgtggcccaacacaaatttgtaaactttcttaaaacatgagatactttttgtgacttttttttgctcatcagctatcattagtgttagtgtattttatgtgtggcccaggacaattcttcttccagtgtggcccagggaagccaaaagattggatacagctgatctaaagcaacaggttcatctactcaacttcacaacgtgtagacctgaaataaagaccattcatataccaatacctgaaatataaatttgtttgaccatgacacgtacagtaattggttctcaataaatgtggatagcttgatggataatgtgaatgcaatgtgataaggaaacttcatattcaacaaagactggaatgtgaggattataattccaaagcaccagaagatagataagataatgcaatgagacattttatgactcaaggcaaagttagttatgagattcagaccaaaccttagacgtgcagtaattgaaatatttgccacagaaggggtataaggacatgacattcaagtaagctaacctttcactagctttagactttgaactcagaaaacatatttggtgaaaagcttatggtcccctttagtatgtattgcttgattaaagtattattttagaaaatggtgagctgcttccattttgaaataaaaataatttttactaagtgaattatattcagtgaaaaaaatggaagctacaattacaactttaatttttttaagttttaagaatacagccatttaaaaaaattaagcaaatctgcttcattttagacagtagaaaatataccattatcttttagaagaatagagatgtgaaatatgcaaattaagcctttagaagtaaagcacacatgaagttcaaagtttaatttctagaattgtgaatcaatagcagtggatgatttgtactttatagcttagtgtcggagaaatctgattaaaaaatgctttttctgtttcatcacataaacataagtaaaattgctctgaaacaacaatatttgacaagaattagcagttttcttttttgacataatctatcaaatgaagggaaaaatatgtcctgggttttgctttgagagtgattactaaatctgacccttaaggaaaggaaggagagaacaaagaagggaggaaagaaagggaaggaaggaggaggaaagggaaaaaaagaaggaagagaggaaggaaagcaggaaaaaggggaaggagagagaaaagacaaaagaaaggtagcaaggaaagaaaaaaagacaagaaaggaatattaaagaggacaaaagaggagtgaggaaaggaggaaatggaagagggatggtgggagacaggagggagaaaggtggagggggaaatatgaagagaggttcccagcagtggagactagtgttgctatcaacaaatagaatttagatggccatatgatattatttttcataatactggtgtctgattgcctgtgctgagttaattgtagtcttttttttcaattccgtttggccaggtgttcaggataattcaccacaaaatctcaaccactgcacttgtattgaataaagaattgagttggcaaaggcattttatcctccagtaagacctttccagattggggttgagacaaattggccaatctggacaagatgataatagcattgttcaagattaatttttaaccacacattgcactgttacctgggagatttcattatctaaaaattgaatgagcagttttagtgggtatagtgtatatttaaatgggacataattacttgaatgagtttaatttttgttgttgttgttaaggtcaaagtacttaaaaattatgattttttaaaactctgtctatacacaaaaagcatttgaattagctacagaataattctgattataacttttggtgaatagattcagtcaaaatctgattactaaacaacttgtgtagtatagccctggaagaattgatgggacaatgtgtgggtaaagtggcattggctatttaaactaaaagcaatacaaaacagaatgtttcttggttttattctgttgtcacaaacccagcagaaagtggctattacaatagtttcccttattcaacaaatgagagaagttatagacaatttagttaattgatctaaagtcacttagtaaatgtaattgtcctaacataaacccagacccccagacctcttgggaatagataatgtttcttacttcttttctatttcctcagccacccccctcaacttcttacacatctcatttctccatccaaattataacaaaacaaagcaaacatggtttatttccatgggcatcaaatggatttcacgaggttgggtgacagtcatcttagggtgaggagattgattattctgtttttctctttcatcgatcaacaatccagcccttctcatctcatcatttcatttctgcacaaacttgtttaagaaataccaattaagaaattaattaagaaattaatgttgtaatctgtttggctgaagatatttacaaattttgtgctttaattatcttccaacaaatgtacatgtctctggtagacagcttgcgaccatctggatgactgatccatatttatataattttctttctttacctaatgagaccaaatccactattatcttcaacgaaggatgtaaagatatgtcagtgtcagtaatgtgacttattttatattctctggtcataacaaaaataaaccgccccttaaataaaaaggtcatagagttgcaaacacacacacacacacacacacacacacaaaatcatattttctaagtctcctaattacctttttatggaaaatgataccatatgcttttttcttaaagaaactacataaacttataaactatactaaactacacatttcaaagtctatgaatggaaatgtgtatcttattatattttaattcaattcactgtaaacttttctgtcaaaatcttatcaagcaaaactgatccaggatatttacatgaattctgatggaagtcactgtactgtgttttccataaaataccagtgggattctgataaggaagtttatgtttgccattgtgtttaaatagagaattctgggccgggcatggtagctcacgcctgtaatcccagcactttgggaggctgaggcgggtgtatcacctgaggtcaggagtttgagaccagcctgaccaacatggagaaaccccgtctctactaaaaatacaaaattagccgggcgtggtggcgcatgcctgtagccccagctactcctgaggctgaggcaggagaatcgcttgaacccgggaggcagatgttgcagtgagccgagatcacaccattgcactccagcctgggcaacaagagcgaaactccgtctcaaataaataaataattagagaattctatttacaaatttcctttcttggatctagttagggctcctttatatggagtgatttttattgttttcatagaaatacgtagaatctgggtcttctctaactttcttacaggaaagcaatgtaataaggtttttttttaattttctgaaagttatataatgttattgttccctaaagtttaggacctgccttttaggctttccatttcaccataacttttggtccttaaagtctgtaattgaagttacagtgtgttatgatgtaaatttttcttattattacctttaatgttagggtaatgttaactaatgttaatgttaggtatatggttgtttttttcattccttcgttcaacaaattgtctttgaaacccatgttacaaagcactctagagtcaggttgaagactattaagaaaggagaatagaaagagacactagagtaataatttggatttaaatttgatttccttgtgtatgatagtgaataagtgtgaataagatgaggcagtgatcacacatcactattagtaaaagtgtttctgtacctgtatccacacttttatgtatatggttacttatgttaaagtgatacatattatataaaattaacgtatacattaagtagatattttaatagtctgtaattaaatactactagtattttctttcctccttcaagtgcttacttttgatacctcgagttacagtgtcataaagattctttagaaatatattgactgtcttttaagagcttttgatacaatactgagtttacattcatctgttatttattgaacacttgctggtgaaaggcatcagtgttatctgctcttagggaacaaaaattaaaaagggataggccctaattttagagtgtatcctctataagaaaaacataaaagatagggcagtcatggccacaaaagaaaaaagtgttatggtggtttcaatcatatatgtattagaatgaataaatcaactgatcaattgtgatttcttattctaaatatgtgcctgcctttttcatatagatgaaaattaagctatgtttatctttccagggatcttgttgatttttattcaataacttgggagtgaaagttgatttttgcatatgttttaatgtttttaaatttcataaatgaattgatcagtaatttccaaggtagtaatggctgcattgtttttgaaaaaaaaaaagcaacaggatttgattgtgcttttatgatttttaaagaattcattaaaaataatgccacggtttctaaaatgatttgagtcaatttcttattcgatttataaaaataactttgaatacaattttagtaattcacaaatgctttcagttcccttacctttatattttatattctgtgtaaacaagtgacataatatttaagaattatatatctcctatgatttattcaagaaaagaatatatactgtattatttatttcaagaacagaaatgctttgatttaactgtcatcttctctcttcaattatggaagcaaaataaactgtaatgaccaatgtaacccctcccccatatcaagttaatctatgttcaactccagaattatttttgaacactcaaactagaaattaaaaaaaattaaatccatgaagacgatttttgccaaaagcatatagataaattgagttgattctatacttaagaaagtggagaggagagagtaatttggagagagtaatttactcttaatcccatattttttccctaaatgtgaaagaagtagattgtagtgagagggaaaataacctgtagcaacttcattgaggctaagctttctgtcatgttatattatacgaaagtaatgaaatgcttccacagatagaatcagaagtcccctctgagaaattctacataaaaattagcctgccactttaccacacttactcaagtttgatttttttaagttatgtaatagatgttaggcactagaagaggacatttactgggggcaaagatcagtagttggaaagaatgcaagcaggcaagaagctatatataatgagattttacagtacaattgttttctaaatgaaaatgaggacgggtccagacacaatggctcacacttgtaatatcagtgccaggatggaggatcccttgaggccagaagttcaagagcaacctgggcaacagagtgagacttcatctctacaaaaaaatgaaataaaaagttagctggctgtgatggtgtgggcttgtagccttagctactcaggaggctgaggtgacatgatctcttgggcccaggagttcgaggctgcagtgagctatgatagcgccactggattccaacctgggcaatggaacaaaactccatttctaaaaaagaataaaatataaaactaaaataataaataaataaaaatgaggatatattttattttaacatttggaaactttgtaggtgaggaccatgcaaacattcaaggtgtgagttctgaccaaatccaattattaaccataccaatgacttaaggtttcttcacactccttaaagttgattaatataatgattatatagttgactggtatgtcacagcttgaagcctttgagatttattcctgccttttctgtaaaggttgttttgttaattccagtatgtactggtcgtttttgttttgttttgtttttgtttttgttttgtttttttgagatggagtctcgcactgttgcccgggctggagtgcagtggcacgatctcggctcactgcaacctccgccacctaggttcaagcgattctcctgcttcagcctcctgagtagctgggattacaggcactcaccaccacacccggctaattttttttatttttagtagagatggggtttcactatggtggccaggctggtctcaaatacctgacctcatgatccacctgccttggcctcccaaagtgcggggattacaggcgtgagccaccgtgcccggctgccaatatgtattggtctttttcatcaatgattcagtccaaaatcattttgtcctttaactatatattttcttgtaaagctgcttctgttgtcttgaacttttcttttcaaatgtatgttgtcatttgactttttagattgttattttctggtcctcgaaataaatttaaatttcctgtaaaggaaggtgtaatattctatttgacatagccgctaaagatgtactaggtgctttataaatattgttgatttactttatcttcacagattactagttttacttagtatttggaatatgacaacattttatagagctatattcatatatatgtttatcttaactgttaaatgcaatatgattcatgtcttgttttggtcaatgatgaatgaaagtctcctgagaattaaatttactgcatcgatgcaaaaacaatcataattttagacactctaagaattttagaaattaaaggattttttttttccagtttactctgttaagattgtgtttagctatgcgtgacagcattctcactacagtggcttatccagatagtttctttttctcatagagcaagacttccagaattatgtgttccagggtcagtgcagcacctccaaaaccgtatgtcccaactttttcctccaaccccagtcatctccaacatgagactttctttttgttttgttttgttgtttttgtttttgtttttgttttgagatggagtctctgtcgccaggctggagtgcagtggcgcgatctcgactcactgcaacctctgactccctggttcaagggattctcctgcctcagcctcctgagtagctgggattacgggaacgcaccaccacgcccagctaatttttgtatttttagtagagacggggtttcaccatgttggccaggatggtctcgatctcctgacctcatgatctgcctgcctcagcctcccaaagtggtgggattacaggcgtgagccaccgtgcccagcaagactttttttcctgtggtctcaacatggctactctgcctccaggcactatgtctgtactttaaaatggaagaagggaaaatggggaaagtaaaagcatattccagctgtgtcagctcctgtttgtaaggaaaaccagtgcttttctggcagccccacacagaagagtttctacttgaacagtgcattaaccagaaatgtgtcacgtgaccattcctaacttctaaggatcttgggaggattgagtgttttaactgaataggtgtgtttctttcttcataattcaaaatgtgaaaattggtaacttagttataaaaccttgctagtctgaacagaatttggatttttttagctaagaaggaaagaaagggtatcggataggcagctggctatgctagccaagatactcttaataatgcacatttttcttctttggacataagcagttttaacttagctaaatatgatgtgattgttttcctgtcttcttagttctgtttaaatttgtttcagaaatcaaggaaataaaatggagaaaaaactctattattcatgtctatctttctgcctctgaatatttttatgttggagaaagagaaagcagtaactttcataatagcttacatagtctgacaaattctaaacatgtccgttagcatcaatatacgtggtattaggtcatcagtttttatattctgaattattaagacccaaataaacccactgagttcaagagaaagtatacactgagcaataaaaacattaccagttctagcaatgataatcaaacaagaaaacaagtaatatagtctgtttagaataacatgttttaaagatcaagtttttcttccttaccaatgttgcctttcttgtaacacttttttttccttcttgagataggctttcctatcttttgtcacaaaccccaatatttacatggccattcgtagtctattcatagcagcaccaccccatggcccaaacttgtagatattgccctccttctatggttgttctaataagaataaccactcttgtctctcataatctcagctgttttgtgccgttaaaatggaaaataatgagtattaagatactaactaggggccaggcgcggtggctcacgcctgtaatcccagcactttgggaggatgaggcgggcggatcacgaggtcagaagattgagaccatcctggctaacacggtgaaaccacgtctctactaaaaatacaaaaaattagccaggcgtggtggtgggtgcctgtggtcccagctactcgggaggctactgcactccagcctgggcgacagagcaagactccatctcaaaaaaaaaaaaaaaaaaaatactaactaggtttcagtcatatgagatgaataagtcctacaaatctgtacagcctagggcttgtagttaacaatgttttatatttaaaactttgctaagagagtaaatctttttttacctgttattatcgtacatgcaaaaataatagtaaataaggaaggtaagagaaaaattttggaggtgatgcataggtttatggcatagattctggacatgatttcacaggggtatacagtcatgcattgctcaacaacagatatacattcggagaaatgcatggttagctgattgatcttgttgtgcaaacatcatacagtgtacttacacaaacctagatggtacatcctactatacatctaggttgtatggtatagcctattgctcctaggctataaaccagtacagcatgtgactgtactgaatacttcaggcaattggaacacgatggcaagtatttgtgtatctaatcacatctaaacatagaaaagttacagaaaaatattataatcttataggaccactgtcctacatgtatacagactgtgcacatgatagtggtccattgatcaaaatgtccttatgcagcacataactgtaattatctcgaaactcatcaagctgtgttcattaaatgtgtatagctttttatgtcaataaagtggttaagaaatcaataaagtggttaaaaaatattttgactaggaaatatactatcatttctagttgataaaagatctcaacatttccaaaattgtcctacagaaaaccaggttcatcaggtgttcatacatgatcctcatgaaaaggtcaaataagctgaaaaacatgcatagacgttgcctatcctagcaatctatgatgtacatctccatagtaaggtcactgaaaagtcttttaggaatgttagtattgttagctcagtatttctcagtgatttctccatggaaaccatttgtgtagagcatcttgaggagcacagctgagagaacattatcttagttggatgtgtatgtccctctgagtcacttgatttctctacatatgcttttaccaaattaatcttttagaaatcttttctcttcgcactatgtctataatttgtgaagttgttaccaggataacatttgtgcctctcaccatgatgtacctaccagggtccaagcagccattccttctctagagcaactgtctgagggaaagaatttaacacagcattctacgaaatcattttatttataaaaatagattactgctttacatatagtaatttatatttagaatattgattaattattaaaatctgcatgagagctttaaagagtagtacataatatatagcagtttgtactcaaactgtcttctaaaaaggattcactttttgtttgtattctattgtcctattcgttgatagtgttacgtaagtaattataaaacttaaaatctggaaagagaatgtggactcagaatgccatctcttttgttatttcaaatggattagaaatgaacatacatattcattttctttcattacacatccagagaaatagaatggattttataaatatgtaaaagcaaggattttgatcactgataaaaagggaaggtttggtcactaccttatttcattccttttttcttatccttttttttttttttgtcaattatttgatgacatctctgaacatcaccttttattcatgacaagaattgggtatcatggtaaagaacactgttaatataattcagttacttcaccccctcctgaaatatagagaagctttaagactatgtgaatatttttttctggttttcttgtatttgtagaaatagcatgagctttgtttaaagtcaggcatctaaaaccttgccctgtatgttattgacaacctgcacaaattttaggatctattctattacagtttgttcaactgtaaaactaggatagcaaactctatgtcatattttcgttatcagaatttaaaaagcatgttttaagatcttagtaaataataaatctctactctgtagttgaatttgttctatattctttaagaaattccctttgatggttatgccaacctctgtattacttttcttcacactttaactttgcgctgaaatcatagtagtattttacgttatcagtcaaaataacagtcatccttaaaacaaatatgaattttagatgattaaatagatttgtatggaggttcttcttgctaatcatagcagttatccttggtgaaaaatgatagacacttgaaaaaaccaattaatcatgatggctatttttgcatcataaataaagctttcaaatttgagagggaatcaaaagggcaatggtagtatagtgtctcaaagcccctttccaattgatggtacaaatttaaaaagagagagagagagagaaacatgtttcactgtaattgttttctaagagcttccaaaaaagcgtattttcttaatagattcaaatttttcagttggattgaaagggaagtcttggagtgtagtgaggagggcaccttctgttgagaggtgttcagacgacagagtgtgcccaaggccaaagatgagatggttttgcgaaagtcagtggccacaaacaggtgtgtttgacccctgagagatatgcaggaagtctaccccactttaattcttccaaatattctttaccttaattcccaagtacttgataaaggagcaatggggagaaaatatgcacactattatggaaaagttttgacctacactttggagagttttagattaagagcattctagaaatcagtcccaaatgcctagggtttacttacttaaagataatatcatagtttgggtgactgggaagcataccctgagattgaggtgagcatgcagtatgtctatttaggagtgttcttggggtcaacgtgtaggggcagagggagaagttgagctctgacgcagtcttagtaagggcctcagctgaccgttcagggagttcttaagctggaatgacccttcagaagtgctaggaaacgaagaaaggggactggatctttataaccccgtgtcaagtcatgcactggatgtgggctactccaggaaggcaacgaactttagcaagatgattctctttagccacgggaatttccataagggggctgctatggtctgaatgtttttgtccctccaaaatgtgtatgttgaaacctaacactcaaggtgatggtattagaaggtgggggtttgggggggtgattaggtcatgcgggctctgccttcagaaacaggatcagtgcccttataaaagcggctccagaaagcttccttgccctcccaccatgtaaggacacaccgaagatgccatttaacaggagtgggccctcaccagacaatgaatctgctgatgtcttgatcttggaattcccagcctccagaactataagcaataaattctgttgtttataaattacccagtctaaggtatttagctatagcggcccagactaagacaagggctgacagctgaaggctgtctaccagcagcactcctagcagctggggaactaagtccttcatttccaaaggggaatctaggcagcatatttacagcttttcactacagataagctcattatttcaaatagggactagcaggaaaaaattaaattgcccaaaatttagtgggatgctgaaatagattgtggtgtgtaaattggagtatagtgaggagagcaccttcaaaccagtatgtactacatgatattgtttttgttgcaatatttattatatacccaaacacacatatattacttttagaaacacacaccacatatatatctatgaatattttatatacacatagggaaggattgttgatgttatttatgctattttaaagatcgatgttttcatataattatgtattggttatatattatttcttgatataaggtaaaaaaaaaaagcaaaacaaactttaagtgatcactatgaaaagaatcccaatgctgcacatttaggtttatccaactcttcccattaaaatattaaatagtagaaataattgtgaataagaaagagcagattttgaaaaatggaaagaaatgcttaaagacatagcattgttgcccaaccatcattatttaaacatacagtgtttggctttgaccaaattgccttcaaacacttccttttggcccaaaatgttaggtcatatatactaccataaaattcatgatgcttaccatgcattaatttctagtatataccaggcattgtgctatgcatatcatattcaatatttctaatcctctcaaaagtggtacaagctaactggcgtttttcttgttttgaaagggagaaactcagagaggttaagtgacttgcccaaggcaatgccattgataagtgccagattctatcacaggtttattggcaacaaaccatatgtgcgcgtgcatgcgcgtgtgtgtgtgtgtgtgtgtgtgtgtacacatacacgaataacatatatggtataaatacgtggaaacataataaactgcattgagctgcgtttataattagtatttaggacatgtttggcaaataaaaacagtggagattgaaatggatttgcttaggaaaaatgatacattaaaataggctttattatgagtcttcaactattctgtgaaaatagatacccagggaagaaataatagagaatatgaatcttgagcaggcaactgagaacttgtcgaagagccaagataaaaatgtcagagaggagaatattttggcagctcagatgagcccccagagggtgggaggcaatgatctcaccgcagtctcgtatctgaaccccaggtttttgcatctccataaagtaatttcttacacccctcaataatgatcgggcttactctcaatctctcgctctctctctgtgtctctctcacgcacacaaacatgcagaacatttcttgcacatgcataactcataagacgattatgtaaataccagcctttttatttcataactaaattacaaggcctggttattgtttggactgtgaaaaaataattatgtgaataggtgcctcaagatgaaagacaaggcaagattgtgaaattattcatatgatagtaatagtatgcaaaaaataacacaatctttaaagatctttaacgacctagttataaaaccatgctttataacaaatataaccatgaggaaataaaaagaaaaatgtaataatatactccaagaataaagtcaaatgtattgttgaatgtaaggagttggttacacttccttatagtggaggttattttaaaatttgtggcttacgtggtgttatgaattgccctagatcaacactattatgcaaggccaactattaggttatttttggtagataaccacagcaaaactttagtataataggtaaaggttagctacactcccataccctcactctcaggtgttgtcatactccgtataaaaggttcaatcaagggagacatgagaatattccagaatctagaggcaggatgcagttaaccttagagaaggcatcagacaactagaatcttcggattcaatgtggaaacaaagcatagtttaggcattaaatcttgggcaccattccaaagaatacaggttccataacttactatatttttatacctagcaagctagagatgaggaattgctctcaaatattttaaccaaagcatgtatcttaagtaacactaatctcataagtgaaaactcatttctaatattcattttgctcattagcaaggcctctagtgttgactgtgataaaaaatagttcaaatgctggtagaacccaccccaggagactggcctttctgattaaattctaactctatccccacgtgaattcctgacttaagtaactgagttcctgcacatcagaatataagtatattatagatataaaaacatatgtaattaataaatattttaagtgagacacttctttcatctttatggcttaactatatcagacatttgattatttttagcggtctaactacaaaacaaaacacaaagcccacaactaaaaatttctttgtatatattgcaaagaggcaaccatttggtgtcaattcaatcatgagtgaaatgctattatacgagtacatctccctggcttgtatgggggtaatagggcatggaatttacagattcacaataactgagatattcacaataacaaagatatcaatatgtagcttttcccataactttgtgtaatgaaatcctcagtttgtgctgtgtaaaaagcttattgtttacttctcatgaaaatcatcttagtttttatctttatttaatagtctgtaatttgggggtaatacattcgttttgttgatactatgtgaagtggcaagcagaaaattctaacaggaatagataagcaagtatcctataaatcagagtcagtgtctctctctctctcttttaatgagtcagtctgtctctctctctttttccctgcctggctatctatctgtatttttcagttttgctttgcaaataagagaattgtgtgttgtaaaccaaccaacttaccattaattttctctgaattcaaaagcaattacaagcggactcttgagtttgtgctgcctggttgtctgcatataggccagatgtctagaataggatctttatttactatttttaccctcctaatttcatggtaactccaaggtagatgatatttgtaatcgtacactacttgtcagaaatctttctaataacactgctattttataaaaataaacattaattcagtataaaattttattttaaattgttaattcaagcaaatcagtgaggtaacttttacactgccgagcgtacgtgtgtgtggattagtacagccatgccatagacttcacttgtaatcttttctttatattttttatacacctgaaatgttcatcattgtgctgtagaaaacaatctcattgtgtttttaaaagctagagtgggtattgagaaggggaagaggatcatagaaaaagttggttaacatgctacttaacacttcaaatctttactcgatgtcatcatcagcaacattttaaatttatgcttctactagtttgcagttcttttcctttgattattcttatgatacaagcctttccacacaaaatttatgtacaggaattgtgtagaatttttctttggaaaatatggtgatttattacaatttgggcaacatcatcattttaaaaattcagaatttgatttttctcagaatcatcagaaagaataaagcatatatatggttcatgtcaggagaattagaacatgagaattaatatatctctgatcttttaaaatattttcatgtttgtgaatcagcagatttttcctagtttgagatttaaaaaatctagatataattaaaatctcactgatgtttcaccatcagatgattttatatttgtattttcttccacttcataacttgtatagagaagaatagaagaaagaaaaagggaggattgataatctttctctctcagttcttatagcacttcattttttaaacttattacttccttctgcctgctttgtttgtctacatgtttgtatttcatgatttcttagaaatccatctactgccattctgaaggtcatttacctgaaaatgatagaaagcagcatatattcaaacaactgcagagtaattgtctatatcagttatcattgttcattacttttctgttttaggattgaggggctgcctcgccacctccctcacacccccagcatattatcacaaagcctactgattcattcacatccctgggctgaatttgccacccactgtgtgttcctgttgttttgtgtatggaagtgaaaagatttaatttgatgttgttgaaaagacacagaggctaactttcaattttcatatgtagttcttccctctccctctgcaccacctcctttacttgttgagaaaattgccctctccatggtaacaatagaagaagctttcagattttagtagtagttgttgcagagaaaagaattcaaaaagtagatgaagtttaaaaatgaaaaagagagaggaagacagctgggaagaaggcttaatgtttatgagtgggtgtggaggggaagaactaagttgaatgaacaaagctgagctaaggggaagatggtttttctgcatcccagaaggcaataccctagcctttcctgcagccttcactccccaaaagataagagctttatctgaaattcttataggattcattcctgaagagcagcttgtcaccaaacagaaacactgtgatttcctcagggagtcacagtttattattatttttttaatgtaacgcttttgtgaactccagtttccacctcaattcaaatggtcttttggttacagggtgaaagagacccaacaatacacctttcccacttccggaggcctttggttaaaccatgtctgccacaaggacacaggagcctggtatgactggttgttttttgtttgcttttttgcctcctgtgctttctagattgtgagatactgtaactcttgtcgatgacacatagtaccgaacccacccgaagaagtatgtcagtatgtcacattgtgacaaacagcttctcatgctaagtaaatgcagaaccattgtgaaaggtttaataatgcccactcctcccccgccaaagatgtccatatcctaatcccaggaacctgtgaatatgttaccttacatggcaaaaggctttgtattaacagatgtggttaagttaaaaatcttgacacggagagatagcctgggttaccccagtgcgcccaatgtaatcacaagagtcctcctaagagagaaggaggtgatgatacaagcagagtaaaagagagattggaagatgctacactactggcattgaagatgaaggacagggccaagagccaagaaatgcaggcaggctctaaaagctggaaaaggcatggaaaagaatcctcccctacatcccttagagggaatgcaagctctgccaacacattgtttctagcttgtgagacccattttttggactttggacctccaaaattgtaagataataaatttgggttgttttaagccattaagtctgtaatcatttgttacaacagccacaggcagctaatacagccatgaacatttagtaatgactaactttgcacaattttaatacaagcttcttattaaggtttattttttcttaattacaaggaataaaagtggggtctgggggcaatgtcatggtccactccgttttagccatatgaatttgtatttccagcattagaacaaaaggtgacaaatctgaatgtatttgtgtgaaataataataaagcagaacaaaaagggaaaagtgtccagctggaaatgaagttagagaaagatgaggagaagcaagccaattgtgtagttttcccttctgctttttaaaatcatgatttgtttaacccactgaattctattttagaaacaggactgcaaggaagtgttgatggatttggtggcatgagaaccagagtcacagaggcaggaaagtaaggaataagtgttagaataggaagcagagttgcttgggaagagaccttatgacatgtggacagggctagacttaggagtcagaaagacctgagttcaaatgctatcctttagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccatttacacgatattgattcttcctacccatgagcacggaatgttcttccatttgtttgtgtcctcttttatttccttgagcagtggtttgtagttctccttgaagaggtccttcacatcgcttgtaagttggattcctaggtattttattctctttgaagcaattgtgaatgggagttcactcatgatttggctctctgtttgtctgtcgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttctcctaattgaataccctttatttccttctcctgcctgattgccctggccagaacttccaacactatgttgaataggagtggtgagagagggcatccctgtcttgtgccagttttcaaagggaatgcttctatagtacaaggctacagtaaccaaaacagcatggtactggtaccaaaacagacatatagatcaatggaacagaacagagccctcagaagtaacgccgcatatctaccactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaagggcaacaaaagccaaaattgacaaatgggatctaactaaactaaagagcttctgcacagcaaaagaaactaccatcagagtgaacaggcaacctacaacatgggagaaaattttcgcaacctgcttatctgacaaagagctaatatccagaatctacaatgaactccaacaaatttacaagaaaaaaacaaacaaccccatccaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgaggcactatttacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcattcataggtgggaattgaacaatgagaacacatggacacaggaaggggaacatcacactctggggactgttgtggggtggggggaggggggagggatggcattgggagatatacctaatgctagatgacgggttagtgggtgcagcgtgccagcatggcacatgtatacatatgtaactaacctgcacattgtgcacatgtaccctaaaacttaaagtataataataataataataataaaatctcaaaataattaaaaaaagaaacaaacaaatgctatcctgatcctaactggctggctgtctttggggaagttggtaatcttttctgtgcttatttcctcatgtgtaaaaaaatgaatatagtacccagctaggtagagttgttgttgggattaaatgatgactataaagcatctagcccagcttcggctacattatagctgcttacgaaattgtagttacgatgtaaaagagaaaaacactggaaaaggaggatatgggccattttattccaccttcaccaccttttagcttggtgaccttgggcaaattatgcttcattccgtgcttcattttccttgtctataaaagggtgtaagtacagaaccattgaggggtggtcattattaacctacctcaaatggtgtctgtaagttaatatatattgtgcttttcctatgtacaatatctagcacataattacaaatcaaatccatcccatgtgcaatatctagcacataggaaaagcacaataactagttattactcttgttgtagtaattgctacgctgtaggagtttgaattgtaaggcagtggagagtcactgacctttacgagaaagtgtagcagaacatttgagtagatagtaatggggaatattacataaatggatagatattaggggcagatattactattaaaatattacagcatggatatttattaaggccaaactggttaattagttgcatctctcaggttcctaatgttgcttaattttttaacctcccattttgtgctgccctttgtacgaatatttaatgctcccaacacctcttcagtagcacatgtactgtgagtttgttttgttattacttgtgtgtattagcattcctttgtgaaccaaaagcatggaattagctgttgcctctaggctacctagttttgtagtttggattgaagccttcacctcagtaacacctattctgtctactatcttacagaaaacttgtaaaattaagacagatcattaatatagcagaaagagacaaagggcagagaacattgagatactggatattggaaccacccaatagtgttgatttatttatgattatcagtttttgtctctgcctagcctcatgccactaaagtctctgaggcaacaaagaataagcaattttgctcaccttatacaaataaaacacagaaaaaggaatcactagagaaatggtactgcagcctttctgcagggattactgcttatttttaaattacttaaaaggtattgaaattattgttcataatgagaaacctgcctaataaaacagaaaattaaacttaacacttccctataatgtaaacagctcggttaggaacacaacattacagaaaccacttaagaattgattgtacttgttcttggagcagaactagaagctcaccgtttagaagctgtgcacatttccctatcaaacagtacataaagtttccatattcctcagaatcggcttcatttgtgccatgtgtttgcttggaactatgccacagaaagcagttctccccctcaagctgggctcctttcatgccgcagtgcaagtgtgtgatatactggcaccatgtgctaatgtagacccatttttatatgataagaattagtacggcctagggaatagacaagtatgtctaaaatcctccccatagaatatgtcccttcctttaaaagctgtcatactgtaagttccagctgagttaaaggccactgtgctcctatagggaaatatattctattgtaatttttacgttctccaataacagtctgttctttgtttactgaagagagctttcatgtcataaaatggtgttttttgacagagaagcagaatcattgttttattatagaaatttgctcttacaacagcaaaaataaatagctcatctcttaagctcctgatcaatgtctaacacctcctacccccagcaacacttcactgcaagtatattaacactctataatagcaattccactcacctaccaagaaatgatcttcacaaatgatttacagctaaaccagagcttaaacacatagcacccaatcaagggcagatttttatctttttcccagtcatataagttctgagaagaaatagattaatgttgatctcccagacaactgctgagaaaatgtacaaaggatgttgtttattttgaagaatgagacctagttgttaagcactttttccccttatatgtacgtccaaaggtaaccattacaccattttgatgcaaatttaggatatatatttattcatacctctcttctccattcggatgttgtctgtgtgagtgctcacagacacatgcacacatacacacatgcactcctgtttcacacttatttgtaaaactcacaaggatttccaagccattaatatagcattgtttaaggtgaacacatggttgttcaccatccatatgtatcttcactttgtagcactcagaatttggcaaaatcagaaggctgaaacctcatggattaaatatattctatataacatatgtcttaattgctgttactgtaaagaaacctggactagccatatttgactaatttctacctaaggtatttgaattcttataaatagattcattgctttaatcacacaagagtggtttatatgaatgtaattatctccactttatagctgaataaactgagcctgattctatccctatatgggaaacatgaattgaacagctgtgccaattattttgataattcaaatttcacatctaccatgtgaagacagcagaagagggttagggggcttgaattattctgattaactgtgttcatgagtgtaatcgcctctagataatcactcatttcttcacttcacttcccatctacaggtagtatcagcgaatggtaacatctcttgctttgcctcagtttattgatggctgccgttagaaataaaaagcatggttttgtttcagtacttaaatgaataatatcttcaaaatgtttttaaaacgtgaaaaggttgaatgcatttttaacaaatgttttgttagctttgacttttatttttgaacagatgagcacaataccccagtactcctttcctagaaataggagtactacctgaagacttatttcccaaagaaaaatatcaggtctagtgcagcaatacgtattaagggcattgaaaagttatattcacaaaatgtgacatcataacatatgttaatacttcttatcactgataataatccttgaagttgtatttccagagagatctcaatttcttctcacactctgaaagtctctgtttatcctttagagtaggaatgtaagaatttaacaaaacattctgaatgtttaccttttttctaaactgaaactacaatccctttttacccctatatagtaaaatataatattacaagtagaatcagcaaatttgtttaataattctttgggacagtttttacaagcaatggggttgaatttatgttccttgtgtgcagtggagttattatattcttcttaaaaagatgcatgaaggtaaattagaaatgttttacatgttttcatgacaggacatttaatcaaagaggagatacaagaggcttttcttgggttactgcaatttaattttccatttctttcttggaagggacattggatgcagttgtacgaggttaatatttctaacatgccacttttattgtggcattcttctgctctcaaacctctgatgatttcccatggccttcaacatgatgtccttatttgggcatctagtgttctgagccctcacattctggccccagcttcccttctcaacttgatcacagccatcgtaattctgctaactaattacacagctgcccttcccactctttctcaaccactctgctgtattctgacttctacactttagttttaaagctactccttgtcctgaaattccttctcccattaggtcattattaattgagttcatcctctaagttacagttcatgttgctgttcctctatggcaccttccctgaacctggtcccatataaaatcccatctctcagaatcccattagggtaggatatgtggtctgtagactattacgtttgtcatttacatattgtcttctattattgggtaactgcgtgtgcgagcatgcatgggctggcctgaaggtcacctccccaactgcattgaaagttcatcacaagttcaattatttcactagagagtctctttcatgtcatccatgaggcacattccctactgtgatgtgttatgcatacaattatttcaataaatattttctagctctttgattgaccaaagcttaattacctgtcaactctagcctcttgtatctggaatttctacagtctttggatagtatctttaggatgcaaaattaggaggagtatgtaccaggcaaactattacaaataatgccctcaaatagttacatttcactattcatgtcttgtaatttatcttctgctttggtattttagtacacttatgattcaatttgctgtatagattcctctgaatagggacaagagaattcgtcttgataagtggaagttcgaaggattccaaaatgatgttattcaaggtagaacaagaaattaatactgaaaaaattgaggagtaataatccccaaatatgtacatgcgtatctcgttttattgggtttcactttattgcactttgcagatatttcactttttgtaaattgaaagtttgtggcaaggctgcattgagcaagtccgtcgggcacaatttttccaacagcatgtgctcgctttacgtctctgtgtcacgttttggtaatttgctcaatatttcaaacattattattattattatatttgttatgatctgtgatcagtgacctttgatgttactattgtaattgttttgagatgtcatgaactgcactcatatgagatggcaaactttgtggggtgcagtggctcacacctgtaatcctaacactttgggaggccaaggcaggaggatcgtgttagcccagaagtttgagaccagtctgggaaacaaagtgagaccctgtctttaaaatatatatgtagaaaaattaactgggcatggtggcacatggctgtaaggagccctgccagctgcatgggaggctgacacaggaggatcacttgagcccaggaggtcaaggcggcagtaagccatgttcactccagtgccctccagccagaatgacagagcaagaccctgtgtggaaaaaaaaaaaaagacaaacattttttcaactttgattttagattcagggagtacatgtgtaggtttattaccttgatatattacatgatgccgaggtttggagtacaaatgatactgtcacccaggtactgagcatagtaaccgatagttagtttttcaacccttgtttccctccctccccactctagtagtcctccgtttctattgttgccatcattatgtccatgacaacgcactgtttagctccacatgagaacacgtggtatttggtattgtgtttctgcattaattcacttagaataatggcctccagctgcatccatgttgctgcaaaggacatgattttgttcttttttatggctgcatagtattccatggtgtatatgcaccgtattttctttctccagtctgccactgatgggcacctaggctgacttcatacctttgctattgtgaatagtgctgaaatgaggatgagaatacatgtggttttttagtaaagcaatttgttttatttgggctatatgcccagtaatgggatcactaggttgaacgatagttgtgttttaagtcctttgagaaatcttcaaactgtttcactgtggctgaactaatttgcattcccagcaacagtgtatcagagttccctcttctctacagcgtcagcagcatctgtcatttttttgactttttaataatagccagtatgaatggtgtgagacggtatctcgttgtggttttgatttgcatttctctgatgttgagtgatgtggagcattttttcatgtttgttggccacttgtatgtcttcttttgagtagtgtctgtttatgtcttttgcccattttttttgatggggttatttgtttttgacttgttgaattgtttaagttccctatagattctgaatattagacctttgtcagatgcatagtttgcaaatatattctcttattctgtagactgtctgtttactctgttgataaattctttcactgtgaagagctctttagtttaattaagttccacttgtcaatttttggttttgttataattgcttttgaggacttagttataaattctttcccaagtctgatgtccagagtggtgtttcctaggctttcttataggattcttataatttgagatctaatgtttaaacctttattccatcttgagttaatttttgtatatggtgtaaggagggggtccagttgcattcttctgcatatggctaaccagccatcccagcatcatgtcttaaatacagagtccttttcccattacttattttcataagatggcaaacttaatcaatcaatgttttgtgtgttctggctactccactgatcagccattccctcatctctcttcctctccttgggcctccctattccctgagacacaacaatattgaaattatgccagtcagtaaccctacaatgtcctctaagtgttcatgggaaaaaaaagagtcacatgtttgtcactttaaatcaaaagtcagaaatgattaagattggtgaggaaggcatgtcaaaagccaagacaggctgaaagccagacctcttgtgccagttggccaagttgtgaatgcaaaggaaacgttcttgaagaaaattaaaagtgctactctgttgaacacaggaataagaaagtggaacggccttatttttaatatggagaatgtcttagtggtctggatagaggatcaaaacagccacaccattatcttaagcaaaaggctaatctaaagcaaaggactaattctctgcaattctgtgaatgccgagagaggtgaggaagctgcagcagaaaagttggaagctagcagaagtatgttcatgagccttaatgaataagccctctctataacataaaagtgcaaggcagagcaacaagtgctgatggagaagctgcagcaaactatccagaagatcaaactaacatctaagttaataaaggtggcaatactaaacaacacattttcaatatagacgaaacagccttctattggaaaaggatgccatctaggactttcatagctagagagaagtcaatgcctggcttcaaaagttcaaaggacaggctgactgtcttgtgaggggctaatgcaactggtgactttcagttgaagccagtgctcgtttaccattccaaaaatcctagggcccttcaggttatgctagatctagtctgcctatgctctgtaaatcaaacaacaaagactagatgactgcacatctctttacagcatggtttgatgaacattttgagccctctgttgagacctacttctcaaaaaaatgtgtctttcaaaatattactgctctttgacaatgtccctggtcacccaagagccctgaggaatatgtccaaagagaatgattttattttcatacctgctaacacaacatccattctgcagtccttggatcaagaagtcacttcaactttcaagtcttattacttaaatcatacatttcataaaggtatagctgctatattgtggtgagtccactgatggatctggataaagtaaactgaaaacggaaagtcctcaccattccagatgccatgaagaaaattcatgattgaggggaggaggtcaaaatatcaacattatcaggagtttggaagtagttaattccaacactcatcaatgactttgagggtccaagacttcagtagaagaagtcactgcagatgtggtagaaatagcatgagaaccagaatgagaagtggagtcagaaggtgtgactgaatagctgtaatctcaaggtaaaacttcagcggatccagagttgctgcttatggatgagcaaagattgtggtttcatgagatgcactctactcttggtgatgatgctgtgaacattgttgaaatgacaacaaaggatttagaatattccataaacttagttgataaattagcatcagggtttgagaagattgactcaaattttgaaagaagttctactgagtaaaatgctatcaaacagcatcacatgctacaaagaaatcattggctataaaggagagccaatcgatgcagcaaacttcgttgttgtcttattttaagaaattgctacagccatcccgaccttcagcaaccgccaccctgatcaatcagcagccatcctcactgaggcaagagcctgtaccagcaaaaagattatgactccctgcaggctcagatgattgttaccattttttttaggagtaatgtattttcaaattaaggtatgtacattttttagatacaatgctattgcacacttgacagatgatagtagagtgtaaacataacatttaatgcactggggaaccaaaaatattcgtgtgcctcattttattgtgatatttactttattgcagcagtctggaaccaaacacacaatattccaaggcagtcctatatattgtttcatgtctctctttcttctaaaatgtgtgtaggagaaaaaattatatcacttatgttactgggccataatatcaaaagcctgcgaatctgatgcacatgataaaaactggtcttaaacctgtcttgattatcctttgttaatatgccaaatttatagaacaatagagtttcaagaaatgtgaacaatgtagaataactaaaagatctaacgttgaatagctaaaattatcaacgccctttatatcactttagaaatgcgtttgcaaatcattatcaacaaattgtagcataaaattctttttttttcttgactttgaaattgtatttcaagatccgcaatttacaccacattatttacttactggcttgtgaaagtgaaaggcattttcatttttggatgttaagggttttagtaaatgacaagtaaatcaatcctttaagttccgtgtggtataatagcttggaaaggaccatcttaatctttttttcaacacagggagataatttattttaaaaataacacactaatagtagattaatattattaccatttcaaagaagtcaccaaatttggtaggcttaagaggttttttttttttttttgagattactatgctctttttttattttatttattttatatttatttatttattttttagttttttaattttactttaagttctgggatacatgtgcagaacgtgcaggtttgttacctaggtatacatgtatcatggtggtttgctatactcatcaacccaacatccaggttttaagcccccaatgcattaggtatttgtcctaatgctctctgtccccttgcccctcaccccttgacaggccccggtgtgtgatgttcccctccctgtgtccatgtgttctcattgttcaattcccacttacgagtgagaacatgcagtgctaggcttaagagtttttttaactccccaaaatatcaacaaattgaaacattactacaaagaaatagagaaataaatttcactgactgtcttattgttttttaagtttgaatagctaataatgatttcttaaacagctatcatattttttatttttaaagctagccaaatgatcagtgatttttataatactgataaatactgcttagaaaaggaacatgtgttctagcaatttccacacatttctgattctaattacttgtttctttttgttttatttttatatttttaagttttgtgagtacctagcaggtgtatatatttatttggtacttgagatgttttgatacaggcatgcaatgtgtagtaagcacatcatgtaaaatggggtattcaacccctcaagcatttattctttatgttccaaacaatccaattatactcttttaattaatgtaaaatgtacaattaaatcattattggttatagtccccctgttgtgctatcaaatagtaggtcttactcattctttctaactaattttttgtacccagtaactatacctacaccacccccacctccccacgacccttcccatcctcaggtaaccatccttctactctctatgtccatgagttcaattgttttgaattttaaatcccacaaataagtgagaacatgcaatgtttgtctttctgtgtctgatttatttcacctagcatactgacctccatttccaacaatgttgttgcagatgacagaatctcattcttttttgtggctgagtagtattccattgtgcataggtaccacatgttctttgtccattcatctactgatggacacttaggttgcttccaaatcttggctattgtgaatagcgctgcaataaacatgggagtgcagatatctcttcaatatactgatttattttcttttgggtatatacccagcagcgggaatgctatattatatggtagctctatttttagttttttgaggaacctccaaacggttctccatagtggttgtgctaatttacatttccaccaacagtatacaagggttcctttttcttcacatacttgtcaacattggttattgcctgtcttttggatataagccattttaacgggagtgaggtaatatgtcattgtaattttgattttcatttctctggttatcaatgattcagtgatgttgagcaccttttcatatgcttgtttgccatttgtatgtattcttgatctgccacaagtctctaattacttgtttcttgtaccactgtttcccttcattgtagtcagtgatttggtcaatcaacactttttacgtatgggtatctgttaactgtatttctaggaatggaccaagaattgagaaatttatcccaaccagaaagaacaaaatctatggaggcacaggattactgaaagctttgctcctatagcctcagtttttttctgcaagttcgctgcttcccagttgtccttgtgataaaattcaaaacctcaaactgatttttaaaaagccaactatatactgcttctactatgtctacctaaacttatttgccattatttgtaaagaattccaggctctaaccagcccatttgaggctttattttacgttcatgcctttgttcatgtctgtctttcccttataatgctcttctcattctctagccaaatctgccaaagttcagctgtagtgccatacttgatatgaagtctttgctgagaattcccatatgtggtcatttccttcactgatttgtttcaatagttgttgccattattattattttttttatactgttgctggatactttcgcagatccaatctctaacctgttgttctaccctaggaggttgaccaatatggcagtagcattgggcttgcttgtctattggcttggtccttgtgttgggaggcatcagcagatcaatggatgagaggagagtgagtcgagggatggctaggttcctttactcacagccccagctcctgtcaagaggtcttgtccctgcagccacttctcagattctactaactataccctccccttagcctttcaggccttgaggaggaaagcctcctcatcccactttgaatgaactatttattgcaagaaccatgactgattcagaatataatctgtccttgaatgaaatagttaatttccccttttgtattctcgtttcatatccctgtccctttatccattcctatattatatcatactatcatatagctaccttatattatactatgacatgagtaccttgtaagtatatcatgctatattatagttcttaagtgtgtgggctttggggccaacttacctatgttagaagttctgccacttattaccatgtgatcctagacaaattgtttaacttctttttcattcattttctttactagtaaaataggggcaatattagtacccacctcacagagtaatatgataattacattgactgatagtttttatttaaaacttttattgttcttactatgaaatgggaaatgttctaaacaccttacaaatattaactctattaattctcataatgaatctgagaggtagagactcagtatctccatttcacagtgctggaaatgatacagacagcatttaagtaacatactgaaaatagtaaaccgaataggtggcagccagtatgcaaattgggaaagcctgactccagagttcattcttttaactagtatgctgtgatagactcttttggcatatggtatgcactcaataaacaactattgttgttgtcgttagcattacttcccattgtattattacacaaaaaataattgtttatgagtatttgtttgctagattataagttccttgaaaaaagaagacaagttttatttgtctatgtgtactagctgagtgcttggcaaatagttgcagtttagtaaatgtttctaaaacaaattattagttgtttcttatgtatttcccaagtctatcctagccttggaaacagctaacacttagctaaacctagaaatgtcatttgagatttcagcagccatcattgttgctgaagccacaggttctcctttttatctccaatttcttcctcagatgattcaccactttctttgtcgtttccctacttcatttttcctatagtgacttttgttctccaataaccattgatagtgatgacagtcccaccttggaaccacttctaactgtcctgttcagcttttcctgaggccagatttcccccaaaatacattttttagcttcataactgctccttccagaaatttgaaacgcattctcaggaattaagcaagaggcatttgattgacgtcatttaatttgtgtttaaatgtgttcttcccatcaacgattaaccagtgcttcagccaagatacataacttttattctccactaaccttagggttgaggtcacaatcaggtacgtaatctgtagagcccagtgaaaaatgaaaacgcagggcccttggttaaaaaaaaattaagaatttcaagatggcaacagtagagcatgaaaccaagtatgaatcccttctaatgcagatccttgtgtaactaactgcacaagttatacgttcaagaagctggtcctggttgaggtctttgtctacctagggcacttctcactcagagaggtggaataatcttaactttctgtcttccgtcatctgaaaacttgccccaaagttccttttgccatctcttgcagcaaacctagtggttgttatctgttaaggattcctggtggcttgctttagtttcctacagttcttgagctgcatgtgttgaatggaactccaccattaccatgtaacacatctgaatactcttattttcctccagttaaattctgcgctccttggaaataatggtcatgcaccctaccttagtgatttctaaatagaggtagtatgtaaaaatacatatttacttgaattgcatcttaagaggccagcccatgggaggcatgaagaaacctatgttactaattaatattcaataattgacagttacacattcaggtagtagtgtcatggaaccatcacgttacatggaactgaagagctgatgagaggtttagggtctaggaggacaaaagtgagtgtattagtcagggcctgaggttatatgtacccagacaggataaaatgggacaatattttattagtggaaatatctatgtgaaagaaaagaaggaggaagccaaggaaggtgcaagagatgttagatcaagatgcaattctgactctgcaaggaagagagagggagagaaggctaggcagaagcatcccagtgtgcggtctagtggaaggaaattttggcaaagctgttgggaagtcattgaggcagagccaggcaaagaagtcccatgtctcccaaggaaggctctctgccttagtattcccaccacacccaatcattgggtgaggagaagtctgtgagaagcttggctttggtgcagtgcaatcatggatttcaaaatgcagtaacaggagtcctcagtcagttaagacccaataatagaaggcctgcatattctcatggtggccacttgggtatgaggagcagtggtgtttaaaactgttttgtataatttaaataaagaaaagctgaggactacttaagcttgattccttcagaagacagtctttggcctttatatttcatgtgatatctttgccatatgctctgataactctccatgtttcccctaccataatacctcaggttgttgcaattgcttttttattgcctgtcatcactactcgtttgttttctctttgagaacaggaattattttctccttcactgctacagcccctgcacctagctcaatgagtgacacaacagaagcacttaaaaaattgctataactcaaatttgggggatattctacaaaatacctggcctctgttggtcaaaactgtaagtgttataaagttcaaagaaaggcaaataactatttcaacttaaaaaagactaaggagatacgacaactaaaagcaatgcgtgagtctggaccagaccaggaaataaaaatatagctataaagttcattaatggggtaattgtcatactctgaatatagagtatggataagattatggtactaaagccacgctaaatttcctgactttgaaactgagctgaggttatttaagagaatgtctttgctattaagaaataaaacctaaagtatttaagggtaaaggggcatgatatctgcaaattattctcaaatgattcagaaaaaaaatatatatatataaaacattacatatacagttatatatctatacacacagagagaatgataaaatgataaataattaaaaataatgtggcaaaatgttaacaaatggtgaatccgggcaagggttacctgggagttctttatcttgcaaatattctgcaagcttgaaattatataaaaataaaatgcatcttataaagtatttattcagtgaataaagaacaaaaaaggctaactgcagttggaagatatttatgaagttggttatgaagattcttaagaagttaccgatggaggtgctagtagaacattcaaaaaagaagtagggaaggttgaccaagtaggaaaatatcaatatccaagccagtataaaatggaaatgagaagtgaggaagtaagtggaagacaatgaggatggttttcgatttggccactctatttggagaggcagccgaatgcaagaatagaagccagaagaagatgctcagtgagatggttgaaagctagatagattacagcatcctcaccagtaaaaccctttcggtaactagaaaggctacaatttagtaccttcctgacttctatgcttattttcttcaatacataaaatggttccgtaaactcttttaccttctgaattctttatattaattttttgaagttgtaaataaaatagcatcagttctacattgttacatttcagcttaattcatattcatttactgaaaatgggaacatttgaaaaatcatcatgggcatttatgctatgtagattgttgatttttatagaaaaatataaaaatatgaccagtttgattttcaaagtcttttcttagacatgtaaatactaagcattcaactcaacatatagagtttttatttgagtattatttaggtggaattctattttaatgaatacaataaaaaattgtaattttgtctaaaagcctaaaatgccctagttataatatgtatgatttcactgtttaacttcctatttcatagggttgctatttataaccacttcactcaactctggggggacttagtgagattaaagacttctgattcactttgtatttgaagaattttttttcctccatctttgctcagctagtggaatccatgatgaattctcatctccaaggggtaagcagtttttagtaaagcccagtagctgacttatgactccttagaaatagcattgattccttccttctcctgtgttttgtttcctctagaatgatagaatccatgtagacacgatccattatcatgcttaggtactggtaagcatgtaatgattttagttttgttcgctttaagttatttgtgtcacaaatatctgggatcatatcagagaaataaataagcacaattagcattctacttgtttgttatgactaaagctaggttgaggaaacagaaaaggaccagaggtcatatgaggatgaagataatactaggaacagcatgtttgggagagtaacatctggtaggggtagcagattgggggcagagaacagaattttatagatggatattttggaggcaagtagtttgagtaatgattagatctaaggtgttttctcatctgtgggtggctcgaaggaatagaggtgaaggtcagtttatttgagaagttctggaattataaaactaagttgaagtcaaagaaagtatagtagcaaataaatagaatacccttaaaaggaaaccaaatgaaaaataatcgttactctcaccatatgcttgtgttcttattagcaagaaattcttttaaccactgtttttataatatcttaatgaaaaaatactgaagcgtatgccatattaaatccctctctttatttctagaaagggaatcaaaggagaaaattcccattctgctatactaaaagaccactaagtaaagagcctattagtgtatgataaatcccatagcaatatacattatcattttacagcttctttgttgaaatgaatgtttgtatgtgttgaccatagagtgggataaaaagttgaaattttgttttgaaatattttagaaatgcatagttgtactgcagttgtgaacctccttagatttttaaggaggctgcttcaaaggatctcattaataatcttctcaggtgcttacaaagcatgtgtctgtcagcagaattagagaatcacccaactagagaacaggtttcacaataccctgagacctattttgttcattagagaggaaaatggcttgttttgagtctaagttgacatgcttgctaatttcagcaataaaagctgttcattgtggtcaggtttaatttagagcctggtaaggttcagattaaagttgatcaacttacttttacaacatacttcttaaatgaactttgaaatcttaaaagaaggaaaaaagtatagcaaacagtgaataatgtatctaaaactgagaagcaaaaaaaatctggttatgtgagagtgaattaaaagaagaacaacccaataaagataatctttgttatataaaaatttccaagtatcgaaaagcacgatttttcatgtgagttacacactataccgaatatatttgtccactgccacatgcatagtccctagaatagtgcctagtgctgaaaaatatttattaaaatgaatggatgagtaaatgaatttatgtattttgccagccctgtgtatttaaagttctctgttaactttgaggtgaaaatttgacttcatctgaggtttctgggtaagtccgttttaaaaattctattgaacatattcaaacattttagggtaggcaattccaaagcaacctttcagcttcccatgtcacagatgaccagagtttcacattctaacactggaaaacatcttatttcataaaatctacctgctactatatggttcctactttaaaatttgttcagtactctccagctgacttatgccacttacttcaatagctgtctttggcaatttgttccatatttcaaacactctgttgtgtaaagaaaccataaaagttagaaacctgaaaattggattttttttctgagcaatcacagcttacaaatgtggaaaatttgttaaaagttagcccctccaatttttcaatacagagaggagaaagtgcctaaagtagatgtacaatgtttggaaaagttttttgcattattttactattaccaaaagcaattgagtttaaatcacaaagcctgtctccctacctcttcacagaagaaacactacagaatgatcaaaatttggcctttccaaaaccaaaattcgttagaaaatcagcaggagtcaaagtacagagtaaataactaagtttcatataagtttcagatacattactatctaccactttcatctcttcatcttcattggcctcatgtggtagaacatcatatttaaaattatacaaacttgctggcttgtttactagtgtggttattataagaaaaaaatgagaaaatatagataaaacatctgtcacatattgcttataaactaacagtaaatattacttgtattttccccaattaaaataaaatttactgagttttagaaccagagctagtcagatgcctttttttcataaatttcttcataaatacctctgagattgtggtccttaaatctagagagactaagatgacagagaaaatagacactgaagaaagggaagaatatcttaatgatttacattactacctataaattaaaaattgttaactttattatatttgtatttttatttaaaatagtgctatattaaagtcatttataatacaggggaataggaatactaacctgtaatctgatgctctccaaacttgcctaaatcataaaagttaattagataatttatttaaaatgcaagatttgcagccctttccactacatattcattagttctggagggaggcaaaaaggtttggtgattcttacggacaggcagcttaggagaaaagctgatttagctcgtctacttcaccttttcatttgacaggtgagaaatctcaggggtacaatgaagttaaataagtaatatctcttaaatcggttctgtgctttttctgtttttaaaataaatataccttaattttgacgtcacacagaatgatattataagtataaatagttatctatcttttaaatacattgtcgtaattcagaataacatttcttactcaaggcattcagacagtggtttaagtaatccgaggtactccggaatgtctccatttgagcctttaaatgaagaaaatctatagtcaagattttcatttgaaatatttttgatatctaagaatgaaacatatttcctgttaaattgttttctataaacccttatacagtaacatcttttttatttctaaaagtgttttggctggtctcacaattgtactttactttgtattatgtaaaaggaatacacaacgctgaagaaccctgatactaagggatatttgttcttacaggcaacaatgcaggatttggaacagaggcgtccccagttggaagaactcattaccgctgcccaaaatttgaaaaacaagaccagcaatcaagaggctagaacaatcattacggatcgaagtaagttttttaacaagcatgggacacacaaagcaagatgcatgacaagtttcaataaaaacttaagttcatatatccccctcacatttataaaaataatgtgaaataattgtaaatgataacaattgtgctgagattttcagtccataatgttaccttttaataaatgaatgtaattccattgaatagaagaaatacatttttaaatcaattcagggcttatatagttgcaaagcatgcattgatgggtgtggtgaccacagtgtggcagaacatttgtggcagaacatttgttctttagttgtcatctgggctggcatccatggagatgccagtctctccctcatatccttggctgttggtccaagcaggcagtggcttcttcctgggccatctttcattcccatgtgcagtgactttcagatctggatatctctccgctactttgatgcccccattttgtaatatcaaaaatcatcgtactgtaccttatgccgtagtagggtgggcaggaactttggtaagacccatctgactagacgctgtgcatattcttttcttctgacatacactcctatccatttaatggggagagtgattcgcagtgattgtgtgttgtgtcagtgagtttccatggggtcaggaagagtgacagacgaaggagtaggggaaactcgccacccggtttccctcagagattctcctcagaaatgaggtccaagtcagctctgctttcaggttctctcagatctctctcggtttcttcacttctctctaccttccttccctccagggacacacactggtattgaattttcttgcttcctctgcaatatcccctcattttccttcccacaacccgaagaatcctttgtagtgcaggaaggaggaaaacctttcagccatctttttttttctctttgaaatcttttgtcttttaccaggcttagacttttcaaactcggaaaccatgagagtctatatcttcataatttatattctgctatgttaacccttccctaaggaaatgactagttgtcaatatgttggggaaagtgaaagagtaaccagagtaaaaggttaatattttaaaatattattagtcatacttccacatattgggtaagtacttattgataatagctagtatttattcagtacctcataagcattagatggtgtgtgcacatgtgtgtgtttctgtgtgtttctgtgtgtgtgtacaaaatctttacagaatcttgtgagctatattttataatccccattttatagacgagaaaacaggttccaagaacagttactcggccgggcgcggtggctcacgcctgtaatcccagcacttggggaggccgaggcgggcggatcacgaggtcaggagatcgagaccatcctggctaacacggtgaaaccccgtctctactaaaaatacaaaaaaaaattagccgggcgtggtggcgggcgcctgtagtcccagctacttgggaggctgaggcaggagaatggcgtgaacccgggaggcggagcttgcagtgagccgagattgcgccactgcactccagcctgggcgacagagcgagactgcgtcgtttacaaacaagcaaagaacagagcttggaatttgtaaatgtctctttctgacttgaaaatctgcgctctttctagtatgtttaccatttcccatcttgttttgttgcttttgttaatgaccttaatcattgtactaagactaaatacttcttttgtctgaaattatgtatgttttgattcacttcctaaagacatgtcttctttcagttgtagtgattgctaattaaaataggctgttcttggttttgaaagtttaactctttattgttgcttaaacaatgaatgtggatgtatgctaatgtattatttcagtaacactagccactataacaggtaatctcccaaatcttggaggcttactacagcagaaatttacttcttattttagtgcagtccaaaataagcagccctctatgaagtcattcaggaacccaagctccttccatcttttgtgtccagagcataagactcatatgcatttaatgggcagatgaagaatgagtattactcatgaaaatttgtcatgagccacgcctggaaatggtgtgtgttaattttgttcatattctgttggatggatcttgtcacatggtcacacctaactgcgagggaattagggaaatagtgtacactgttgagcctaggaagaggaacagatttggtaagatagccatacaattgatttagcagagcattcctccaccatactggaaccttgagggttctccaacaagttgcaacacactgacccaaaagagtgaatcttagtgagtgatttactcaatatgagactgaattcccattacacaggtaagtgatcagtttcttgcctgagaaatatggaaatttggcagtgaggtttatgcaaatctgaacatactatacagagagtcatttgttattttactaatgaaaaatcacttcaattttttccctaagaggaagacaatatgaatgtattatacagtatttgttcaacattgtctgaacattttccattatcccctgcatttttttttcatattgcattgactttttcatgatagagattaaaattgaatgaccggagggcaagtttgtatctctctgccaatattcagtgatttgaatagttcttcttttctaagcttttgtcttttaggaatgaatacctttatgaatatttgcagcctagtggaaaggctgtaatccaaatggtccaagaaagcattttcttaaaagcaagtgtctgtcgagatgtgtcatagcgcttattaagagtctaagctggaatcttagttccaaatatgcctggagcctctaaatggtaccaggataattctgacaagatatgtttatctaaacaatgtcatttgcagccctgctacacttcagtttatctctccctttgaaatctataaaatgggatggaaattcaatactcataaacttttcgatcgtgttcaaaatagaatttttcttagtaaagatttggttttcaggaaaaggacagaaataaaatacttgctcataaaattgtattttctcatttgatgattttggtcttcctttttattgccatgaaacttctagaaatgctcaaaaagaaatcagctaaataaagaaaaaatagttaatatatgtatgtaatactatattgaaacatttttctttctctggtaaatcccatttcataactttgaacagttgggaaaatctatacatagttattgcagtctatcaagagaaaagttcagtacaaagctatttatgtctactagaaatattcatgttaaacttcaagtaattgggtgtgcaagccaccaccatgttttactatatgaaactattaccgtggtatctgttgtattcaggtaattatattgatggaaatcatgcagtaataatctaggtaagagagtaaattttgtctaaatcagatcaaatgaaaaattctccctctttctaatattcgaattgctcatttttctttaactctttggtgtctgaatttgtcaatcattcctggccattttcttctgcaaaagggctgggtcaggggaccaaaagcagataagattagaagaatttaaattttcttccttggaggcgtctgaattacatgaaactcttgttcgtgtctgttaatactgcaaggcataataccataataccttgcatagcagtgaagaggatttggaaagataaaactgcttccttttatcattctgtttatttcacaaacaatattggtgaatgtcgttcctgtaacatttggatttaagagccttgtttctgtagcttctccctccgtaacccccaccactaccatttcggggctatacagcaatagcatgcattactttaaaaggcaggctgcctagactggccacttgttagctttgtggccttgagcaaatgactaatctcagtaaactatctgctcttagtttccttctctgtaaaataggctcacttataactatctcatgggttgggaggattagatgaaataattaatgtagagcccttagatcagggccatagtaaaagctgaatgaatgttagcatttgttattttaattataatctattggggtgctttgaaggcttaatgcaaaatacttaatgagctttttggtagctgtttagttatttcgccccccaccaccaccccaaaaggagagatttaaaagaccgacaggagaaggttgcttggaaaagatggaataagatctataaatagaattaaacaaatattcaggaaagccttttgtgggaaatactgcaaaatttttattatctataaatttaataggtagataaaattactactcccattttagagacagaaaaccgagactcggagagctaacgtaacttgtctagggtcttaggaagatgacaagtgaggaagtagaattcaagcccacgtctatatgattttaaagcccgaggcacatcaaatggaaaaggctggttagtcagaaaaataggaaggtatatttatctgacaacttaaaatattaggactaacctcaggtaattatagtctggatatacatttttgctgctcctgtttatacttttgacttctgtgtatttgagtgtctaatcaaaggattgtcttttacatgtgttggagatgtacagactagtggaccccaatgatctattagctgtgtaaccttagccaagttaattctctttcctaaactgtggttctctcatctgtcatgtggggctaataatagtacttatgctggtagggtgattaagaaagtaaaataattggtgtttctaaagtaaatatgtggcacatattagatgctcattaaatggtacatattgttatggtgagatggatttggtacagagagaactggagatgggagaatatgaagggtgtataatgtggccttttattagctaaaccaagggaaggacttctgaaacagaattccaagttttaagagggagtcgtttattttggaattattttttcagctaaggatttttcaacccagtccagaattcttagagaaatttagtgatagcttataaattttaagaaaaggaattcacattatattgcataaagaactggtatacagggccatagaaggggagaatgttcttctgtatgagaataaaaaaaaacatctctcacacgatttttgaattaactgacagttttatagcagctttgtcaacccatcattcattgctgcaaccaaatctatgaaatccttcatggcgaaataaaaaggctctgttgttctccacatttgtatgaaatctctgttgctaatgaaatgccagccagtatcttcctctcaggtattgtctattagatggttgcttattttagaagaagtggagtcaaccatataaatttccttcttttgacatctagcacctgctgtcaacctgttatagctacaagcagctctcaaaattcacatccactaggatgccgctggcaaccaaagagttcagttcagttcagcgaacgtttgaatgcctactctgtgctatctaatatcagagatggtagaggggatacaggaaaaaagtaagattcagcctttgtctttaaagagctcacaatcaaatgtgggtatttggacaagtatatttaggcaaggcagtttaggataggtgcttcagtagagcagtattacaaaatgttgagagaaaactagaggaggagttttaaatgagggcttagtggaatgcttccaggaggaggctgaatttgacctggtcatgaataagactttgaaaagcagaaggaagctggagagggaagggtatttcaggaattgatgacaggagaatacataattagacctgttaacagtggggtggaagacgaatatcagcatgggagtgtgtgtgtgtgtgtgtgtgtgtgtgtgtgtgtgtgtgtgtgtgttgtggaggataagggagtaaatgaagtcagtaagaccagttagaaggcaagagagcccaagctggagcagtgaccatggagtaaaaagaaagaagtgaaattgagacataaggtggagctagaattaacaggattttgacattgattgcatatataaaactgtcaatctaagagaaggcctgcctctaagagttggagattgaattctttggaagattaatgtcataaccagagacaaactcaggataaggagttgattatgggagacaaagtaatgtgcttaacatgaagctagatgaccatactgagattttaaagaaatggttgaaaacatagagattgcaggagtgatgttacttttggacaagaattcaaaagttacctggaatgtctgagcttgcacagagagagggtacctggtgcaaagaaaagtgaacctaggaaaaagcctagaagttggtttacatttaaggaatttgagaagaggtagcaccacccaccccccacacaacccccaaccctgccaacttacaatatagaagcatttagacacacactgaataataattttttttttgagacagagtcctgctccattgcccaggctggagtgcagtggtgccatctttgctcactgcaactccgcctcccagattcaagctattctcttgcctcagcctaccgagtagctggcattacaggctcccaccatcatgcccagctaatttttttgtatttttagtagggacggggtttcgtcatgttggccaggctggtctcaaactcttgacttcaggtgatccacccgcctcggcctcccaaagtgctgggattacagacctgagccaccgcgcccagcctaaataatgaatttatagatgctacactgtatggtttcctttttctgctgctgtacaaccattcaagtaacataagtttcatcctggttcttaatgataccatgaataaagtatagaaactctttagctgaggattaaagattgttgtgtttaggtagaccaggtttctgatgcagccctcagtataccagggaaattagccattactgtttgccttgtaggtctaatgaaccctttagctttttattttgtatatgtctaagttactctacaaattcttatggaagtataaagagatagtgaaagacaatcttatgagaaattttaataagaattgaaatacaggctgggcacagtggctcactcctgtaattccagcactttgggaggctgaagcgatggatcacctgaggtcaggagttcgaaaccagcctggctaacatggtgaagccccatctctactaaaaatacaaaaaaattagccaggcatggtggcgggcacctgtaatcccagctactcgggaggctgaggcaggagaattgcttgaacccgggaggcggaggttgcactgagccgagatcacgccattgcactctaacctgggcaacaagagtgaaactccatcgtaaataaataaataaataaataataaaaaagaaatacaacttactttttgtatcaaataaattttggtgcacaaacatcataaatgacataatatctgtcacacatcctttagcaaaacaggattgttaaaattcttacagctaatattatgtggtgaagttcttcctgttgaataattaagtggattaaaatatcatatttcctttctgtcattagaaatatattgtgcattaatcagtccttgggcctgagaacatttatctaggttttcatcatctgaaaactcacagtccaatatttcacctgtattatcaattcaccattatcattagagtttagaatgctgctgtctctttccatctatcttctgttgtatctaataattaggagatatatatatatatatatatatatatagagagagagagagagagagagagagagagagagtgagagagagagagagattggtaataatactaatatatataataatattatatatatacacacatacagagagagagagagagagagagagagagattgattttaagccattaactcatatgattgtgggagctgaaaagtcaaaaatctgtaaaatccaaaagcctggcaggatggagaccaagggaagagttgatgttgcaatcttgagtccaaaggtaatccgatagcagaattccttccttttctggggacttcagtcttttctcttaaggacttcaaaattgattggagaaggcccacccacattgtggagggtaatctgctttactcaaagtctgctgattgaaatgttaatcacatctaaaaaataccttcacagcaacatctagattggtgtttgaccaaacaactgggaaccatagcccagccaagttaacacataaaatttaccatcatcagccatcatcatgaggttcataatgtcatgtgtttcttcacatataaatctcgtggttcttttatttttttagtagtacctagttaataaggtacctggaaatatacgttaaataatagaaatggtctttaatatcttaatgaatttcagagttctatcagagtaattgtaacttgtatataaaaactgatatataaaaaacaagtatgttttttcttcctatacgttgtgttaaattaatactaattacctatcatgaaatgaatgttttccatttttcataaatgtatttcatttttaaattaagaggattaatatcaaaacatatttgaataggatttaaaatccaaattacctgttgcgattatatttaattataaatctttcaagtgagtttataataggaaaaatattttttattaaagtgatgtaccataattatgaacataaatagtgttttctactaattgtttttgtcttcattatgtttctttttaaggggaaagatctgggttaacaaatgttttattcatccaccttgaaaattaaacataataaacaaaactattaaataaataaaccaattaaagaaaatagtttttcttccttttttgtgataaagatgattatgagtaaatatattaaagaattttatactcagacaaagtgagctaataagacaaatacaaacagagatgagcccagaaagagatactctacatgtttataggctagcatttttatcttatgacctacagggtcattgtaactaaagtcttgaatttctgttatattttggtacctgtgggcataaataggaatattactccctgatggcatcatgcattttagataaaactaagccaagggttaaacacgtgccatggactgttcctaaaaaatgctctcagctctcaagttatagaaaattgtagggattattattttgtacctactacttctttctttaccaaaatttacttatacatgatttgaaaattgcttgccacctgtctttattctgttgtacttgtcttaagtaaaacatttataaagtaagtaggaaggattaatagattgtgacctttctacatgaaaaggggaaagccgagcttgttctacttttgtcaggaaagagtttgaatagttacctgttactgtaaaacaatcaccccaaacttagtgtcctaaagtagcaataatcatttattatcactcataggttctgtaggtcaggattcatgcattgcttggttgaggggttctgtctcacgatcactcatgatgttgcactcagatgtcaattaggctgcagtcatatgatggcttgactggggctgaaggattcactttcacagtgagttacttgtatagcttgtgagttggtgctgtctagttggtttccctctaaacgagttcctccatgggactacttgagtgttcttatgatgtggtggctggcttaccccaggacaagcaacctatgagttttgccctgagttttctgaaacatgatcccatgttgctttgaatatccccattagacactcccacaaatgtcaatcatactctttgccctaaaagttgcagactacttgtacatgtcctttatcctacatgtgtacaggaaacacgtgcagaataacatgtgtttttgtttcttgaaagaaacaagaacccaccaaaactttatagctccgggacatgatgataattatctcaggtccactcagcctggctccacatggaaaatatgggtattgtaaagaaagcttttgaattttggaggcctaacaaaaagacctaggaagctaatagttggttatgagataattataacaatggtgatgaaagcaattgcgattattacttttatgttagtgagataaatacataagaatgtccttctttaatttcattccttaatttccttaatccccattcttgatttctggattagaggaaagctatactatctacctgattacacaaaaagactggactgaggggtaaccattaggactcttgttagttgaaggtaataaactatattacttcagtggctaaaacaaacaggagcttttttctcatataaaactagaagtcaggaaacaaatggttgctgatgttggtttatccgtttgacaggttctacctttatcctggagattctttggcctttatttctttagtaatatagtagtaacagcactgaatctaaaataagagcacttggtccaagcactggctctgcccccttagtgacagtgggacccatggcaaattatttaatctctccaacagttaattttctcatctgtaaaactgggatcctgataacttccatactagtttggtgttaggattcaatgaaatgacgcatggaaaagtccttttcaaatggctactcactatacaaatattaatgtcttagtaagctcaggctgctataaaataatgccatagactgggtggcttaaacaacaggcagttgtttttcacggttctggaggttgagaagtacaagatcatggtgctgacagatgtggttcctggtgagaaccttcttcttgctgtatcctcgtatgttggggagagaggtggtgcagagaggtactctagtctctcttcttgctcttcttaaaaggacactaatccaattatggaggcctcaacctatgacctcatctaacccttattatttctcaaaggccccacctccaaatatccattgggggttagcacttcaacatacaaattttagccggcgggggggatgccagcattcagtccataacaatcaactatcctcattattgagagttccactaggccttctcaagggttgacaatgatagtgccctgctagctataagagtaaaaaaattttcacatctagaaaatgggtgcacgaatattggtaactgttctaatgtctatgcacagaatttttagaacttgctcgagaaatttgtctttcctgacagtgttgcttctcttaaattccagtcgagggccttgaaaaaaataggttttccatcaagattctctgaatgaataaatgaaatgctctgatattttctttcaatattaagataaagcaaaatgtatacagaattttctattttcagtgtttccaattactgcatggtttggcttattaccatctctaagtctaaccctgggtcataggagtaaagccattgggggtcccctacaaaggatacaaggcagtggtagatacaataagcctgacaattggagtcagatttttctctttcatacaggaaccatggaactgttgccctgggccacagctggctctcagaaaaacgtagaactggtcgaggaaaggaaaggcagggagtccttgattcacttgttatcagaaaattgtctgttcaaacaacagaatgtttgaaaagataaaatcaagtctcaaatgcacagaataagaatgaggggaaaacacctttctctgtaattaaacagaaaagtgtgccatgaagtgataaaacccagtcaacctgaaaatgtgaacatcaagtgtaattgtgcagaacgataaggtaatatgaacagcacaggaatatataggctcacgttggcattttaaagcaatggcactttacctgttcctcatgaaggatttggtttagtctaatcccttgtaggagccactaagaggagaaggcacagtccttttgggatgtaaaatggggaattctttctatgattacaagaatttgtaaattgctcagagttttaggacagcaggttatgtgtctctcaatgttgggtaccatgccaaacgtactttaagagacatagcaataaatagaatgggattcatttttttcttaatgtctggcagggcaaccaaaatgcccacgtttcccttcagtagcttggtattttggtaactaaaaacatgttccagggaactccagaatatgaaacatttcagacaatttgaaactgtcaaaattttcacttctttatgggacaaataaaatctaactttattcagattttaaagtatctcataaaagagtaatactttagatttgtgctgtgctttatacgaattggatgaggaactcttatacatatataagtggattttattttcacaacagtccctatggtagatattgtccttattaagtaaatgagagaaccaactatcaaagatattaatattttgcataagatcacacagatagcggaaccaggatttaatccaactcctctgattctaaaaataggtgttagatgggtattctttccccaaacctatgctgaaaggaggctacatttggagtcagttattgaaagtttaaatatatgtgtatatatatatatatatgtgtgtgtgtgtgtgtgtgtgtgtgtgtgtattcttatatactcatgcatgtagatagttataaagtacatgcttatatgtcaattttatatatacgactgatatataaactatcaatttgtgatagtttatttcaattaagttcaaacatattgggtatttattgactcatgggacttaaaatttctcagaggcattaatttctatgcctttaagcaaaataatgtttagcccgttttagaaagataaaaggctaacatatgttttgtttttgtttgttttgttttgttttgttttgttttgttgagatggagttttgctcttgttgcccaggctggagtgcaatggtgcgatcttggctcacagcaacctccgcctcctgggttcaagcgattctcctgcctcagccatctgagtagctgggattacagacacgtgccaccatgcccggctaattttgtatttttagtagagacagagtttctccatgttggtcaggctggtctcgagctcccaacctcaggtgatccacccgcctcggcctcccaaagtgctgggattacaggcgtgagccacggctcctggccgctaacacatgtttttaaaaaataaacaccattcgagtaggaaaagtgggagaactggtggttcagctagagatacggagatgggagggcaagttgctttctcatgttgccacatctgtaagttacaaatgccatagattaggaatttcaacgttgttgtgtctctctgaggacattctccatgtagtatatgtttcgcctccctgatggacagtaagcatcaaacggttactcctttatatttgaattattttaattctaacatcttgttctgaaaataacgggaatgccataaatacttactgattgattggactgtctcgcaggggagctggcagctagtgtaggctacaagctgccatcatcatctccatgaccatgagtcatcactggaattaccctaaagaggttaataaaacgccttgtttgaaaagcaaacaaaaagccagaagaaacccaaagcaaacagacccagactttgcaatgggtagtgaattttcagtcttaagggattgagagtccttttagtacaatctctcataaacatataacagattttaaaagcaccttggtctgattccagttcacatacctcatccttgcagaatacaacatactaggccatttgaaatgttcctcagtttacttttggaggatctgctgatttgagcaaaatggaaatgaaatgtatatagaaagctcttaatttttttttttttttttttttgagacggagtttcgctctgtcgcccaggctggagtgcagtggcgggatctcggctcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccagctcttaatcttaagaagttcagtttcgcagctccccccccaccaacccccaatcttgaaagcaggaatttggattagggttttttaataaaactttctttttcttattaccatgatgttttttgagagggtacagagaactcattaaaatgttatgttataacttaagacaaaatgggaatgagaatttgcattatataaacaaagtgtatgactaagtaacctgttacatataaagtgtttgactaagtaacctgttgtccctaggagaagtagaataaatatcaacatgtggcaactaacagaatgtgttgtgatcactaaagcagcacattcattgactttacacttcattaagtaggtaacgaattttacaaattttaggacttaaccaggctgtccataatactttgcatcagtaagtaccaaaatctacgatagggcacttcggagttccttaatttaataatattgataatattttgtttacattttgatttaattgtatcatttcattatttttgtgtcctgattctaaatatatacgtcaacaagctatatggccattcaaaacaggtaaactttaaatatgtttttgacatagaaattatgtaacagtcttcatcatgagtataggagtcagatttccaattgaaaatttcatcctctaaaatacttggcatatgtatacagttgtctagttcagacaaaaaagtattgaatataaagttgattttgtaaaaccagaattggcatccttaaggaatacaaataaagggaatcttaagataatataataatgctgatttgaaatgaaaattaataaaattgttattctattttagtatgctaaattggacagatccttatttcattgaaaaattagattcttcagtatatcagtgcactgtgctaataacacaagaagattaaattatgtccatatgtgatttggtagaatttaattataaatataataaatccttcaatatgtacagcagtgaatattccaaatttatctctcatataagttgtgagcaacttaaggataggcaccatcccttaacatacctagattaagaacagtacctagaaaacagtcatcaaatgcttcctaaataaattttcaccttcaagcttatggcagcaaattaaacatagattgacccttttctaatagagacagaatagatgagactgatgacttttttttataaatgtgtaagtctgcaaatatttagtaaggatctaatttacacaaagaaatcaacctagagtgagattattttattcatttcccggaggctgtgactgaattatatttgcaacttgccctaatttttatacttaataatttgcattagtatttaaattatgtgaaggaaaaatataagtttaaaatactgaaaagtatattcacacattcatcaaatgttgattatgtgcttacagtgtgcaaggtattggggctaggaattatgtggtgttccaaggaaaccatgatacagcctctttcattacagtgtttattattaggtagaaaaagtaaaattagtataatattagataggatatatgtgtcataggagtaatataaacaatattttatgaacaatgtatgaaggtataattttgttcatttatccatttatcgctctgtacatccatccgtttattcattgttcattacttcatttaataatactttagtgaccattggaaaagggatttataaaagtgagtaaaatgttaatcattttctaaagaagttgataatctagggaaagacaaatgtgtaccaacaataacttggatataaagcataaattagaggtacaagcaaagaaaaatgaaagtacaaaggagaaaaatatttggctgcatgagagcagggactgtgtcttgtttcatcatagattttccagaacctagatcagtgtttggcacaaagtaggttcagatgagtttgtgttgactgactgtctactgaagtaattgtggaacatatcatagaagaagtagatcagaggctggatcttaaaactgggagaaatacatttcagctccgtgaaaccccagaagtgatatttgacattagaaagcacaaagtcacactctaacagtgacagtactgagtgaagtaagaattttctgcaccccttcttcttcttccactcccattaacccttgttagggtgagaaatagcagctggtgaatggtagagaagactagcaagacagaaagaggaagcccaccatgcccactaccccaggtagtaaaggacctgtccacttccatcctcttctaattgaggaagaaatcatatatgtgagttcagattgaagtattgattaatatattgagctggatattctaattttaatgtctcgatatggagcaggactttgtttccttaatgatgaccagaaaagacatgaaacttacccatattttcacccaagaacagaacagaacaacctacttgaacagatttaaagggagaaccaaaggcagataaagttgtctttattcttacacagcataagtcctgattattcatcaatttatacattttatgaatttaagaaaaaaggaaaggaagactataaagggattcatatcaggatacacatgaaggtaatgtagtcagttttttagtggaaccaaaatattacagtcatcactgaacgaaaatattacaatcattacatcattcactagattaagtgaataaattaaaaatatattaaataaaattaacaaagacatgagcttttcaaagtgtgtggtaacctggagcaataagcagtgtagttggaatgttacctcttaaggattatcaaagaggctggctgttcagtaggacagtggtatggtaaagcaagcttgctacattgcagaactccagagggcaacattctaattatctttagctatggggtctgttcccataggataactataacttagtaggttgacagagcctcccaagaaaccacagcagtgctcaattgtggcgaattacttctctatcccatcaaaatgtcgtgattggacccacaactgtgcatacatttttttggcattttcctgccagaagcatatttacatttctttaatatccagtcatatccttcccttatttaaaaataattattcagagaattccagttttttgtaatcctctcttctatgaattttagcaacacttatatacagatacttgatattctggagaaatatgcttcaagaccatgtggattaacagattttcaaatgccgttatagtatatgtatatactatatatgtataagtatgtgtagtccccaaaatgcgtactttaaaatcctcataatagatctcttacagatgaggaaaagaagatgtagaaaggttacataaagtagctaacaagtattccaaataatattgaacttcagtctgactattccaaaattgcattcttaactctgatttctatatttgttttccattctaaactgtgtattgtgatataagttcctcactaaggctctttttcagggtcttcctaatactaaagtcactcttacaatgagtattttctttacgtgtgaaatccaataggcaaaaaaaaaaacttggcaataaattttaggcattaacctcatgccaagtaattatcagaaggctgtaatgctttgaaacttcacaagtctgattttaagataatggaatgaggcttgcattgtgaactttcttgatgctttacattgcaatatgctgtatagattgacttcctaaaaataaaaaataaaaaaaaagatttgtagagcatactgggaaggtcttgccaattaaaaaccggagattggctgaaggcttgcagcaattgaattttgaatacagatggtgtcaaatcgagtgtttccatagcaacagactcttccttaataacttttagatgggagggggtacataaaagagaaaaccatcttttagcagatgtatgttttcagcatgttttcagattgattttggaagctaatttgtacttaactagtgattgttttaagtggatctaaatattactaaattctcctgaggaaacattttgagaataacagaaataaactctaggaactttataaagacatgaaaagggcacaattttacaaaacctttttttttttggtctggagccaatcaaacagtattttatattgagtatgacctatcaatagtcaaagagttcttgattcttaatgcctgttaatattgaatgtttagaatatgggtaaaatcaaggaaaaagtgctatgtatctcatggatttggaatatcttaatatactctttcttcaggttaatgattatttttaaaaaatgatgatataaatcatttcaggaaggactgcataaagaggtcattgatagagttcatatcatatagcagagttgtcgtagatttaatgtccaatcctcagttttgcatagccaacaactaaattttagtagtttacctagagatgatcaggctctgggagactgattcatgctacacaaactcacaaggcactggtttataaaccatttgaaagaagaaataataattcaaactattattttacaacaagactggcaggaaaatcaataatggtaatgtgttcggggtgtcctccccagtgaggactatccagaagaccaaatgatagattattgttcaaagtgatagaattgggagaagggtaataaagcattatgaaaggatgcttccttaagtgagaaaagctacataaactacccatctttactattctagatgaccttaaaaatattaatagaaacagagaaacagacaattcatctcagatggtacaaaaaacataatagcacatgtttgctccctggcttccttttagattccctgcaagaggttttcccccaaccaccaccatatacagatatacagctttaccttcactctcctattatctgtcacagaacaatataaaactcagatatgttagtataagttaatagttggtagctttatgttaatgacattgctacctgttacccccagattcatctgggttacttcatccccaaaaccctttcaaaacgacatttcccacaaagatttctagtattactggccattcccggacatcttgcttccaacataagaaattctgacataatagggatataagaaggccttgggaatctgtatttataacaagctccccaggctatctgaggctcagccagtttatttttgcagatagctattactatccacaatctcttttatcctattgtaattgcagaagaaaatctttctttctagtttctttgaaatttctggaatgttaggacttagagcctctaggaacttgtacataaaaagagagacttaaagagatatcaaagtagagatagagatagatacagataagtgcatagacatagaagtagacatatataatagaaacatatatgtatacatagaaatagaaatatgccatttagaactcttaagaaatatgtgcactcttaaaatatagtttaaaaatgtaaagaacttgctattaattgaaaatagcataataaacttaaatgaaataaggaccccaaacgcaaatatttctctctgacacaccacacacacacacacacacacacacacacacagacagagagagagagagagagagagagagctgtacaataacaaccaattcctgacccagataaagaaaaaatttttatttatcttctttctcattctattattattttttctagattaaattaaaatggtaattatgtgtaagaacaagcattattgccatataaacaatgcaacaaaggaatcaattgaaaattaagtgaaaataaaaggtacagcttcgttaaagacccagttcttagagcttagtctcaaactctttgtactctgcactcttttcttgatttgactcgattgattgattgattgattgattgagtcagagtctcactctgtcacccaggctagagtgtagtggctcaatctcggctcactgcaacctccacctcctgtttcgagtgattctcctgcctcagcctcctgagtagctgagactacagacatgtaccaccatgcccagctaatttttgtatttttagtagagatgggacttcaccatgttggtcaggctggtcctgaactcctgaattcaagtgatctgtctgccttgttcccccaaagagctgggattacaggtgtgagccaccacgcccagccgattttactctctttagaactgcaaaagtaggaatctagctcatatgcagacattctagaaagtttgatttcaaaagtcttctcaaaagaaagagagcaagagcaagaaagaaagcagagagagaaagcagaagataaaatggcattgtttgaacagggatggaaactgagtaagaaatttggtcactaaacactttagtgtctatcatttaagattgtaatttggttatttatcactggaaagtgattaataatctaaaatgcattttataatactaatactattaaaacattaatttttggagaaagtttattatagattgatttatacttaccactgaatattaaaatgtttaatggaagtagtttcaaatagtatttaatgatatagggaattattacaacattaatgctcaggaaaaaaagtaggatatggaattatttatgccataggatcctaattttgtaaaaaacagagaaaaccagcaaaagaaattataactggaaggaaatacatcaaagtggtttgcagttatcactcatgaaattgaggtgaacttgatttttttccttttatatccatccgtgttttaataccacagacatgctttagatctgcccgtatattgtggctttcagagggtaataaaccattgtgactcagaaatagctaagaatttttatctctcaagaacaaattttcactcccttggggtgtcattatctgttgagaatgcatgcaatagttcaagagccaaaagactctgattcagtaagtttagggtagaaaaaaattaagtacatttttaaaatagagctctggtgtttcaaaggcaatgtgcaaatatacctacttaatattattctaattttttcaggatagctgaaatataaacatctatttttagtaataacacaaatgatggaatgcttttacatatttataaatcattaaggatttgctttttgtttctactgtctggaacatataaatttgaacacaatttagaacaacattcaggaaatatgatttatttattaccttcttgacctttattttatttttaccatctacttttatgtaagtcttttttttcaatcattgtttatttctttacttttccttccacatagaattaaagggagattcgggcttagtgtccttaattcatagttccattgtggctattaaaaggtgaactgaaagcttgcaaacacgtggtaccttgtagataattttctccagtcagacagttagataaaggcctctgaggtttctggggtcattgttgaagctatgttttaaaatcctatatccttctctcattgttggttccttttcacaacacagaagttttcttttttttaatttcaacttttagatacagaaggtgcatgtgcagatttgtcacgtgggagtattgcatgatgctgaggtttggagtacggatcccatcgccatgttagtgagcatagtaactgataggtcgtttttttaacccactcccctccctcctccctctagtagtccccagggtctattgttcccgtatttatgtccatgtgtgctcagtgcttagctcccacttataagtaagtgagaacatgtgatatttggtagaacttttcatttttaagttaaaaaacaaaacaaaatgaggatgagtggaagaactattcagcacagcaggttataaaccaattaggatgatgacgccctgaatggagattttcatgaacatctcatattagctatttcagctttggtttttttaatgttcaaagtaaatagaataatgaagaggctatttaggaaggtttagactgagggaaaaaaatcctttcattaggttccaaataacggttagcttattaaacagcaagaggcagagatttagcagagaaaaaataaaaagatttaaaaaaaaacaacgagattaaaaggtcagtaataccattggaactggcagcatggcaagtttatatcagctatcttttgttttggaacacaactatgctaattctgttctgaacctcttgctaatgcctgtctcaagaaaatttaacatactttatctgtgtgtacaaaaatacctaaggacaaagctattacccaaactgtattcagattgaaagaatccatatagaaatttgcagctaacgtattagtcagtgtatgtaatttctactgcttcacagcacaactctttctaattttcaggagcaatatagcaactgcttgccagccaagagaaaaccataggagcattcttatcattggagccaacattagttctgcctacagtgactaacatagatgcgtttattgctagctggaattttccattggcactagttacatgtaataagttagtgctttcaaatggaccgtggaatataggaaaactagagtctgacgtaaccaaaaaaaaatgttgataaactcagagattatgaaagagaggagaggagtggtttttgtggaaatgatagaaaagcaaaaaaagatggcaggatttggaaaaaagaaaatcaggttagagatttaattagtaaaggagctccttttaataattatataagagtatgagtttagagtaactgcctggctaatatgtacaatcttcaagttcagtcgttttccaaaattctaacttttagcattttttttttgtaaattttaagtggaaatcttccacttttgttgactaacttggctacctgatattttactcaacctcctactttcttgttctctacttcttctgagtctttgcttccacaatgaggtagctcatattccttaagtttcctgtctggttttgcttttttttttttttttaacagctaaaataaactctacaagcatttctatcattttctttacatccaatctcttgtcagccatgtcctaatcactttggtaaagtatcagtgaccacccaagaggttcactttgcttcgtcaaaggaccacctgtcatgctttatctccagagcttctgccttgaaagtaagaataatataacctttcctgaatgtcttatttcaatttcatgcatttgatctgcctcttcagaccattcccaaggctttgcccttgttctttaccctcatggcttcagttattcatcactatatgaatgacagctctcaaactgacagctctggcctctcacctatttcatctattccatatggcaaactgtctatattacatttcatcatgagggataattataattccacattcaacaagaaattgtgggtccgtgttgatttccaacagcaacctttattttttagactatgatagagaaagggtcaactttctctcttacttatttatctcaaataactcaaagtcaagctagaaaagccaagcaagtaatatttcccaacaaagcagctttaagcaaaatgattttcagacacgacatgcagcctgtattgtggaagaagcacagtgacctaggtgtactttgctgaaaagcagtggtcacagtccattagtttcatctttttcctgcaagagagaaaagtatggcagggccaagactcctaagaccccttaaaaaattgtgaggtttttataaccctgttcatttcccatcaaaagcattcatgaagcacctgccatgtaccagatgatgcattctaggcagagggaagaacttgggcaaagtcctgtacattttatcttctaaatcttactaatcttttcttatctttccatctaccacccaccatcaggctgtgcctggactcctatgctaacatcttactctgtttttctgcatcttttttgccctcccctccaatctactctccaattagcaacatgactaatgttttcaagcccagattagacggtgtcacttccctgctttaaacctttcagtggattcccattgcactgaggttgaagaccaaaatctttaccataactcacaaggccactgggagctatgaaaattttcttttttagtttttccttttaattagtgatgcattcaataagtggagtctatcgtgaaagcatagattccaaaggcatgtgaatactcaattatgtaatttacttacagaatgtttattacttcttttttagctttgattttgtatacatcctaactcaatctcagttatataagagattataaaaaagtttgtgatgaatgcatacataaaggaacaaataattaacaaatatataaagacaaatcagtattgaatgaccaaatggctctttatttattaaagaacttagaaaaatatagtcttgcttgagaccaagttctggcaacgtatgtgtgtctttttgtttgggttaaaaagcattagttttatatgttttaaaaggataggatcttcccttggctgcaaatagtataggcaaaatgctattctgtatcttattttaaagaaaataacaatcataccttattatttgctgacagttttgcagtttacaaagcactgttcacatggattaccttattttaaattcctcaattttttttccttttactatgggaattctgtttcaggagaatttccctttaaaattaaggtgattatactattctgttcctgtatttcgtagccatatgtttcaccaaggtattgtctctctccaggtctttcttctctggatgtatagttatgattttccaggaggtaaatgaaaacagtgggagcaattgacagagtgttttttgtttcccataaacccaagcattgcatttaaggagctgctgtactattgtaagagttcctatactaattttaaaagttcatttacatattttgtagatttttaggataagtcatcagaaaaaaattaaaaataaatttacatattttgtattaagctgttttgttacttgaatggggattattggaacgaggaaagaattacttttatctccccatttttcaaatcatttactataacattcatgaattgctgaagtttaaacaatcaaaaatatctgaaaatggagcctaggaagggtaacttatgtctttcatactccttcctttttggtttttctaccagcattttagtctaaaatatattttattttcactgatcctgtgtttgtcttaataatatagtatgtatgttaaatgaaccagaattcattgatctttttttttattattcctctttttgcttttctggagaagcatttgaagaaatcagttcaggctacacttcatcaattcatttcctcatcttccccttaatacaaaagccccattttcactcttcaaaacatttgatcacatacttaattttcatagcattgactaaatgtatgtgtttattttgtttatatattgcatatttgtgatgattttcacttttacagtttaggcatgggtaggaaggacacttacatgagtacttaagttcttggttatgacttgagaaactcacaaggtagcatggaatggcacgtaaacaaggctttgatagggtgaaagggaattatcaggacaaaactgactagtggcagtgacttttgagcagagtgctgcaaactgaaaaggcagagagcattgtaggcagagagaaagcatagacacatgtgagatacatgtgaaatacttagacaaatgtgaggtgtgtggtaacattgtacatacctagggctccttcctgtgtagctgtaaagctggagtataggcatcacaacaggcagcagaagccaagaaactagaaaagtagacaaaggccacgttataaaagatcttgtaggataggtaaagagttttaatactatcctgaaagcagtgtggggtgggaggcatgacattaaggaaatttaataagtgatgaaagaccaagattttcatcttcagaagacttctctggaggtgggtggaccacttgatgtcaggagttcaagaccagcctggtcaacttgatgaaaccccatctctactaaaaatacaaaaaaatagctgggcatggtggtgcatgcctgtaatcccagctactcaggaggctgaggcaggagaatagcttgaacccaagaggcagaggtggcagtgagccaagatggtgccactgcacttcagcctggatgacagagggagactccctattaaaaaaaaaaaaaaaaaagacttctctgactagagttttaaagaaggatggggagtgcaaaaggctaacattaaatcagtggttctcatccctggctgcacgttagaatcactagggggagtttaaaaaaaatgccaatacttggactccaccccaaaccagttaaatcagagccttaatagggcccagacattcgtagtttttaaagcagccctcttgattcaaatgcacagacaaggttgtgttccgctgaactagagagaccatcaggaggcttttaactaaagcaatctagggaagagagagatgaatgatatagaggccagaagagctattaaggagaagtgactcggcatcttcttggttaaagtataaggaagaaagaagaatgaaggataatttgcatgtttctccttcagtgactaagtagaggaacagatgtgtatcagtgattaggggagaggaagaatgaagatgatgtaatccagtttggatatgttggctatttcatagagatttagtaggcgtttggctctatggatacagagttcaagagacaattcttagcttaaaacacagattttactctgattattttagagatagtaaatgaagcaatatacatacatgaactcaccagagagaatatgtaaagtgaaaacaaaaagatcaaagggagacccctagggaatagcaacatttaaggaatgggcctaagagagtgaggagtggccaaataggcagaataaaatccaagaaggaatcttccatattaatcaaaagagaaggtttcaaagagggttcgtcaattggcaggtactgaagggatatctgaaaacataaagactttagactctctaatactgtagcaactttaaggtcactgctatcacctacaaaagtaatttcagtggcaaaagccaaaacgtaatggtttagaagggtatgtgaggtgtggatgtggaaatagtgggtatagactattgcttctcaaaatgtaatcacctgaaaaatcttattttaaaatgcagattttgattcattagctctagagtggagcctgagattctgcatttctaacaagttatcaggtgatgctgatgctgctcatacacaaaccatcctttaagtagcactggtgtaagccactctcccacaaaggaggaagacatagggtttccatcaggggacgcaggtggggtgtaggaccaaaggaaataatactcttttgtcttttgtttggttggttttggttgttttcttcttaaaataaacatggttgtagacggagattgaagacataggaggggtaaaagatggaatcacttctcatagaagatggaagagactggaacattgagtacagcgagggaattaggcatgggtaggagggacacctaaatctgaagagaaggaggtaaggaagaattgaaatacagaaaagttctgtcagtaagcaatgtatggaattgtgctttttagccatagtttctgttcaagaaattgttttccatttatttttatttcttaacttgaatagttggatggtggagtatgcttgtaaaaataagagtgaggccactttgtttttcggggttaatttccgttttctgcactcatcaagtaaaagttgaagtggcaaggtgtagatatgaaattcagtgtgtgctaagggagaaaaaaatgctttttattctacatgattttaaaaatatttatattccaacaaatgcatcaaatttgatgtgcaaatttacagtgatgaatgagttttattgtgtgcattgcatgctggtgacatggtaataaatctgtggtgctagaattataatggtcccctttagcttcgctttaatgaactcttgctgaacacttttgagttgttagtactttatttgctacatttggcacttaattagttaatgactgagatgctggaccgatggatcatctaatgatatgttaggcctattatcacatctagatagtttcttttctgtgacttgtaagtgacctaagatgataaactgaaatatttttgcatagatatacatcaagcttttctcctaacttcaggctttcatcttaagcaatagtttccaacacccccaaaagagaagtcattatgtttttaaaaaaattattcattttaatgtgatcaaataatatcacatttcagcattcacctatttaattaataaaacaacttacatgtttcattatgactggatgttgatattttttcataatctattatcctccaaccagtggtaaaaacccaatcctcctctcacccagctcatctttccgtatgggaagcaatacatacttccctatgttttattaccaaaacaggagaatgagctttctttagaaggttaactcattttctctattagaatattcagcatacttttaaggaggtaatctggtctttgacagtctgttgattagaaaattaagagacctgcctaaattccatttccaactcctctccatacacattgtgactttgagcaaaacgttttgccatttccactcgtataagttctgtttagtatctttaaacttccatatcccacagatggtatttttttcttcattggaaagtggtgttagtgattcagaaaactgcttaaataatacactgctttgtgttttctgtgagagaatttttttttttttttgagacagagtctcactatgttgcctaggctggagtgcagtggcgcaatctcggctcactgcaacctctgccgcccgggttcaagcgattctcctgcctcagcctcccgagtagctgggattacaggtgcctgccactgcgcctggctaatttttgtatttttagtacagacagggtttcaccatcttggccaggttgatcttaagctcctgatctcatgatccgttcacctcggcctcccaaagtgctgggattacaggtgtgagccaccgtgcccagccgagagaacattttatctaacattctattttaaaatttttcaaatacacagaaagctgaaagaattgtacagtgagtgctcatgaacccactctctagattttgttgtatcactttacttctttctctacccgccaacccctattattttctgatgcccttcaaagtaagttggtgacatcggttccctttacccctaagttcttcaacatgcatgtcattaaccagagctcaatatttgttcacatttcttttgtttgtttgtttgtggcaaaatttgtatagactagaatgtgtaaatctcatgtgtattatgaaatgagttttgatgaatgggtatacctgtgtgacacatgcctctcttaagatacaaaaaaatagccttggcccagacaggagggaacattttttaggttggcttgagtttcctttaactgacatgtagcatgactgaatatatgaccataagattgccaagttgaaatttaccaaaggtccatccaggggaacagtatggctattgatacgtcatttgttcatctaggcactgggctgggtgagttcttcacaaaaaccttgtaaggtgagctttcagctctgacagaggcatcaagaaacgtatttcacaaactgttagagctgaaaacatctccagggatcatccaatctatcctcctttgctttatgactcaggatttaagaagccccagaaaagtccaacagtgttaccaaagtacacgattgcctatttacgcccctataattgagagctgtctaggggtcaggtacttttctcagtgccttgtgtacattatttccttttatctttctagattattaattttcttgttattatccccatataatagaggagtaaacagtgtgaaaatagcactaaactgttgatcttttccatgttccaaactaaccttaaatgttaggctaatattataaaattttaaaatttagtcatttgttctgggtctggcttccatgaacttaaccaaaatgcttggctgtttctgcattctagctttttgggatttagagaaaaagcaacttggtcatcatagtggccaggatttatttatgtgccaataactcccctctgtttttagctttttgatctgttacatctcagatactttattctctatttgtaaaacaaccacattcctccttttctatatctaagtgaaaaaaaatgcccgttcatactagctacatggttagcatatatgtttcttcctctttgtgggtttgagttgaaacttcttttgcaaagcttaactatagataggtcttccacagaaccctgtttaaatgccttgtggaagtagaagggacatatcttaatattccttataatctgtgttattatttggactttcctcagttccttatatgtctttgtatgtcaaacattgagttatgcttacattactctaggtatagttgtgtcctagctttgtacaaggttacaataatggtggtttccttgttttcagcttcattcttgatcatgcctaacattttttgatggttttagcctcggagaacagtctactgctatttctccctttttcctgatcccaacaaatagtttagaaatctttgtcttaactgcaattgggatcatttttcctttagagttgcccacagttagtcatgtccgtcactcttcactcactcaaatgacctcaaaagatttacctgcaatttaagcctttcaccttggcattttctacctggaactctggcgtactctgtgggatcagtgagatccatagtgtgcactccctagcagatcgtgaatgtttgttgataactataattcattgtttagtcttgtctatacagagaagcagtagcaccttgctttagtaggatcctttatgcttttattcattattgaattttatcttcacaataattctgtggttctgcagttgtcattatttcagtttgggagttgaggaaactgagatcgtggcaaatcaacttttcccatttaaatccactatttcatcgctaatccagggttataacccaagactaactgctagtcaaagttgctttctaaaaatcagttacacagacttctaattctcgtgctgtacagtcagtgcagaaattgcaacagaactgttctttgttctgtagcaatgtgtattcaaaaggtaatcatttcttgtgtataaataacattcctccctaagagagatgttgtgggaatttatatcagtcaagaatgtatatcgataattaaacatagctagtctaaaaaacttgaagtgaaagattggttcgtattcaatcaactgaactgtttctttctctgcaatattgtggttcttgacatgattgctgagtttccaatttgacacttctggaggttcgtaaatcaggacacatgctgggtctcagtctgtcatcctgagtcttagcattggttatttatttccctttattacccaacatctatttactgcacaaattagtcgagaagctttccatgacggacctttgtgagaaaaaaaaaatgtgtacattgggtagctcttcaattacaaacatgcacagattgtctgggtttatgtgcatatactttattattatttcacttttgtatgtcagatgaatttggtgtaaatgtaaatctaacaatatgggctctagtggccaaatacattgccataatatgtttttgatctgtcagtctcctgggtgaagtgtcgcaagtgtggtaaaattctgtagtataaattgatgctcagttatggacaattaccaggtctatatgatgtcagactaccacactgatccacttttaggataacagcttcgctctgatgatcttcagattttagatttgctttcattccttgacaaaatgaaatacatttaaaacttctaaaattgtcttttgtatatatttctgcagggtctactcttgggactactataacaatcaattgtactgctttgtttcttttattaaatagcagaatagctgcttgattcgtctgtatgtgctgatgtgtgtctgtgaatctagtccagttcactgtccaataagaatttctgaaatgttctttgtcacatcaatgtacagtcaaaatcgtattgtgtttgtagcagaatgattgcatcttttattattcacagcagccaaaatgacacatatttcacacgtgacaccttttttaaaaaagatgaattgtccaaagttgtatgtagaatatatttcacaaatcaaattccctatttaataaatggtgctgggagaactggctagccatatgcagaagagtgaatttctataaatagaatgcaactgtgtaaatagcatccaaatcaagaaacataatataatatagccagaagctcaggatcccccttcatgtcttctccagtcatgaacatttcacaagggtgactactatccttacttcaaaagttttctattactttttcctgtttttgtgtattatatgaaggaatcgaacagtcatatctacttgtctgtggctgtatttttccccccaacaatatgtttgtgagattcatccatattattgtatgtagttgtggattgttcacttttcttactgaataatattctattgataccacagtgtatttacacatgttgatatagatgagaaattgagtagtttccaacatgaggaaattgctgtcaacaattctgcaatccatagccatgctatcaacagtctagtacatggtttttggtgaatatattaataactatgcatttctgttggatatacacctgggagtggaattacaactcaaataatattcattttaaaaattttatttcgtttttagtcgacaactatattatggggtacattgtgatgtttcaatccatatatatacattgtggaataatcaaatcaggctaatagcatatctatcacctcaaatacttctcatttttgtggtgagaatatttaaaatcctcctttttagctatttggaaatatacaatatgacaatattagctatagttcctgtgctgtgcaaaagaacaccagaacttattcctcctgtctaactggaactttgtacccattgataaacgtctctcatttttccatccacccaccactgcagcttttgatcaccaccataatactctccatttctatgagttcaactttttttaaactgcacatacaaatgagattatatgatatgtgtctctctgtgccaagtttatttcacttaacctaatgtcctccaggctcatccttattattccaaatgacagaatttcctaggtttttaaaattttttttttatttttaattttttggggtacatagtaggtatatatatttacggggtacatgaggtgttttgatataggcatgtaatgtgaaacaagcacatcatggagaatgaggcatccatcctgtcaagcatttatcctttgtgctacaaacaatgtaattgtacttttagttattttttaatgtacaattaaattattattgactatagtccccctgttgcactatcaaatactaggtcttactcattctttctaactattttttgtagccgctaacaatccccacctatcccctacctccacactaccctttgtagcctctggtaaccatccttttattctgtctccatgagttcaatagttttaatttttagatcccacaaataagtgagaacatgcagtgattttcgttctgtgactggcttatttcatttaatgtaatgacctccagttccatccaagatgttgcaaatgacaggatataattcttttttattgctaaatagtaccgcatcatttatatgagccacattttctgtatccattcgcatgttgatggacagttagcttgcttccaaatcttgcctgttgtgaacagtgctacaacaatgtgagagtgcagatagctcttcaatacactccctccttttcttttgagtatgtacccagaagtgggatttctggaacatatggtcattctctttttattattttgagaaacattcatactgtctttatggaggccgttactaattcacaatactaccaatagtggataaggtttccttattctctgtatcctcatgaacacttgttatctttcaactttttgataatagccaatccaaaagatatgaggtgatatctcattgtgattttaatttgcattttttgatgattagagatgttgagtattatacatatatgtgtgtgtatatatatatatatatatatatatatatatatgctgtttgtcatcttttgagaatgtctattcatatatttgcccatttttttattagggttatttgttttcttgttattgagtagcttgagttccttgtatattttggatattagcaccttatctaatgtatgatttgcaaatatcttctcccaatctgtgggttgtctctttattccattaattgtttcctttgctgtgcaaagctttttagtttgatgcaatcttacttacctatttttgtgttgattgtgtttgggggtcatatgcaagaaaccactgcccagaccaatgtcatggagctcttctcttatgtttttgtagtttttagtttcaggtattacatttaaggctttaatccattttgagttgattcttgtataaggggtgagataagggtccagttttattctgtatgtgaacattcagttttcccaataccatttattgaagagactgtcctctccctattgtgtgttcttgctacctttgtcaaaaatcaattgatcaaaggtgtgtaggtttattttagtcctctttgtcttattccattggtctgtttttatgtacttgccatgctgttttgattattatagctttgtaatacattttgaaatccagtagtgacatacttccaattttattctttttagtaaagacagctttggctatccagggtcttttgtggttccatgcaaattttaggattttttaaaaaaaattctataaagaacaatatgcagattttgttagtattgtgtcgaatctttagattgctttatgtttaacaatattaatttttccaatttatgaacacagaaatctttccatttatttgtgtcatcttcaatttctttcgtcagtgtcttatagtttcaacacgcagatctttcactttcttggttaaattcactccaaatattttttcatgctattataagtgagattgtttccttaatttctattttagacagtttgttgttattgtacaaacaataacaattgttatcgctactgatttttgtaagttgattttgtaccctgcaactttactaaacttgtgtatgaattctaacagttttcagtggagtccttaggatttgctgtataagattatgtcatcagcaagaaggggcaattttacttcatccttttcagtttggttgccttttatttctttctcctgcctaattgctctggctaggactcccagtactaagttaaacaagggtggggagagtgggcatctttgtcttgctcctgatcttagagaaaagccttctacgttttactgttgtgcatgatgttagctgtgggcttgtaatttatggcttttattcttttggagaacatttcttctatacctaatttgctaagagtttttctcataaaaggatgttgaattttgtcaaatgctctttctgagtttattaaaatgatcatacggtttttgtacttcattctgttatatgttgaatcacatttattaatttgcatatattgaaacaaccttctatcccagggataaatccctcttggtcatggtgaataatccttctaataaactattaaatatggttcactagtatttcattgagaatttttgcatctaatttcattcgtgatattggcctatagttttctttccttgtagtgtctttgcctggctttgggatcagggtattgctggccttgtaaaataaatttggacgaatcccttcctctttagttttccaaaagagtttgagaaagatttgtgttaggtcttctttaaatgtttgtagaattctcccatgaagccatctggtcttgagctttcctttgatgtgagaacttttaaatactgatgcaatctccttaactctttccttagctgttactggtcttttcagatttccaattttcattattcagttttggtagattatgtatttctaagaattcatccatttctgttaggatgtccaatttcttggtatataattgttcatcgtagtctcttaggatcctttgtatttctgtgttatcagtcataatgtcttctctttgatttctgatttgatttatttgagcctgctctcttcattcttagtctagctaaggatttgtcaattgtgtttagcttttcaaaaaaccaacttttagttttattgactttttttctattgtttctctagtctctatttcatttatttctgctctgatctttgttattttcttctttctgctaactttgggcttaattcattcttctttttgtagtttcctgaggtataatgttaggtatttcatttgagatatttcttcttttttgatgtaggaatttattgatataaacttccctcttagcactgcttttgctacccccagaagtttttctatgttgtgttttcatttctgtttgtctcaagacttttaaaaaatttcctcttgaatttcttcttttgacccaataattgtttaggagcatattgtttagtttccacatatttcttaattttatatgatttctcatgtaattgatttctaattttatattgtggtcagaaaagatacacgatgggttttcttaaatttgttgagacttgtctgtggcctaacatatgatctatcctggagaatgttacatgtgtacttgagaagaatctgtattttcctactgttcagggcacaatgttctgtatatgtctgttaggtccatttggtctaaaatgtcattcaagtccaatgttttcttatgaatttttctgtctattgcttaaagtggaatattgaaattgcctgctattattatgttataggctatgtttcccttcagatcccttaatgtttgctttatatatttaggtgctctgatttgggatgcttatatacttgttatgtcctcttgatgaaataacctttatcaatatataatgatgttctttgtcactttgaacagatttgacctaaagattattttgtctgaagtaagtgtaactaccctgctctctttttgttctcatgtacatggagtatcttttttcatccctttactttcagtctatgcatgtcctttaaggtgaaatgagccacttgtaggcagcacatatttgggtcttgttttttgttgttgtcgttaatccactcaaccactctatgccttttgattggagagtttaatctatttacattcaaaataatgatggatgggtaaggacttactagtgtcattttgttcattgtttcctggttgtcttacagattctttgttcctttcttcctctattgctgtcttcctttgtgttttgatggttttgtgtagtagtatactttgggtcttttgtttttatcattcatgtatgtattataagtttgtgctttgtggatactccgaggcttacataaaacattttataagctgataataacttaaatttgattgtgtgcatatactcaacactttgactctccctcctcccacattttatgtttctaacatcacaacttacttttttttttaattatactttaagttctagggtacatgtgcacaacttgcaggtttgttacatatctatacatgtgccgtgttggtatgctccacccattaacttgtcatttacattaggtatatctcccaatgctatccctcccccgtcccctcaccccacgacaggccccggtgtgtgatgttccccttcctgcgtccaggtgttctcattgttcaattcccacctatgagtgagaacatgcggtgtttggttttctgtccttgtgatagtttgctgagaaagatgatttccagcttcatccatgtccctacaaaggatgtgaactcatccttttttatggttgcatagtattccatggtgtatatgtgccacattttcttaatccagtctatcattgatggacatttggattggttccaggtctttgctattgtgaatagtgcagcaataaacatacctgtgcatgtatctttacagcagcaggatttataatcctttgggtatatacccagtaatgggatagctgggtcaaatggtatttctagttctagatccctgaggaatcgccacactgacttccacaatggttgaactagtttacagtctcactaacagtgtaaagtgttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatatccttcgcccactttttgatggggttgtttgttttttcttgtaagtttgtttgagttctttgtagattctggatattagccctttgtcagatgagtagattgcaaaaattttctcccattctgtaggctgcctgttcactctgatggtagtttcttttgctgtgcagaagctctttagtttcattagatcccatttgtccgttttggcttttgttgccattgcttttggtgttttagacatgaagtccttgcccatgcctacgtcctgaatggtattgcctaggttttcttctagggtttttatggttttaggtctaacattaagtcttcaatccatcttgaattaatttttgtatatggtataaggaagggatccagtttcagctctctacatatggctagccagttttcccagcaccatttattaaatagggaatcctttccccatttcttgtttttgtcaggtttgtcaaagatcagatggttgtagatgtgtggtattatttctgagagctctgttctgttccattggtgtatatctctgttttggtaccagtaccatgctgttttggttaccgtagccttgtagtatagtttgaagtcaggtagcgtgatgcctccagctttgttcttttggctcaggattgtcttggcaatgtgggctcttttttggttccatatgaactttaaagtagttttttccaattctgtgaagaaagtcattggtagcttgatggggatggcattgaatctataaatttccttgggcagtatggccattttcacgatattgattcttcctatccatgagcatggaatgttcttccatttgtttgtgtcctcttttatttccttgagcagtggtttgtagttctccttgaagaggtccttcacatcccttgtaagttgtatttgtaggtattttattctctttgaagcaattgtgaatgagagttcactcatgatttggctctctgtttgtctgttattggtgtataagaatgcttgtgatttttgcacattgattttatatcctgagactttgctgaagttgcttatcagcttaaggagattttgggctgagacgatggggttttctaaatatacaatcatgtcgtctgcaaacagggacaatttgacttcctcttttcctaattgaataccctttatttctttttcctgcctgatcgccctggccagaacttccaacactatgttgaataggagtggtgagagagggcatccctgtcttgtgccagttttcaaagggaatgcttccagttttgcccattcagtatgatattggctgtgggtttgtcataaatagctcttactattttgagatacgtcccatcaatacctaatttatcgagagtttttagcatgaagggctgttgaatttggtcaagggccttttctgcatctattgagataaccatgtggtttttgtcgttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcgatgttcatcagggatatttgtctaaaattctctttttttgttgtgtctctgccaggctttggtatcaggatgatgctggcctcataaaatgagttagggaggattccctctttttctattgattggaatagttttagaaggaatgataccagttcctctttgcacctctggtagaattcggctgtgaatccgtctggtcctggactttttttggtttgtaggctattaattattgcctcaatttcagagcctgttattggtctattcagggattcaacttcttcctggtttagtcttgggaaggtgtatgtgtgcaggaatttatccatttcttctagattttctagtttatttgcgtagaggtgtttatagtattctctgatggtagtttgtatttctgtggtgtcggtggtgatatcccctttatcattttttattgcatctatttgattcttctctcttttcttctttattagtcttactagcggtctatcaattctgttgatcttttcaaaaaactggctcctggattcattgatttttttgaagggttttttgtgtctggatcttgtaggtatgcttcattgtttcttattatttttttcttttgtcttctctggctgtgtattttcaaataggctgtctgcctacaagatccagaaaatagcctcaaaagggtcaatctaagagttattggccttaaacaggaggtagagaaagagatagggatagaaagttgatacaaagggacaatatcagagaacttcagaaacagagaaagataccaacattcaagtacgacaaagttatagaacaccaagcagaattatctcagagactacctcaaggcatgcaataatcaaactcccacaggtcaaggataaagaaagaatcctaaaagcagcaagagaaaggaaacaaataacatgcagtggagcttcaatacatctggcagcagatttttcggtggaaatcttaggccccgggcatatccagagatgctgtctgagggccagtcattggagtcaaaaaccttagcagtttacctcatgttctattctattgtggctaagctagcactcacaccacaatataaagtgctccctgctcttccttgcccttttaaaaggcagaggatcctctccctgtggccctcaccaccatgagggttctgcttggcctccactggtgttcacttaaagcccaagggctcttccatcagcttgtggtgaatgctgagagaactgggacccatattttagggccttgggctcccctctggcccaaggcaggaccaaaaatgctgtccaagaacctaggccaggactcagaaatcccagaagcctgcctgcttctctgcctttctgtggctgagctggtacctaaggggcaagacaaagtcccctttacttttctgtctacttttctcaaacagaaggggtctttcaccataaccaccacagctgggaatttgctgggtgacctatgaagccagcacatctcagaggccaagtcccacagtgtactccctgggtattgcaactggttattcaacgttcaaggcctctttagttagtagctgatgaatcctgataggactgagtccttccctttaaggtagcagattcccttttggcccagggtgtgtctagaaatgctatccaggaactagggcctggaatgggggcctcatgactctgcccatgccccatcctactgtggctgagctggtatccaagatgcaagacaaagtcttctttacttttcgctctcttctccttaacgagaagtaaggagtcacttctgttgctgcaagcttcactgctgggagtaggggaggtatggtgcaaccactcccttagccatgccagctggtgtctccctaggtcatgtgggagaccctaatccactggcttcaatatatagagggacgtttctaaattatttatctgtaatttgattaagaagatagacacaggcaataggatatgccaacagattctctctaacctatagttattttaagaaagttagggaaagagaggtcattgattagttttggcttactgaattatttgaccctcccatatcttttaatttatggattttatataaggcacagatattctactagtaaacatgacattaaagatgttttatacaaatgaatgtggttgatacaaaggcattaaataagaaacaaaggaaattcagaggacatttgttcgcctggaatagagatcattagcataagcataagaggaaaataaggaaggaaatgggaaagtcttgagtccattttcaaattatgaaaacttgaaatgcaacaaacaaatagtggttacttaagaagaaagactgaagatgctgggcaaaggttaactttagaaatggcatttttatatcattataaagagaaagtggggataatggaaataatctacatgtacaactcatttgacagacatttattgaaggtattccaaatgccaaacactagtttgtgcactaaggatgtttttaatttttactttttactttatttttattttctagcttcttccgctttgccagagaaggatttttttaaatggataaaatactaacttaggctagcttctttcagaaacagacctttaaacaatgattaatggtgaaagtggtttggttgtaatgtgatcccaggaagtaccagtaggagagtgggacaatgagataataaatgaaagaagccaataattaagccagttatggaactagttattgctttgggccactggggtttgatcctgatgaaggagctctgggagatagtaaacaaacaaacaaacaaaaaacatgcctcaaagttgtcaaccacaagggggtaaaggcaaggaaccagggctaactattccaactcttatccatcattggctaaatgcttcctggtacataaactttccagcacttctggccagcgcacctagcaagctgaggaaaatctctcaggtttgcagtagggcaaatgcttgtactaggacactgctggcatatacttgaaggatgagtgccaacggcagatagatgggccctgacagcatcttctacagattctgtccttgcctttgaggcaaggacactgtctagagtcagagacagaaatgtaaaatgtaaaaatgtaaatcatagtagcacacagtacaagttttaaaatcttaacaaagtgttatgggagaaccacggtgagagaaaatgactgcacatatgagagcaggggaagtctttatatgtgatgatgacatttgagtgggtgttccgttatcaaagatctacttaaaagggaaaaagagtagaattattttaaaccatggatgtaaccaggcgtggccaccctatatgtgaatgtcctgggataattttgtccccagatgtctctctttttgagtgtcattttcatttatgtattcataatataaagaaattgaatagaaagaggtaaacattggtggcaaaaatcccttcctacccataaggctcacagaataatgttgtctaaatgccataacatttttggtaagttttggttctatgggctttggaaattttttatgtaggaactcctccaaggtgatataagcattcagtgtatttatctagataccctagttaaagctactttaagcaggatcaaagtcctcttttaaacttttgtatttgaaagctattcccatgtacaattcccatgattcttgtacaattcctaggagacctttgtttacatcaaaagagtttgtctctctctataagttagaacttgtacattgtagtaatggaaaatccatttcaaagtagcttagacttactcagacaaaatgtattgatcagtgtcattaaacagttgaaagatagacgaggcttgattcaggaattaaatagcatgaccagattctagttttccttctccattgcatggctctgctccccagtatttgttccgtttaattcctcttaattgttctaagatggatatcaggatactgcagaactacgtgctttctcatccatcttaaacaagaagcaatgggttttctcttttagaatcacgaacaacaacaacaacaacaaaaatcctagagttgtttcattggttctgattgaccttacttggaaccataagtccatctttgaattaaccactaaagccagggagatgagttaaaactaagtacacaccatccacagagcaaagagaggtctattgtgggaaaactgcacaaatggaaaaataacaggggaaacacaggagaaggaggtagttagttaatgttcaatacacgcaccttctcagggacttttcttccatctggcatcatctttgtcttttgaccattttccccaatcaatacctatattcatactcaagttttccatatttgggaaaaaacttctcttgacaccaaactcccctctgacttccttcttataatgatctatggttggatagtctacaatttactgtccttactttttcataggtattttttaatctcctacagtaagatttctaccactgcactgaaatcattttgtgtatggtcttcagggaattccatgtggccaaagccaatggatacttttggcatgggctttggaggtctaacttcttgaatccaagtgtcggctctaacaatcactatctatgtgaccttagaccagttatttaacgctgtctttatttcctcatttgttaaatgaggataattgcagcaatagaaaaagaacgtaaacaattatacttataggattgtatgatgattaagtgattaatgcaaggaaagaacaacacagagcttcagacagtgtagatattcaaataaatgttagttatgatttttattatgtcttgtgacatctatgagatttgaaagtgttaatcactcttgtgtttttgaaaatctttcttttccatgttctataaaagtacactttcttgatattcctcctccttctctagtctttcattcatcttatttgctctttgtgttttatttattctttttacgttgtattttccaggagtccattcccagcccggtgttgggctcagtctatgtgccatataaatgagaatgcacttgcatttgaggctttgctttttatttctctgtagtgacggccaatcccagatttctgtctctcccaaaatacacagctatgctatagatccttcagtcctcctgactaaaatgttagttttatgtgtgtgttcctcacaacctcccagtgaataggtccaaaactgaactcattatcttctccatgctcactctgcattctttggataggcagtgaatagcaccactatctaacaggcacctaaaccagaagccaggtaatctgtcttaaacccttttgttttccaagttcttatcataatggctggtgtctaacagatggtaaataaaatagagactagctggctacatggatggatgtgtggggatgcacagagggatagatggattattgagtgagtctctagcctataaatatttttaattaactaataaattatgataatgtacagttgaaggtcaagggtgaaaaagcataccctcagtgggatgcacaccccaaggagccattttaacttgctacataacacacatatgaccacttttttgctgaaagccttctattattgagcaagcattcaaatcccatgtttgcctgaaataatggttcaggttataaaagtttccttctttttccaggattaaaattatcttcctacataataggaagaactgctttatcttttcctaatatctagagatggccttttaaaaatatagactgttttccctattgaaatgaactgtaggatgtacaaaatatttactggcatgaatcaaaagagcttgctatgtttatgtgaaaaccactaggcattctaaaaaatattgctagcatagtaaaatgttagtaattaagactaacgaaagcgaaggcaaattggaatcagagactatttttaaggaatgtcaactgtattattttcaaatacacatggtacataacagtaggatatgagaaaaagtcccaagtatgtgtactaaagtagcctgctatgataagttgaaaaagggtttgtaattggaatatccacagaatatttcagaacacttaaagacattttcatttacactttatacagctttcttataagagcatttacaccatttattttataaaccaaagattaattagaagactaaacaattacaaggcctcaactacgaaagctgttccactacctagtggaacaacaacaatgagacacacaaaacaatggcgttcaaagattagagagagacttacggttaaacagaggttgacatgttaactgaagttgcaatataatatgtcgactagttttgcaatacatagcaaacacccaaacagaaataaacctgataaaaaaacagtagtctataatgtgtgccacttactgagttttaattattctggggactatatttttgatttcatgttacaatcactagttttgtggggtctttctagtcctgatgcttatttacaaaatatctgaagtatttctttctatgtatttatttttgagatggagttttgctctgtcacccaggctggagtgcagcggcatgatctcggctcactgcaacctctgcctcccgggttcaagtgattctcctgcctcagcctcctgagtagctgggattacaggcgtgtgctaatttttgtatttttagtagagactgggtttcagcatgtcggtcaggctggtctcgaactcctgacctcatgatccacccgctttggcctcccagagacctgggattacaggcgtgagccaccgcacctggccatctcaagtatttctttaacttataacttcacataactttgtggaggcaacagggttaattaaaaaggactttacttacataacaaaataagaagcatagttttatattcctgtgccatatacattttgtttgtccatctgtagccattctttgaccttctctcccttgctctttattctgggaggctgacctctgtcatcattgggctcccatgccctttggcttccagttggtttaggcacccaagagccctagaaggaaattgaagacaggaggtaaagtgaggtcaagatatttattctcctaattccctccctttgaggttgccacaggctgactatgtcctttgacaaaaggttattgctcttctcagggtggtttctcattccaattctctgcttttggccacttttccctcccctcatcccttgggcctagatgtagtaacagctctactgttgcaaggttcttgtattatctgtgatggtttcttataccctgcttatcttgtgatttgttgctttgtagataaacctctcagattatctaggcaagatcatagaagaacacgtatgtccagctaagatattccagaagacagtagggaaacattgaagggttttataagagggagtgcagtgatcagatttatgttagttttaatctttaattggggtagaatttacattctaaaacagagatttgggtctgggaggatgatatagagcctcttatggatgtgagggcaaaaaatgatagaggtttgcagtgccaatagaaagaggaaagaagttatatatgagagaaatttgtaactaattatatgaggtgttgggtgacgcttaggaaagaatctagaatgtctatcaggtttcatgcttaagggataaagtagatggcagttttattacttgttttctgtattatttttatttcataaaaccagcttagagaagttgcatagaaaaaataatgtagtcctgtttattttaatatttgaaaagaacatatttcagagtagaatctatatagtacctccctcttggacttccaatgataccagtgatagcctcaatataagccagtcttacaaaatgcacccagcgtgaattcttaggtattgttaaaagaagttggccaggcgcggtggctcacgcctgtaatcccagcactttgggaggccgaggcaggtggatcacctgaggtcaggagtttgagaccagcccggccaacatggtgaaaccctgtctctattaaaaatacaaaaaaaaaaaattagctgggcatgatggcacgtgcctgtagttcctgctactcgggaggctgagacaggaggatagcttgaacccgggaggcggaggttgcagtgagcggagattgcaccattgcactccagcctgggttacaagagcaaaactccatcaaaaaaaaaaaagaaagaaaaagaagaagtttctaatacacttatcttcccttgggttcactcagaagacccttggaaaaggttttaagagcaagtgatttatttggggggtaaattaatcagtagaagagtggaaaaatgagacaggtgaggcaaggcagccagtaaagagtggtgcattatcaagccagctgctgttgtgggtcactggagctttatcccttgggaaactctggaacccttgtaaaatacatgcctcagagttatttcccctagcatcaagggagctagtgtaacaatatcccaattcctacaattagtcattatatacaggctgcctctgggagctggaggggaggcatcagttgcctggtatgtctagcctgtcacatggatggcaaagcaaactcctgtggcaacagaaagccttcaggcaatgaaatgctggcactgggaaatcaggctgatgggtgctgaagtggcaaggatgaggggatatggatattctgctgtagtgcttttctaacagatgattcatatttggttctagggatcaagaattgagttaaaattttatatatatgttgatgttctatgtcaccttcaggaaaataatttaacagaaactaatatttgccatcaaaaaagcaaagaatcctgttgttcatcatcctagccataacacaatgaataattttttaaataagcaacataaatgtgagataacgtttggaagttacatttaaaatgtctcctccagactagcatttactactatatatttatttttccttttattctagttgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaaggttagtatcaaagatacctttttaaaataaaatactggttacatttgataaaattataccatagattgtaatttaatgatgtttaatgtaaagttattaacagaaaatcacgttaaagctgaaatgaacagtagactttgtatatttattttcttagagacagagtctcactgtcacccaggctaaagtgcagtggcacaatcatagctcactgagccttgaactctggggctcaagcagtcctcctgcctcagcctccctagtagctgggactactagccaggcgtgtaccaccacgcctggctaattttttaaaaatttttgttttctgtagagatgggttcttgaactcttggcctcaagcaattctccttccttggcctcccaaagcactaggattacaggcatgagttagcatgcctagccagtagacttttgagtcaaggtagagaatagaggaaaattgacagctaatgtcaatgttaaagttaattttgtttagtaatctggatatagttggctggttttctgttgcaccatctttaagatcacttcaaaattggtatacgtatttatgtagttgcatgaagtcaaccattcgggcttaattccttcctagaaaaagtaacaggtctactctttcatatcttatttggaggccctggatcaagaaatgggggtgagtgggtatcaggattggggaggaataaggagtactctcactttctccccccattctcttacctccagcccagctcattcttctcttctttctctttcctctgaaatttcctcaaatatctgtctgcttagtagtctataattcctcaggataaaagaaaaaggaaaaggaagaaaattgcttaataactatgttttatcaagcagcatgcatagtgctttgcatgcgtttaatcccttcaaacttagtatttactagtcagtttgaaaagcccttaaatgttaaacaatggttaagctttagggtattttgagcagggaagtaacatggtaggaggttgatcagattgggcacttgatcaaaaccctctatagatattttatctgacagaaaaggccttttgctaaaccagtatctgattctcaaattggttatgtcatctaagaaggaaaccgtatcattttcttggatgaaatggcttccatttccaaattagtcaggttaggctatgctaagctatagtaagaaatgaactctgaaatctcaatagcttaacacaataaagactgctttcttggttatatcatagtccagtagaggttgacaagccattcttaggagctgtcccccaacatggtcacttggaaacccagacttttccaattttgtgacacttgtcattttcaacacactgccaaaagccactgcagaaaaggaagacagaatgtggtcagtcaatccatggtgttttatggccaggcctggaaattatgtatatcacttccaccacatcccatcacacagaacttgttctcgattgaatttcaggaagagttaatggaattagtgagcttttagccaatctctgtcatagccattttatcgaagggacctgagctgctatgaggacaaggttttagtttatatgatgaggatgttagaaagccacatagaattttacagtcttatcattagctctgttggagtcaaaatctaggtgaataaaaattctttcaagagacacatgttaccactaatggttttttcaatggatgagcatagatgaattaggaatctccaatggtcattttcctaattcctggtctgactatgtaatatatagaatcatgtggttattcttgaaagctctagtcatattcgtgaggtagtcagcatgttatgctacttctttttcttctctataagtttcggatactatgaatctattggatcacaaaccaaagtagttaactggtaagaaggtataagcagaaaatacgaagtttggactggatccttgagttagatgagaagaaggagagatgagaggcatacagtgatagatttgactagggcaagaggactctggtagttagcaaatgagaaataaatttaacctaagaaaatcctaaagtgatggtaagaatggttagggtttaattgctcttagaagagcaagtagctttaaataagagacaaaaatatctgcagaaggaaatatgaaagtagaaaacaaaacaattgcattgtcaaaacatgtaagatgttttaatcacctaaaataaaaccagaattgtattataattgctatcctttgtcaaacttttgaaattaaaaaaaaaaaacgctttggaatggtctaaaactacatcataaaaatggctcagccactatctatagagattgacattttttgtttgtgctctgtgtttaggaatttaatgatgtgtattgctgcagattcaatgtaagttcccgatacagataaagatggccaaagctgtaattttttcatccatttcttgaatgatgtatgctaaaattaaagtaatcctaatgttaataataacttttagtgaatgcttgctgtgtgtcaaaaagtatgctagtcactttatatatattggtttatttcatcctttcaaaaacactctttgaaaagtactcttattattcttagtttgcagagaagaaaactgaaggctagagaagttcagaatcttcttttgaaagtagtagagttgtgatgcgaatgcatagcaattactcttgtagatgacctcacaggcttcctcttccaattgtctacgtggctaaaacaaagcaagaaaaccccataagaatctgaaaaagactcatgtaattattaattgacaaataagattatattacattactgataaaccaacaggtagaaaatgaaagcaatgaaatagtatactgcgaaaaaaaatttcatattatattctttgatgaaaaaataaaacaataattgcaaactgcatttcatttttaatgaaacgacaatgtttaattcttctaaaaggtagggagcaaataaaatggttatctggtctttacatcgaatgtgtcatcactactaagtgatattagctggcttattacttaaaattttcttttaggaaaaaagtgtgaaaatagacaggaggagacattaaatggctaaagcaacacccccttgctccgtaagttctttctgagtctgtgtgcctaagattaacaagagagcctgtgagcctcacaaggcaatcacaaagctatgtctacagccttggagagctgtgattacagcagccagcctcctttgcagcacctcagtgatgactacactaactctcactactgagcaacaatgaaatgtttcaaacccaaccaccaacactgttataactcttaaaatttgagccagtcaccatacctgaacgtaaaaagaaaattaccaaaaatgcttgataccaaaaagcaattaatgattcataattgctaatctttattgacagtctcttctagttcttatctacatatattttaattgtctacataatgtaaattaaattttaaattctgatttgtaaacttaatattgcataaatatttatcaatgttgttaaacatcttttaataattattttaacttctttatattatttcattaatttccatctttatgtccttgctggtctgacatttagaaaaaactcctccttttatttagaaaaaaagaatggtgaggccgggcgcggtggctcatacctgtaatcccagcactttgggaggccgaggcaggcagatcacgagatcaggagtttgagaccggcctgaccaacatggtgaaaccctgtctctactaaaaatacaaaaactagcctggcgtggtgctgcatgcctgtagtcccagctacttgggaggctgaggcaggggaatcgcttgaacccgggaggcggaggttgcagtgagccaagatcacgccactgcactccagcctgggtgacagagcaagactctgtctcaaaaatacataaataaggagaataaatggggacaataacaacctattcacagaacagaaataaaaccggagatgtcatgtggaaaaagcttatcttgaaagcgtggtcagagtggaaagaaacagcaacaggagagtcttgatttggtgaaaaaacagaatgcagatggcatagagtatcaacaattaattagcaggccatcaagagacggccataacatattggtaattgttttctttcacccttaattttttctaaaacaaaaacatgaagttagaaagtagttaattttgttagccacatggcttcatggtttaattttatcttctctatgggcctggtacaacaataaagttcttttgagatagaaagacagatgttaggcaaaaacatacaagattttcattctaatcaaaatctttgccaataggctatgacagaatcctatgagagatgatgccatttagaactttcacaagaggcaaaaatagtatgccattggcacctaaaactgccaacagtgatcatcataggatttatttcatttggcggattcttggttgagttcataacctgttccctaggcttttaagattggtccaaacttggcaatggattctttggaaaaattatttcttgatcgttttaaactttcttttccagtgtcaagagagattttcccaggctccgagttttcatttattttttcccctgtcagtttttgaaagagaaatcccctttttgtcggctttgtgattgcttttgtgtcaaattcagcgtaaaagcttttcaaacgtgacagcattagctgttttgtgcttggctgagctaagagtacatgaattcaatagagaagtgaaatcttgtttgagcctggctgatttggctatataatattgaaaactatctgaagcaagaaattcaatacttttcaaattattgaataaacatttctaaggctgcaaaatctctgtgtttttgaaggcattctttaggaaacttgaaacacagacattctataatcacataattaattttaaaagttgaacttattgtatgtagtaactaaggcagctatttgagtgtctcaaattattttactaaaaagggagacatttttcaaatatggaagtagtgccttacatttttagttatctgtggaaggatcgatggcatcatatatctcatccaccataaaaatatgtacggtagtggaaactgaatttttcttttatatattttgtgtattttttggagttgtacaaaattaaatcagcaaattgacccacactagtagtttgaggtttgggtttctggtacaataatgaaaagcattattagaaatcttcttgccaggacctaccatttcttcatgtattttctttattcccttttgttctcccctaaagcttctatgtgattaaagagaaaagatcaataacccaatagtacttttccttctaaagtatgcatgaaactcttaaagttctcaaagcatacaaacagagtgctctctacattgctgatagaacacaggtagtaatgggctagtttccccaggtaactattatattatataaatatttaatgcagagtcaccaagccttgaataactttatgctttgattgtaccatattttctctagtttgcttttcacaatttaacttatcccgtgcttgaaaatataatgtggtaactgtgtaaatctgctcctcaaaaaattttcgaaatcatcttttcttttttcttttctttctttttttcctttttttgagatggagtctcactctgtcacccaggctggagtgcagtggcatgatcttggcttagtgcaacctccacctcctgtgatcaagtgagtctctcagcatcccaagtagatggaactacaggcacattccaccacgcccaactatttctcgtgtttttagtagagacagggtttcactatgttggccaggctggtctcaaactcctgacctcgagtgttccgcccacttcagcctcccaaagtgctgggatacaggcgtgagccaacatgcctggccccacatcgccttttctgaaccctgggaattaaccaaaggctggcaacaatttttgaaatgctgactctcaataaaaatggcaaagtttgaggttttttaagttggcctttcccgtcactttctcccagctccacagtagccttgaaaatcagtagccttgcaaccataatagctgtgaaaactagcagccttttagccaccagagagtgtagaccaggattggaattcttcaaaaaggccaattttattccaagaaccttgccactgtttgacctatcttgcagctccctggaataaacctatatacatggccttgcctttatttggcccgacttagagataactttctaggaaaagccctagctccagggtgttggtccaaaccaattagcagcaattctttaacataacaggttcctaaggctgtgatgctagttgagataaacataggtctggagaaaaacttccagtgaagctctggagaatgaggtgtccataggggattttggcaacctctgacatgttcttgcgggatctagaagcccatgtgcttgtcttaacaaatagagagtatcaataaagagatagaaattgtaaataagaactcagtggaatatctggagttggaaagcacaataactaaaattaaattttcacttgacgtcagattcaagctgcaaaagaaagaatcagcaaacttgaaaataggtaaatgggataatccaatccaaagaaaagaaagaaaaaatattaaggaaatacagaaagcaaaaactgactgaactgaaagaagaattaggtaattcaacaaaaatagttggagacttcaacatctcacttttaataacaggtaaaagaactaggcaaattaacaaggaaatagacacttgaaaaagactataaagactataaacttacaagacctaacagatatctatacagcgtttcatccaataatagcagaatactcattcttttcaactgtacacgaaatattctctagggtaggccatatgctaggtcataaaataagtctcactacattcaaagggattaaaatcatacaatgcagattttatgaccataatggagtacaattaaaaatcagtaacagatgtaaatttgggagttcataaatatgagaaaattatacaacacactcttaaatagccaatgggacaaagaagaaataagaaaatacaaaaatatcttgagataaatggaaataaaaatacaatataccaaaacttatgggaggaggctgaagcagtgcttagagtaaaatgtataactataaatacctatatttaaaaaggaaaaagatctgaaatcagtagcctaagcttctaccttaagaaactagaaaaagaagagaaaagtaaatctacagtaagcagcaggaagtaataacaattagtgtgaaaaaaatcagatagaggaagaaaatataatagaaaaaatcaacaaaaccaaaatctagaaatttagttatttgaaaaggtcaacaaaattgacaaagttttagctgattggttaggaaagaaatggtcaaattactaatattagagaaaaagagggtgcattactaccaacattacagaaataaaaagaagtaaaagaggatattatgaacaactaaacaaatagataacctggatagacctataacaagaaattgaattggtattaaaaacttctcccaatgaaaggctcaggcccagaagtcttcccccgatgaattctaccaaacatataaacaactcttccaaaaaatagaagagaaaggaacacttcctaaccagacaaagatatcacaagaaaacaagctacagagcaatatgccttatgaatatagacttgaaacgcctcaaaaaattatcaaacctaatacaacaacatattaacatgattgctaccataaccaggtaagatttatcacaggaatgtaaggttggtttaacatccaaaatttaatcaatgtattataccatatcaatagaataaaggacaaaaatcgtatggtcatcacaataaatatagaaaattcatgtgacaaagtacaaaaccctttcaagcttgaaaaataaagaacacttaacaaatgaagaatagaaggtattggccaggtgtggtggctcacgcctgtaatcccagcactttgggaggccgaggcagttggatcacgaggtcaggagattgagaccatcctggctaacacggtaaaaccccgtctctgctaaaaatacaaaaaattagctgggcacggtggcgggcgcctgtagtcccagctactcaggaggctgaggcaggagaatggcgcgaaccctggaggcagagtttgcagtgagccgagacagcagcactgcagtccggcctgggcgaaagagcgagactccgtctaaaaaaaaaaaaaaaaagaaggttttgtggattgaatagtgtcccccgctcccaaaagacatactaaaagcctgagcccaggtatctgcaaatgtgaccttatgtagaaatagagtctttgcagatgcagtcaagttaagatggtatttttataagaagaggaaaagaggcatacacagagagaagaatgccacataaaggcactgaccacgggaaaaacaccatgtgatgttacagttagagattaaagtgctacagttgcaagacaagtaaaactaatgattaacggccatcattagaagcaaggaagaggcaaggaaaaattctcccctacaggtttcagcaggagtatgggcctgctggaatcttgattttggatctagcctccagaagtctgagacaatgagttttgtctacccagctacgcaaattgtgacacttaattacagaagcccgaggaaacgaatacagaagaggatttcctcaacctgataaaaggcagctacaaaaattccacagctaatgttattgtgaaacactgaatgctttcccctaagatcaggaaatagtgaaggatgcctggtctcaccacttctattcagtattgtactggaagttcaggccagggaaattaggcaagaaaaataaataaaagacatccagattagaaaggaataagtaaaattatctctacttgcagacaacatgaccttgtaattagaaaattttgaagaatctatgaaaaaatattagaaataataaaataattcagcaaatttgtaggatacaagatcaatatacaaaatgaattattttatacattaaaaatgaataatctaaaagtgaaattaagaaaatatttacaatggcatcaaaaaatgttaaaaacttaggaataaaagagatgcaaggcttgtatactgaagaatacaaagcagtgttgaaagaaattaaagataaaaaaatagaaaaatatcacatgttctcagatcaaaagacttaatattattaagatatcaatatccccccaattgatctacagactctatggaatcattatcaaaatcacaactggcttttttttttttttcagaaattgacaagtggatcctaccatttctattgaaatgcaagggatgtagaatagtcaaaacaaccttgaaaaaagaacaacattggaggagttaactttccaatttcaaaaactactacaaagctacaattattaagtcaatgtggtactagaatgtgaatagacatatagatcaatgaaatagaattgaaagttcaaaagtaaacctttgcatttatggtcaactgatttttgacaagggtaccaagagaattcaatggaaaaagaatagtctttcacaacctggtgctagaataactggatatacacatgaaaaataatgaaatttggccccacctcacaccatacacaaaaattagcttaaatgtatcataaaagaaaacaaataatctgattaaaatgggcaaaacacttaaacatttctcaaaagaagatgtacaaatagctaacgggtttgtgaaaaatgctcaacatcactaatcattggggaaatgcatattacaatcgcagtgagatgtcaccttacacctgttagaatggctgttataaaaagagaagaatgataacaagtgttgatcaaggatatggaaaaaaggtaacacttgtatatcattggtgggaatgtatattagtacaaccattatggagaacagtatggtagctcctcaaaaaactgaaaacagaattaccataggatccagcaatcccacttccgggtatatatccaaaagaatttaaaccagtatgtcaaagagatatcttcactcctgtgtttattgcagcattagtcacaaaagccatgatatggaatcaacctaagtttccatcagtggatgaatggataaagaaaatgtggtacatatacacaatggagtattattcagccttaaataaagaatatccttttgtttatgacagcgtggatgaacctggaggacattatactaaatgaaataagccaggcacagaaagtcaaatactgcgtgatctcacttatgtgtggaatctaaaaaagtcaaactcattgaagtagagagtagaatggtggttaccagaggctgtggatttaggggtggaaaatggggagatgttgatcaaaaggggttaaaaactttagtcaggaggaataagtttttgagactttatgacacaacctggtgaccatagttaataatattatattgtatatttcaaaattgctaaaataacagattttaaatgttcttgctataaaatatgataaatatatgcagtgatagatacgttaaattgctcgatataatcattccacagtgtatacatatatcagaacatacatgtaccccataaatgtatataattatttgtcaaagcaaaataaaattaaaaataaaatgttttaaaacttttgtaaaataaactttataataataatatatttttaatgaatcatagagctaaatatattaataagaactaaaactttaaaactcttctaagaaaatgtaggaatacaatggattatgcagtgttttcttagatatgacaccaaaagcaaaagtaaccgaaaaatacacaatttggactttaacaaaattaaaacttttgtactgcaagcaatattgtaaagaaagggaaaagacaatcctcagaatgggtaaaaatatttgtaaatcatatatttgataagatacttgtatcaagaatatataaaaactcataattcaacaacaaaaaggataaatgacttaattacaagtgaagaaacagtttgaataggcatttctccaaagtagatgtatagatctccataagcacatgaaaagatggttaacatcattgattgtttaaaaaatgcaaatgaaaaccacaaggagatagtactttttacccactaggatggctaatacaaaaaatacagacaataacaagtgttgagaagatgaagaatgcttggaattttcacattactggtggaaatgtaaaatggtgaaacaactttgaaaacagtttggaagttcctggaaatatttttttaatttttaatttttgtgggtacacagtaggtatatatatttatgggatacaggaaatattttgatataggcatacaatgtgtaacagtcacattggggtacctggcctatccctcacctcaagcaattatcttttctgttacaaacgacaatctaataataatcagttatttttaaattcacaataaattttttgactgtagtcatcctcttgtgctatcaaatactagatcttattcattctatcaaactatatttttgtattataaatttcactacccattagccatccccccctttccccctaccactacccttcccagtctcctggaaatattaaacatgaagctaccatatgacaaaaccattctactcccaggtgtatgctgaacagaaataaaaatacatatgtacacagaaaacctttatacagatgttcatagcagcattatttataatagccaaaaagtagaaccaacccaaatgtccatcagctaatgaataaattttaaaatgtcctctacatccaaaaatggaatattatttagcaataaaaagaaatgaaatactgatatgcactgtaacatgagtgaacctcaaaaatatgctaagtgatggaatccagtcacaaaagaccccaaattgtatcaatacattcatataaaacatccagtaaagactgaaggaggaggagaatagacaatagaaagggactgttaattggtatgggtttcattgggggcaaataaaatgttctcaaattagatcataataatggttgcacaaccctgaatacattaagaaccagaaaattatgcactttaagtgggagaattttatggtatgttaaaaagtatatctgcatgtcattgactacagatcttttcttattttttcaagttttatgaacacagttttagaaacatagtctccatttttctctttcatgaagctgcttgccagctatagaaatgaaaaaatagccatgtctgtggaacataactgctacctagatgggagcctccatcacacaatggatagggagctattttcttttatggtcaagataggcaggttctgtcctatagaatatattctgagatgttacctgtagttcagaaaaacagggatattgttgttctaaacatttcctcaacatttatgtggcttcctatttattaataagagaacctgttctttatgtgtcattatactagtttattctagccctggtcctggtccaggactgtctggaggtattagaattgccctactctatgtgaaataaggtcatatctgaataggtatgtcagtcagcataggctaagctacagtaataagcaacctcaaatctagaggcttaatagtctatattttactcatgttacatgttcgttgtagactgatgagagcattctacttagcttagtcactcggggaccatggctgatggtatctccatcttggtacattctttcatgatcatagaggcaaggaacatggttcttgagccttctgcctggaagtgaccagtagacaaaaccagtcacatggccattcctgagttcaatgggaatgccgatgtataatcttctggcgtgaaaaggcactggatatttgagaacaataatgcagtctaccacaatatgctcatggggtctgaaaaggagctgaaaaaacgccattttctggggttctgtcctctggcattgtttctggaatcgtttccacccatccatttctacaccctctcaactgacttttctcagatgcctggggtagctgggtgatttgttaattacagtattgcttaagccttttaataaagtcagcaaattaaagagagagcccagataaagagaatgctttcaaaaatgtcataatgaaattaaggtaacgaagcacttggagacctctcctcccttctttttgtatgaaacttattccaaagcagctggaagagaaatggggcctgaaagtaaagaggggaaaaatatattgtatgccattagtttaattataaaaattcattacatgaagccatgtaagacagaaaataatggaactctaatgggttggccgataacacatttactagtctgctctcagcttgtagtcattgttgaaaggacagaaaagtaacgacgttggtatgtagtcttcaaagctattgtaaagattaatcattttcagtaagccggaaaatgagggccattttcttaaatagtatgccctgtatagagtgttaccttctgaaacagagttgtttggtaatgtcagaggtttaatagatgagtcttgaagttaatggtgagaggctttacttttgaaatggctttcttacagctattttaacatttctattataaatccataaagaggttttataggtcgttttaattcacacaaggagggaagaaattgtgcttctcttttcccaataaggatttatagaacattaattcattcttgggaccaaattgtttagtgattttcaaaaataaactatgtatttttctgctgtctttttttcagaaatgccttactttattatacataataattttccagtcatgctataatcatcaagattgttttatattcttcaaagctcagttaaaataaacccagtccttttccttaaatttctttatatggatgcataacttctttaactgaattgaaatgaaacctgaattgagagtccagaaacctgcatttttatgatgactctttcactgactagctatgtcaccttgaacaagtcacttaacctttcagagcatttatattctcatgtggacaattatggaattgctcaaaaaggaagaagatatcaaaagatgaaagtgaatatgtaggtaggggtcatatattcgagggccttgtaatccaaagagagaggttaggactttgtcttgcaggtaatagcaaaccattgaaaggttttacacagaggagaaatgaggttctatttgcattacaaaaagatcatttacgcagttgtatgtaggtggaagggtggtttgagagtggagggagggagccaataaaaaagattattttagtacctgagcaagagatgatagggacgtaaattaaggtagtgtcaatggaagtagaagatttggataaaagttaaaaaaaaaaaaaaaaaaacttatgatacaactacccagggagtatgttccctgcctcctgctccagttgaggaccaacatatcagattgatccagagacagaattttggagaacattaatatttaaaggacaggcaaaaaaaaaaaaaaaaaagcttgaacactcagagaatacagaggcgaccaaaagagtggaagccaagaaagcagagaacttcgagaagagaatagtcagcagcaccagttgctgcaaataaatcaagtaaataagaacttaaatctttccataggcattggcttttggtaactgaatcagttaactattttcacaaatgtgagtggcatatagcaataagcccatattgcctttcatgaattttcagcttgggtggggtggcacttcttcatgttgcaggttgattggggtcgctctgctccatatgtcactcattctcctcctgagatgagtaggctagtccagagcatgtttgtcttaaggtaatggtgaagtgcaaaagggatagccacactgcataaatacatttcaagcctctgcttgtgttacttctagtaatatcccactgggattaggcaaagcaaggcgcatgaccaagctcaatgtcaagggcatgctgtctttcgtaggaagaatttcagagttacttagcaaagggcatggatacagggagaggtaaagaattggggccagtaattcaatttgccatagtgacttctgtcagaatagttttagtggaacgatgatggcagaagcctgattttcatgaattggagagtggcacgaatgtagtcaagttgagataatgagtgaatatctgccttctaaagagtgtgactgtgaaaggaaagaaaatgatagagtgcagattattgttgttgttgttgtttaaagatgagagagacactcatgtttgaagtctctagagaaggtccccgcagagaggcaagaagttggaacacacaaagagagagggagtatgtggaggaggatcccagaatagatgggtgcccagatggtgaaatcaacttccaatagcagaaaagtcgcctcttcctctgagactagagagaaggatgcaagatgtaaagtctgatatttcatgaaatgtatgtttgatatattaaatttccccctgtggaattgtaggtaggatcatttactgtgagatttctttcagttcgtgttgtcaggaattagtctgtaaaccacattcgatatttcaaacagaggaaattcaatacagaggactggctcctccataggaatgaaggagctgacaaacccaacagaggacagtgaggcaacccagagtttagcaacttcaggaaactattaccacctcaagggctggggaaccgacaagttttaccaaagcccagaaaccagaaccatcgggtgctaattcacccaatgtaaggtctgcacagcaggtaatggaattacagagggagcagccgtccagtgggaaacggagacaaaggagatactgccaagacagagagagaagggggataattatcttgtttcaccctttctcatgctcttctgtctcccactagtgtgtctcatgacttaacctagttagaagccagctagcaagaaatcccaggaaattctgacctcctatgggagttagtacatctcaatactgagtggagtaggaaatgggtagagaatggatctaagagcaaacgacctcttggtggttagctaacagagttaaatttttccatgaatcccttggttcatgaatgtaaatacaggatccaaggaaaaataacaaatccaacatgtagaactttttgttcataagcatattaggatcctgttttacaattttccgagcaattgcttgattttgacacttcaggacaagccggaggcatggtcagagcaagtaaccccatcctagtttacagatgacaaaactgggacttacaaggttaatgacttccttaagatcaaactgcagaacaatggacaagcaaaacttcctgggaagatgtcctttcgttactctgcactgcctttcttgaagttcctttgagacacagtcattaaaaatttaagtaatagttcacccggaacaaacatttattttacttgtaggtgaatatcacaaaacacattttaaaaggaaatttaaccaatattcaaccttaaaattttaatgatagagctatgcacttgcttttatcttccaagttaaagggagaattttagagttgcagcatttctagacaatgtccataaaacagcgagctacttgctttgcattcagaaggggctcacactgtggggaatatagtttgactcattaaaattagtagtagatgtgctagcagtagtaatgatgatgatgatgctgatgctgatgatgattaatatttatttaatccttcgggcacgccaggcacctttgtaaatgttctccctgaattctctaagttaacccacctaatcatatttccacataaatactgttaatattcccatttagcaaaggaggaaactgaggcacagaaaagataattaactctcccatttgccactaagcgatcacgccaggattcaaacccagcaggctcattgtattgctcaggcttttagctactctttctcttcctcctctcttttctaccatgtagggtcaatatcactaaaataagttcttacacataaaagaaatgagagaagacaaacaattaaagtagaaaaaaatactcaaaattcttgaaattaattcaggttgtctcatagtccacaatcactttttctacctaagatactgtgaatatatatcaagcacatagtgcagtagcagcataatgggtttgaatgtgaaacatttctttcctggttggggaaacaatcttttggggatttagcattttatattcttcatagaaaacacacacacatacacacacacacacatacacacacacacatatacaaaggcaatctttttttataagctagtgctcacagtattttaaatttcttcacacaccatgatcaccacacaagcaattccctgtggtgtacaccattgtcaatggaattcagaaagagaaaagggtgtgtgtgaagtctgttgtatttttgaatttacactccttctgaggtctggagttatcccagtagtaaatttcacagcagtaggcaaagctggtcaaggtcatggttcctagtgtgaatgacacttgggtaaaacccaaggtgggcgggcagaatattaccgtaggagaaagggaaaacattctgtgtggggaatgtctttaagaagggagaaaaaaaaaaaaggctacctttgagaacctttgtgtttatataagggcctgagccccctcaatgtcagtcaaggtcagtgggagttttactttttaatcctacatcctcacaaaacctgggcagtattcagtgagggttagcactcagtcaagatttccttaggtataacagtcctaactttcgctgtgaatacaattttgcagaaaaatatatggcacgcgtatttctacctttcaagcattaaagtacatcaaaaagttctggtttgacgtcaagcctcactctttactaccttgtttagtaggaaatctgtcatttaactctagcttactatttctttcagagattttggaaaattctaggatatgttataatttataattttaggcatttttatgatctattgattatgtttttagattcattggcaccttctgcattttatgttttttaattttaacagctttattgaagtgtaattgatatacaaaaactgcataaaattatatgggctagaacatgtgcatatacccatgaaaccatccaaatggtataacctcttatatctagacttttcaaacaggaacctatgagtgatgggtggcttccaaggttatttaacttgcttgagtaaaataaatgattttaattatatatttactaaaaattttgtttttattttgtattcctgagcttttacatatatgctctgatactggtccatcataagtattttattaacaattcagtgttttataaaaggaattcatttgaaaaaaaggtaaccaagttattggtctcagttttgtggatgttcatgctattaattagcaatttaatagatgagagataataagctcttcttttaaaatgcaaatagcaccctctggatactaagggccaattacatgttctttcgtatcttggaatacatttcttttatcactttaggtttggcttaagtgaggaggagaaagaaagaagtggtaattttgtaccctaggatatttctagaaaaggcaagcctttggcagaagttccctcagaagggctttcaaatagtgcgaggatctgaaaagtggagaatagaaactgtaatgcttgataaaaggagtatggaagaaaaggcaggcattccacgcggataaatgttaattgttttgtaatagcagcaactatgctctgtgcctttagacactgtcctctgctttcatagcaaaagtcagtgatattggcattagcttcttgataatagtttggtaatctgggtctatttgctatatgcagtaaatactattacttggtttgattctaggatgttttagttaactgagaaattacattatatatagattgtatatgttcaataggagttcaccaaacacgctgaaattatgctaagaacactgtttgatttttattctgtaaatatcatactaacgcaaaagaacaaatattaaaacaaaaatgatttttctcctcagaagcattattttcaatttcttccatttcgtgttcagctcatgattatgtattcttagagataaacacagtgtagttaaaaattgtgttctgttttttacacaagaaaattgtgctctttttacagtgattactgtgcacatttgctacatattggaccattggaatgatgtattatgttcttttaatgtccctgcattaaacatcgacattgtttctctttttttttttttttttttttttttttttccgagatggagtctcactctgtcgcccaggctggagtgcagtggcgtgatcttggctcactgcaacttccatctcctgggttcaagcaattctctgcctcagcctcccgagtagctgggattacaggagcctaccagcacacccggctaatttttatatttttagtagagacggtgtttcaccatcttggccagactggtcttgaactcctgacctcgtgatccacccgccttggcctccctaagtgctgggattacaggcatgagccaccgcacccggcctgtttctcatttttttactgctttggttaatgaagattttaagtcatatagtatattgatcttcttttgaagattttatcaggataaagtaccaaaagtgagattattgagtcaatgggaataagcatttgtatgtcacttggtatctattgccaaattgtcctaatagataacggtccccagcagtaatacgtgaatgtgctagttttactggtcttttcagctttggattttattttttgttaatttaattggtgtccaattgtaccttttcaatttaatactctattttttattacttgaaagttaacttttttctttttaaataaaatcatcccactctttctcttgtttgaactacctgttcctattcctgtgtccatttatcaatgacttaacccatcctattgaatttgatataactatcttaacaattagtattatcttaatgcttagaagcctcctctctgcacttgcagaaatgtttaatagaaatttcaggttgatatgcttcgagataaaacctaccattaattgacttctttctttgaaatatgtttcaagtgatgagatagcaagtttgaaaacactgaattgccaaagacaaacaacgaagaaaatgtaggtgatttggtttagtaagattcttatattttgactttttttctaattttaaagtaaggtattctaaaagtattttgatccttcaaaaaattcgtgactagaataacagtactattcttttgttgttcaatattttctgtatgcaggtttagttgaacgccagtagatggcactaattacataaacaattcaacaagttaatgaagagggaaagaaatgtatgaggtttttttcgttcaaatgttgttatatgtcacatattcaacaattatatatgagcttatttttgtagtttttttctcttgtgataaaaacaattaagcccactttattgccaattaattgctactaagttgaaatacttgatactggttattgctcaagatgctgcatttgaaaagtttgtcctgaaaggtgggttaccttatactgtcatgattgactaaatcatatggtaggttaaaagcaatctaatatatgtattctgacctgaggattcagaagctgtttacgaagtattttaagacactccaactagagatttcataaaaaaaactgacattcattctctttctcataaaaatctatagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaaggtatgaattacattatttctaaaactactgttggctgtaataatggggtggtgaaactggatggaccatgaggatttgtttttccaatccagctaaactggagcttgggagggttcaagacgataaataccaactaaactcacggacttggctcagacttctattttaaaaacgaggaacataagatctcatttgcccgctgtcacaaaagtagtgacataaccaagagattaaacaaaaagcaaaatactgatttatagctagaagagccatttatcagtctactttgataactctatccaaaggaatatctttctatctcatcatggcgcacactgccttacctgttatctgataaataagtcactttgggattcatgatagagttatagctgtacatggtctcatcctagtatctcactccacacacccaatgggaaaatttgtggagggcaatatgactcgtcacttcatttcccattatatatgaatggaaattaacagcgcttatagacagtatctcctcaaactaagccttgtatccttattatacctctcttgatctctagtgcttttttcactagcatttattccaatcataaataaaaatataaattatgtaactaattgttaaatatttgtcctttaaattaatctaaatgccatgagggcagagattttgtctttctcatttgatacatccccaggtcctgaaccacgtgatataatagggagctagtaaatgttttttgaatgatgactccctttgcagaatgtacaattaccttgtgcaagctgaaaaaatagcacctgtacaatatgaggaagaccacggtgaaaaataattgagttccaaaatatgacatcaattactgaaaaaataagctcggtgatttttaacaagaagtaaaagtcaccactggggccaaaacagattttgaactaagagtaggaagtcttaggagaaatgagataatgatatatggaaattaagcggccaactaaattttgaaactgagctagacattagagagtaaaaactcctgtgaagctgaatttaagctggtcaccctggggaatagagcaactctaatcctgaattccagacagtaggtgtatagatggaaaagaccatggaaaagaagattcaacctaaagttgggaagttttaattggagccctatgaaaaagaccctggtggagaaagggcaaacttgaatatggagctgatatttggaaaaattctcatagtaactactttttctcaatggcaaggcttggactttcttctcaaaatacagatcttatatgtgttcaattaaacagggacagattaggttcaggaagaattattcacatggaatcaattggtatcagagagtcaaccattagatcttagtgggaaatatctgcttctcaaagagaagtcttttggggaaagcaaattaaagtcagagattaatttgatgagtttaggtaatataaactaaggggccaagaaaaaagcttgctcatggtatgaaactagagcttgaggacactgatctagtctatctatactactctttctgacagacccctctcttcattctcatgctccttgatggcccaagccactctctcagttttttaaaaaattgttttatcaaggtctctggattcttcatgggaatgacttccagtttatattttttggcttggttccaaaaagctatcagctaaggaatgcatatacttacttcccctatgggtaaagtaaatgagaattttagaagccaactcacatttttagcctgtacagaatctgcaattcaccaagctacttctgactcatgtctataaagttcttccctgttcttttctcacttcacatgtactctttgcaagaattcatccacttgtgtagtttcagtctgttgatgactacccatctataattccagctgagaatgatcttttgagttttagacatgtagatcctgctgctttctttcgatgttaatgtcccacaggaacttcacattgaagaggtccaaagctaaactcatctttgccttcttccaatctctttctccaaatgcaacctacttctgttgtccttgtcttagtccttttcgtgcttccgtaacaaaataccacagactgggtaatttataatgaacagggatttgttggctcatagttctggaggctgcgaagtccaagatcaaggggctggaatctggtaagggccttcttgttgtgtcatgattccatgatggaaggtggaagaccaaaagagagaaaaaatggggccaaacttgtccttatatgaaactcactcccacaataatgatgctaatccgttcatgaaggcagagccttcatgtcctaatcacctcttcaaggtcacatttactactgttgcaatggcaattaaattttaccataagtttgggaagggaaaaacattaaaccatagcattctgcccccttttccccaaaattcttgttcttctcaaagacaaaatacattcatttcatccccaaagccccaaaaatcttatttcagcataaactcaaaagtgcaatctaatataaattagatatgggtgagactcaaggcacaattcatcgtgaggcaaattcccttccatctctgagcctgcaaaatcgaatcaagttcatcccctcaccccctacccttcccagcatcaggtaaccaccaatcacagaaagttttactgatagtcctgctctagatcatctttgtctatgttcactttagctatttatcctagtgttccattattggaatactaagcatgtgggaattatttatattctactgttcaaggtcctcaccaaggtctgattgcaaaaattcaaaaaattgcaaccttaggcataaatgggttaagcagtttagggtacatttataataattatttactgtgctacttcaaaaatcttattgcctctatttataaataaaaagtgttgtctctacacagtggcttgttgtaatgcatttacttgtttctgcctgattttttctatttatacattttcttttttatttttatttttattttttcacttttaagttcaggggtacatgtgcaggtttgttacataggtaaacttgtgtcatgggggtctgttgtacagattatttcatcacctaggtattaatcctggtacccgttagttgactttcctgatcctctcgctcctcccaccctccacactctaatagtccctagcatgtgttgttcccctctacgtgtccatgtgttctcatcatttagctcccacttataaatgagaacatggggtatttggttttttgttcctgtattagtttgataaggacaatggcctccagatccatctatgtccctgcaaaggacatgatctcattctttttttatggctacgtagtattccatggtatttgtgttggtctcaaaaactacaactatgacaggatggcattttcacttttgttgttatattaaactcatcttaaaaaggaaagattaataatgtcaatatttgggttatggagaaaaagtatctcatatctttgaaaaagttctgtaactatagctttttaggtaggagggattctgtggaaagttttctgattacatcatttctcacagttcaggttagacaccattttactatgaaacactaatgcattgcctgcactgagactttcagtcacatggagaaacctaggcaaaatttttgtacacttggaagaatatttaaattagtaataaaatctttagttttaaactgttgaatgttaaataagatataaaatgtacttgaaagaaatttgctttgatatcagacactgccatgttgcagtttcaagacataataaaaaagtaaactaatgtttatattttgctgtttaagtttattaatacatcagatgagtcttcaaattctacagtggcttttgatatgatcatttttacttgccattttatatagaataaatataaataggcatttatgcttaaaaggaactaatctatctatggaaaaaagagaaggctgcttctcaactaaattgtacagtttagaaacccagatctgaacatagattattgttgtgacctatgtaggaaaatatgttgttttccttatcgtagtccttacagagtccatgataacatataaagccagaaatgtgagcctctgcaagttcatttctttgtcttcaatctctgtgaatagatatgagtttgtgaataagataatattagatgtgatattacaaattattgtgagaagcctctaaggattagatttcaaggactgccatctggctgatgactttatgatgacactgtcatgagatttcatttccttatttctgttccaggatcactctttaaacaagaaataagcattaactctgaattgtctgcttgtagctgtatgagggcttccacaactgccaactagccaggtacaaactcatcaagcagaggagatggtccttgcatcagagggttaaacatgcctagaagttccttagctaagctcccagatactaaaaaatccctctaggttctaagaaagattcagcatgtacatgtgtgtacatgtatgtgtgtacatatatacatatacgtgtatatgcatatgcatgcatatacatacaaacacattttcttccataacatctcagtattctctgttctttataatactgttttgtattttaatgatcaaaattaatagttgatcatctgaaaacattttgacctgttttctccgtctttgacaaccttgaaggcacttgtaagtcactctttgcttctctattcctaggtcctttctcatcttcattgcaacaagaaaagagaaaacaattgagccctattttgtgtgtagcaaggagctactctagttaaacactagatctcttttacattctccaacatgttgttttagtaattattctactttcctttttttgggatattcaatttcttctttctttttgctcctcccctttagcaggccaacatactcaagtctccctcatcctaagagaacttttttagtatatcattttttttctatccagctgtacttgcttctgcttactatatcatttttaagcagtagttggcattactgtttcctgttctttagctactagttgtactttgacccactccagtctcacttccccagcaccaccactttatgaaaacaaggacttactaagatcatcagtgactttgtaatagctaattagtgtattttaattcgtccatcttcttgactatattttaacattgatcctgttggtcaactctgctaatcaaaactttatcctccttggttcccagaacaatattatcttgaatatctcatttctctaatcatataataattgtgaggtgcttggcacaatgcctagtgcgtagtaagaactcagtaaaatatcatctgccatcgacaccataaaaattaatttacttactcaacaaatacttttgtatgaagtttgtgctaggtaggcccagtaattggtacttggtatagagcaatgaaaagccctaccctcataaagcttatattcttggaagcagaagttggaagacagacattgacaaataaaaattaaatacatgatgtgtcagatggtcatacacacagtgtggaagaacaaagaggaaaacaagtggagagagagagggaggtggaagaggagtgctgccatgaaaatgtggtaatcaaaaaaggtcttactgaaaaggtggcatttaagcaaattctaaaagacctgaggatgtgggccatatgtataattgggggggaaaaagtagtccaggagagtcctaataagttaaaatgccccaaagcaggaatattcttggcatgttgaaggaaccttaaaagggagatcagttaggcagaaaaggatcaagcgagcaggaaggtagttgacaataaatttagaggggtaactggcatctgattatattggccttttaggcctgtggactttagcttttaatctgaatgagatgggagttattggagggttttgaatggaggagtgacatgttttgtcttatctggctcctctgttacaatagactaaacagaagtagtgagaccattaggaaactgttgtcataattcagtcaagagatgactgtggctgggatcagaatgggagaggtgaatgtggtgaggagtggttggattctactatattttgggtacagagcacaacagattttataatggaataaatttaggtgtgagagaaagagtcaagaagactcaagaatttttagcctgagcaacggaaagatggggtcatcatttactgagatggggaaggctccaggagtaacatattttgggaggaagatgtggatatgttacatttgaaatgcctattatacatctaggagatgtgtggagtagatagctggatatatgaatcttaagttatggggagtagctcaagatacaaagttgggagttgtaacaatgatcagtgcaagttctctgtcttcaatgcaattttaaatgttgatgttccattcttaattgtctctcttctttctctctgcacattttgagtagctttgtctgttggcttcagttaacattaagactcctcagtgtcaacttccatcttacactcttctcctgatctccagaactgtactttctgccacctaacctacattaccacctggatatgctacaggctgcaaaatgtgtcaagtagaatgcattatcttgcccctaaaagaaagttaaattttctgtgttttcagtgtagtgtaattgtctaacttaattgtctctaaaactggaaacctaagaattaccttctacctttctcttgatctctctttcccaatctactgacacatgtattaaactggcttccaaattctgtgaattctacttcaaaaattgctctagaaacaattccctctctttatccctattgtcacctcatcctaaagcctcttcatcctttgtagatttctgggagattgtaaccaacttttctctattctgccagttatcaagtctttacgctcatttgacattcacaacagccttggatctgtcttccttgaaatgaatcttcttgcttccctttgattccagtgctttttttttaccctcctgagacttgatgcatgatatttacatgtatgacatgtttccaaaagcattctcaaatttttctgaaagtaaaaacaaatgaaaaagtaaaacattttcctgggaagaaaagcaaatagtgttatacatttttgcttgttcatttgtttgtttatttaggagagggacaagcattagaacttcataagagtcttatatgctgtatctacaaataccgtcccttggcaatataattttagagttccttttctggaactacttaaggactgttttatgatcctcagcagactgttatattattttatagccataccttttatttgctgagtaattgtactcaataattgtttgtaattgaatgaaacaattcatcagatgttgggcactgaatggctttggattatttccaaaaatttaaaggataaagatttgctgccttcaaagctatgtacaaaaatatgatagaatgctagcgggatatttgtttaaaatacaacctttattacattggggcctgctcataatatatatgtggcacattttatttaaaatattaaagttcctggtgggacatgtccccataatcccagcactttgggaggccgaggtgggggtgggaggatcactagaggccaagagtttgagaccagcctgggcaacatagtgagataccatttctacaaaacataaaaaaaaaaaaaaaaaagccaagtttgtagtcccagctacttgggaagctgaggcaagaggatttcttgaacctaggagttcagttcaaggctgcagtgagctatgatcatgccagtgtactccagcctgggtgacgtagtgagactccatctcttaaaattaaattaaatttaaagctacaaatgaccccaaagccaccagttcaaccctctcaattttgaataccctattttaaattcctcttatgcgaaatgtaccttgtagtccattttaaggactgagaggatttggtatgttaaaaaattcaatccattatcaactcctttaggtacacttagcagtatgaaaatgtgtctttcggctcttcaggagagagtcatatgtatagttacaagacaatcccatttttatattgctgagacccaaatcttcccaactgattatgaagcataagaactcttcggaggtttaagtgagctgagattgtgccactgcactacagcctgggcgacagagcaagactttgtctcaaaaaaaaaaaaaaattctctgcattctacagtagggtaatataacatctatgatgtgaaatcttggggctccgggccagagagtgtcatgatccatatggatctaaaaggttcatagtggtaacagcctgcttcattttatgtcatctcctttcaagtaattagaatgtttctagcttgcagggattgcacacaaagggagacatttggaaccatgtcattggtgatttactggtgtggaaaattacctggtgatgtagccaagtagccattttcattctaacccagtcctacagtcctgaactgggctgaaccaacgcaccaaaatatatgcttagaaatgctcctatgtatcagttttcccaggaaaaacaatagtattatcgaaaacttaccattgtttcctaataaaaaattataggataccaacagactgttttttgttcataaatttaatattacagtatcaaatattaaagcaaatgggagaaagtttttcttatttggtttaattgaaccattaatgttagctacaatacccatcatgttacttttcaattatatttatattttcattttatttctatctgtatcattctcagaaagacttctttaaaacattcaataaaaatagaatttaggtagatttatttttagaaagttgagtttttttaataaatgaatataatcatcacttgacttaatttttttctgcacaattctagaaatcttatagttttgggatcctttggctttattcagtatgtaacagggatctgtttcctttctctaaatcattaattcaaatgatttcttatattaaaaatgtttggacatataggtattaatgagttttatgaaatctaatctttccaatttccccctaaaaagggatgtcatttaatcagttctaggttgtgatcaatagcagatttttttttttttttttttttttttttttttttttttttttttttttgcagctccctttcaccccgtagggaaacctgatatcatccttgactaattgcagcaaagagcctggctcaggtcctttgtcttataccgagtgtttatagattcttgagcccagcagaatctgaactcctggctactgctacctacttcccagcccaggccccaaaagccctatgtctgcagccccgtgcaccactgtgtgtttttgtggcatttctgaaacacagagctacttaacttgtttctaagcccagattgtgcctttttgattttctattttggtattttatctaccatttttctgtgtttggatgtttcttctatattttgaaataacttctttcctttagtacaagtgattcttattgtagaaactatcaaaaatttacaaataaagaatcattctcaacattcttagcaattccttctatcatatttttgcaaatatatttttgcctatttttattttacttactccctgtttattaacagttaaaagcattttcagatagttttattttttcatttaaaaaaatcttaccacatttttattaggaaggaaatggacaggtgtttatcttttcaataaaaaacatgggggaaataatttcttgaagtacatagtgacattcttccagccaatgttttatgctgtggtcattccgtctgtcatcagtattcatagaaagagatgaaaattatttaaattaactaggaaatcaattccccattcaaagcagtagttgtgtgtttcaaatatcttctaatagtcagtttcacacttagctttatcaaattcctaattatgatactcattacatcactctgtgtccagtcagtgtgtttatgccacagagcaattaaagcaaatcaggtgaaccaaattcaatcacctttgtagataataacctacgttgcttaaacttatggccgctcatacaattactgatggattgcctttttcttttatattgccagtattttaaatgtcctagtgaagttggggtagctgttgaacttcaactttatcacaacctcttttttaaaatgtgtaaacgaaaaaaccctccatgaaatgaccaaatacagttttcatgctgggacaaattagatgaataataatcataaattcataatgattatttatgattttatgtttttatagtgagatatgttttgttgaaatgtgttatataagtgatacttaagtttcctattaaaatagaaatgctaaaatggcattgttctctttagctgtgagtctagcttttgacctctgcttaaacggaactgttgttccatcccaaatctgcaactctgaggcctatgctcccttcactgctgtctaatggatacctatcaatttggaaggaggtttcaggcagctattcccggtaatctaatctcagctctgtccttttcaatattttcatcagtggcttggatgaagacatagataacattcttatcaaatcaatgccacaaagcagggagaaatagcaaatatagcagacaagagtatcaggagccaaaaagttttcaacaagttggactggtaggctgaatactgaaagatgtaatgtaaatgcaaggtgctacatgtgggttcaaaagaaacatgaaacaaaaaacccatctaacttagactgggctccctggaaatagactaagatagagagttgtgtgcataaggtttgttgaggagtgttcccatgagatacatgtgtaaggttgtaagataggcaagattgcacagacgaagaagtgcagtgaagcctgcagtgcgttgcggcctcatcagattttcaggggagttctggaaattgcatggccctttagagacacgctgaattgaagcaagggatctggacctttgaacccaatactagagagttaatggtcctgggtcaccccatgggaaagagcagactggagtaagattgttacctacagctgaaggcaatttccagggagggaggcagctgtgagctgttagtagtcaatattccaaccagctagggcatgaggtcttggcagagcaacagtgtacccaagaccgcagtgttacccaaagtatggtcctctgactggcagcattggtatcacctatgagctcactagaaatttaaatttgtaggtcctaccccatccaactaaatcagaatctctggggatgggacttggggaacttttaacaagctttcaggcctccaagttatttctatgcatattaaaatttgagaaccactgcctacaccaaccaaaaacattccaaatatggagataacatagagtttttagcaacaataatctccttctgtttcacttctctctttacacacacacacacacacacacacacacaacacacaacacacaatgtgatagaacagtgggaaaggaaagccaaaggggatcttaggccgaataaatttaagcatataacctagtcctaagaacgtatatttcagcttaatagagagaggaatattgttataaagctgtccaaagatggaacaggctgccttgtaaagttgtagaagtattcaggaacaggttggtgataccttggtggttgtatggtataacatcctgatcttcacatactcatcatctagagtgggagttttctttttccaaatggggttttggcagaactagttccactgtatcttaataagtaataactcaagaaagggttctatggatgaaaaaatgattaggtaatatcaagttaaatcaaagcgaacagacttctttcccataggagtaatcagacccttattacagtgcatgcttggtgaatcaacaaagtatgtgtatttatgaaagtatggggggaagggataatctatacagtatgcatcccttctaaaagtttgaccatgaaaacaatttctcaagaatcttatacaacactacagtatctggtccaatactatgcatagaacatgcactcagtaagtgtttgtaagatagatagcatagcatataggccaggccactgaagggaaatcatctcaccgtgagttacctgaatagtattctctagtgccattagctcaattcttcacgtaggcataagcctatacatttgccatgctaaccaagggaatttgtgttacgtgaattttgactctattcagacatttttttctatgactcctccaaggctgttattcttacctcatattctggtagaagtttaaggacttttttctgggaatattgattaattagctagctagctagagacagagagaggatagagattgattctctggcagagcctatttgaatcatattgaatctttttttttcctgagacttcccacaaggaggatggaggagaaattttttagaaatccaccgaagtaatcagggatatcttcagtaaaagaagctatacttaataaagtctctattttagcagatggcaatcaacaatagaggcaatagacaatagagtctattaaaattgctgggatctgctaataacgtttttcttttccctgaaacaaatgccattaaccctccttgacactctgtcttcatcaacattctaatagaatggaagtaactcataattttgaggatttttttcccacacaaaacctataaaccacaccacgctagtgattacttttagcctagttgctaggttgctgctggtaacagtaaaacttatcctgacaggtaggcaattccagaagcccagccaagcacttggtgtgtgtgagtaaacccccatacacttctcatgtagagtaaccctggccaacccataactcttagcaactattcctggtggacggacctggtctactctaagaagaggccaaggttctttaatagtgcagttgcaagaaccagaattgaaagtcaaagttctagcaagattttgcagactccttggcaaaccagtggcttgggactcattcttgacttcaagcccttaattgataatggtaggacagcttgcttgcgctgggttctgctccctgggatatgcactgtttgccaaatgagtagcaggtggacagacatctttacaatttgctgtcccatattctaaatgaacgtgacattctataggtctgagttaacctatgaagtcaccaatttcaatatcaaaatatttatgacagagaaaaggatactgaggcacagagagtctgtgactttcctaagctcaaaacaccagtttgtgttaattctgacacagaaattcttgtatttgctatcagtctcctttttctgtgtgtgtgtgtgtttttacattgcagcatcacctatatgatgttaggttctgtaactttttgagaattttctcacatacagtgatgtgttactttttgatatttcaaatagttctagtaagtcttttctacttttattagcgtattaacatactggctctaagagggcatctcaccacatctttgccattcttcctggaaaggcaagtttctctccatcttcttttttgtattccaaagttttgccaaagtttgcttttgaaaatgggttacctggcagagctttattattctaactttgaaagtacaagtcagaatcagacagtggcagttatatatgcactactgtgattactatataatgaaagtatctatggtgaaaatactgatactgacatatatttgccattttctaattaagtgcttcagtaaaaattaagcactcactctttgccagatactgcaatagatattgagcacattgaacaaaattctccatatacatatatatgagtccacattctatgaaagtataatgtttttctgagaaaaggcataatattctattaatatcagcttttgcttcttccaccatatattgaaagaattctgaatactgttataatttaatgggagaatctagagaattctgtatttgctttcactgcattgatgaactaagatttttaaaaaatgtattcttcatagaactacttttccatatttacctaatattattcttatatcatttgagcacatatttcactaacaaaacaaatgtgcaatgttattagttctaacatcaaaattacactgatactttaatttttatcctattatttttcatgcagattaaaataattatagctacatcacatgttgcaagttttaagagctactttaaaaatatatgcttcaggaaagacatgattagatggggaaatggatgatgttcatattttcaaatgaaaagttttaaaaaagtgcctatcacaaacactaaatttttacataaattatcaactactaatatatctacaagaaataccatttttccctacaaaaactcttaacaataattgttaaacttagtcctggaacctgctaatataatcggacaaatgttgtcaataagaaggtgaaaaagaaagcatatatagtttatcaaactataaaatatagtttatcaaaaccaatttttcctattgacatttattcaggaaggaaaatggatgagtgaaatgaacaatggtctctaagagaggtgggagatagcaataaattcagaccacgtttcctgtcattacagcagggaagtaaaagagctacagtcaactctcgaaagtacttgggggaactaatgattccctgtagacctgtgatgtttttgaaatttaattcaacaatttgatatacaccgcaaagcgaacagatagtcagatcaaaatcggaagaacgattgtctgaatggcatccatttttcctagatgtgctgtcccatcctgtgtcaattaaactttcaggtgatcttcaaacatatttccaagtaaaaggtattgcagttatcctataaactggcctcttccccagcactgcttttgctgtggtcaactttatttctttgggctcacaaaactgatagagcaaaataaggaaaacggaacattggattaaaataaattaattcccattctgtgactcactaaaaaaaaaatgataactatgcttctgtgagcattaataaggaaatgaataaggaaatgaccaaattgttcagtggacaacttgtatgggatttttaagtattgtgtcatcatcaatgttgtcaattagcatatactttgaaatcaactaaagcaaatcagttgactaatcattaagggtctttttaaatgacaacatctaaacagcaaatgttttattttggaaaatcatgacagcacaagaatgagccagatgttttacaacatgatatccataatttaaagtatgtagtagtcactcaaaggatttctatttcagtttccttatgatttggctaagctagaatttggaaaaacactttaaggtaatgtgagaaacagcaaaattcaacatgtggattttttcactaaagcttatttctgattattttttacaaactttactaggtatatgttaacttcatgacacttatagcagtggaccgtagttttaataaaatgtgaatgtatactcttttctcaataatattaaagaatgttgactttcgtgaggatatttttatttttctcaacattaagaactgtcaaagatttaattctacaacagaagacgtgaattttgttttctaaaggagaacagaatctatagaagaagtgttgctcatagtactcagattgttgaccaatcttaaaggagaaaccgtcaattaatttaccgagaagtaataacattatctttttcttcaattatgcacatccacaaagatttggggcaaaatccacttaaatgatattatacataatagatgagtattcatatgttgtaagagtcctggcttctttcctgcaaaatgattaaaacttggatcagaaaccaattaaaaatccattctaattcccaaatgtatgtaactgtactataagaaaaataaatatttcttcttgagggatatccattagttaaggatattcataacatggtgtcttgtaggaaatgttaatctttgggtgaatagggatgtttgggaataacaagactcaaagagatgttgcacttactcacttttctctgagttgttatttctgtcatttccccagtgcgcctgtcctcaactttgcctctctccttattcctttttttttttttttttttttgagacggagtctcgctctcttgcccaggctgtagtgcagtggtgcgatcttggctcactgcaacctctccctcctgggttcaagcaattctctgtctcagcctcccgagtggctgggattacaggcacccaccaccacgccctgctaattttttttgtatttttagtagagacagggtttcaccatcttggccaggctggtcttgaactcctgacctcgtgatccacccaccttggcctcccaaagtgctgggattacaggcgtgagccaccatggccgatccctccttatttctttttatctctacctctgcctcaatggtatttctctattactgttagcatttgctttctgtgagctcttgcacactgtcagcttatatacatgttcctgttcacatgttttcctgtccccagtggttacaacatgtcttctatctcagcccactctagaattgtcttacttttccaggtctcctgctcctcagtatttttcccacttttctagattcatgttttcccatctgcatatttctcttccatgtctgcactgtcatccgcttagaagacagcgcataaggacactgttatctgagcaaatcttcagcacagccaccatgaagcatggttaccttgtcactttccatttttcccatagtgtgtgcaaactgccctgatctgcatagaaaggtatcataattgaggaaacaaaatgcacaaaaatgtccttggttattccacccctcagaaatataggagagaagtaatttacagaattacacagaataacgctatgtcacatggacatggagttatcgggttagcatataattggaaaatatttcctaggaccttgacatttactcactttttgttttcaaattacatgtccctatctattagttgcaaattattttaatgcaccgtttaccaaagaaaggctgtttcttctgaaagctttcatttgacaagtaacttgtaaaaatattcacattgtgtatctgttttccccttctagtccaaactctagttatcttaaactttgcgcagttataaaaaatcataacaaaaaaagcttcctcgttgtcattcttgtcaaaacaggtttaccagacttaggtaaacttaaaatagttagtgtaaaagttaaaaagctgatttgctccttccagcgtgtttgttgcctttttgccacagcaaaattgtaaatgtaaacgtattccctaggagatgagctgggctgcaattttcagctaattgggagaagcagccctgagttgagcactgtcaggctgatttgagtcttaagatatgatgatgattattgtgtcaaatgtaatcaagaacgtgggctctgaactgactcaagggctggctgtttttaattcaggttcgtatatgaagtagacctccggttcaccgatagtcacagctggttgtagaagagagcaatttttaaaatgctatttcattctctatggagctctagggatcagagattggatgcacagggaggggacacatcctcattctctcctgaaaaattctattaattttcagtataataaactttctcttgagattccccagtggctctgtatcggtggttttcaaacttctcagacccaatgccacccctcttttcttttttaaataacaaatactttgtaataccttctttacgattataagccaaaatatgtagacaacataccctacttatacaggcaatagtttaaatgatgccgtaactctattttaaagagaaataagagtcatttataataaaataatatgtgttgtagtatgcagttattcaggcaggatcacactggaacacaagtgaagtttttagatcacgagactatcaatgcagtataaacaaatgcagaatgacaccattgtgttgtatggagactcaaataccatgaggggcattggtcatccatagcgtaattttccaaaatgctgaacaactcttggcaaaattcctaacaccatgaaataaattttttcttggatcgttatggcagttagttgcatggctgaaaaattcaatgtcttaaaatcatgaggaaaatatcttatgtttacgtgtaaaattgagttacgttccaggtttaggtgtttataaacagggtttccacatacatgcatgtccagtgggatattccaaagtgctgtcagacttgggagagttctttgttgtataagaagtctaccatcttcattccctctccacagaatgctattatagtaacactcttcaatcactgtgatagtcaaatgtcctccctcaatttctaggatgcctcttttttttgtggtctgtataatttggttaaatatctttccagacaaatactgatttgtgaattaatgaaatagcagtattttcggagcacctaacctatttctgagtgatacagttgccatttttacaagactaaatgaaattaccatttcagacctgccagattgtctagcccagtcttttacaattctgtgattatcactgcaattataatctattttcaccacttgaatggcatgatctctataaaagggtggtgataacactcatctattctccttcccctcacatagctatatcaatcgccccctaaccagttgttgataaatgcagttgaattttatgtaaaaattataagagatattattgtagctgtccaagacatttaaaatgctaaatgcaacttacgtggaggctataagagaaatatgaacccatttattgaagagattagctaatttagtaaaacaacacagatatacctgcatacagggataaatccctattgtctaaattattgagataaaataatgttttacaatgaaaaacttttagacaagtaggtaagtaaaatgcagcagtctatttgcatttcatctgggcatttgacaaagtctttcgttatactcttgtgaataagttggagaaatactggctagatgcaagataaattggatggcttagaagccacttcatgattttacgcaaaggatgtcgattaatagaccagtgtcaggtggtgatggaagatctctggtgctatgtcacaagcttctgttctcaaccctgacacactggatgtttttgacagaacatgagtagaactacagagaggaggcccatcaaacttatgggtgataaaaagcagggagggcaggagtattttgggtgacagaagccaaatgggtgtctggacaggatgcgttttaaggcacttttggtacttgatgtctgaagaccaggatcaaacttataggcaatctgaacatttgccaaaataacaggttaattttgacagaagttattatttgtatgctgtctatttctttaatacacctagaaagtattgaaataacattttttgcagacactcattttgaaaattcagaaaaaaaattgttaactttcgtggaagagtaacagaaactcagtcattgacagctaaatacaatgtgttgcccagtaaaatagtccaccccttcactttcatggctaatataaaatttgatgaaagatacaaattccaaagattgaatatctgtacatttgcaaagcaaaacacaattttgggcacagaattgctcattctcatttttaaacatcttggttataactgaacaatagttttttataacaaagataatattttcaaattattatgaggttcaactgaaataatttatgtgaaagcaatgtctaaactctaaaattctatataaatataaattattattcaataaattcacatcaagaaaattttaagttttttaagaacaagagcctatggccttgtttttagaagctgtataccttatcggtagtaggtttattgactttaattaaatttattgagtatctattaaattgccaggaactgtggtgtgaatctttgccctcaaataatttacagtaagttgtggttgatgaatggtgatgacgatgatgaatatccagactatagtaagtggtatattcataagtcagaggattcttaaaaccagatgcaccctcagattcattcctttcatgttgtacttctaattgaaaaaaataaatcctaaattatgactgttctttataaattttaattgatcttataaaaggccatcaatacatttcaaagtatctaggtcttttaaatgcaatttttcaccctggtaattaaaagtacgaaagcaagaaactttaaatctttattttgataagttttaattagctcaagctacttgtaatcccacatcttgtcttgtaaatcatatctgagccattaaaataggtttacaattagaagggcaattcttttagaatctacttaaactaagtcacttcgacaaattaattcatcgttcagttggttttattaaaatgtatttatttcactgtaaaatgtctagtaaagcaatgtatgaagtattttattttcatgttagaaattttatgtaaaagatatcccaaaatacatagacattcagatactctctgtatcattaaccaacatttactaacttatcatttagagaaggccaaaattgtatgtactataactttgtataatttcataagaattaaaatattcgattaatgcctgtaatgccttctttctaaatcaaatcctcaagcttacctcgagttcaaagttcagtatttattgtaacacatctcatagatgacggatgaagatggtaagcaaaggaataataatttcttttctcttttcacacatatatacacacataccccataatcctaattcatataataataacagaaaacaaagggcttttgagaatagtgacatattaatatccattatatttacttcacagggagactggcaagtctaccttgagaggtaatgtcttatagtacagtggactagattgtttcaagatttgtcatttattttggcaactcacccagcttccctgaaagttaagttcctcatctataaactgttcatgataattacaacctgcctcattagcctcatcaagctatttaaaatatgaaaggaggtgctatctgtggatcctgtcaaaggagcttgaaaactgcagaacattattttagtgtaaaatactataacaatacatgttgaatataaaatggctttttcttaacttttattttaagttcaggagcacgtgtgcaggtttgttatataggtaaactcatgtcatgggggtttgttgtaccgattattttgttacccaggtattaagcgtagtacacattagatatttttcttgatcctctccctcctcccaccctccccactccagtaggcttccacgtctgttgttcctctctgtgtccatgtgttctcatcatttagctcccactaataagtgagaacatgcagtatttggttttctgttcctgcattagtttgctaaggacaatggcctgcagctccatccatgatctctgaagaatctccacactggttttcacaatgactgaaataacatacactataaccaacagtttataagcaatgctttttctccagaacctgttatttttgactatttagtgatagccattctgactggtatgtgatggtatctccttgtggttttgatttgcatttctccaatgatcagtgatgttgagctttttttcatatgcttgttggtcgcatgtatgttttcttttaaaaagtgtctgttcatgtgctttgctaaaagggccctttcaaatgtgtattattaaccacaagagagtactgagtaagagactaggtaataaaagtcacaaatatttcgatatcataattcagaatttagatcagcggttatgaaattgttcgtatttccaaattccactgacaggactctactataagtttatttcatctgttgatatgtttttagccacttctttcttttaaagtgaatctgttgtgtgtttgccatttgatattagaaaactgaacctgcctgctttgctgtcttctgaatattatgtatcaacaactaacaagctacagttagttgttttgttctgtttttctctaagttattgtggatgaggatatatataactgcacagtcttatcaggtttgtaagagatgatcttaggctcatcttttaaattggtttttatactattttaaacaaatccttttaggagagaagaaaagctgcttagtctatcaacattaggaaatatatctttaaagagtttatcactgcaagtaaccaaagccaacttaaaaattcgcattatacaaatcattgagaatttatttagaacagaaatgtgtccaactataggtcaacaccaattttaagtgtgtaattatctgggaagtagtgttaactgcatttttttctaaagatcccttacagttgtataaatgcccaaaaggatattttgagtctctgtatattaaccaaaccaaatgtaattcattactcccaacattatatttcaacctctccaaatagtaccttttcgtattgtatcagcagaaaaatataaaatgcagatcttaaagagtatcaatctctttaaaaattcaagaaagaaaaaaatatgtgtgtatagagacgtgtatttcatctgctcataacactgtgtacatttctttatcaactaatttttttcagtgatttatgagttgaaatacaaatcaaatgaaacgggtaatgcaaagtaaagtagaaaacacattttctactgctgtctcctaatgcaggtcttttcaggaaagtactaatggttttagggaaagtgtataattatggttgtttccctaatgataaattcgcaaatctctattttaaaaacattcataaggttaaaaaaatgagagatgaaatgtgtctttcaaaattccttacgtgattgataatgcctatactctcttactatctaaagtctaggtgatatgtatattttttttaaaaaataaaatgtctgtatcagtgaaggaagtttacacagatagcttcaaagctgtggtttatctttggaggattaatctatttctcatgccagtgtgttgctactgcacatgttaaaaagtcatcctgtggtgtctggggtgacaaaagatgggaatgagttttctgagaactaatcagcaatactttgggaacatttaggtcatggtttccaattaactctggagagtttgagtaatttagtaccagacctcaagagagaggggatgaaaacctcgttaattcatatgttggtgaacggcaaaccagcaaatttgcattaaaaatggatttttattttaaagcaaagagcagccagatcttttctgcaatagtttgggtaggagaatatctttgtatgtatgtgttcccttatgtgtaggtatttgtatgtttcaacgaccctgcatatggcaataacagaaaattaaatttgtgctctaaaatgaagaccaggattcagtgacataatcttccttgtgcctttctttcttttagtacaatgaatatatcagagaggagtgtattccaatatctgtcttcagagttacaaaaacttcttttctagaatgcaagacttgggctatacccccagctctgccacttaacttgtatacaaccttgggaacatcattacaattctctcagaatcaatctctccagccctaaaatgaaaccagcaaaagcctgtactgtatatctaaaaggttttttatttttatgaaaattagttaggcaaacttttgttaagcatccatcactctattttgagataaagccttgctggatgatctccacctcttttgatggaaagagtaaaacatgtttaagatacatttatcacttgtttggcaaattgagatagaagtttatgaaagcagattgatatatgttacatttgagctactgggaaggactccagatggtttatagccttaattacattgtaactctagttaaatgtttacctatctgtaccctctgttaaacttgaatatgttaaataccaaagtccatgtattattggattttctgtcaccatcatcaggcacagatcctggtacacaataggtacggaatggatgcatggatgaattattgaattagatgttggtaggcatgtggaaataagaatgaggttcagaattaaagataatctgtatcgagtgtaaagccattggcagagaatgaaatatccagctgagtatacatagaaaaagaaggtaggtagaaaaatggaaaatatcttatgaagtgatgatagaataactctgaatatgtttgaaaacatataaagagttatgtggatgttagctttaaaaattatcttccatgctgtacattagatctgccattcttcatgctgtggatgaaaagcaagcatcagaagttaaattaaaatgatgtcatatattcctcgccttacagtttcataacagaggagaaaagagaaacattctctcattgccaccacccttctccagtcatatttctaggtagatgttgcccaaaaacagataaaaccacagagttggttttgctaggaatggactactaatccaggcaatgttgacagcttttgcttctcattagtgcacgttactaatagaattgctagagattaaaaggaatcctttctacaaagtgctgtatatccataggtgacaaaattctagcttcccctcacaagtacaatataaagttatgttttaaaatcaaaatgcaatttactagcaaactagtaggaactgttatggttacaggaaatttgaatttcagattaactctggttctatgagtagcggttgatatggcaagaatcattttgatcttacatccaggtgctactaaggtctctctgacctatatctcaccaaaaaaaggaacaaaataatgatcctttaatctttctcctaaaatatcataggaaatgatagtggctaaattgcaaataaactaggaaggaaagattcagagtattttatgtgattactctataacaatgccaggccatagtgaaagtgttatttagcagaagactgagttctttgaatgttcctaatttatcacattttaaaaataacctgggcaaaataacctttcatatcagattgagcctttttctaaaaatactcaatatgtttctgtaattatacctacacacttacaattccacagtataatgcaccgataaagtatttttcatccatatatctaatagtagaatggtgtgtatacaataattaagctctttaggcttaccccggaaagcaacaagtttcccttcctttttcctttttatgtattatgttggccataagaaattgatgatattcaactcaatgcagtcttagagatttattcagaaataccatggtgtgtgtgtgtggcgggagtagggttctaatgacaggtcagaacttacttatttgatttcttcattgataatcaggtcttaaaaagaaaatgggtatgctgaaaacatgccttctgtgattctttaccttcatgtgcagttgtctctggataaacactttctttggcacgtatagggttgcactaagctttatagctccaacactccgccccttcagtagattcttgcttgtaactgatgataatgcaaacctgtattatctataggtctccttaaagggcaaccaaaagttcagtagcaattcaggcacaattactgcatgtgagaatcctccatcttgttccctttggagaccacatatatttcttaggcaagtatatttttaaaatccttgttcagcatgacaattcaggaggtcaagttctcccagaaagcagattctgagaaagtgattagcatgaaggaattttattggagagtgctctcaggattaacacctgtgagcggaggaaaggaaagggagcaggattgggcagaaggagaagctgggctaccatacagtcacaactacaacacaatcaaccctccgcctctccttcctagccttccccaggaggatctctgaagtctgaaggtagaatagcccttcagaattgtcctgagttgcagcaagggacccaggattttataccccacaactctcccatcaaccaatacgtgcagcccgtctcggggacatagtgggtaactttgggctaggcacctctctttagctgagtccagctctcagacaggaataacagctgaggactgtcagccagtagcactaccagcagctggggtcagaagtatttcagtcctgaaaaggggtccgggcagcccagcttagcatctactatgccagtcgttctcaaatctggttcctggcaactgtgattctcaagctttagcatatattggaaggcttgttaaaacacagcttgccggattttacccacagagtctctgattcagtagagctaggctgaggcctgggaatttgcatttctaataacttctcagacgttgctggtgctgctggtccatggactatgagaacactgtttcatgctgcccttatttacatactgagaatggtacacagtgctcttatgaatagaatgaaaaccttttgaaatcacattattccttactccatcaaattctcagctatttttgtgcaccataaagctggaatagctgattataaaactttgttatgtaaaaaagtacttaaccaatacagtagattctgtttgcaaagcattattacagtttctaatatctggtcattgttacttgtaaaattcagccaaattttctccagggcctgtagtttgataacttggacaaaggaatttaaaaaaaaatctaattcaagacctttggttttttttctgaacatatcttttttttctttatgattcttatttttacattttacttatcatataagccacttaaacccatatggttccggaaaatttaaaactatatgatacatttagagcatgttgaatgcacagatatggaaattaagtattcttgactcattctagactagacctggcacaattaaaatttagggattcaacgtacacacacatagattccgagagaaatgttgaagccgtaaaacccccacacaagcaggaaacaacagtcttacctattattcaagaggcacgtaaaggagctcatttgaggagattttctgctgttattgccatcgaatttttaacgtattttccaaattagaaaatattcagcctgatgttgtcaatatttcagaccacaagggtatcatttaggaaaatggtttcttactgtcctgaaagagttactgttcttccctaagggcctaatttacaaagcagcaaacttgctggtaggatttggctgaaaatcacattgtctcggtagaactctttcatctgatttatgtgcattgcattttgcaaataactcttggaaagttatttactagttactttctctggaagcagagggtaagcggcatttctagtttaaggatagaggagctaagatgcatcaagcgcagctcatcatgaagctgatgctgataaaatgcacaatattacattctctaagtttcactctgccatgggagaatttcatatttttaaattttgtttgaaattggactacattagaaaatatgtcaaatgtctaaccctgcatttatattctggaatgtgacagcttatttctgttccaaattttgcactggagatggagtaagtcttaatgcaaactgcatgaaactgccacttttataggtcacacccagtcaattgtcagcagttacacatggttcaaactgtaaggtgtatgcccaattgtagcattgagattcgtggagttgttgcagtggttctgaatttttcaagcatgatacataaaaagataaatgactcttttgatatttctccttgcattgatagtttgcctgaaaactagataagcagggagccggcagtccacgttagcccttgaactacatgaggtttaatttatttgcccaaccagaaccctacactacctttcagctgtgcagtattaaagtttatttaggagttgataaatagcttagtgcaatgcttccttttttccagtagctacatcctcataaacctattctaccctccaccagttaatgcagacagaagatttttatccagtatgagcactgaaactccactgtggaagactgtgtgctcagcaaaaacctcacccatgatgaataaacagctcttccgggggctttgctgccgctggctcggcaggagttgtttattgcctggtttgcacatcccatgataaagttgctgctgaaataaattgcagttttgcataattattgacaatcacatcttaacaagcaatgtgtatcatattcaagtgttcaattttttaaaatccatttttagcttatgtttaatcccagaaagtgtttgtgtagtaatagaaggcaaataagacatttaaatagagtactaatttcctcattgcagacaaagtttacctgaatctttttccataggactgttactgcctaaggcaattttcctttctaagctattattatatagatatttgctgagggcatatgtgtgtgtatccacaatacatgcattttatatatatatatatatatatatatatgatcaaaaatatgaatacatttttagagtttttgtcatgaaagagtttgtttcatctttttaaaatattacaggaatggggaaatgggatatgggtagaaggaactaatgtttttgagtaactgtaatgtataactgtataacgtggggcactcaacttcacaggaattttttattttaattctcatcacagcaatagatattgcagatgagaaactgagaatcagagagggaacttgccatatcacgtaagtggtaaagaacactgggaattgaactcagatctgcctagtttttaaaactctactctttttcattacacataacatttttattttggaaaatgttctcagttgtatgatcaagtagttaaatatgaaactaacacaataattataactgatgtcatgcaaaatgatagtttgcacaaaatgatagtttctatgaaatgttatttctttacttgttaagtctttcttcctttgccctccaatccccttctttttgtcttttcctctagtcttttccttttgattctaggtttgtattttcttgacttttctccttgcatatcaaatccttgttttctgcctcagagcagcatcaaagacaagcatggtacagggattttagggttttaactataaaggtttgtctcaaatttggcagtatattaaaaataagctttcaaaattgaccaacaaaaactacaaaattgaaaaaaaggtactttgaactttcacatgttcaaatatatgtatatatatttcacatatatatatgaaacctcctctgtggagaggggtttatagaaatctgtaattgtcattcttgcatgccttcccccatacaaacgcctttaagttaaataaaaatgaaagtaaatagactgcacaatattatagttgttgcttaaaggaagagctgtagcaacaactcaccccattgttggtatattacaatttagttcctccatctttctctttttatggagttcactaggtgcaccattctgatatttaataattgcatctgaacatttggtcctttgcagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagtaagtcaggcatttccgctttagcactcttgtggatccaattgaacaattctcagcatttgtacttgtaactgacaagccagggacaaaacaaaatagttgcttttatacagcctgatgtatttcggtatttggacaaggaggagagaggcagagggagaaggaaacatcatttataattccacttaacaccctcgtcttagaaaaagtacatgctctgaccaggaaaacatttgcatataaaaccagagcttcggtcaaggagaaactttgctcagagaaataacttagggattggtttattaaattttaaaagttgacatttttgagtgtttatttaatattttacagggaaagcatctgtatgaattgtctgttttatttagcgttgctaactgaatcagtttcccttcattactttcaaatatgttttgaaatgttaatctggcattttgtagctttcttcctaacatgatctgtgaaaataagaatgagatggctgaatttgtcgtagttaatgatcaaacaattttcagacaattgtttttcctagaaacaaaaattatttccataaagttccatatgcataaacagtgaaaacagaacgtggggtagttttgtttaaatgaagtcttggtgagaatcatattctgtagtacaaggaggctcttaaagtttattctcaatacctgatataattttcctgaactattatggagttttgttatgtatagttggtttttctgacttgatataataactttactagtctctcaaatacaatttggatataaatcattataataagatgattgattttttagactaactttattttttgatatttttaaactattatgaaaaactattatgaaactattatgatatttttaaactattatgaaaagtatattctagtttgaataattccagaatcaaatcataataagcagaagttcttctcctctccctcctatcgttctccttctcctgtttttcttttttgatatgatagttgatctactttgctgctctgttgcatagagtacgtaacagtggcaatgtatggctcctgaatttatcgttcttgcttcatcatcctgctttgaccccactttctcctccaaaatgcgtgttgagttagtttgatcatttggaggtaatttgtttggaacagtatcagactttatagatatctcccatggcttgtgatagaatataagggcaatgcaaatgtagagttttttgctcactcttcgatgtatggttagacaatgtaccactgtaatatatttggcttaggctatttcataaataaaattttattataaaatattataaatgctgataaagctactccagaattttaatagatatgtgggtttcccggccagatgcggtggctcatgcctgtaaccccagcactttgggaggccgaggtgggtggatcacctgaagtcaggagttcgagaccagcctggccaacatggcgaaaccccatctctactaaaaatacaaaaattagctgggtatggtgacctgcgcctgtaatcctagctacttgggaggctgaggtgggagaatcgcttgaacccaggaggcagaggttgcagtgagccgaggtggcgccactgcactccagcctgggtgacaaagtgagacttcatctcaaaacaaataaataaataaataaaaatacatgggtttacattttacccatcagctatggtaggtaaataataagctttgattaagtctattttagtctatttttagcagattactttgaaaaataaagaataacccaatgactaaaaaattattttatgtcagggatttaataaaacatatctttaaatctagttgagggcaaaaatacgtctattttctactatacaatttgtatttatatctgctgtattatataatgaaaatttatctctatttctaatctcaagaaactgcaagcttctgaatcattaaagggaagattcaccatgtgtcctaactatatttactatggaagcatggaaaataaatattttatgtttagatttctgatctctctttcaaaagcagttggaaattatgctgagaaaatgtcttagcttatcccatgttactcaagaaaatgtatttattcgtttttgtccagtggcttaaccaaaccacagtttatttgttgctcacataaagtccagtgtcgatcaggctactcttttccatctttgagctaaggcacatattacacataactttcagtgtacccgaggtagaaaaagagagagcttgggaataaggcaggggctttttactgtctcaaccccaaagtgataaactacatttattctcaaaatccagataaaactcccatagagcctctgaaaacctcaacatttgcgtcttaactataataaggttaactaagattccaaaattattttaaaacagagacagtttccctcttccctggcagctaatattgtattttctataaatccacttgcccaaggtttaaactacattttatggattgaaatgacatttatagccaactcctgatttttagttagatggttggataatgatcttttgatgaaagactcggagatgtcatggtaaaacggtgaactactgaaactattgattattgttaatggcacatttcagctgattgaattgagtcaagaaactggtgttgaagagcaacaaatggaaatgccgagcttgaaaataaataaagcagcataccttaagagattacatgcaatttcagtatttcagctaaatggaagtgtttgctttttttcctctatgaatttttattttgaacaaaaggaattttctataatatgtaggtaggagaaaagtgaaatggcatgctttttcacttcatttgaagaagctggtagcattgtattcatagattcatgctgtatagcaatcatagttctcatatattaaaaaaaaaggaaatttgaaatgcctagccaaagcaacagctctgccaacagattttgatatatctgtctaccccaaaagtagtgatgatttacttcatacaaatgctagtgaatgaagagagagggtgaaaaccttcacaaaatgtgtttttctctaagactgtcaatccgtttttctatatatggagactccagctcttgctagactacctatcactttcgtctatcagccacttcgtaagatatttattctctcagcaataatcataattcatagattctttaaacatacatgtaatataaagcatatacattctgaatggaattaacatgattaattcttctctgaaagacattagaatttcctcccgtattataaaaaggtgtaactcactttccttactaaaatcaagaactttaccgtcgtccttgtacttcaggataagggggtgtttcttataaatattgttatttctgatatgctaactggaatttttaagcaaatgtatttttatagaacgccatacaaagcctttaggggtgaaagtttcaggatttttaaattgcagatttatcctttaaataaaaaaactatattcgtaattgaatcggattatttctctatccaaaacattttctgctttgggcctaagaagagttgacaaagctgttcatggttcaaagtactaccataaaaccctgggtaactaactgaaaatggaaagactctgtctttctgaatatttcacaagagtttcacaaatattaagtggttctctaagtacccctgagagatcattgtaatattagcttgtaaagacaatgtgggggtgtgggtatgtggtgacctttatgatgttcataaaggtggtgtaattaacatatttttctcagcaagacaaactaaggagcaataaatatatgagataccttcatctgtgatctgggtcatgtctcaggccatatctttcaaatcactcccttccctaatctcgtgttttacctacgtctcctctcaatccccccattataaaaattgtcttctgatgaataaaacatttccagagagacaagtttcataaagtttgaattgtacatctgagtacacctatgaattaagatatctttgatttctaatatgttattaaaattgggtgtggtggctcacgcctgtaatcccagcactttgggaggcagaggcgggcggatcacgaggtcaagagatcgagaccatcctggccacaaggtgaaacccccgtctctactaaaaatacaaaaattagccgggtgtggtggagtacgcctgtagtcccagctactcaggaggctgaggcaggagaattgcttgaacccaggaggtggaggttgcagtgagccgagatggcgccactgcactccagcctggtgaaagagcagactctgtctcaaaaaaataaattaaaataaaataaaataaaattggagaagtttctcaccaaaattttggcgcacggattaattctgaagaaagaagaaagaatgcaatcttagtagcacaattagtaccttgaataaattggagtatcgtatttcttggactatctgagaatgcagaggcaatttaaggatccctaattctaaggagaagaaacctttagtgtattccttcctgttgctttagtttgaattgagttttatatgtattttttaatctttctattttgattgttgtctaaagagtgtgaaagtgaattttgatatttttattttgcctggcgatgaatgccttctgctctggatatttaaaaattatatacacatatatgtgtgtgtgtgtgtgtgtgtgtgtgtgtatatatatatatatatatatatatatatataaaatttttctgagaacttttattaattcagcgtatctttgctaaacacctgccatgtgtcgtggtgttaggtctggtgatacaaacatgttcagagagatgattttctttcttttttggggggtgggtaagggaaagaaggcttatacaacagaatcttatttctcacagttctggaggctgggattccaagatcagggcctggtgagggcccctcttcctggtttgcagatggcttccttctctctgtgtcctaacatagcaaagagagacagagctctgatgacacttcctcttgttataagggaactaattccatcataagggccccaagaaaggtgcttttcaaaaacagttcagtaaaagtactgggttgtataatcactttaatgagtatcaatccatatttttaagatagaaatgaatgaaattagtaaaatagaatagaaataaggagtccatcacttttaagtaagtttcaatattgttcgtaaaactttggttcggtggtttgtgtgtgtgtgtatttgtgtgtgtgtgtgtgtgtgtctgtcggtgtggaaatactggatcactttgtaacatatattcaaaagcctctgtattttaacattatttctgcctttgagaggttcacattccagaggtgaagacatacatcctaagacaaaattataatagcattatgagaattacagtagagagctggacagggtctagcaaaaacagaagactaggctaaaccttccaaagaggccaggaaactcacctagaacggtggattttaaccttgcttatgcactgggggagattttaaaaatatctctgcccacaatagataccaactgaattgagcatagcatgtcctacccatgaatctattgtccagtgagaacctctgtttagagaaagtcaccttagaagaattgttaggagttatttaggttcatggggttgaaaagagcattcgtgatagaggaaacaccatatccaaaggcttagtcagtgtggtagtgtgagaatctgaaggaacttggctggggtatggttgctacaagaaatgaaattagatcaactggggctaaattatgtggaaagacagcatgatgtagcagctagagtatggaccttgtaagcaggaagaccccttatttagcacttactagcttattgtctgacctctgagtcccaattttactcttctatacaatgagtacatcacaggattttatcaggtttaaatgataagatatatgtaaaatgcataccagagaggcagactattggactcgaagggctcagtaagtgtaagctggctctctctgccccttgccacctatttttcagactctggacttttatcactttaagtcatagcctagttctaagcaaggaaatggactaatcagacatgtttttaaaagatcattctggtagtggttaggagaatgaattggaaagatatgagacccatgcagggacaacagttaggacattatttctgtaataagccaagcaagaattgatgatcaaagtggtgaggttgaacaaacaaaacagatacgtgagctatttggagataaaatcaacactgtcatatgttttgtgggaggtggaggtgagcagaaaatgtgaggtaaaatgagaaatcagtgcctgcttaccacttggcatgattgactgaaggtagtgtcttcactcaatcatgagttgcagaattcaagatggcaaacagttgtgaggagcaaagtcaagaacgtgtttgattttgaggtatctgtaagtgaaaaatcagaggtgaaaaccttacctctcttgaagcagttgtgaatgtaaatctaaggtttggaaaaagatctgggttaaagatttaaaattgaaggacatcaacatggaagccatagaaataaattatattacacacaaatttatgtcgttatttgaatttctccatggtccactcagaaatatatctaaatgtcaccaaaatgttacttactgtagtacagaattggtattaagtgatactattgtccatgttattcaaaaagacagttatagggaccctcttaataaactaattgtgaaaaaggcaaagaattagcaaagctttggcataaaattcatatcatgggccaggcgtggtggctcatgcatataatcccagcactttgggaggctgaggtgggcagatcacctgaggtcgggagttcgagaccagcctgaccaacatggcgaaaccccgtctctactaaaaatacaaaaattagccaggtgtggtggcacacgcctgtaatcccaactactcgggaggcagaggcaggagaatcgcttgaacgtaggaggcagaggatgcagtgagctgagatcgtgccattgcactccagcctgggtgacacagtgagactccatctcaaaaaaaaaaaaaaaaaattatgtcatggaaaaagtaaaagtctttgcataatgtatccaagatcatgaaaaactcttttcaataagataattagttccttttcttatataaacatggaaattttcatttttccttttattctcatattgatactataaaaaccccatcctcattcacaatactactgtctctaccctcgatagataccagttcaattgaacgtagcatgttctacccatgaatctattgttcagtgagaacctctgactataatgctcaggaatactcaagactcacatgattgtcttcttgctatatttagttactttattattttccattttgggaccctgaattcctgtagatctcagagaaaatccgaaatgaaataatgaaaataattaaaagtttagaaaagggagtcaatggggacaaatgttcaggactggtcttttatctcctgcaggaagaaagactgaatgcagaaaattagaatccatttttcatccagtcaccccaatttaatgcaatatgagtttagctatttgattttaagtgttgtaccgttttggaccatgttaccatggtaacatgaaccatgtctcattcatacgtaaacatgttaattgtattaaaacctttaaaacctacttctggatgttgccattacattaaacaattatctagaatgatacaaagtaatgactaaattgaataactttgtaaattaactattggattttgtaattttatatctataaaccaaaagaaaagcccacattggtaagaagacactgtgcatactgaaaagtcaattttgttagcctccaataaccattgtgttttattcctcgcagagcttttgtgaggatcttataagggaataaatatgaaagcactttgaaaaagctttcaagtgaaaggtccttattaattttatgaattaccattaaacaaaagtcaaactgaagatgtaaatctaataggatgctcttaaaagtcaatggatcaaagttatattaattaataaagaataataactaaatattttatgtttcataattggcaaagtatctttactgtcattttctaatttgatccttagtgaaaacctgtgatgttggtactcctattatttccattttcatttgagaagaataaaattggagaggttaagtaatttatctattgctacttgttaaaataactactaaattttattactcccagttaggagggcaattatataaactaaaagcttgtcacaataaatgtttacttttctgggattaaagtcatcatgtatttttcaattattaaggggggtaataataataatagctacctttttaaaatagttactatgtgccaaggtgtgtactaagtgctttgcttgcatgatgtaataccatcgtatatttagtacagaggaaaaactgagaggctgggtaacttctactaaggtaacacacaagtactggttgagtatcccttatccaaaacacttgggaccacaagtgttatggatatcaatttttttctgattctttttttggatttcagattttttcagattttggattacttgctttataattatgggttaagcatcccaaaccccaaaattcaaaattggaaatactccaatgagcatttactttgagaatcatgtcggcgctcaaaaattttcagcttttagagttttttggattttggattttcagatttgggatgctcaacccgaatatatagaaaagtcagcatttgaacctaagtttgactttctgatcttctaccaactctactgtcctacccattactctacattgactcagcattacagggaaagacccaagatcaccaaaagcaagcttcaaatcactcatctaatagaaattagtggaaatatttctacttcctaaacatccatctttcctttacattttaaagtcaagtttctacatctgcctcccaactgaaacacttctctatgaaatcaccataactaccaaatgcaaatatttttatcaagtcctcattgccctagaaatctactcatattttgttattactgctcactacagcctactgaaaaatgtctcaccttttgacttgccagggtgatatattatactaattgtctccttgtctctctaagcactcattccttcctctttctttcttctttttttttttttcacttttattttaagctctaggggcacatgtgcaggtttgttacatgggtaaattgcatgtcatgggagtttggtgaacagattattttgtcacccagataataagcatggtacctgataggtagtttctcagtcttcaccatcctcccaccctccaccctagagtagatcctggtttctgttgttcccttctttgtgttcatatgtactcagtgtttagctccacttataagtgagaatatatggtatttggttttctgttcctatgttatttcacctaggataatggcctccagctccatccatgttgctgcaaagaacataatctcattcttttttctggctgcacagtattccctggtgtatatgtaccacattttctatatctgatctaccattgatgggcatttaggttgattccatgtctttggtattgggaatagtgcagcaatgaacatacagctgcatgtgtctttatggtagaatgatttatattcctttgggtatatacccagtaatggcattgctgggttgaacggtagttcagttttgagttcttagaggtatttccaaactgctttccacagtggctgaactaatttacattcccaccaacagggtataagcattcccctttcttcacaacctcaccagcatctggtattttttgactttttttttttttttttttttttttttgagacgaagtctcgctcttgtcccccaggctggagtgcaatggcgcaatcttggctcactgcaacctccacctcccgggttcaagtgattctcctgcctcagcctcccaagtagctgggattagaggcgccttccaccatgcctggctaattttttatttttagtacagacagggtttcaccaggttggccaggctggtcgcaaactcctgacctcaggtgatgcgcccgccccggcctcccaaaacgctgagattacaggtgtgagccaccacaccaagcccacagtatcaattctatgcattcttttctgatttcattaatctcattatcttcatttgatatttagtcaatagttactgtcagttatgtgttagttattatactagaaacagtcttttctccatctcctttaatccaatgatttgaacatttttattcctttccaatgtctgtcccacatttcttactgtatgtaggacatttcttactcaaatgtctcacaaatgacataaattcagtatgacccaaataggccattttttataccaagtcttatttcctatcctgctgttcatcccggtaccatcttttcagtcagagagttcagatcatatagtcatttctaaatctcccacttacttgcctcactttcaagttcatttttaaggtctgtagattctgcctccctaattctttatgaccattcctttctcactagccccttacctccactctcattcacactcttactattttttaccctcctccactcattcctgcccaccagtggctccaatccaacttgcagatttccatttaaattaagcttcctaaaacatagcttaggttgtaactacaatgcaaattccatgagagcaaagatttcatctgctttattcacttgtatatatccattgtccaagactgtgtgtgtcacatgaaaagtgttcaataagtatttgtcagtgaacgaaaataatatatgactcccctcttcaaacaccttttttgacttcaaagcccttcagaatattctacagactccttcacctggctctccacaattgcccctgagtctcgtttccaatcttatttcttattttacctctcaatgcaccttcaactcctactaaaatgaacagctagccagcttacttctgtgtctttcgatgatcttgttttttgtcttgagattcctttttttcatctaagcttacccaaacattacctacttttcaaggaaagccattttcgaatcttccctttttccctgagcccccaagctggaagacatcttgtctccatctcaattcctataggcatttctctgcactttaaatgacgtttagtacttctgacattgcattagagagaggctggggtggatagtgtttcatagtgtgaactttgaagcccgactgcctgagtttaaatcgtgattctggggcttactgaccatagacgcatttctgaattgctctcagattatggagcataaatcaaaagtaatgacagctacctcttcaggttgttgtgagggtgatgcgaattaatgtactgaagtgcatggaacagtttctggcacacggtaagcacccaataaacatagctaatattatgttattactattttcaggcttatttttatgtatacatatagtatgtaattttatgtcaatatgtataaatagactttggtattgtttatttcactatcaccttgagagcacaattctcatttgatttgtgtgagaaactacttagaaagaaatagacgtgtgaatgaaactatgcttgaaatattggttactgtgagtgttgaaaatccattttgtttaaagaaagcttcaattgttaatcttccataaattttagttcttaagcgttcatattgactcgttttggaaaagctctttaaagtcttgggatataaacaaggctgaataccctcattcatgataacaaacatattatactgaaaattgtaagagagatattttatctttcataatgccctccttgggaaaatacattgacttggcccttctctttcaatcagacaccaaagttgagattgcctgaaacacagtttggtaaaaggagtttctttttcccaaacatcctgagtaacacaggaaatcacaccaatgactgatagataacgttaataaaattaataaagttgttttaaatgcataccatggggcagtggcaatgaaaacattgagaaggctgggactatttgccaactttctttgatctccattagaacctggacaagatccacataatttcagaacttcttctccaaacaagaattgaaaaggtcaggaaaagtttgaccacagaaaaatgtcaaagaattttgtgtcactttctcctcctcccttcctctaaccttgaataattttttagggttattggtctttgggagcagactttctagaccaaaacaaaaaaaatgatattcctctatgtgataggtaacaatcactacccatcctactggaaaattctcaaagtgtaaattgaggggataaaaaaagaatcttaagtcctttaaattatttttaagatgaactacattagtgcctctcttgtgcctttcataattctgataataaaacattccaggtattagtcaaagattaatggtattgaaaataatttaggttatcagcatgtgattttcattccacatgaggtccttttgcagtttacatggttttctaaattatattaaaataaaatgtcagaaagttcacatttttttcatgtttaacagcatcaatctttaaagaaaagttattgcacaaaggtctgtgcataaatcagccattctccgaagaggtaaaagaagtcattacgcctggttatgagagagagtttcatgaatgtaagagacataaatcatttcccactggagatcatattagtctagatggaagaatgtctgtttcttgatagtgagaaagcaacaaattacttttgtttgctcctgagtctgtggttgtccttgagaggtctgttagcatgttgactattgactattcaatattagcattataataacttacaatgatctgagtcacataaatataatctttcagttctctaaagattttactttttcctctctaatatctattcacctccaacacctttgcaaatatattattctctgggagttacaaagaaagttattctctgcaggaagcagcatttcagttgctctcaggagccaaccacatttcacctcaattctttgctcccaattcaacaattcaatattggattaaattcaaggctgtgaccccaaatagaatgagacctggatatttatgaaccacttgaccaggcattcttcccatgatttactccataaatcctttttagtttttgcagtagctttacaaatatttggaaaatggctgtgcaatgcagttttaaaaagtgcaatgagtagaggtagcttcttcacctggtatggtaaattgttgattctcttttggagtggaaaacaagtgttcttatttggatgcaaccattgcattgattagacaaccctaaattcatctttcatccatgacctgaaagaaattttgaaattcatgcaatatatacccgtagtggaaaatgtactttttgaatggattcctgaatgtgacttttaagaagagctattaagaagtgggatcttctacagaacagtaaacaggcatgaaaatatacaagttgataagatatggaactaccccaaaagaggaattaatagtggtggggcttggggcaggaggacagagagacctagccaaggaaggaagggctatattataatagagtacaaagtcctttagtcatccaagagaaggggcaccttctgcatcccttatgagtaagatcagagaaggtattctagttaacttttgctacataacaagccagcccaaaacttcatggcttcagtaaaaattacttgttttgttcatgaatctacagtttgctcaaggttcaatggggcttgcttatccctgtttcagttgatatcagttggggtagattgcctgatgctggaggattcacttccaagagggctcactcacatgcctggaaaataggtgctgactgtcagtttttcttcatgtggacctctccatggagcagtttgggctttttcacagtgtaagagttgggtcccaagagcaattatcctaagggacaagaaattaaagctgcaagcttctcaaggcctgccctaaaagcaagaatggttttgcttctcccatattctatttgtcaatcagtgacagagctctgattcaaggggatgagaacataaactccacctttccatggagaagtatcaaaaagttttgatgccatttaattaaagctgccatacaaagtttcttataaatgacactgagctgaatgaatactaaacagcaagtagtcattatcccagtcaagagaagttatctttgctcagaataccctttctctccttgtctacctggaaaattcaactcttggccaaagccctacctcttctcgaaagcattaccaggccttgcctctaagtgtacaattggagatacaccagtatactgatgtttttaaaactttaaacttttttctacaataaaacataaattaaataacttcccttctgacttaaaagctgcaaaatgctcatgacagtaactatataaattaaaattaaatcttaagcacgataaatacctctcgaatagcaacatagatgcttacttctttatttcacttctttatttgcttttctttgtctatagtttgccccaaaggtattttaataatatcgggttccatgtataccagtgtgtaccaattaatatttagaatatacctgttaataacctcatttgcatagccctactaatctgagcacagcgcagccttaagaaagtcttagtttttctcagtttagttcatctctcttctcttctcctcctgtctctcttatttcctatttctttttcttttcaagtgactttcaactaagtagaaaatgcatttcacatcactatgccggcctccaggctctgtctatttcattcacccaggaatgccctttctgaatgctttctctcatttagcagctatctattgaagttggacaaatgatagaaattcatttcttaaagagccagaacatcatcttgaacaagaagttaaaagaattcagcaaatcaaaagatgagctaatatgggtgaatcttagaggcattatgctaagtgaaataaaccagacacaaaatgaaaaatattgtatgattccactggtatgagctacctacaacagtcaaatttatacagacgtaaagttgaaggatgttaccaggagctggaggaagaagagaatgagggcttattgtttaatgagtacctgagtttcagtttgggatgatgaaaacattctagagatggatagtggtgatggttcaacgataataataatataatattaatgtacttaatagtactcaactgtatacttaaaaatggtcaagaaaatggtaccccgttatcctgatgtgattattacacattgtaggcctatatcaaaatatctcatgtaccccgtaaatatatgcacctactatgtacccataaaaaaaatttaaaggctaaatggccaggcattgtgggtcacttctgtaatcccagaactgtgggaggctaaagcaggaggatcacttgagctcaggagttcaagaccagcctgggcaacatggcaaggccccatctctacaaagaattcaaaaattaactgggtgtgggagctcatgcttgtagtcccagacacactggaggctgaggcaggaggattccttgaacccaggaactggaggaagcagtgaatgacactgtaccccagcatggtcaagatcccaaatcaaaaagaaatgattaaaatgatcaattttatgttgtgtatattttgccacaatacaaaaatggggaaaagcctattcgcttttaagtatccttaaaaaggcacagcttcttcagctaacagactctaaaactttttttaatagaagtattaaggtatttagagagtgcaaaatatcttattttaagtcaagaagttagggtcctgttcctaaacactagcctctgtaatcctggggaagtcagtgctgttggagatctcaggttgatcttctgaaaaatgatggatctaggtaaaagatatgtttctccaggtttacataccacggacaccatctttacttggaaactttattaaaaatgcattgtgtcagaagctctctggggatgggtcgtggaatctgcatatgtaaagagcccctaggtagttcttgtgcccacttaaatttgagaaccactagaccagatgttttgcttatggccctttcagctctgaaatttgaaaaaaaaaaaaatgattctgcaagacagagtctctgtgcttttgcaggataaagaaatgaagaaaataatacttcctgcttgtgttggagcatttttttcatttggtatccccatctccagtggctagccaatcaagaatagtattgtttattcttcccactgttttgaagatacaaaaggaaaagctaagccagatgacacctaaaggcttccattaccattttcatgtttttccctttgcataaaaactgtccatgcctccatcagagccatgatcactagtacaatgttacactctaatgactcatgacattaaattatatcttagcctaatatgaccaaattacaatatcagaataaaaatttcttttttcaggttgaatcccataacttaatccaattataatactggctgaatttttcacaattatgtctcagtcttgatttagggaatcttctctttatcataaaaatgcattttgttaaacatgtttcattataatcaatttctcaaaagtaaagttaatcaagagaaggaaaaaaggttttgttttgatttgatttggaatgtgtatgtgtgtttactgtattgaaatagattctgtctgaaagactgtatataagataaaaagtacagaagagtagtcagagagttattacccacccctgactgatggtgaatagattatctaagtatcccgtaaaaggcacaactccttcaggtatattttacaaattaattagtaactttctagccaaatttgtgtcttaaagacaccagctagaacttggttagttctagcaaagaagattattttattctgaaacaggtttttgttgtcgttttacttatttgaacttttttcttgaatatgtatttctttgcacataaaatatattgacttatgaatgtgattaaaatggaaaataattagttgattttagagagacagagagaggagaagagaagtgtgaaggagagagggaggatagaaaggagagagggagaacaggaaggacagagggagaatgggaaggagagggagagagagagacagagagagaggaatggagtgggtaataagcaagagaaaaatgccaatcatatgctttgctagtgtgtaaagtctgataacccaagggagagaggactactctggcctagtgaaacaaaggaaagagaaatatggtagaatattctcctggtgcttcaccaaatgtgacaccagaagtctgacagaagtcatgtcagcatttgagctccataaaactcaggctatcgacctaccatgtgagagtctcaaaatgagtttaggtaggggcagaggagttgaaatccagtaacatatgcaacagtgatcacaccaggattgcacatagaaagcaaattagtcctctaatagagacgccaatttgaaattcaccctctgagcaggtttttaagcacactcttcttttacttttctatttacaaaaatggaacaccaccagaaaaacaagaatttgaaagacgagatgagaaaagtaagttgtaattggaaacagacagaatgtgtacacaaacacacacacacacgcacacacacgtgcatgcacaggtgatgagagagtagtttgcctacatggtgtatctgactaagaagactttttgctctggttgtcttacaggaagtgactaaatctcatgatgtgaaatattttcttgcatattgtattggaaaagaaaataattttcccaaactccttaggggcagtgttgtcttataattcccatatagtatatgctcttcaagtaagtaactccagagttgagtaagacaagactcgtgactcagatggcatgctctgctccctagactagacattgcatcagtctgcctatactcacatccgctgttaaaggattgcctccagtaaaatatgtcttttaattccttatacaagaatctggaaaaaaaaagtaagattctctatttcttaaatttagcagcaggttaatcactgataacaataaaaatacataacaatcatctagcacgggtaaatattgtggcaaaaattacaccctgaagaattcagtcaaagatataagtaagtacacatcattgtcatgttccacaatatatcatctgctttaaagaaactgttatgtagctgtagtagatttaatcattaatcccatttcttctccaccttctgcaatcacaaccttaacaatgcctccttatgagtggaatgtacttcccaacccctagtcttaggggttggccatgtgatttgctttagcaaatggtaaatgagcaggagtgagaggtgacagttttcagcctaggccttaagagatctatacattcctgtttgtgcttctgctatcattctgagaacacgtccatctaggctgctggtctcaggaaaacgataaaagacatgaacagcagggctgcactagccattcacatccaggaaaagaaatgattgttgcataaagccattgagctttattctacattactgtgacaatagctaattgaaatagtaaatatactttggtttttcctaaatgcatattgaaaattaataatattagccatctgtatgataaaaatataaagcctatgttttattttttaatggttcactgccctaaataaatttccaaaaagtagatgttcccttgtctagtgatgtcattatattttatttatacatcataaacacactgtttatttctgctcatttttttgtaagtaacatgtgttaccgccaatcttgagatgatacacacacttctgtactaaattttggaaaacatattagctacccactccttatatcaaaatattgcctaataatgtgttttgttttaatccttcatgaatttccaggagaactgaactgatacttgggtttgtgagatatatgaaaatagtgaacatgaacttctggtttaacccttgtgatgataatggaatcatagctctgttaattactcttgtggtttgtcttcctagagataatcatgtacaaaattcctttccaatttgttatataatattagaaatacttccaaaattggcatggatttattgttatcatttgttggcacaatcattaaaacgaaacccataaagctagataattaaatgtttacaaagctatagtactcaaaacaaaaacactgtgaaaagagattttttaaataatagtttttgcatgccttttgaataattggattattctgaatttcttcatgtttagtccctgaatctaagtcataccgtctacataaaaatagatgtcagctgaagaaaaccaggcaatggatttgtcttgacgacaatctttttatatgttcagacttcatttaacattagacttgtctgtatttgaaattggtatttctttacatttctgaatttagggaaatggcacaagagaataacattaatttcctctgcattttggcctaatcaaatttgagcctttcaagagacacagccaagtcaattcaaagagacatatgaaaagactactgttaatgtatctttaaaatgaattagcggcatgaactgttgctaggtgagttaggtatagttgtagtttttagtaaccctaagagaagatgcagtgcattctaaaatgtcacaaggagtttgattgctcaaaattctgggagattggctctctgcaaggcttcttgatgtcattgttcctagaggaatgttgttccagtacctatagcgattgcagccataactatttatgtgtcattgtagccattgttattactacatgcttcacatacctctactgaggtctaaagaattagtggacttcatattctggagagaacacttgaagaaccaaacagaagtttgatgtgaatctgcatatccaccattattgttcataggttctcaggattagttgagtgatgccttaaagaaagaaagtcagatgataggtcttcctgctgcccgcaccacatcatgagtgttattcctatagaggaggagtaaagagtgggaagaaaatgaaatctgtcaatactgtgaatatataaataataaaagtagcagtaggactgattaattctgaatcatctttatgaaatgactggagccgtgaaaatgctcagtctgcacagctgattgagaaatgtatgcaatctgttgatcggaatttatttgtgaatgctctcttccagagatttatataccagagttcttaaaacgaattttgtccccatgaaaagaaaactacagatctgtaagactgcaatttaaaatggaagaaaacatgttcccacttgaagaacaactttcaaacaaacaactgatacaaaaaagtcaaaagctgttttgttttatataatagtttcagaatacttccagtcaatatataccttggtttggtgaaaaaataaaaagctaaatccttagatcattaactagaaatttttgtaaaataaataaaagccgtgggttttagtgcagtgatcccatgaagaggaatatattcaccattggtctcttaatctcagatagaatgtacatgttactttattttataacgaaagcaactgtgttgtgatattatgtataatattataacaggagaagtcctcttagctaactcagtaatcaataacattgtacgttgtgtgttattgtaaccaaaaactatgacagaaccccatttcataagatcagtttatccacctatatgatttatatttgaatattcatttcagtacttatgttgcttaaacaaagctactgtattagtccattttcatactgctataaagaactgcccgagactgggtaatttctaaaggaaagaggtttaattgactcacagttccacatggctgggtaggcctcaggaaacttacaatcatggcagaaggtgaaggggaagcaagcatcttcttcacaaggccgcaggaaggagaagcgcccagcgaagtaggaagagccccttataaaaccatcagatcccgctatcatgagaacagcatgggagaaactgcccttatgattccattacctccacctggtctctcccttgacacgtggggattatggaggttatggggattacaatttaagatgagattgtggggtggggacacagccaagccataccaaaaactctgttttttgtttttgtttaatggaaatgatttagaactttattttctgatgtttctttttcataaaaccacgacaccaaaatctacttttcactgctccattcaactagtagagaatatctaatctcttctcaagtatttctttctcaattatggtggttttagctaagaacagcttatggcatgcttttctaaataatattagaacacataaattatctgtacctggtattaccacattcattgctcattttaagatctcaattgatacattcaattcatatatatttaaaattgattcatttagagcaagagatacaggcattttaatgtattacactgctactaaagcttagcaaattattcttttttgtgcccacaaattatcatccattcatgtcctaaaaataaaattgaatttattatactttcccatttatccaaaaaaaaggttttttttaacaattgatgcagatacacattttcaagctaaaaatatgtgtgaaagtggcctctttctcatagtatttattttaggagtctagcaataatttttcttaggttatcagcacatgtcttagcctgaattatttgaattcagtctgtgtcttcaagttcagatggttatgtgatcttgttaagatctcaaagtagtgggaatgatggagtatacaacaacctcattgttttttatggcaactgtcatttactgaaggacataaggctagcagaacatggtcagagaaggaatcaaagtttggtcagccaactctgctccacagctacaagctgctagacaggcataaatttttccaaacctacacaaagggacttagggcccttggctgagagcgacattctaaccacttccttatttatggctggtggggtttgtacattttctcatttctgtataacatttcttgactgtaataagcaatgtattcattctgctttaccactttcactaaccttaacctcaatatatactcaattaagcaattgaaaacagcagttttaatcttttgacataaatgatttcctccgaagcaaaatgctggaaatcccctcaaatgcaccttttattgatgaatacctataagcaccacctacagtcgctggaggctgacaggaaccaaacttgatgataaccactgagctgagaattttcaactcactctttttccctgtatggttcttctagctgcattatttcccactatttaaagctacagctggtgaactattcaaatatttaaactttggagaagaaaatatcaacttatcacaaccctctttttatattctaaattcatatacctgtttggtacttaaaggaaaaatatgctgaggaacaggctggtcataagactgtatagaacgtgcatcttccatcctattgaggtgactcctagacaatgggaaaaatgccttcactcgacttgctcattaaatgtgaccgtagctgctaatcttttggcgctgtctcgaactttaattagatgtgctcttctcttgaaggttggaactacagtatccagagaccatagaatcacagagttgaaaacaaaatcttggaaatcattgaatccacttatcagatgagaaaaaaaaaataagcccatggagatagccattttaaaacatatcattctatttagcctccaatgtaaaacaatgagttactatgtttcaataatgttgatgttaagaaattatttgatagcttcctcacttggtctcctatattcctccaaggttactagttaggaagactgtcattcaaatttggagactacataagaagcagaaaaagcatataaagaggcacatgaaattggaacttttctggtaaaatcttctttcttaaactctcctcaaataagctgttggtggcaggaggtgaaagacagcctccaccctttagcacagtccgtacttgtcagcatttcccaggaagggtgatgtctggaaatgatagagattgtggaagcacattgcattatgggtcaagaatgcgaaggtcaaggagtggagtcttcctttacgaagtagtgttaactgcttggcgtggcattgttgtaaacagaagccaccaggaaggatcatccttaggagggaacctgtagatatgactgaaaacaagagagatccagttttaccactctggaaacataggtaatagaaagcccaaaaggtaccttatcacttgtttgttcctttctgtacaaaaggacttaaatcctttctgagcaagaaagatatttgagaatccaattttgttttaaacttgagcttagcattttggaactattccaaagaccacagaattcacagtcattagcataccacagcagactcttttcaaatattgcaaaccagaacagtctgcttgaaaacctggaaatacgacctagtgggttcaacttgactttttttatttctaacccttacccctaggcaattattgataactcattctggtacctggtatgtatatggactttgttagaagaatttgacaactttctaatcatctgttttttttcttttgcttgatagacatacatttagtagaactttactggattgtattgattataaaccacatttcagttcatatcagtccattttgctgcacaataaacaaccaaaaaaatttaattcagtggctaataacaacaatattgatttattcatggagctgcagtttggtagggtttggccaatcatggctggaaatggtttagctatgcttatctctaggccgtcggttctgttcgggtctataccacatattttcttctgagactcaagctgaagggacatcagctactcggggtatgacagagtagcacaaggcaatgacagaagcacaaacaacacttttcaaaatctctcctcttgtcacatttgtttatagcccattagacaaaacatgtcttgtggccaagcccaaagtcaaggggtaggaaaatactttccacctatgtgaggccatggctggagcgtgaatgtatgatactactagggatgtgaaaggattgaggccaataattcaatcttctattggagacaagctcaacgagttagttaaaatggaaggctaatatttactaactttgcaacccaaggaagagaaagcaggatctctctgacgatgacggaatttcataccctcatctttgaagttatactaaagcttaggaacaaccgtcagataggactgaattgctcccccttccagattcagcatgtgaagtatgcagcatcttattatagcagtagccaaaacagccgttttcttcaatttgggaatacaatgtaggtgtgttaattttcaattaagagttctaaacttattatctgcttggtagctcttccatgtgacagtcattccatctgactcttcatgttggcttttgaactaaattttaaaggaaccgccaaaatttaagggccatgtactttttataacctgtttgtggtctgggtaagaaaataaaaattatacaactgttctttttgaccagccacaagcatgtaatgaaaatgactgttttggctagcagatgtattagaagctttcaaggtgtttaaaaaaaaaaaaaaaaactggagaaaggagccagtgaattgacctcaaacaaaacaagaacaaataaacaaaacacttgtctgcacttccaaggaagggtgatatctagaaaagatagagatgatggaagcaccttgcattatgggtcacaaacgtgaaggtcaaggggtggcgtcttcctttatgaagtagtattaactgcttggcagggcattgttgtaaaaagaatccaccagaagtgaaacaagcagcactaaaagttaaaagatttatgtgtaaacctcatctaaggcaacagaagccatttctataaaatagtataggaccttttattatatatggtcctagagtatattaaaataagtctgtttgggtccatttgcagctcatttgaagatttttataggaaaaacatcctcaaaaatatcatactacagtgccttgatgcttttttctttttataaggtactgccagcccaaatagtaagaaaccgatatgatttttgtccatgtgaggtgtttaattgcttcccaaaatatggttattgtgtagatgtcactaacgaaatatataaagagcagtatttgggaaaatttattttaataccacctttttccttttttaccctaaaagtatttatttttttcgtagcatacactctgtgtctcagtatcattgtttttcataaaaacataaattcttaacagaaaatttcctgcaagctcccctaagcttgaagagacaaaggagatttgtaatgtagctcagccccaatcagggtaaaagaatgcagggctgactttatacttataactcagaaaaaggttatgcttcccgtctcttcacagagctagtctcttaattgattccgaactaggaacatgtacaagtggcccacgatctggaacagactggcggataatggaatattgagaccttgtctatggtcagccatattaacactggataagtctgataacactgtgattacatatgtatcaatatagtatgctgttaatatattaaaaacttatttacaacatgattattggacaactgttacagtacagccacatcaatcctatatcaagttagaccatgtcaactggttttgtgttgagacacctgtgtatggacatagtctgaacttttcatagtttgtgctaaatgatagcaatcaacatcggtatggcacttacagtttactgataactttcatgcccattaacatagtaccgcaataactctgtgaagtgctgaatttgtgtcctgtttcatgattgtatttgtgttgatatctcagtcagtcagagtcccaacaagaaacagatggcacattcagattagggtaagttgaggagtctttatttacaaggcactacatactcaggattgggcagggtgtagggaaatctcacaagatagcacaagactctaggactagcagcagcagagctgtcacctctcctagacctgaagccgttgttggggagagaggtttctcagagcccagaaaaaaagaaaaaaaaaaaaaacatcatgcagattttaatgccttgggaggagcagtggctttctcttaaggacagaatttgcctcgaaatgatactcagggaaaaagagatgaagggaatcaatactctgacccaagactctcccttctctgcagtggtttgctagtcctctccttggtcaaacccaaacagaaaaccatagggcataggagtctaatgatgtaatccaagtcagccccctggaaggtggaaaaagaagggaaaatggatctggatctggagggataccaaaaaaaaaaaaaaaaaaaaaaaaccatagttggcatgcttgtttattgatattttcttgcatgatataagaatccagataaatatagtaagaggtctattttactaacaattttaggcacctaataataatactccttctttgaatgtataacctctagaattggttcagaaatgtaactgtgccgttacaatttctattagtattcaacagtagattcatatccattcatctatgactggagtatctgccatttgctggttagttactgtgtaaggtactttgtaaggtatagaaatacacttggggtgcgatggctcatgcctgtaatcccaaggatttgggaagctgaggcaggcagatcacttgagtccaggagtttgagatcagcctgggcaacatggtgaaaccccatctctacaaaaaatgcaaaaagagtacctgcgcatggtggcatgtgcctgtagtcccagctactcgggagcctgaggtagaaggatcacgtgaacccaggaagtcgaggctgcagtgagccataatggcacaactgcactccagcctggatgacagagtgagaccctatcaaaaaaaaataagaaataaatttgagctcagtgacctacattctagtgcagaaaaaaatgaccatagttgattatgagattttaaagcaataaaccacatgagacatactaatgagctcataagatcattcagaaattgtttattatgaacacatagtactttcagtgtggcattaaacagagatcactgtccttaaacaagttaaaagcagaatcaaatcatctgcaaattaacacaccactaaactttaagcttcttgagtgattctgtaatttttaaaatgtcttcagcatttcagtgtcaagatagtgcaaactcagtaaaagcttgtggaattgcattaaacaaaaccaaaataaatagattttattaaaactatatacaattgtctttctaatcatatcctctccatgaatagggaagaaataattttaggaatttaaatatcttctatcttaatagttcctcttatttccctcttaagcaatgttcactccttcaaaaatatttattgagcatctaatatgtacttaacactgtgccaggtgctgtgaagaatgccaaggaaatagaatgaacttctaattctttggagttccaattaaataacctaaagttaaattggtttcggagagaacattatgccttcgagactgtaggcttctcttgattagaaagtcttaaacattttaagtaactaaacagattaaggagaattcaaggatgcctctcactagtaaatttggattagtctggcaaacttcagaccttaaatgcaagatttttaataattaaaagaagagagaaaatgataattacatttctagagtctatgtttaccattcagccttcttaatcatttcctaagtatatctggtgatcaggattttataactccagaaaatctttctatacatcgcataaatctcttcttttaaaaagctcttcaattttgtattttgttaaaacttaaaagcctccatgaaaaatgagacaaaagtcagtgagaggctgtagcaataaaaatcagatgtgattttcttttgaataacatctgtttttacagtcctttcatgttaaactttataagaatttattataaacagctttattgacagttcaatcctatttctaaaaggatttattttcccccaatggtaagagttttcttttcttaaacctaactagttgcagatatttcagatactacatttctcattgtgtaaggtaaagtttctgaccacctgaatatgacttgtagctcctgagaacaatttgtttagtaccgatatcatgcagtgacattggtacaaaggaattttctttatttcactgtactgttttcagttttattctatagttgttaaataagaccattaaatatttttattagtcttatttcctgtttaactaggtgggtttttgatctctgttcagtaaagcattgtgctcttcagagcaagcaattgaaaagcaaatagtgagtatttctactgtaaaagtttaacattaaaagatatacacacagccaggcaaggtggctcacgactgtaatcccagcaatttgggaggctaaggcaggagaatcgcttgagcccaggagttcgagaccagtctgggaaccatagcaagactccgtctctaccaaaaaaattttttaaaaaatagttggatgtggtggaacacctctgtaatcccagctactcaggacgctgaggcaggaggattgcttgagcctgggaggtcaaggctgcaaggctgcagggagctgtgactatgctactgtactccagtctaggtgacagaatgagaccctctctctctcaattaaaaaaaaaaaaacaagatacacacacatatatttgcgtaggtaactctaatttcatttcaagtatgttatgtaacaaccatttgtgtagtgcttgtaacagtcaatatgtaaatactgactcatcttctttgacaattctacctagatacttattagagtcccccttagtcattgaaaggaaggttaaaatcaaaagacgttgtttgccaaagtaatgaaagaaaacttataaacacaatgtatcatgtctggggctgaactaaaacccttctgatatgtggtattaacagatcatctttcatgacagtaccagttattagaaataaaatgattggagttattattaatactaacaatagtggtattcttaaaatgacttccttatttatcttcacctttatacattctactactgcttcaagacccatcttgaattcttcttccacagaacattctgcattaatttcagccaacattgatttctctttttaaaatttgtcttgcacagtgaattagaaaaccaggaattggaaaaccagaaaagcttattaagtaagaagcagagaggagagagtttcaacaaagggccattctaaagtggtctactgcggacaccatactgattatagttggtgattaaatcttatctttccaactgattataaactcctccagggcatactcttatattccacaagatgcttatctgggtgcagagcatgcatgcagttggtatttgctgatttatcaactaactaaatcttaacatattattattaacaatttaaaataaagttaaatgtatcactctccacccctcaaagccatttctgttctttgttttcatagcaccattattatttcctgcatagtattttttaaaaaccgtatttttaaaatttatatatttgtttatttgggtatacttcactagattgtaagcgtcacaaaagcagaactattataaccccagccactaacacaatgcctaacaaatagtaggttctcaatatttgttgaatgaatgacctacagatattacttcattatgaaagattttgctaagttgttttacatctattttatccaaaactaaagttcttgaggcaaagcctagaatatcttctatgttctcacaatgctctgaatcagtgcttctcttaatatgcatagcaattgcctggagagcttgttaaaacatagattacttagccccaaccccagagatgctgattcagtaggtcccaggtgatgctgctgctgtcagtctctggcgcacactttgagtagtagggctctaggatgttatatgtacagacacatgctgaatagtgggctatgtgcttacttgctggctaaataataaatgttctcactgagtcatagaactttgaaatttgcaaggacttttgctattatctagtctatggatagcaaataacctgataccgtgctatagtgcttgactgcatttaacctgcagaatcctcatgagcagcccagcaccatcactccaagtgaaactactctcttcttgaggttgtccaattctatcaattaaagatgaaaaccaggttctgagagttgaaatctctggacttcaaaggtccaacagcccaggtcttctcaattctcgttagtgtttcagcagctgaatacaaatttattaagctgtatcagagtagtatctgtcaaattggagtgtccataatatgcttaaacagagaactccattccaataacatgaactttccttatgctttattcatcatcgcttgaaattttgaattttgcccaaagaagtttataccagtacatgttaaattacatcatagccttctttgtataaatcttagagtagtttactgaagtacatcgcaaagttttgttgtttcttaggtgattttaattatgtatgtttactttcagtaatgcatcttttctccttcatcaatattatgttatgctagctgtaagtacaaaataattgagaacaaattatgacaaattgaaccaagccacaaaaaaaggagaaaccaaatacttttgtgatttgagcttttttcagtccttgaaactttaagaatatctgtctttattaacttttgctttttgctgatggtttctctcattttattatagcttatagcattgtaaattaatttaacatgaaaggataaaaacgttgcttttgaaatgtttctcattaaattatgaaaaaatattacactaaataaaagaaaggaatgcctctggtaccagcttctgtttgctcaattattgcagtacccaaagtgaattattacacagttaactcagaggcaatattattgtcattatattataaaatagatgagttgcaatcttcaaaaaaaaaaaacagcataggtcctttgaaagtgaaataccttttttccttgtgcttcatttaaatatatactgaccccagttttgtttttgtttttcctttttagagttcttgctaatgatgggcccaaagttatattaagaactgcaaagtaaatttcaaccaattactttattcaggggagtcattaaattgaggtacctctgaaattttggaaggaatgtactgccaattagccgaaagcactactcaatgtcctttctatggttataatctctctagtgtatttttaattgaagacaacctctatagaggaggtgagaagttgctatttattggtacttgttaggatggaatcaagggtgtggaagatattcatctatttctctctccagctcccccacacaaaaagaatggtgcttaatccatctgaagcatttggggagcgagggtaaagatgtaatatttaccatgagccgaaacagatcttcagaagtggaaaatggaagcatattgaagtccctcaactaaacagactttcttccatatggaattcaatgcattaatgttttcaaattctatagcttcaaattcttaatattttcaaattatgtgagcttatgtcaaaacatttaagtgagcttttaacaatgaggcaaatatttgaatcatttgtctacataacaaatactactataaagcatattaaatgttataaaaatcctaatatactaatgtaagctattataaagtacaaataattaaacaatatttatatgatcaatgttttataatacgataaacacattaaataattaaaaactcttccaccgtgcaaaaatgactaaataaattgttaatttctaaggctttttgagattactgtgaaagggggtatagtttcaggaaaggtgaaacttcccttcaatgtgtaaaccattaaagaacataataacctactgagtgtgggtctcaatgatatgccctggaaagtatgggcaactactccacacccaattttgtctttatatgataaggcacagcaaataattataatgcaatggataaatggtaaatcccaccaaagattaaccaatcagagcaggatgaaaattctgagtttggaaatctattggaagatttacagattagattaaagtgcccagtaaccaaactatcaaaattatatggcttcagttaattaatgatttccaaggtttttagtatactgtattacaaaacacattaagcatcttaagcattcaaacaacatttttttgatgattcagaaagcatcacaaattgttatatcagctgataataacttaggtacatatcaattaaacttgtattatagacacgcagaattcttcagaccagaagtcgaaagggcttctctagtttgtttatgctaagttgtttagagatgacataactctgagctaatttgtctattgcaatggttctcaaaatggggggcgggggatatttttacctccaccaagtggacatttagcaatatctggaggcatttttaattattattactggattggagatacaactgaagtctagtgggtagaggccagatatggtataaaatatcctacaatgcataggatagccctccacaaggaattatttaggccaaaatgtcagtagtataaaaattgagaaatgctagtctaatatagtgtttactcacctttcctgaaactatgtcccctttcacagtaatctcaaaaagctttagaaattaaaaaatcgtttagtcatttttgcatggtggaagagcttttaattatttagtgtgttttatcttatgaaatgttgataatataaatattgtttaattatttgaactttataagagcttatattagtatattaattaggattttatttaacatttaatatgctttacaataatattcattatatagacaaacgttttatttttttcactttaacaatgatttttaactctaattacataagaaaaagtatgagttaacaattttttaaattacatgcttggtttgagggccaaatacacatgaaaatgtggactaaaatttaaaatcaaataaaatctataaagtcgaggaaaaagctacttttatgacgaggcatggggaattcttcatagtttttgggttttatcagaagttagctattttttttctttttgctctgtaaacaatcagataagagaggctcaaatgacattttcaagtacatcttaacaaaatacactttgagcatcaattgagtaaagtttcattcttttgaaactttggttttcacaagatttcctgagagttttattttattggtgttctgtgggacttgggcatcataattcttacaaactactcagctcaatctaatgtgcagcgaagctctgggaacttttgttttgtctagtatccagttggaagattctatagctacagagcttgggtttaaaccccctccaagtctttaccagctacctttatgaccctggcaaattacttaaactgtgtgccaccattttctcctctgtaatacggaggcaataaaaatttccacttttagattttctatatgcggtttacaaattgacttactctgaagatcatctggagtaaaatctggagaaatatgatcccttataacttcttcaaccctttatatatttcaacatgagtaaccaatgctctaaatatggatataaattataagaataaaaaatctaggactattataatggtctaaactctcttcatagctaaaagtgttgagtaattaaaccagttgagcagctaaatcatgtacacacttctttgatccctcccacgatcatgtatttggcattgtaatgaaaagatatgtttattttcgagaatagacataactacctttaataatatgatcacccagaaatttttacaaacccctggaaaatttcatgaatatcaggctgtgctcataaaaccttagagatgagatcacaatagactgggtcaacatatagtaatgagcaggattaataaaacctcagatgggcatttacaaatgagtcaaaaccatgagtataattaaataattgtagcaaaaaaagagccttgggtaatcctttcagcaaacgtaatcgaagtgattgcatttagaagacaaatatttaatttggtgactagaaggtcttttattattccattatgtctttgtgtgtgtgtgtgtgtgagacacttttcaaggtcaatttttacttataaattgtctctaattaaaaattgacttggttattaaatcattgaaaattggccatcatcaaattcctcattaaaatatttctatgtgccatatatatatatatatatatatagaatatatatgtagaatatatgtatacatttatttttactttttttttactgtgcctactagagaaatttaaactacatatatgtagaatatatgtatgttttaactagacatactgttaagtacactatacctaatatttggcaatattaataccatctcattgagaaacctggaatatatgcacattttggatgtctattatatgttgggcactggactagtcattgataatacagagattagtaagactcaggttgacttcagccatgttgtcaggaagcacacactctagtttgggacagcgaggagaaattcaataagagaaatatatataaggcataatgctctaggagaatatgcagtggataactgcccaataggaccaggcaaggctttttagaggaggaggtggcatttgagtcaagtgttaaaggctgaatggaaattcactggttgagataaactccttaggaggaactactttaatagaacttgccgttagtcctgaaataaatggtgtgcaaaatcattaccatctgtcaattcactcagtctactttgctcttaacttcagaaaaaaatcagaaatacaattaaaacatttgagcctattttactgtcttttaaaatgagttaattcaaagaggaaattaaatataatgagagagaatctcccccgaggattgggggctggggaaatgctattgattctttgcttgtgtttattttctctcaaaaatacattatgcataaacttgatgatcaaaaattcagattattacatttctaaattggcaatgcaatttattgcatcatacatcaatcacaaaaatgctcatcttgctgactttcataaacttctaaatgaacaaaaatgcaaaaatagtttatactatattacactatagtagatttgttaaactaaaccagaacaatggtccatgaaaaataggcctctgactccaaacgctcacaccacaggatctctctgagatttttgtgtcatttcaagtcagagaaaattgtctaataaattgttggcttgtaacaatgaaaactaagatatctgtggggctattcttgttctcttcattttactacagcagctctgcccagtagaaataaaatgtgagccacatatgtaatttaaatttctctagtaggcacactgaaaaaataaaaataaagaagtgaaattaatttcaacagtatgttgtatataacccaatatacccaaaacattgtcattttaacatgtaattgttacaaaagttattaattagattttttccgttaagtatttaaaatctggtaagttttactcttacagcgcaactcagttcagatcagccacatttcaagtgctcagtagccatatgtgtctagtggttaccatattagaaagtagtttgagagatccacattaaaccaaaaggaaaagaacttccggcccttcactgatgagtcactcttcactgctaaccttggaagcattcccaaatgtagtctacagagtttaaatagtctatcttaacatctctcagggcttcagtcttaatgccatagtatttttaaagaatggtggatattcttttttacagaacactctgtaagagcaattagaagtttatgatgcacgtaatgcaaaatacaggtcatttcccaagcctattttaaaagcgcaaaaactgtagtcatttatcacccctgagaatgttgtcttaaatgtcttggtttggatattggtgatgtgagaactttgtgataagaaagtagtctttaagaataagatatcagactaaaattcatatctagaatgaaagtcttgtttttaatggaagattaagagcaagtctgattcagatcatgcatggggtacactagtctaggaaaacactagtctgaaaatatactaaaagttacttcgcaacttaacaagaaaatgtcttgtgggtgatgtcgttcttgatttttaggcaaacctacctacctttgcaaagcagctgggacctttttgcattggaagaatcatttggagcacaaacaaaattagattatcaacactttggaaaacaactacgaatgagcaatcagaaacctgaccttaagattacttgtgaattgtgaatcagcaaaataaactcgattgttcattgctaagtgtatttcaattatcaagggccttctagattataagtagtcttttttttttacttagtttacaattaagatgtgtggtatttgaaatacatttgccacagggagaaatataaattataattaatttcctaggctaattcaatttatgacatacctatatacattatctgtcatctataatttttcccttattgtttacttcccactggaagaatgaaaatggaatattattacatggcacatggcttgatacttttacaaactctgacaattatgtatttattttgggaggcattgagtttatttgttttatttatataaatttatgaggtacaagtataattttgttacatgcatagattgtgtaatggtcacgtcaggccttttagggtatccatcaccttaataagatgcattgtacccattaagtaatttctcactctcataaaattctaattatgtgaatttaatttaatctatttaatgtgttttaggcaaatatagccggtactataaacagttgattttaagatatcattgcttacattgagactaagtaaaacaaaatgggtcaataaatgtcaatctagataacaatgtcaactaaataagaggtcaaacatggcagtatttttgaaggtgatctgtgaaagtgattatagcgtttacactcatggaaaatgccttcagagtttcaactaagaatgccaacagctcattcctttatcctgatgcatattgtcttccttctcacccccagttccttcttcccctaacccctacccgctttcctttgctgattttgacagaaataggacccccaataagtcagggagatagcaggaaatgggataggatagaacccggaatgatagaatagctgagcctgaaggcatgaagaaaggctcctcctgacatctaaatggagacctaagagatgggttggtcaggtagggggaaggaaacatgaggagtattctctaagccaggcaacatactgtgcacaagtctgaagtcatgggaaagtgattttgagaggattgctgcttggtaaacctagagtttgaattgggagagatgaagctagaaagttagtaagggtcagattttttttttttttacttgcatgacaatggtaaaaaccactaaaggttctgtgttaagcagaggagtgacttcatttaaaaaggtaaattggattgaaatgaagggcataaactgaggcaaaaatatccttcgttaagttattgaagcccagttgaacacactggtggcttaaactggagtattggtataagtgggggaaagaggttaatagattccaagttgaaaaaaaaaaaaaaaaacatagactttgctatctagtaatggattaatatacaaaaggaaaaagtaaagtttctactttttggacagctagaaaccttcaccgaagtagggaacccaagacttagattatgttgggaggggcagggtattttagttgcacagggatttgctttacagaaatgactgaatgacaatatagagagatcaattccattaaaagaagtttgattactcacagttctcaagggaagagtacatactacgccatgcaaagccatgcaggaaaaaagttccagagtcggtcagcaggcagaaaaggaaagcacagcccaaaccctttattgtggtttccaaggaaaagaaatgagtgaggtagaataggcaagtctgagcaagtttaggactggatagttcaaataatttccaaaatttcctggctgtaaaagtggtctctggttgtctggtaccaagccctagggtgaggggaaaaagttagggtgggggaaatattggtttggtgtaacaacagttagatgaagaaggtagttggggatacggactttggattagttggtttgtataacgaaaagcaatccaacaaatccacaagggagcaagtttacaagttatttgctatctttaggaattagctagccctgggaggggcagtctctccctggccttccaaggacctcaagatgttcaagcatccataaaatatggaaattttttaaaaacattataaatacacagagtaaacgctgggcatgatataggacagtggttctcaaactttagctccactggaatctcctggaaaacttgttaatatgcagatgaccgttttacccttaagcttctaattggggaggtctggggagggcacagataatttgcatttctacaaagttcttccatgattttgatgccgctggtgagggaccaggctttgagaacactgatttaggacgtgtcctgtttagggaatatccaaaaggcggacaagttcagggaatattcttgggcagttggctgtgtgagtctgaaattcaggatagaatattaagctgaaataaagatttgggagcttatctacagtcaaatgataattgaaatactgagagtacggggggagagaggtccatgtaccaagaaaagtgaaaatgactaatcccaagcctcgctgaccattgagaatggagctaagtgagaggagttaacaaagctgacccagaaaaagtcataagggccttaggaggccaaggaaaaaaaatacattcactgccaacgagaggcacttacgaatggcttgactggctttgccagcatgcatgaactgcttcataattatttgtattgattacagtaacagatacatattttaacaagcaacttaagtaatacaactgatttttaattatcttgtttaaattgataaaggttgtatatattcatggtgtacaacatgatgttttgatatacccatacattgtggaatggctaaatcaagccaattatcgtatgcattacctcacatacactttatttgtggtgagaacacttagagtatactcttagcaagtatcaagtatataatacattgctgttaactatagtatccatgttgtacaataggtctcttgaacatactcctcctgtctaattgaaattgtgtttccttcgaacaactgatttttttaaataaaaaacttaatacctgtaagttagaattcttaatggtcaccttaggagcctatacaattattcctacgttgttgttactattctgtgtctttttcttttttaacatctttaaaggtatcaaatttttatattttgaaagtagaatttattttttgtcagtctaaaatatttttatgttgaacaaaatgcatgaatggtaaacctagatgcaatcaatttttcaaataaaaaaagtagatacccatgaacatttcttttgtaattgcaaactgtcttgaaaggcagtttcaaaaagagtttagttcctaaattgtaccattactcactgcgttaaaatgcaacattcatttgagcgtataaccttttgatcaatttgtttttgatgtcttgttccctgagagttgtctcaaatagatacatataaatatacacatatctcagattggctctgagaaatgtcttgattcaaacgttcttgattctaagattcatggtacataggaactgtatggtgacaaccttgtcagcctatctttagagtagctttggattctattcagaacatttcccaaagctattctgctatcaagaatataaacaggaatagtcaagggaagctttttaaagggcaacattttcatgtaggcatttttctcacattgaaaactagtttactaaatgcagtgtattaccttctcattacaagaagtctttcacattagtataaatgcatatggcagttgtgccagaaataaattgcctctcaaactagcacatggaaagaagaattctgagatttagcacatatgtagcttttaaatagtatactctgtttcaaacattatgtgttagtccacgttctcttcagccattttcagttgcatttttactttatattcctttgtatatttatctttgctaatcattgtcctgagattcctttagctcttgaattctacgtttttaattaatagaaaactttctttttatttttcccccgacatagttgttttctagaaagaaacagttataggttataaatccaacactttagggccgacttgaacatgcatcaaagctactagaggacttgtagaaatacagattgaatggtcccatgcctagagttttacattcagttacagatagggtaggacctgagaattcacattgctcacaaatttccagttgattttgatggcattggtctagagaccaaaccctgagaaccattaaaaaacaaacaaacaaaaacaaacaaaccaaaaaaaaaactatatacagagattttcttcattggcttttgccactgaagacatttagatgaagagactccacaaagtgtaatcatttagttatgagaggggcctgataatttgcatttctatcaaattcccaggggatactattgttgctgattgagaaccacacttggtgaaacactaattaaaataccattaaaaagcaaaaacaatttaggccagcaaaacctcctaaagaatgaggcctaaagacttattttgttttatttttgccagaagcttcttatgggcaaaattatcaccaacagagctgaggttcaaacttgtgttcatagcaagcaaaagggataatttggaaaaaaagctgaggttagctttgtggttggtttgggagtgggaatgagtagggaggaagaaatttaaaaaaaaaaaaaaaaggaagaagccaaatattaaattgttcacagggcgaaaaaagagaaaaggagtaactagaaatatcttagactggttcggcaagtcgggtccctcgcagctaacagtggtcccaccctctggagtttatatgtttacattctttttttttttttttttttttttgagacagggtctcactctgttgcctaggctggagtgcaatggtatgatcacagctcactgcaacctccacctcctgggctcgggtgatccccccaacctcagcctcccaagtagcagagactacaggcaagtgccaccatgtccagctaattttttgtatttttttgcagagatggggtttcaccagttgcctaggctggtctcaatctcctaggctcaagtgatctgcccacctcagcctcccaaagtgctgggattacaggtgtgagccaccgcgcctcattggagtttgcattctagttgggaaaatagccaataaatttgtgacttattttcctttaaaaaaaaaacttattctggctattgtgtgactataggatatggaaggtgcaagagtatgaggctaacaccctgttctaaattccgtctcctctgagccttgttctgtcaagaatctcctccttctatactttttaagtcaccttcctactgatcctttgctgtcagcttaccactctggtacccttcattttaacaaacaaacaattgtccaagcttaccggtgctgctccttcacccctccacctgtacctagtgtcaattctctccctcttctgatggccaaactttgtgaaactgtagcacagctccatatgtgttcctgcaaaggacatgatctcattcctttttatggctgcagagtattccacagtgtatatgtaccacattttctttatccagtctatcactgatgggcatttgggttgattccatgtctttgctattgtgaatagtgctgcagtgaacatacgtgtgcatgtatctttaaaatagaatggtttatattcctttgggtatataaccaataatgggattgctgggtcaaatggtatttctggttctagatctttgaggagctggaagccattatcctcagcaaactaacacaggaacagaaaagcaaatatcacatgttctcacttaaaagtgggagctgaacaatgagaacacatggactcatggaggggaacaacacacactgaggcctgtcggggggtggggcgaggggagggagagcattgggaaaaatagctaatgcatgctgggcttaatatctaggtgatgggcaatagcaaagacttggaaccaacccaaatgtccaacaatgatagactggattgagaaaatgtggcacatatacaccatggaatactatgcagccataaaaaaggatgagttcatgtcctttgtagggacatggatgaagctggaaaccatcattctcagcaaactatggcaaggacaaaaaaccaaacaccacatgttctcactcacaggtgggaattgaacaatgagaacacatggacacaggaaggggaacatcacacaccagggcctgttgtggggtcgggggaggggggagggatagcatttggagatacacctaatgttaactgacgagttactgggtgcagcacaccaacatggcacatgtatacatatgtaactaaccttcacgttgtgcatatggaccctaaaacttaaagtataataataaaatatatatatatatatctctaggtgatgggttaataggtgcagcaaaccaccatggcacatgtttacctatgtaacaaacctgcacatcctgcacatgtaccacggaacttaaaataaaaattaatcatagaactttaaaaaaagaaaagaaaatgtagcagagctgcctagctcaccttctttacccacagctcacttttcagtccatttatctggctattactcctaccgtgccaggcaaactgctctcactaagaaaatcaatagcctaccccctgccaaattgcctgactcagcttctccttgtaattttctcctttagttctctaacaccctcttccccaggttttcacctgacctgtctccataggacatttgagtctctttcctgatgattcatcctcagcctcttccataataagtatggctgctccccagatcctaccctcagcacttcttcactttccatgccacatctcttctgtgatctcatcttcatccacggctctaattagtatctataagcagatgactctcaaagcatatgctgcctatgtacccctcttggccattctacattgacatctgcaactccccagtgaacttctatatttagaccacaggactggtacctgctgataagcacaggtagggtgtactgagtagtgttttctctatttggttgggcttttgctaaagcagttgtcaaatattttgagtcttactcatggccacagacattttaacattagcatgtcccaaactgaaatcccctactgcctctattctctatttcagaagatggcaccaccatctacccaattatttaagctagaaacttctgattctggtgagacttctctcttttatgcatatgtctacactgacacaaaagactgcaaattttacctcctaagtctgtcttaaagcagatttttctctatgattctctatggtttcaggcccttatcactgtgaagtcaagcatacctgattcgaatcttgtcaccgttggcaaatttttaaatctcttctagcctcagtttcctcataaagttttctgtttcttagggtgactaaagggcttaaatgagattaccatacagagagtaaggtacataaaatgcaattaataaagaatagtcactataactgctgatgatgatgctattactattcgtatcctagaaaactccggtaacttgttcactggtctttctgcatctagcatcacttcctcagccagagttatcttctgacatgaaggctgatgccgtcacccccatactcatgtttgaaattcttcaatacctttaagataaattcccacctccttggtgtagcatgcaaggtcacacatgacataatctctccaaggccccatttcttccactctccttgagtgatatatgtggcagaaaatttaaggctgcctggatattatccaccttacgtcccaatacttccatctgccgcaaagaccttctacccaacttcccatcctcaacgaattcttattctttctttaaaaataacctcaaacttcagactagacctctggtccatagggcattacaaatctctcagtaagttgtacaggatgaacacgccccctaaaactttgtttcagatatttcaatttttattttattttattattattatactttaagttttagggtacatgtgcacaatgtgcaggttagttacatatgtatacatgtgccagatatttcagtgttaaaggtttaataatcacatttacagaaaaggaattagctacaaaatggtggcactggtatacaagtatgtaaagatacagtgcttacaatttaggattattgttgtcgatgttttaatattaaaatggctaatcatacagcaaagtcgaaagaaatttacggtcaacatctgtatacccagcacctatactttgccattgaaattttactatacttgatttattacatattcatctatccatccctctttctgtgatcaatttttaatattctaatactcttacccttaaataataagttatcttttcaaaaaataatgtgtttttacatagatgaagcaaaataaacttgcccttgataaaacaatatgcactgtagtgccttctaattcagtgcattgaagtatccattaacaatataaccagagaatataaaacatgtttattaatattccactgtacctgattagatatagaccattaggaagagttattataattaagaatctaggtttgtcaatatagaaaaaaacctgtgttttttatcccactggaatgtcttgtgaggaatattgttcccctttttctaaaatttaactttgacctttattttgttaatgcaccatgggttaagccacactacgacatgtgctaaatagacctggaagttttcaaactaggtttttaaagtgtatttgacattaaatcttcataacaccttattgattaatttaaatccattaccatggtaaggaaaattcgcagacaggcaggtgaaaattaaaatagaaacaaaacaacatggtaagcaatccttccccccaagccaatcagcatgtagtcagtgtgtccttttaaattagcaaggcgcagcttcccataaagtcccagcttgattttatatgctgcaatagtattgctaaaataaaggagaaggcaacttttctctataatttttttctagaagttttcacgcagcttagtatactgcaatgaccacattactcagttccagaattagcagcattccattgtgaatgacttaattcacattgtgattactcatttaacaacattcttgagggtttacaatgtgcaaagcattacattaagtcgtgtgtggcagaggttctcaaatgcagatgatctgtgaagaagatttcctcaataagcagagaaatgagaactataaggacagaaagagagagagagagaaagagaaattatttaagcttgtagcttgtcatcctcctttcttaggacagcctaccatttaggctgagactatgtctttctgattatttcttgtggttgaaataccccttccttaacaatatgatggtaacagtggatggtaaatcttgttttgttttaatagtttacctggcaaaagtatcattttatgtctgtatcagttatatataatagtatatcagtccattaccaaaccgcctcaaaactcagtagcttaaaacagtaggtacttcttgagttcactaatttgtgggctgatggtttacattgggtagtttatctgctctgactgggctcccttgggaatctggagggtagctgagagcttaagtgtctgaaagtggctgggtcaacacagctctatcgctcacatcttgaacatccctccagcaggctaaccagcccgagcaagtcctttttgtgaaggctgaggtgaagagtggaagtgcaaacatgtaaacaatttgttgagcccctgcttccattaagcctgcaatatccgattggctaaagcaagttttatttccccctgtggtaggcagaatcatgggcccctcgaagatgttaatccccagaacctgtgaatatgctgtgctccctggcagtagggaattaatattccagacggaattaaggttgctaagcaggtgactttgagatggggagattttatggactattcagatgggcctaatctaaccacagggttcatataagtgaaaatggaagcaggagagtgggagtcagagagatgaagatagcccctgctggctttgaagatagagaaaggggccattagccaaacaatgttggtagcatctaatgctggaaaaggcagggaaatagattgtcctctaagcttcttcagaaggagtatagccctgccaacactttcattttaatccatgaaacccatttcaaacttctgacttccaaaactataagataatcaatttgtgttgttttaggccagtaagtttatggaaaattgtcacagaagcaataggaaacaaatatacgctccattgttcaatcttttgaataacacatatactattatttacttaatgtttttcttaaaatcagctcattttgttttctgcttttagccttaagtgataattcccacaaaactgtagtctgatgttgcagtgtttttttccttaatacagataaaactaaatgaatattaaaatttaaactataagctgtttatctgtgtaacatggtaaattggctccctaccactactgttcagcaaaccacattttgggaaacagcgatttaggtggttcaaaggagcaagtgattgtgcaagaacaagaatttattagagaaagaagcatttggccaatgggtagaattgttggcagacaaaggtagaagagaaagacaaattattcagtatggctctagcgaactctttgcacttttatcacacaatctgaagcttgctaatcttgacatgtcttaatgttgttggattgctcattaaactggctgaaatgttcacaaagactctcacctgtcttctggcttaagctgagatttatcacacttcttggaaacatcttctggtctccagatctccctcagctaagctatacagtcagtctgttctgtaagaaagcccaaacttctctgcagtgttcctcagtctttttgatatcatgatgaacagattaagttgatgtgttcatcatgatatcaggtaagctggccgaagactctaagctgcctaaccatcccagggctgagagggatcgatatctgaagtacctataacccaatcagggcatgtgccttagcatacccattggaaagccctgttttagagcctttatcagctgtgaacttattgaaggcaatgattttgtcctgttaatcattctattcataattttcaacaagatacgtggttgttgttaataataattgttggttgaaatgaagttaaataaatagcaattgacttttccaaggtgacgcattgcacagatttatttatcttccctttgctgccctggagtaccagttgtatctaccaataagcttcatttataggccagcctcatcttagtttctgaattagtctaagtggctctggtagcgcatcaaaaatcttgctttctgatggtctttgtaatttgaattctgtgacttacagacttggtattcaatatgtcaggaataaacctggggtgtgcccaaatggtttgaaaaatcccagccttcctgatttcctctcttctctttctcccctggccaccctaatagtctgatagtttttgttatttggatactcctaaactcttggcaatttttcttacatctgttctctacaggctgtcacaagtgagtggaggcaggatggcatgggctgcagtggaaagaccaagaaaataagttaaaagccctgggttccagtaaatgctctgtagtgggatttagggcaagtctcttaacttctctcagcatcaatctccgcatctgtgaaataagattaatgacacctgtcttgcctatacttcaaggttgttttgaggttcacatgcattttccaccccatatagcctataaatctctgatgcctacagataacctataatgttctccagtaagtttaatatttccaggattttaaaactcaatgactagcactgctctgatctaacataacatattgtgtcaatatgtgtgggagtctctctggttgatgttaatggaagtttgtatagtttacctaaaatagaataaagctataatattaatatatatcatcgatgtgttttaggtgatttttttcaatataaaggcaattttggttcaaaattaggtagaacatttaatttttactaatttacaaataaaatgataacatcaaaagggccccttcttttaaagataagttgtaactctcacattgatagtaatctgtcatttaggacagggaatccatgtagtttgaaaattcattggcatcatggagctaaaacagtggctttttaaacatgtcgatttcagttttctttgttttacaagtcaagtagtgatattactgggtacatatgaagcatactgattgaccaaaaaatagtaacaaattttgtaaacccttcacttaaccattattcacctttcccagccacataagaatcctttctctttgtccttagattaattgcctttctttaaccttttcaattctaagtccagacaagctgctgtggttctttaaaaggccacacaaaataagtattgtccagtgctaacactctgaaatgtgatattgtaattactaccaagtgaacattaatcactactagattagaatggaattacctgttatattcacattaatagcaaatgagctttccctgattgatgttgttataatgaatacaaaaggaattaatagtgatctggcactcaccaaaagaggggtagtcattaaggacatgccatcaaaaggcgggtaatactttacaaaaaacaagtattaattaaagtaatatcacaacgaatgcctattgaataacttatatccacattacaaagatattatatggttgcgattaatgtgattgcaatacattttgtaaaaattaataatgactaaccctttaaaatatttaggaagcagatatttgtttatatttgctaaatagctatgccaactctttagcttttgtgagtgacttctagcataggaacagtgatggataatatgaagcactatatataataactcatcggccgggcgcggtggctcacgcctgtaatcccagcactttgggaggccgaggcgggcggatcacgaggtcaggagatcgacaccatcctggctaacacggtgaaaccctgtctctactaaaaacacaaaaaattagccgggcgtggtggtgggcgcctgtagtcccactactcaggaggcagagcttgcagtgagccaagattgcaccactgcactccagcctgggtgacagagtgagactctgtcaaaaaaaaacaacctcatatatttttacttgaaaacatacattttgcctttaggatttttacttgttagaatatcctaaaggacctataattgtaaatgtaaaattgactaatttctgggttttaaaaaaaagtatttgaaagctgatctgctgtgaacattgaaccagatgttaagaaaaatgctagtaagaaatgagacttgggagcaaagaagcagaactaaacttttcatatatggtttctatggagtaattgagaacgtacatattaacagggatacaaagtcaggccctctcattcaagatgctttctgtctttaaaaaaaaaaaaaagtaatttttgaaattttctgtggcaacagtcccatagcagaaagcaaagagttttgaattaagtgatcagaatatcattcttataattttactacactgaacattatttagaaaattttgaatgatattaaaaccgctataaaacatacttgcctaccataagacttaggatttaagccagattaaaataaatatttatttagaaggatgtatgtaagaactggtgaaatataaatgaggtctgtatttgagttaatagtattgtgccaatgtcagtttcctagctttgatgataatgtactatgggtatttaaaatgctatcattgggagaagctgggtaaaaggtgcgtgagaagtctctgtactatatttgcaagttttgtggtcttaaaccatttcaaagtaaagttattttagaaaatatctaaatatatattttagaaagtattatctttttctctgtaactagtggctaattagctcagtctgaaagagtatgtagaggtggaactgctaaatatatttctgatctagacttacttgatgatgcttgaattagtaagtgaatgttatgtgccaacatatgctatgatacatataaatatataagattaaatgataggagctaattatttcttggcatgttgcagtgggtccatttaaaactgtttatgtaggaaactactgtaattataaaaatgagcacagcccaacagcccagtatattagttgaaatataaaaggcgttgtgtccaagatttgaaatgccttacaataagcttggcacttacttaccttcacacaaagcagacacattttattgtgattttagtgttccatattatatggtacagtaccaaaggaaaactctaaaatatgtactcaaaatcctgatgtgcccttctttccaaacaggtggcaccacaatgaatataacctttagagttaatatctgaggacaaacccagcagttacaccagcatgatttaggtcctgctgttacaattattattattgtatttatttcacaattaagttgcagagttgagctcgatatagttccagctgtggcttttttttcaactgtctcaatagttcatagatatggccaaatgttcaataatagtgaaagcttatagtccacatattatttctgtagcaccaattttatgtgaaaaaatgatttatctaaatctcagagaatttccataactagttttgttatacatctacaaaactaagttaaaagaacagagcagactttttaaatagctagattggccaaatccacctcattatcatcaagaagatactgaaacaccgtgtttatacaacaagaccaggcattgtaaaagaggaggaaaggtagagacaaaatttatttagccctcaggaatctttcattctgatagtgtaaatttgacaactttagagggacttattaacatgtatcttatatatcttgataccgaatatatattttgtgattgcattagagccatgaaatattacacaggtcatttgaacatagcattttcatagagaaggtgacatttgcaaaagattaggagaaaagtaactacgattagaaaatcgtagttttattttgtctcttgagaatgaattgatgttaattttatgtctgatttggccaaatacgatgtggaatttgctaaagactgaaaaaagaagagacatcaaatagagggttgcaagttaacagaccatgttataattaaatgagggaaaaaaaagtagagttgttaaactcccagagaagtcatttccccttggtttggtgcatttcactttggtggtgaagtaaatgaccatatgggcacttttctagctctgtccgcaggtagcactgggtatttgtggacaaattacctagcttttcatagcactagtttccttgttgatagacttcagaattctaaattccattttacatccttatttctatgtttaacttaaagataatcctttgcagccgggcacagtggctcacacctgtaatcccagcactttgggaggccgaggcaggcggatcacgaggtcaggagatcgagaccatcctggctaacatggtgaaaccccatctctactgaaaatacaaaaaatcagccgggtgttgtggtgggcgcctgtggtcccagctactcaggaggctgaggcaggaggatggcatgaatccgggaggtggagcttgcggtgagccgagatcgagtcactgcactccagcccgggcaacagagccagactctgcctcaaaaaaaaaaaaaaacaaaaaaaaaaacaaacagatcatcctttgcactggaattatcctgcagtggaggatagtaatgaaagtgtagactctgtttctgaacactagctatgtcactttcaaactgtgtgattttccttcaagtttctcaatcactccaggtctggtttctaaatagaggaataggagtagagattaatattgtgaagattaaatgagaaaacttatataaagcacttagtacggtgccctgcatattgtgaaggcttggtatgttgttagtagattcattttattatcattattaataatactgaaccctggctgttgggggaattggttctatcctcctgtctcatagtcaaaataggttaaagggccttctatctcttatttctggtggtgcattataattactaatagtaatgtgcttcatttgtatatgatcctttatagtttacatggcgctgttttatgtaatcttactaaaatttcaaaaataattttaaaaagccagaattcacaagaatgtgactcggagaagaagtagatgtttttctaagtagatctttcagtttaactgattcaaattttctcatgtttcatatacatgattatcatgtcttttgataaacagaatgttaaccagagtacaaccttgtatgaacatatttattcagcttagaaaagatccagaggtacaaaatctagatcccagtgtagaagttagcatacacagtacaatttctagtatgtccataaacaatatgttaaagtattagtttgagccatataggattgccaatatctgagtgttatagagctacaaaattagtaggaaattttgttgctttaacctaatcattaaattagaattgtgtgacttaaagttacaaatggtttccgaatattttgcagtaaaaaagtagtgaggaaaataaatataaatactaaactagacctgggaaatttaaggctataaagaattctagcttacagagagaggagtctttgtttgcaacctcccactagctaaatttaaattatcacaaatttcatcctctcctttacttaacccttgactcatgcaactagtcaaatgtctttttcttgctaattttttctttccatagatcacttatagggagttctggttaaaaatgatgtctctttaaccttcactaaaatgagaataggggaattaaaatgatatttaccacaaagagaaaaaaatctgggaggaaaaacaataaaataaaaaagataaaaaatttaggaatatgcagagaatggaggagttagcatatcttggaaacctgaattccaagtacttagaacttgggaagtcctagaaatgtgaagcaccagctactgcagaaggcagagatgaatgtgaggtaagatagtgagactgtgaagagaaatcattcagtaaaaaatgcattatcaagccaactgccactggtctagtggagtttaatcccactggggaaattctaaatggattgaagacatgtgtttaagagttagttattctttcaaaggggcaagggagctggggtatttatacacaaaatcctgctagtcattggtttaggactgcttccaacgggggaattattttcctagcatttctggcataccaccttggcaagaaaaattattttgtgtccagagtatgtctaaagccattagggaaaaaaaatgtggatcctcatagttgaaagccaggccagtctgcactaaagtggtaaggatgttttcttttagagatacaggtctaagaaagaaatctgaaggtggttacctcttatgcaagaatttaatttgatggattcaaggtgtgttggttaagagaaatggggaagggttgcttctcatgactgcggcacgattctactatactaaatttttcttttattaagcagcattgccttatgcaatgataggaaacatttgttatatgtgaaatcacttttatttttattttttaatctattcctattcttttcatttttttaacttttattttaggtttgtggggtacatgtgaaggtttattacataggcaaaccggtgtcacaggggtccgttttacattttatttcaccaccgaggtattaagccaactactcagtagttatcttttctgctcctctctctcctcccggcatctcttttaaaagaaaataatttttagcaattctttagaataagtcttggccacctaaaggtttccaggactctagttcagggagtatttatctaagtcagtagttcttaacctgatataatttcatccccagagaacatttgacagtatctcaagaaattcttggttgtcacattgggggcggggatactgctgtcatcaagtgggcagaggccagggatgctgctcaacatgttgtaatgcacaagacagccccccacaacaaagaattatttggtccaatatgtcagtagtgccaagtttcagacatcctgctctaaatcaggactgtgatgtgaattctctgcgatgatgaagatattttatatccgtgatgtgcagtactgtagcatatggctactgagcaattgaaatatagctagtgtgactgtacaccaggtgtgatgttccataccgaggaaagaagtagaaataagatatagtctttgaagtcagagctcacaatctagtagcggagacagatttttaaaaattacaatattttaaaaatattgcaatagaacatggtaatgttagaagattaataacatgctaaatttgaggcatcaggactcagacagacaattaaaaattctctgaggtgaatttccacccttagctcagaatactgtaatgtttaaaagctgttttctatacacacacacacacacacacacacacacacacacacacacccctttaaatcttttatcatgtaactcattgcttcttattttacccttttgtcagagaatacatataaaatactggaatctgatgggacattctactttatttaacaatgctattgagtttctcaaaatagtttcctaagaaagtctattaaagtattgattttttcataaaggataatacaaatggcatgagtctgtttaacattttaatcaagcttaaaattagtcttgcatttgaaacaaacttgcccagagaaattgttgagaaacttaagagaaaaacatcataaaaaattgatgggccagccaggctgtgagaatattaaaatccaaatctaaattatggttaaccattgtcacatctttctttgaagcttaagtaactcgatattccctgtaggatacccagtgattcaaagtgacacatatactgtcagctcattttccttcccagcatgctggtacaatttgtatccatagaaatatatggaaaaacctattagtcttgagtgccagaacctaccaaaaggaatctttgtcatctacaaataaattaataacataagataaacaatcctattaagttatactggcccgaaaagggaaaaaagaccagtttatgaattgacaaaagaaggtaaatgagattagccatatagcaaccactcagataataatgtgttttctctgtttagtaaaaaagcatatttgagagaaaattttcccttatagaacaattcttaataatatacatagatactcctttcctgggatgtagagtttaatcctcccctaagcccctccatgaacttggtaacttacttccagataatagaatatggaaaagtaggaataacaatggagaagaaaccaggcaggcaccaagttaactaagtagtcaagtataacatcgccagtgataataatattgatatcatgtctcctgtgatatgatgtcatgaaaaggacatgttatctctctggtattcttccccaaaacctgtaacttcttctaatagggaaaatacttcagtcaaatcttaagagacttctagaatatacctgactagtcctattcaaaagtttcaaggtcatgaagaacaagaagaaactgagagactgtcacagactagaggagaccaaaaagacccaaggaccaaatgcagtaggagattctggattggatcctgaaacagaaaaatgacatgagtggaaaaactggtgaaatctgaataaagtctgtagttttgttaatagtgttgtatcagtgtttgtttaaatgtttagataaatctctcatgcgtacagaagagttatcattaggggaagctgtgtgtcaggcacttagaaaactttcagatacataggtaccttttgtaagtaaaataatgaattaatgggtcattttatgtctgtattttatataaggctacatttctaaagagacaaaattgtgagtcccataaaaatataaaatgaatatgtgtaaaacattttattagatcattaactgatgaaggaattagtaagatgttagttacagttggttcaaaggagagtctgaagaattggcatatatatatacgtatatatacgtatatatacgtatatacatatatatacgtatatacgtatatatacgtatatacatatatgtgtatatatatattttatatatatacacatatatatataaaaaacactctagaatgctgataggaattttataacagatacaatactgatcactaactgtagggcaggaatctattgcgttccatgagaaaattttactggcatctagtgaacaagaatcatttgtgtcaccatcagccctccacaaattgacttttaaacgtacagaattgcaaaatagcataaccaaagtctaaggtacagactcttagataatcagataactcctaaggttttcctaaggaattaaagggaaagagacattctcagattaaggaaaacaaagaatttcttgctagcaaatctgctcttaaagaatgacaaaaagacattctctaaacagaaaggaaattataacgaagtcttgacatttcagaaagaaaatagtagaatgggtaaaaatgagagtaaaataatagactatcctatttaccataagtttgaagtgaaaactttaacaccacctgatgtggttctcaatgtatgtagagaaaatacttaagagttatattttaaaagaagacatacctaagtggaagtaagagtccttctacacgtcacctgaagtcaattccagtagattgcaatgttaatgcgtatcgtaatgcctggaaagaccactaaaaaactatacaaagtgatacgttaagaaaatacaacaaataaattttgatggaatcttaagaaatgttcaaataacccacaagaaggtaagaaaaaagaaagagaagaatgagaaataaagaaaacaaacagaaaccaaataaggtggcagattgaagccctaatatatccataattaccttaaatgcaaatggtctaaatataccaattaaaagagatttagctgagtggattgataaaagctgagcacacaatatgccgtctaaaagaagtttatttcaaatacaacctaggtaggttaaaattaaaagaatcgaaaaagttacattatgcaacaattaatcaaaagaaagcagcagcagtaatgttaatatcagataaagtaggcttcattgcaaagaaaattactagtgacaaacagggacattacataaagattaagtgttaattcactgggaagacataataatcctaaatgtgtttgcacctaacaacagagcttccaaatacatgaagcaaaaatgaatagagctgaaaaaagaaacagacaaatccatatttctagttagggacttcaacactcctctctcttcagttgatagaactactaaatggaaaataagcaagggtaaagagaactgaacaacaccatcaaccaataggatctaattgaagcactcctcccaacagtagcagaatacacattactttaaagctctcatgaaacattcactgatataagccatattctggactccaagcaacttcagcaaatttagagaattcaacttatatgttcccagaacataatgaaaccaagctagaaatcaataagagaaagacaaaagaaaaacctcaaaacacttggaaatgaagcagcacacctttaaatcattttccccaggtcaaggaggaggttgcaaagaaaaattttttaaacacaaagaactaaataaaatgaaaataaaacatcaacatgagtgagattctgaagcaaagggcaagcatatctactgtctatttttaaagattaagcttccttaagctcagggtttctctcctgtgatgcaatccactgtgtgtacaggtgtctcctgaacttctttgggattactctgtgggaactggctcaataaaatgttggttctttgactactgctttgctgtgagtaatctagtctttttctctggcaaaaaaaaataaagtgagatgtcataaaagcagtattgagaataaaatgtatagcattagattatttagttagaagacaggaaaggtctaaaataaataaatgagcctagagacaaaaaccatcaacaaaatattaaataacatgcgtcaaagtttaaaaaaagagtgtcataccataactaactgggatttagtattgaaggctggctcaacatttgaaagttaattagtgtaatctaccatatcaacaaactaaagaagaaaaaatcatatgattatattgattgatgcagaagcatctgacaacacccagcatccattcatgataaaaactatgagaaaactgggaatagaggataacttccacatcttaataaagggtatctacagaaaactacagttaatagcataattttaataatggaaggcttaatgtttccacccatgattgctaattagggaaggatgcccaatttcactactcttttttaacatagttctggaagttccagacactacaataaagcaaggaaaaacaataaagcatgcatattgaaaagtataaaataaaattatttctatttgtggatggcatgactgtgtacgtagaaaatatcaaatattctacaaaaacaaaagcaaaaataaccaaaaatgctcatggagctgagaagagaggttaacaagatccaaaaatacaagatcaacacaccaaagctagtcacatttttatatacagatgctcctcatcttatgatgggcttacatttagataaacccatcataaagtcaaaaaatcataaggcaagccatcacaacttacggattatctatgttggaaatgaagatgtgaaaagtgaaattaaaaacacaacaccatttataattgcttatccaaaaatgaaatacgtaggtataaatctatcatacatgtacaggatcggtatgtagaaaattataaaatgctgatgaaaggcattaaaaacaacctaaataagtggattatatggcatgtttatagactggaagagtcagcatagcaaatatgtcagttcttctcaaatcaatctaaaggtttaatttagtttctatcaaaatcttatcaaggatttctgtacacatagacaagcatactctaaaatctataagaaaagtcacaggccacagaataactaaaacagtcttttaaaaaggtaaataaagtgggagtaacctctctacccaatattatggctaacaatatagtaaggctatcaatacagtatgatgttgctggagggatagactcatagaccaaatgaaacagaatagagaacccaaaaacagacccatgcaaatgtgcccaacagatttttgataaagttgcaaaagcaattcaatagagaaagctcaccttttcaacaaatggtcctgcagaaattggacatccctagagtgggaaaaaaaaagaacttcaacctaaatctcacaccttgtaaaaacttaattcaaaatagatcatggacttaaatgtaaaacataaaactatcaaaatttagggaaaaatgagaaaatcttcaggctctagggctagaattggcattgaaagcatgatccacacacagaaaaaaatcagttggactgcatcaagatttaaaacctttgcactgcaaaagacctgtgagggaggatgaaaagacaagctacagactgatagaaaatattttcaagccatatagccaaaagatggatgtctagaatatataaagaactctcaaaactgcaaggtaaaacaagaaacaaacaatgcaattaggaaatgggcaagacacatcaagaaacgtttcaccaaaaaggatatacagatagcaaataggtgcatgaaaagattatcaaaaacattagccattagagaaatgcaaattaaaattattatatattcctacacatctatcagaatggctaaaacaaagtagttacaacaccagatgctagcaaggatgtggagaaaatggatcattcacatattgctggtggaaatgtaaaatggtacagccactgtagcaaactgtttatcaattttctgtaaaactaaacatgcagctaccatacaacccagcaattgcactcttggacatttatcttacaacctgtacaaaaatattcataccaccattattcattatagccaaaaactggaaagaacccagacggtcaacaatgaatggttgtacaaactacggtacatccatacataccaggcaatactattcagcaataaaatggaatgaaatatttatacatgcaacaacttttagatcaatctccacagaattatgctgagtaaaaacagctcatctgaaaaggttacataatgaatgattctgtttatatagccgtcttgaagtgacagaattaaagaatgaagaacagattggtgattgcaaggagtccgggacaacaggggaaagagagagagagagatggatgtgactccaaaagggcaacacaggaggcatccttgtagtgttggaactgttctttaccttgattgtgtcaatgtcaatatcctggttatgatattgtactatatttttgcaaggttttaccttcagggagacggggtcaggggtatactggttttctctgtattatttctcacaactacatgtgaacatacaattatctcaaaactaaaagtgtaatttcaaaaaacaaataaaacaattcagaaattttaagacttcaacagtcatttatctcatttgttattttactgttgagaaaacaggcacaaagaaactgaagtgacttactttcatgcttcacctaagtctttttttcttttctccatcactcagttaagagcttctgtaatacagaaagtatgtcttgtattcttttaactcccatattacttcaagcaatgttgaacacatgttaacattgtaaaagttgttgtctgagtaaatgggaaagatagaggtctatgtctatatgcaaatactttgtattaacatgtttcagtctgatataactttccacacagaaagtacaaaagaagatctgttcaagttatctgatttaattaagatagtaaaaagaaagctgataatttagggggtcttatttgattgtttttaattttacttattttccactaggtgatcattttgatgattcaaaaatgaaaatttacaaaaaggtataaaataaaaattatttctcctacctctatgcactgtcgaatcaattcccctacccaccaccaatcagtattgtcagctgtttgtatatccttcaggagatatgtacgaatttcaagcgaatatgcataagtttatgttatgtatatgtgtgtgtctgttttctatatatatgcatctttacattaatggtagcatacgatacacattttcttctgaattatgcttctctctcaacaatgtttcttggacattttcctgtatcagtacataaagaatgtatttgtttcctatgactgcaatagtgaaataccacaaactggatgacttaaccaaaagaagtctgttgtcttacagttctggaggatagaagtctgagatcaaggtgtcaggagggttggttccttctgagggctcggaaggagaatctgttccattccattcccctagtttctgatggtttgttggcaatctttggtgctccttgtcctgtagatgtctgccttcattttcacatggcatgccccctgtgtacgtgtctgtctccaacttccccttttaaggacagagtcatattggactcaggcccaaccaaatgacctcattttaagttgattatctctgtaatgaccctatctccaaatagggtcacattctgaggtaccaggggttaggacttcaacatttaaatttggagaaaatttggacagaattcaacccatagcaaagaacttaaccgttagtttaatgactacatattgttccattttgtggatgtatcataatctatttaagcagtgctctgaacattttattggttttcactttcattgttttgccttaatattggtgtctgtttcatagaatagatttatagtattttaggcttatcaagattttatttaaatcttggaatttaaattccctgtaaatttcaagtgccttgaaggcaagatatattgaggaggggagacttttaaagttcatatgaaataataaataatcgcaagtatctcaggaatgcatgaaaaataataaatgtctctgcatcaataataagggagggggcttgccttatccaatattaaacttgctgtaaagctactgtaatccaaatagtatagtattagcacaaaacaagacaagtagatcactgaagcaaaattgagagtccagaagcagatcagattgtttttggaggccgggcatggtggcttacgcctgtaatcccagcactttgggagtctgaggtgggtggattacctgaggagttcaagaccagcctagccaacttggtgaaaccccgtctctactaaaaatacaaaaattagctgggcgtggtggtgggcgcctgtagtcccagctacttgggaggctgaggcaggagaatcgcttgaacccaggaggcggaggttgcagtgagccaagatcgcaccattgtactccagcctgggcaacaagagcgaaactccatctcaaaaaataaataaataaataaataaatagatacaaattgtttttggaaacattatatggcaaatgtgttattttaattcaaggaataaaggtgttttattcaataaatggtgccagcactctttgcaattcctcttagaaaacacagattgcctcctagcttatgcaatgtaagaatacatttcaaatgcattaaagttttaaatgtaaaaacaaaaattcttggaatgaggaagacgttttctaaacaagacacaaaactcaaaagctataaggaaaaaatataccttgttactgcttaaaataacagaagacaaagtcaaaagaaaaacagcaaatagagtagatgtattcgcaacatgtgacataaagagatgcatatacctaatatacaaatttctcctacaaatttgttaattaaattaatattttttaaaattcaaacaacccagtacaaaactggccgaagtataggaatatgcaattcccagaagaggatatccagatagctggaaaaataaaactatgataatatgcttcctcatagtagtaagggataggaaaataaagaaataagacaccatgtctatctaacaaatagacagaaattaagaatgataatttttaatggaagagagcactctcagatattgcagatgaaacgcaaattgctgtggtctttgaggaaagaaatgtggtatgatctacaaaaattttaaatgcacttaccttttgatcagtcactccatttctgagaatcaatactacagaaataaaagtaccagtatgaaaggctgtatgtagaggatgtgtattttggcattgtctatgatggtcaaaaagtagaaatcaagcaaatacccttcagtgtggaaattattgaatatgttatggaattatttgggcatcccagaatgaattattatttagtctagttagagctgtgtctactgtcctgaaagaatggtgatgatatctttcaaaaatcaaaacaagtttcaattaacatattccatttttaaaataaaaaagataaaattaatcttatgggattacataaccatgaaggaggaatggagagatatatactaggttatcagtatttgttaccttggattttcaaaggagaatgaaagaggaacaaataatgtatcaagtttcacaaaaagtgaaaaggtggaatataaatattactgcaaatatataaccattgaatatgtatatggacaaggacgataagataatatagaaaactgaatatgttggttttattatgaggtggttggattgaagatatttttgtctccaaatactgttgttttaatatgttgtgttttacaaagaaacatgggctgagcagacagggaagccctgataagcatagtacctgccatgtggccattcaataaatgatagttattgattattattattagagttgtagtacagtagtgcctaccttaatatatttagattgatgcccagcagcattgagttaacccgcattttaaggacaagtgttatagctattatatactaatggtaaacttgagtctgtaactagcactgttgaaggaggacaacagagtaatatgatgtgtattggcctggggatggaagggtggtgcttaaggcacagcagattttcactccagccaggtttccttaggacctctccaatgaacaggatacctcccttcctgttctttctaccctcccaccccgttttttgctttttcagtttcagcccaaaggggaaggaagtatgatgactgactccccatcagtccctgaggtgaactgggattttgggagagtgtggcagctgcaaatttggcttcctggagataggatttttgccctcaatctggagaaagttcctgaggctacagctgttcaagcttgtgaagtaggaactttgatcccttttttcaaaagttttgtataattagcatccaacttgttagacagtatgtggctcattacaagattgccacaaattcatgctgggccgtgtctaagaacagggcaaagggagcctttggaaagtgttatacagttgaccctcaaacaatgtgagggttaggggcgctgagcccaacacattgaaaaatctaagtagaacttttcactcccccaaaacgtaactactaataggctactgttgacagaagccatactgataacataaagagtgattagcgtatactttgcattgttatatgtaatatatactgtattcttgcaataaagtaagttagagaaaatacgatgttactaagaaaatcataaggaagagaaaaatatatttactattaattaagtggaagtggatcatcatataggtcttcattctcattatcttcacgttaagtaggctgaggaggtggagggagaggaggggttggtcttgctgccaatctaaatgctgggcccagccaatgggtataagttttaagtgtgcacatattggtgaacccttacagatcacggcactgtctgttcgagtgtctattttgaaatgtccctatccgtaatataagttgcaaaggagtttgtgggcccactgaattctaccaccctgatcattgtgaagcccattcagctttgtgaagagcttatcttggtactaccttagccaaggtatgataactcagacataatgtcttttctttcatggttccttttttagtgatcatagattcagttctgtaataattagagatttatgtgtcctattagtaattgcatcattctttaaagacagtgtcaaccttgctatacagtgtgattgaagccttgacataacttgggggtttgttggcattttgaaatcccaggccccacttcaaaactgttgaatcagaatctgcattgtaagaagatccccaaaagatctgcatgcacaagccttgaaagagaagagaagccatctaacattcctcacctaagatttgaagaatttcccacttatgcaagagtaggggtgtgatttctcaggcaggatatctaacagaaaacaacacttatgaagtgtttcctgtaggagctaagcaggtggccagaaaatggcaggctacaaaggagaagaatgactaggaacctgagcaaggagaaagtctcaaagacaaggaagtggctggcagtgtcagggactaccaggcagctgaaaaagctaggtgtgaacactatttcttggagttttcagcaagtaagaggttcatgatgatgcctcaaagaatttacagtggaaccagagccaagaagtcttattgtggtgagttgggaattagggaaagtgttatacagttgaccctcaaacagtgtgagggttcggggcgctgagccctaacctcaagtaagaggttcatgatgatgcaatcaaagaatttacactggaaccagagccaagaagtctttttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccagctaatttttgtatttttagtagagacggggtttcaccgtgttagccaggatggtctcgatctcctgacctcgtgatccgcccgtctcggcctcccaaagtgctgggattacaggcgtgagccaccgcgcccggcagccaagaagtcttatggtggtgagttgagaagtagggaggtggaaataaggaatggagatgaagacatgaaaggaatttgagaaatgaggcaatagctagagaagaatataggaatacacagatccagcaacccagcaagggaagggctagattctgatttcatgagcaaattgcctactaattaaattcacaatatcagaggaaactgttggactcacttactgaataatagctgaaaagtatctttgctttatagagagatcactgtagatgaaagtcatcttccagtggtgagatattcttcagtgtcatctcttcatttttatttctaatttttcttaatttgaattatttcttctgataatgggaatgatgtggtaattttgtctctcctgtaaattattttaaagatttgtacgaactcctttggcaggcttgagtgtgttgtgacagcttggcttagatatgcattgaatgtcattgaattcaaactccttaccaacatagttagatagcccataggcattctacttgaccctttcaaggagatctggagatgcaattgtaggggaaaaaagaagaaaagaattcaagaagcaacaaagtgaaagataatttggcttgcagaagagaggtctttctatcacagtaataataatgccaattatatgtccatatatatatatacgcacacatatatatagtatatatatatacacatataactcagacataattctttcatagttctttcttttgtgcacagattcacttctgttataattacatacttatgtgacctatttgttagtaattgcttcagtttcttaaaagagcatcaccttgctgtgcaaagtgtgattgaagcctcaacatctcttgggagtttttttagaattttgaaatcccaggccccacttcagaactgttgaatcagaatccgccattgtaagacaatccccaagggatctgcacgcacgttgcagcttgagaagcactgcagtatcacacatatacacacatattcaacaccaaagagagagaaagaggtcataagctctcaggtggagactagttccatgtatatatgcatagagagaagaacaaactctaccttccagcaacgtaaaattctactcaatcatgtattcaccaaaaaagaaaaggctttctccatataatgtgtattattcatatattggcactcttcagagctcttcattccaccctaatgttatctttcttagataattcacatgacactttgttatcttccaataatttctgtcattgttataagcgaaattattcaggctttatctaagagagtaaatcaaacagtatgcctctctcattccaattctgcaatattttcattctagaatgtctaaaggagccttgaaagagaggagaagtcacctaaggccagctagaggggatatatagcagggaatggtggcaactccactcctcgtagcccagtggggttttttttttttccaatctgtatttgtatgtgagtatcacgtctatgccgattttatgtgtacatatgtaactcaaatctgttcattgtgctagttagaatcttatttccccctcttctactacactctaccctttctctttcccctcctttggcaaccaagacactgagttattaataagcagattggagcaaacattttgatgcactattgtttgatagatttgttggttcattcaataagcattaattgagcacttgctaagtgttaaacaatgtactaattgctagatttaaggatgaaaatgataaaacccttggcctctagagcctagagtgtagttggggagacaaatgggcaaattagtcacacgacaacatattccttgttaaaacagacagttgtgcataagtctgtatacccagactggagatgactctgtttccaatgttgccctgggaaacctcatgatcagtttaataatgatgtttggggtgagaggatactgagacagtttgcttctagcatagtaattacccatagaagtttggggtctttattcaaaagagtttacaggccacatgagccactgtcttgccttttataggatcacatctaagttccgtgtcatataatggccttggccttcttggctttctctgtgctctttgcctgccaataccctaattattgaagtactgtctcccgcagctcctcaaccatgagctgttcccgatcctcccagcagctatgtttctcctttcttcaaacctctttagctttttatttgtactttatttgtactaaattgtatttagagctttggagaacattcttcatagttgtaattagactgtaaagtcctgagaatgtatttttcatcttcgtagccccctgcagtatctagcagaatgcctttaaacaaatgggcagtaaataaatcccaacaaacttaaattaaatttctccaaattgcatatttaattttatagtggcatttactgataacatacattgaaataaaggccagagcataatcctctctgtttctgaatattatttatttaaatattaactttctaatccaattaggtctttcaatgacactttagatctaaatttatttttgcattgttttaaatgtcatcaaatgattcatctcttgtgttttttaatatttttggaacgaacgtgtgaaaatgagcaagtgtcatcagaatatgatgcttgggtttttttaattcaacatttctttgatcatatatttaaagactttttctcaattcctttctggatgtggcctcacaaatcatttcagaagtcaatccatttcaagatttttttttttttttttgcttttttcacttcacaggaagtcaagttcattctttaaaatgtagcaaatgattaagcaaattcaacgaatgatcttcatcaactccgaggtgtttttcccccttgaaaaatttaagttactattatttttttttctttttttttttttttgatacagagtctcactctgttacccaggctagagtgcagtggtgtgatctcggctcactgcaagctccacctcctgggttcacgccattctcctgcctcagcctcccgagcagctggtaccacaggcgcctgccaccatgtctggctaattttgtgcatttttagtagagatggggtttctccttgttagccaggatggtctcgatctcctgacctcgtgatccacccacctcggcctcccaaagtgctgggattacaggcgtgagccactgcgcccggccaattattattattttttttaaacttcacctatcataaatcttttaaaatttcacctatgataaacttcctctgtcatctggggaattacttaaatgcaatgatggccttcaagtatactaccaggcagcctatccaaatcatgaaacagaaaggctcatagaccaaattaaaatacttgaatcacagagtttattaaaatcacagtgagaagcaaacgggaaagatatgtgctaagttaacacgcttagaatagagtgtaagcagactgtgaagattagagtacttgaattctgcagtacacaacattatatgtcttgtctgtctctgtattgcatcagccttcccaattatggtgtgcttacaaggaccaaagttgacttcccaacaagggagtccaaaatgggtggtgcctgattcagtggcatgtggtttatcagagacacagagacaagaatgcatggccacagctgtaacttgccaaaatagcctgatgactagccatgtaattctcaggcagaagacttacggtgctggaataggtatcacctatggatgcctgaattaagaccttgtgaacattaagtgctcatgtgtatttatttgatcttgaatatttagtgcctcttgtatatttggtctcatgtgtatttagcatattatgaatatttagtacccaggtgcctcatgaatattgggtatcttttggtccttctatccctcactatctatgtttagtacacacatgctctgcttgctaactacttatcttctaattaacacattccaagagccaattatgtgtatctctttccactgagttcttcattcaatgacatcaagttagttgcttgaaatcagctattgtgagagcacttacaccacagaaattggcaaatgctacaattagcgccactgccctcccctagagccagttatttgacatttactagcattccactacttacatggcccttcatgctctcactccgtgtgaccactcaagccttatccctctttactgaactctacaatcaaataaaatatctttgtttcttgcttctggccctccatcaaatggctccctctcctaggaacaatctgtctctcctctatcacctttgtttagctagttaataatcccttttcagacagcacctcataaatagattcctgaacatcccaaaccggatctcctgcaccttcaatgtgctacttcagtacatttgtcttaccctttgccatatggtatttcaattgcccatgaatttgtattcctgtttagatcttaagctttgtgaggtctttttgtacttttttgtacttccgtatacctaccacataataaatatttaatgaaagcattaatgaataagtaagtgaatggagtgagtgaatgagtattcaattatgattcatttgtatcaaagtgataacatatacttacagggaaaaggccagagggggaaaaaataaaaaataataatatattttatgtatgaccttgtgtggggaaaggaacatagggccactgcctggcctgcttcttttatgcaaatcctaatgtaaaatatgatcaacgcctggctgggcagaaatacaaaaacccagtactagtgattctcccaaccagataccagctagtacagatcatagccagatttaactactgtgaagtggttaggttagaggtgacctataaggaaatgacgctaatgatcattagcatcatcttggaagcttaaaaaaatgccccagctgtaccccaagccaatgatatcagacttttgtggggaacccagatatcattgtttttaatctttaatgattccaatttagccaaagttgagtctcaacaaaccaagttcttcttactctcatattctcttcttctcgcatagataagaattaacagccagctcttctacatgtttcttagacacatatattgtttcagtggtaattcgttaacagtgcatatgtcagcaaagcatgactgaaaaaaatatctgctcccacacattctgatcccatcttgacactgcatagctgttggcgaaggcaatttcaacaatgaagaagtgggagaaatgactacattttatgtaaatatgtattcattgaaaatcaaaaggacatatgtaatgatattgtttaagattctaaatgaaggacaatacttaagagtcctctgtagtcaaatttctcagcagtaaaaaaacattgtcttttctttacaactattaaccatatggctgtgaaaatgttattctacaagcctttaagatttgaaatctgactttatgttaatacacagaatttaccacacaatcctgtatgatttctaagtagatttaaagagtagctattgctcaccttttcaacataatggtaatgatggtgcaatgtcaattacatgatactctcatgggcgtgattatatgattgttaacacactgaagtgcttatatagacatagatactgatttttatatgtacatatttaaaacaaacaaggacttaaaatggcctgtaaaagtctttctagtcagtctttctggttttggacagagaacaaataatcccttacagctgttaggttggtgcaaaagtaattgtggtctttgccattgcttttaatggtaaaaaaaacgcaattacttttgcaccaacctaatagttatctacttccatctttaacgggccctacccaagactgcatggtatataagtaagaaatgtaaatgaaaatctcaaatgctagatctgcccaggaggggaccactaatgagagaggaaatgttaacgtcccatatgaactaagctcagcttagcatttacccttcctgctattccgctagagcagtgcttctcaaaagttgacctgtaatggaatcttctgaatgcctttttaaaacgtagctggctgggccccatccccagagtttctgtgtcagttggtctgggatggggcctgagaatttgcatctctaacaagttctcaggggatgttgccggcccttgaatcacaacttaaaaacctctgctctgaagaaagggaaagctctctctgctggatttccccaagcctttttcagattttcaggagacttctgtgcggtagcttgcttccttctttccatactactactactaccactactactactacaaatagcaacctctagcatattttcagtactaaatacccagcactatatatacatcacaaaagtcccttgaggaaggtggtattatcatctccattctgcggataaggaaatagataagaaatttgctgaagatcgcagagccaaatgagactcaaacccatgtaacccatgtctgtttgactttaaagcccggaatcttaatttgttccagacaagctcattatgtgctctgatcttcaccactgaaatgttctgaatatgaggctgagggcagcagtgaggttggaaggagcagcccagaggagcaggcactgtgctggtagaatagtagtatggtggggcctgcactccctaataaaagaaggggacaatgactatttcctccttctccaaggtcgtgctgcctcccatttctctgtctgcctggtaagaagcagctctgggccatgtgtggtggctcacacttgtaatcccagtgctttgggaggctgaggcgggaggatctcttgagcccaggaaattaagaccaaccctagcaatctagtgggacttcatctctaataaaaataaaaaacttagctgggtgtggtggcacacacctataatcccaactactcaggaggctgaggtgggaggattgcttgagcttgggaagtcgaagctgcagtgagccgtggtctcaccactgcactccagcttgggcagcagggtgagaccctgtctccagaaaaacaaaaagcagcagctctgaaaagaggatctagcagtttctatatgcaggagagcatttgcgcaattgttcctggggttgaatctgagaaactcacagtgcacattcagatactatttacaatcttctaggaatagtataaatattgtggccagggcaccttcatattgtgaaacacaaaaagacttcagaccttagattatgtgtcgaaagttaggcaccaatgatttttttttccatttgttcttaagtggcaaatctttacattaacatttttggtacttgtctttagggaaatttcttctctgttctgaatgtatatattgtaattcctcatttacaattttgcctgcaaatgcaagtgagtacagatcatccagttatgaaaatgctctgagatttgagtctagctgtttcagctttaagagccctgacctagactttgaaactgacatggttttatatgtatgtggttggaattaaacccaaagcacatcttttaaaactctgaggaacttctgtgccacagctttcgctcagttggtgagattttactttgaaatttaagggatgagtctagtttatatgcaaagaaatgtagggagctttgcaaacccaatcaaatcctttgtgaacagtgtgtgcatctgtttattttgctgtcattttgagtccatgatcctgtatactgttttgtgggcacatattgagggtaatatcaaataccatgtagaacagatgctgcaggtatcctttccatgtcctcttagctttggggtggtagatgggcacatggaccaagcccaaagtgacagggtattaacaggagcaagactcaaccaataagggagagtagatgggtacaaatctcagctttctctcccctcactgggataattttgagatatattccaaagatcctcagagcatccccaacagcattgagccccagttccccagattagtaatctactcaataaatacctcttttttttttttttttcccgagatggagtctcactctgcaccctggctggagtgcagtggcacaatctcagctcactgcaacctccacctcccgagttcaagtgattctcctgcctcagcctcttgagtagctgggactacaggcatgcgccaccacacccaactaatttttgtatttttagtagagatggggtttcaccatttggccaggctggtctagaactcctgatctcaagtgatccgcccgccttggcctcccaaagtcctgggattacaggcatgagccaccacgcccagcccaataaagaactctggattgtttcttccttttcctctcctcctttcctgttccctacagtgtttcctaggatcacctcagtctgctgtatgggaaacccagactgagtcaccataacagacagaggcattgttactttaggactttagtggatatagttacatgggagagagagactgtgtatgtatatataacctttataatattaaaccatgctatactcaaattatttactggccaagatttccaatataaattggaaataaattggatataaatcaagaacagttaaaattggaaatagttaaaatacaaataaaatagctaaaattgggcaaaatacctgacccaatgctttaatatccgattgcataattaaacgagtaaagaggaaaggaaattattagcaactctatatttaaatgcaactgacatccaaggaagtcatgaagaaaactctttgtgttgataaactgaaggcctcttctagcagacttctgtgtttattgttctgttgctgactattttattccaaacaaatgaacttgcttgtcattataccccacccttccctagtacagggcccccattctttgaaacagtaactcattcagttccaaggagaatatgaaaagggagggtaatatataaaagaactgaaatgaaaagtggcctaagtgtggcacatttccattgtggattccatggcaatggagaattgatggcagagcatggtgagagatgtgaagcatcaattggctgtatctccagggaattcctgaagttcagttgccaccctggagggtggcaaatgctctctctcaccttccttgagttattgcttagatgactcaaaacaaaaaactgatgagctataaatgggctgtattatttgtttttacctgctgagtagttcagatatttcaaaataatctcaaacttaacctatggtgtggtttctgtgttaaacaaaataccgtaacttttagttgaaaatactgtgtaagcccacacaatctcttgttcacagataatcttgttgtcaaacattcatgatgacaaaaactcataaacgattcttttaaatatcaagaataacttatgctgtaagtcataatttcataagcatgaatttatgaatgtgttttgtgtttgcaattttcatttaggttgtcttaaaatcatgcgttttagcttaacttaggagaaatatatcttttgtgacaacataggatattcagagaaacgtgaaaactaggtgatgtgttttatgaaagaaggcataaagtatatcaagcataagaactttgaattctatttgtgttttttgtggctttagaaaagattgttctgggaatagagaattccatttgggaaacctagcacatacacagtagcagagttaaaatactgacttggagggttcatttgaagaattctatagaatttttgcatgttgggaataggtttatattcttaaacattgcactcagggtttctattcaaagcaaaaataactttgcatagaccttggccattctttcacattctaaagtaatccatttttttttttcagggtagttgttctcagtcctgattttctgataattcagatcatctttaatttacaccaaaaacttttagaagagtcagataataatttaacataaaatgtaaatgactgaaatatacattttttaaaggagcagatatggaggggtccaatgtacttaactatttgctctctttgtctccttgcattcacgggaatgtttctatgtagttttctaatttcacacaatttcaataatccataccctcctcatttttatgggccttcatgatactaaaaatgttaccagaaattattttgtgttagtctctttgtttagcacattcatacataagttttaacatttaactggcatatttttaaagtaatacatgttttttttttaaaaaaaatcagttatgtttgtgtgtgtgcatattttcttttgtggccaaatgttgcacgccctagtccttctatttaaacaatgagtttacataacaaatgttacatgataaacatgaagacatttagtttgaaaaaaaatgattttctagtttactcatttaaaaaaagctgaagtaaccgggaagaggagtggcagaacatattagtctttttcataatgccatcattaaacaaagatacttaatttccaggcctggtgcagtggcgcagcctgtaatcccagtactttgggaggctgaggagggcagatcacttgaggtcaggagttcgagaccagctttgccaatatggtgaaaccctgtctcaaaaaaaaaaaaaaaagaaaaagaaaaagctacataatttccaaaatgacttcagtgggacctgaggtgagggaataaaggctctggagtaatttcactctctattcctctcctaattttttttctgttcctttataacaacattttcactacttttgagcttgggagttgaggaatcatgaccagaagaaaaggaaagacgggaaagatgttcaagggtgaggatgcttaagaatgacctggcaagcttatgaaaatgcagttgtctggatcccaccacagagattctgatttagcaggtctgtggcaaggcctgcgattctgcattgctaaccagctcccaggtgatgacactcatgctggcaacctatgaaccattgagtggcactgttccagggggcagggcaatgagaaattgaagtcaaaagccccaagacctggtgctacgaaaatactctggttccttccctctcaactgatttacttgtcggtgtgattttgcaaaaatccctgaacttcttaaatcccagttacctcacctgaaaagtatgagtgttgctccagatctggaggctttcagaccatgcaaatcgaattcaaaccatgcaaaccattcaagtcattctagaaagttctgcaaggtgcctcagaggccaaagggagagatgggaagagggattgaatgggctctttccaaggttccctaacccacttgaatactttcatcttttatctctttcatatattccacttttgagtatggtttcatttagaaaataggattttataccaacagatttaaagaaaaactccaagtctgaaaatgactcatttatttaaaactgtatagaacaaagacatttagtgcacaattccaaaaattctctgatccttccacagcatgcccagtatgctgcaagagtgccagcaaacacatgcttactgctcacaaatgtgaaatttaaccccatgcactaggaggtccctagtgtggggtggttttagctaaccagactaagagagtacagggcaacatcgagcctttctctgcggtcatgtctgattcattaaaaatccagctttccccgaagatatattaattaccttctgtttcagaatttgtttttagagcctaattcttaattatatctccagccattgtgtgatttgaccattttggaactaaaaagttatcctatgaaattccacctccaactattgccacactgttagtttgtctatttcatacaccatgccaatcttagcgtggtgctagcatttcattataaccagctttcatttttaataagaccatgtgtatatgaaattgtagacttcagtctttgtatgaattgaaagctattaatcttcccagggttaggttatgttaaacagattgtaatgttcttctttttattatgttatttaaatccccttcatttcatactgcaccaatacatttctactatcttggaataaattaattccagttacgtgatggaaaattttagtgtaaaaatataacctgcagtataattttttctgtcagaataccaactagaactggtatgtttcattctaattggaaatttgagttatcgctttgatttttaacagtgggaaaggaaaatgaagattgatatctttcaatagccgttcattcattcttcattccttcattcattcacgtattaagaatagtctatgtgctaagaacagaaagagtgttagagatatgaagattaataagaccagatccctgcctgcaggcatttcctattctatgtcatagatagggggctattctgtttagaggtaaagcatgacccacattgcctctgacaagaagcataatgtctgtagcagctaactgctggagacaggaggctagagggctgccctggtaattggtattcaagtcttcaagaaaggaaaccagctattccaaaatcagtgggcaagaggaagttgtaaagttaagtgaaatgactaaaatatgaataactaaaggttggaatctggtagaaggagaggagagcatcggtcagcaccttagtttgggaaggtggtgtggccatagtaggctttatttagaaagaagcaattcttaggtaccagctaggtttcagttccttaaggggagaaaactggcaaaatataggcaggtttccagggtgcaaagccacgttctagcttcagctcaggcaaggccctggggtatgaatcaccaccagagtagcccagccaaaatgactaagggatctaagctggttgctaatgaaagaggttgcagctcaaggcagctctgctgacgcccactggatactgggattacattgatttaacacatggaaaccacttaatatggtatgtggcacaacacaattaagtactcataaatatttgcagataatgctgctgccattgctgtttttgtcgttagaagactcgggaaaatcatctaatacaggaatccatctgttggcggggcttgggcttctaatatttgactggttgatttttgtcgacccaatcttaacaatattatacacagccattacttcaggaaaggcagttgtaaagaatggtataaatttcctgtaacttgactgccacattctagctgagtcacctctatatacctcagtttctttgtatccgcagtgaagattaatgacctcatagggttgttattagaatgaagtgaattactacactggacttatttaggacagtaactcgcacatagtgagtgctcaaggaaatctcagaccctgcctgctagtggagggtccagctcctgatacatttgggggcaggtttaaggagttcattgatttagagctgtaagggctgatctttcaccctgcatgtcttcagcaactgtggctggtaaagtccagagcagtcaaaggctgacaaatccttgttagaaatcacaaatgcccattctcacaacttctgtggtgttttccatcctttccctagaatactttctttttaaggcaaaggaaagaataatcactgcagatagcacacagtatttttttgcaacatattttcaaaaattatgatgagaaaagtgtatcattcctgtgaagaaacagcataaggaaaatgatttgagaaagaaacatggttcttaaactgaaacaagtgtcagaaggaatcccagaaggcagaaggaaatatagtaatcatgatgaagtctagagctcacaccggttaacagaatggcagcagcgatattcatctcacgcctcttccatgctgtccctgagtgagcttctgctgaattgcctggctggtgaggattggtttcagcagcagaaggaatgggctgccagctgaaggctctggttctgatcctgggtagggtcagagaaagcaagatgtgaccatcacttttgaccttggtcttgaatttgattccatggaacaacgatattttacaaacccagttgaaggtttatccctttttctattcaacacagggagagtccttagagccccaggaagacttagccctttttcattctaagagtaaaccacatctaggtttccagagatgaaaagaccaggctctgatcttccttctggaagcccttgcctattcaacaagcatgagtattaaatgctattgccttggaatcataattcagttttcacagtttgggctatgtcagaaccattcttgtcaaccccctgttttctgagaacccgaaacctgcttgtttagaattttagaatctacttgactcttacaggggagaaaagatctcttttctcacccatcgctaggttcatggctgaggcacctataatgaaggacaaatcaacaacataaaagcatgcgaatttatttaatataagtttcacatgacacaggagccttcagaaatgacccaaagaatcagggaaaagtgtgtatttttatgctctgatttgaggaaaagtagatgtccagtatgactggacaaaggggaatggtaataaactggggtgaccacagcaaggcctgtttctgcagaacctcctgtgtccctgtgttttcagaggtaaaaattttcctttccttccagtatagtaagggcacctctggtatgatagtctcatgacctgcttcaggggagaagggggaaggggaaggtgagagtgaccatcctgcttctgctgtcttctcaaataccaagctgccatattgtggattttggagtagcgtaacttgaatccttttttttttttttttttgagacggagtctcaccctgtaacccaggctggagtgcaatggcacaatctcggctcactacaacctccacctcccaagttcaagtgattctcctgcctcagcctcccgagtaactgggattacaggcacatgccaccatgcctggcaaattttttgtatctttagtagagatggggtttcaccatgttagccggactggtcttgaactcctgacctcgtggtccgcccacttcggcctcccaaagtgctgagccaccgcacccagccgcatagcttgaatcttatcaataccttaaccaaatgactctgacagttttcctcttcttatctaaattcttgagggtcacccacacttcccaatgtcttttgaaacttgacctcttttctgctgaattgaggaagatacctgatttctttaacctcaccaaattcctacttcttactgttgttcattgctggctgaaaatttactttggcgagttcaccaagaacatacttatcggttcactgtttatatttgcactcaagataacacttgaggccctgctactcaaagaatttagtgacaactttcttcatcactctcatatcttatctgtcatcaagtctttttttcctcgtaaaaatgcttttagctctttaagtatgtttcatatctataatagctaagataggctaacagctataatatattaaacatccaccaaatggactattaaaatgacttaaacaaaatagaaatgtatttctttctcatgtaaacagtctaaggtgaattcatgttagttggtgttggatgtgtgtgtgggaagggaggggtgacacccacataattattcaagaatacaggccaggccaggtgcagtggctcacacctgtaatcccagcactttgggaggccaaggtgggcggatcacctgaggtcaggagctcgagaccatcctggccaacatgatgaaaccccatctctactaaaaatacaaaaaatagctaggagtggtggtgggcacctgtaatcccagctacttgggaggctgaagcaggagaatcacttgaagccgggaggcggaggttgcagtgagacaagatcatgccactgcactccagcctggcgacagagcaagactctatctaaaaaaaataaaataaaataaaaataaaaaataaaaaataaattaaaaaaaaaacaggccagcaagggtcttccatctgcaatagccaattgccgaggttgccctcctgaagatattcagccagcccaaaggggaatgagctagaggactgcacacggaggcgtcccatgtcctttgactcaaccttctactggctagaactctgccctgtggccacatgtaacagcagaggggctggaaaatgaagtctagctagatacctaaaaagaagcagagaaaggtttcaagagcatttagcaaccatatccaccttattcatgccctgccctctattcgcagtggccccgcagcactgctcaactagcttgctgcattggcctcttatctcttatctattgccttagatccatctaaatgctctgctactcttatgcctggaatatgttttcaagatgtgactaatcctctcacagcttgaaggataaaaggtcaaactgctctggtgaatgcatgatgcctggtcacctctgtagccccatcttccctgacactttcacagacagtattccctttactccaacctgtgggagtattttctaattcacaataatagcaggaaatacaatgtggaccagacacagttctgagcagtatattaactcatgcatttcttacgataactttataaggttgacagtagtagtatccctatttcacagagaaggaaagagatacagataagtaatttacatatgatctcacagatagtaagtggtacagcttgagtgcatatgactcaaagggtagaggttctagattcttaatcactgtattgtactacttctcccaatgttatcgtacatgccattccgtcttcctggaatacccttcgtctttcttcatctaacttccactcaaactttaaggatcaatttaagcatgccttattttaggtagccatggttgacatcagcctaatttaattgctactcatctatgtccccatagcgtcctttgcattcctctatatctctctgctatagcagtaaatgtaccaccattccgtaaaatccttaagggaatgtttagttttatgttcccaatgccagcacaatgtccagaacagtgttgtcccatagaaatgagagccacctatgtaatcttaagtattctagtagccacgttctttaaaagtagaagtgaaactaatattttattgaccctgatatatccaacatattattatttcaatatgtaatcaataaaaagtattaataaaatttgctttttccattctaagtctttgaaatctggcatgtgtctttcaattgcatcccatctcaatttggacaccgtattttcattgaaaatatttggtctcacctgcacacgtatgtttattgcggcactatttacagtagcaaagacttggaaccaacccaaatgtccatcaatgatagaccggattaagaaaatgtggcacatatatatcatggaatactatgcagccataaagaggatgagttcaagtcctttgtagggacgtggatgaagctggaaaccatcattctgagcaaactatcacaaggacagaaaaccaaacaccacatgttcttactcacaggcgggaattgagcaatgagaacacttggacacagggtggggaacatcacacaccagggcctgtcgtggggtggggggaggggggagggatagcgttaggagatatacctaatgtaaatgacgagttaatgggtgcagcacaccaacatggcacatgtatacatatgtaacaaacccgcacgttgtgcacatgtgccctagaacttaaagtataataaaaaaaaaagaaaatatttggtctctatttacatttcataaactttatagttgaaaaaagaagattcacattcctaagttgttccaaacatacacaaaagtttttcaataactgaaccaagagtcaatttttaaatttatatttaaatttaataaaatggaataaaaatttgttaaacttcagtctctccgtctcactagcctgatttcaattgctcggtagctacctacagccagtggctcctgtgttagacagagcagcacagccctagaacacagtagatcctaaatcgatgtttattgaagaaattaatcaatgacagtgtagaaaatttgcagtgattatgtcagaatcaatagttctccacccattttctcccacactctcaaaagggccaagttttatatcaccaaatgatattcctcttacttctttctgagcagaaacagttttggaaattaagatctttttcaaattttccagactcggcattttagcagcgtttctatttgtaccaacaatgcctttctacctattttccttgcttcttaataagttaactttgtgcgaaggtcattttgtaggtcagtgtaatattgtgcattaagggcttctaagttttctggtattataagaactccttggtttccttctacttttcagaatggaaaatcctcagagcaattttcatctaaaagtgctgcatttaggttgtttcacaattccccaaccctgagtcaaatataggttggtgtatgagcagcagtgtctcttggctaatcaagagcgtctccttttgctacgctcagtgttagagaaatggagaaagtcagctgggtttagagattaggtgagagactcaggcatatcctttgataagtcataaatcatttcctgtttagaaaagcacatgtttagacacccataaaatctccaaatgaagggtgttttacttttccttcaaaatctcactgggaaaaggtacttctgactttccaagtgaataaaaataatgactcctgattaccatgtatgtttaaactgatttgcaaagcaagtgaaaaagagtctagtgagtagtgataagcatcttttagacatcagaagatgtactgatttaaaggtccgtatcattttataactagtatctattgagattcaaatggttattactctgtgtgaatctgtcttttctaattgtttttacttattttagaatatcgatttgtgaatattaaattcctaagttttccagcaatccagtgtttgttttggatatccagcctggatgcagaatagctgcagaaagttatcacaaattgatctctatattctgtttccgagtggcaattgtcaaaaatttggggtcatcggctacccctcccacccctaagaagttccttgtacttcctctttcaaaacactcacatcattgttcagtgcctcacttctctactaaaatgtaaccaaccacaaagatagggactatgtctttcctgtttactggtggattctcagtatctagcaccatgaccaatgttaatagacgttgaatcaattccagttgttacctcttcacactgggacaaaagtccttgcaagtattctgctgccatttgtatagattcaagccaaatatgtctcaaaacgatattacagatgatctcttcgttgttcctctgacaatttctttcccccctgcattgcttaacttgattgacaatgacccctactacttataacatgtgccttttaggtagtgcacttggcactacattttatgtgatagttttatgatgctaaagactatttgctgtgatgatgctgtgttctcacatggcatatccagatttatttatgctggtgaccaaaggcaggtagttaaccttgaaaataggttaaaatttgaaaggcagcaaatcttagggctagaatttataatttatctttaaggaatcttgaaaccaggtgtgaaggaagggacgtaggctagaagtacagaaacctgggttctgctccagcactgatgttaagagcaagttgcattgcttttctggaccttaattttctcttctggaaaatgaatagattaactggaacaaggaaggaaaatacgtgaatggcttccgtttctgtctcgtttacccctgaaagacatggctagtcagtcagctctgtatcagagcacttctcaaggcaatgctccaggtagctaccactcactaatgagagttagcacataggtaaaacctctttgtcatctctaggctacttcatgtttaagatactctccagctttaaaattctaataactctattagactgaaatttaagaatacgagaataatcatccctcaccatgaagagagagtctgaggaaaaaataatgagaacgaataacccttctcttttactacaattcaggactgccatgaagagccgtccagattgtgaaacatacaactcatgatgtgaatggtacttctttgtttttctcggtgtacaacttgcacagctgttcatggccctctgcttccacaaattcatttctaaatagctgtacctcagttctttgacttctagtatgtctaatttaatacacatttctagatttacgatatataagaaatatctccatgaaggaaaaatgtaatagcccatgcttttcattataatagaattttatgaaacaatgtcttttaaaaacagaaacatatgtactactacttcgcaggacattagcccttgtatataaatcaataatacaaaaaattcaaattaccaaggattagaaaagactgctgtgggatatcttctggtgcaagcatacagttatttatccatttctttcatgaatatttattgatgttccaaacattaggctagacactagagacacatcaataaataaaggaaataggtttgatctctatcttctttgatctgtagtttagtgggggaggaaggaaattaaacaagtaactactacaggttgaacatccctgatccaaaaacctgaaatccaaatgttccaaattccaaaactgtttgaatgctgacatgacatcacaaatggaaaactccacttctgacctcatgtgacaagtcacagtgaaaatgcaggcacaccacatagagtttattcagcatccccaagggaagaaagatcctctcagcccccgttagctgtgatatatcttttccacccacacccagattccatcatacaagcaaacccacaaaaggtacgaaaaatggcacatgtgcgggctagacgcgacaacggcaggtaccctacaatgtccagcatggggccaaaacctacgtgcattaatcactgtgtttgctggtatattctctggtggtgtcaagatattgttgaaaatgccctaaaggcctgcatgatatccatagggtaatgcaaatattccaaaacctgaaatttgaaatactttcagtcgcaagtattttggatatgagatattcaacctatagatggtaagggtattactatgatagtgctacgggtgtacatcaaggtaattgaccctggcttggcaggatgcagaaggctttcccaaggaagccttacctcagctgagacctgaagagaagcaggagttagacaggtcaagttggggatttggaggaggtggagtcccagcagatggaatactatgcataaaggcctggaagtgagaaagtcatgtcatgttatttcaagggactagaggaagcttagcaaactggaggcaagaagatagcttcagcacactattgaaattgtccaggtgagtaatgatgatagtgtaactaagttgtgatacctaggtatgtgagctgaacctatggagaaatgttctaggctagagaatctttaattggatatttaattatcagtatatacgtaattaaaaccttgcaagggtttgaaatggttcagagtaaagttcgtagatgagaagagggcctaggagtgaacccaggaaaatggcaaagtttcaggggtaaataaagaaaaataagctttcagtggagacagggaaatttgcagttcagtagataggagacagactaggttcgtgtgatgtcacagaatccaagggaagagaggttttcaagaaaaagtaacatttagaggtgtcaaatactacaaaagcatcatgaaagataagaccaaaatatatcctattaatttagcaacaaggaaggtattgacaacctttatgcaagtgatttcagtgttgattatggagaactcagtaattacttggtggtaactaaagaaccaagattgcagtacgttcaggcatgattgagaattgagaaagtgggggagcaagtgtaaaacaattattttaagacttttggctgcgatgggaagagagaaagggccatagtagcagaagatggatgtaggggcaggaagaacacactcttaaaagggtagtgacttacacatgtttaaatggcaatgagaagaagatggtagagagggagaggttgaggatgcaggagaaattagagataatcaatagcacaggtacttgagaaggcagaaagatgaaatttagaaattagcttcagataggaaggaaagtacagcttctattacaacatcaggggagaagggaaggaggatgggcatagctactggtagttttgtaagtttggtgaaaggttaagtaggattgttgtattggatttattttttattgaagtggaagctgcagctaaatgcccagtgatgaggaaggtgttggagtctgagatttaaggtgagtggcaatttgaaatagctgctctaggatcctatttaacagagaaaatgttgagtacacaatcagtgagcagttttaagtccactctattctgtttgcagtttcaagtacctttcattgcttctaagtttatgaaaactggttcacaatcttcttgtgcttcttatttctacctcttttccttctgttttctcacctccccagtttaaacagtcccgaattttttacaattaaatatacagcaactgccatgaaatctactgataaaagatactgcaaaatcagtttgggattgggttcattagcttacttattattatcaatcctaggccactaagcaaccttgcataaaatgcataaaatgaggagattctagtggaggatagttttcaattatctcattaatttcaggccatgtgactagtccaaatagatattataggccaagaagagcctatcttgagattttaactcccaggataggttttctacctgatcaaaagaatctaataactattcaatctcttcttaaatggtttggttttctgtgcaaacagttttacccttttagctgattttctaggtgttaaattaagaaaattctctcagatacttgttcatcatgtactaggatccctgatgtgttcagagttgtccaactttcaaagggctttgcattcagagtacctaatctaaaccctgatatcattcttttataacagaaaaccccggattagactgggacagtgtctgtcatgttcatcactgcatctccctcagtatttgtagaatgaatgaagggacaatggcaaactatagtcctaccatcacacttttggtagtgaggagaactgctgtaacttggaagattggagggggaaaaggtggctaaaacaatcatacagtaaactgggctgctatcaagagaaaccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttagtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagtttttaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggagttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaaatattgattattgccacaatttcagagcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaactcgacctttctctctggctgcccttaacattttttccttcatttcaacttggtgaatctgacaattatgtgtcttggagttgctcttctcgaggagtatctttgtggcgttctctgtatttcctgaatctgaacgttggcctgccttactagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattcgttattctagttatacattcttctaaatttttttcaaagtttttcaaaagcaatggcaacaaaagccaaaattgacaaatgggatctaattaaactcaagagcttctgcacagcaaaagaaactaccatcagagtgaacaggcaacctacaacatgggagaaaatttccgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatccaccatggaatactatgcagccataaaaaatgatgagttcatgtccgttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaaattaaaaaaaaaaaaaaaaaaaaaagagaaaccagtgctctattatctaggtatataccaaggttacccactgcttgactctcattattagccttctttgatgttctctggtacttgatgtctttcataactaatcaatgtattaatgtatccaatcatttactcgataactttattgaaagcaaaagcagttgcataccagctatcaagctggaagtgggagatacagccgcagacaaggcagatatggtcccagcccttaggagctcccagagtagcaggaggtttccccttccagtgtcttctctctgcttttcttcaaaaggaaaaggctgatgtgtataatataccatatctctttgaagttctctgattatggattttaggtttaaaccagttcttcatccatgactttataaattgaaaatccaggattttgctgtgttgttgtgttcttgttttgttttgatgtccctgttttctctagatacagttagaaatgtctaggaagaaatttttggttagtatgggagccccacaaagccatttttttaaacataaaatctgtattacatatcaggtatgaaatacagggggaatgaatcatttctccgtaaaggaaaatttaaagtaaatttcaggaaagtgaattctttcccgtttgcattaccgacagatgcagaaactttaatcgtcatttgctaagagggatatggcagataatacacaatagatgtcgtagcaacattcactcgcattctttttttttttttttaaagaaatctttctttcaagaagctattctaggatctttctcatgacagtgtcctagttcttatctttgctacacacaggctcacaaagtgttttctttgaagggcattttgttattggccctcttttcatttttcttttccgtagcaaacagaaccgaaggtgtttactccccacggtgagagggcacctgggtgcacaaacagtggtgtgaaccactggcctttctctgctttccgttccctgaatgtaagaaacaggtgcagtgatcaattcactgcgtgcagtgaaccccaggcagaaagagaacgtcgtgtcacagaccttttgttacttggagagaatgagcgggaagaaaggctgcctctgctgctactgagacccttttgcccattttattgactgctataggttcatctatcctaatttgtctccggctgtcccagtttatccctgttattcttgtgttactttactttactatattttattttattttattttatttattttagagacagagtcttgctctgtcacccaggctggagtggagtggcatgatcatagctcactgcagcctcaaactcctgagctcaagcaatcctcctccttcagcctactgagtagccaggattatagctgtgcaccactatgcccacctaattttttttttttttgaaatggagtctcgctctgtcacccaagctgcagtgcagtggtgcgatctcggctcactgcaacctccacctcccgggttcaagcgattctcctgcctcagcctcctgagtagctgggattacaggtgcccaccaccatgccctgctaatttttgtatttttagtagagacagagtttcgccatgttggccaggctgttctcaaactcctttaactgtttttttatttttatttttaatttttaaaacatattgtagagataagagtcatgctacattgcccaggctgatctcaaactcctggcttcaagcaatactcctacctcggcctcccaaagcacctggattacaggcatgagccagtgtgcctgaccctgtgtgattattattagcatcctggacactctcaaaagtgttcaggtttggacaatgaactataggatcaccctaattacatgagattaagagtagagaccttgaccaccagaaatggtcaatactcaccatatattttcttcctgatgttagaacctggtacttttgggaaatgaaattgtacatgagatatatgcagaatgggcgaagggagcgaaaagatttaaaaaattaagctcgatttattgagcgcctcgagtgcgctcagtgctgttccaagtgctgacagcagagaggtaagttctgttctccagtgttcacctcacacgtgcaagccaggtttgaaaacacactgtctttccttagtatccctccacccctccatgtgactatacgtatgtatcaagtttgtgatatttcacttctgggcttcttttcatttggaaatttaatgtcagtgtatcatgttttaattaataggacatcatgttatgaaactgttgaatcgaatattttccctaggcatcaaattacttgtcagtggaaatttgacatctagatatgagggacaaaagagatgagaaaaataatagtaaagtgttcctaaaggatgctggtatactgtttaggtattttaatgcactgttacaacctaaagtgtcttgtaaagtatgttctttagaaataaaataaataaaacaagacatctctccataggtacaaatccacttgccttcctcaattcctatccttctgtgatgggaaatctctgctgtgacaaagaaccatgttaagaaaaccataaagttgtattgtttgtagatttttttaatgactaaaggaagatattgcaagtagtagaaacaaatagaggaggtggccctgaaggtcaatataacggagttcactgcagaaaagagaaactactctaggtacgttagacacatatcaaagttttggaaaggctaaagtagcaggttttagacttggcttcgaggacagatttctaaaactatatagaactgatccaataagaaactaccatctccggggtaccactgaagcaatgatttcaagaacatactttgtaaataggaactaggaaccaggaggttgaaatctagacgctaccacttttgaagctgctgttagcaactgcccttctccagccaggaagctggagaaagaactttggaactctgatgtaggaaatctcatgtttctttgactaagctcgccaacagaaatagccaaaaggggcagaaaggtgacctatgcctcacttccactttccagatctctcacaagtatacacatttggcaaaacgttgccagatttagcaaataaaaataatgcatgcaacatacttaacactaaataaaaaaagattgtgtagaaaatttaaatttaactgggtgccttgtattttatctgacaaccctaacttattatatcctaattcataatcagaacactagctgcatggaagtctggcaaatacagtttttaatttccaacctgtccaactggaaggatggtaagtagatttaggtgagccagttcacagtattaaccaaagtagattgcctaccaagaatagctaaagcctttctgcccccagacgcttatgctaccatctgaatatttttactttgcattcttatattcttggaaatcctatcaatctgtgattcagattggtttggtttaactcagcttccccttttttttggagacagggtcataccctgtcacccaggctggagtgcagtggcacaatcatggctcactgcaacttcgacatccctgggctcaggtgatcctccctcccacctcagcctcccaagtggctgggactacaggcacgtgccaccacaccccgctactttttgtattttctgtagaaacagagtttcgccacattgcctaagctggtctcagattcctgggctgaagtgatccacccaccttggcctgacaacgtgctggaattacagatgtgagccaccatgcccagcccctctttttaaaatataaaaatctcccagaatgtgaaagttgtcagtctatactttgggaataagattttcaacagatagaagagaatgaggattaaaacataaggaagtttgggagtagaaaatatgggcaccagaaggtggaaggagagagcagatgcccatttatatatctcctttgttgggtgttggacaaatccaggtcttaaaataggaagtatttcttttccgtacttcttgaatctttcatatcccaaaagatgcatatttcccaaatcatataacccaaagtcatgctatcaaaatgatataaatcatccatggtataggttaaatagctatatatgtatatgctggtctgagacatgtatatgactattgtgtccatggaaatttgagtttggggttctggaccatttatttgcaagtgatttttggttagagaactctttgtaagttggggattgcttttacttattttatgagtaaagatgtcaaaaggatgactgctaaatttgcactgtgttaattcactatttagtgagaagaaatattagactagctatgaaaagtaaaactgcctctccaaaaagtcaaagctgatgaaaaacagtcatacaagcacaatgccgctcttcggaaacatggaaacactttttccttcccaattttccctcagattttctcttccgcatttaaaacacttgggtggttcaagtttctaggctaccactgattgtaacagcaaacagtagcaactggaagcagtgggatgttgggagaagtaatagaggtagctgctacccaagttatcctggaggattttccatggcaatgaaatcaggtagtagaagcttggctaactgagtgtaagcaaacagttctactgagaatggtgttgtcttttcaatccgtttatctgtgatggtgatagtgtgaaacaggggaattttatccaaggtttaaggaaggttatttggttaaaagaggatattgttacagtgaagtcaaactttccattaactttttgctgtaacaacagattgaacgtagcatttcaccgtcaacgagtaaagtgaaatttacagattaacttatgtgcctcttttaaaatatatcagatttctaaattgcttttatttcagaggtatgggaggttcactttctctttgaaagtgtacattatttttctagtgtcttacatctgcctacaaagatgttattttacttgaaagcacagtaactatttgatgagaatttgtcagcatcagtaaattaaagaccctcaaatgatttctactaattatagtttaattccgtacatttaatgatattttaaaacacatgagttatttcataactcccaacatcacaaggataaattttattctacaaacaaaatattgtgctaaatgaaatagttcatttaggcaaagaaaggagcacagaaaattagtggaactctctgctgtaagtaacgtagacattacatggcatattgagtctccatgaatattgtcatgttatgttttaaaaaggtgatcgaacatatggcatttaaaagttccaagtcctcttttaaatgcttcagaatctattatttaatgatcatcttggatctcaaaactgatcttttgaaagattttattcgccccatgtgttaatatgatttccctgtcatatgatatgattatctatcaatacttaaaaccagcagccaagtaaaaaatcagttcatatcatttaatgaatactatgagtcaggatctgggtaggcaagctattttcgggtttgagtagttccaaagcttaaaaatcttatattgattttacagtgaagaagaaatagtcttagctactttggaggtttcaaacattgactactcaaggagtatttccttgctttctcaggcaccaggcagtttttcaggagcaagcattcatccattcagggaattgtaacctgtagtttccacttttctagcaatcacacttaaaaccatgagagtaggccataggacataaggagctcagcttctcagggcaagcacatcctttcagctttcacctgtccgtttgttagtgttcacttccgtgctcaaggagtttcttgttgcctctgagttctaagagacagaacgaagggagaagggtgcagaagtctaacgcatgttcatggacttatctctccaataaagagcttgttttatcttcttttatttatttattttttctaatgaagccattagcctcaaacaaagccatggaatcttatcagagtgaaaccggggtcattccataggctggctgagtgagagctccatggcacgatgatgtatggtcactgcacaacaacgcctttgccacaacacatgtgccttttaattacactttaaatctcatttgaagagatgttatcattatggaaattgctctgtaaatgtgcccaggatgagacccaataaaagtttgctgagaagaattgaagacagaggagatgaatcagcagctaaaacattaccatcagacagaattttcttggctgtaggcaaaacagcccatgcaataacagaaaatcttcattgactcagaggcgtattttccctagattattatggggcactcctgcctgtagcactatcacttctttgataagctgaaggaagcgttctgctctccagctcagcgggcctttttctccccaacctcagagccatcatttgaatttatagttgccaaaatgaataatacagtattgcccttgtgttcctgacttcatgcatgcatgcagagcggggttaaggttctttaaatgaaagattgccttctattcatgcaataaagaacacctctgcttcctttccagggtcatttaaaaataactataccgctgggctatggaaagcacataagaaagattcttagggtaaagtcaaaatgctcttttctctacaacaggcattgtctcatatctttgtgtagcacagctgatttgaagttttcttttaagcacattcttaattatcttttcctttgatcttgaactgtttccctgggctaccagacagagagcctagagccctacctccgctttccccgaggtgcaaactgctccgtccttccacaggcaggcccctggctgaatgcacccttttctccatggttacccacccacctctctgttatttgttacttcccaagtgaatggcaggttaaaatgggaaaaggtcaggttatctgaatgtggttagagtgaaatgaatttcctcattgcacccaagaactgtcctttgacaggtctccttccccaaatcgggtcattttgtacgtaggctcactgggagtaattctaagacaactaaataagtaaaatcacattttggtgccattttccaatgtattcttcttcttgggggttctcctttaaaatggtactggaaggatacgttgtcttcattaatccattgtatgtcccgggggtggaggtggaggtggcagtagcagaagcccgtgaagtaataggtcgtattttgtgtttataaatatttctgcaggtttttgaggagaagatccatcattcttataaaggcattcatgacctccagaagattaagggctgttatgctagaacagtgtttcattcttaaaatggggtctctggactagcagtatcggcatcacttgggaacttctaagaaatgcaaattcttgagttctaccccagacatacagaatcatgatctctcagagtggagcccagcagcctgtgttttaatgagccctctgggtgattctcaagcccactcaagtttgagaaccactgtactaagggaactactgatgcatgatgcaagttcacgctcacaggcacgtgtgaatgacacaaagaacacagacgcctgagagagcaagaaagacaacatagactgtctgactccctgctgggcccttctttaccgcccctatttcaggctaccatgcccatgagtggatgacacgtaccccccgacaaaggtcaacaccactctcccttccacaccctatcactaagtgacaggctaagcctatgttaaactgctcacatctccttggaaattcaacactttaataataggtagcattatcacccccatcttcttctctaagccagaaacccaacttgcctccctatatgttatccttgcattcagtcagtctctaagttgtattcatgatctctcaaaaatatctccctttttctcatcctgtgtctattacctcagtttagatctccatattctcttgcctctaatgttcttgcctctaatgtaccttttcactgccaccaagatgatgttaccaaaaaatcttaaacagattagacatcttcacaggataaagtccaaacccttagcttgatacacaagccccttcacaatccaggccctccttcctgtgcagctatatatatatatatatatatatagagagagagagagagagagagagagagagagagagagaaattttgatcttaccactctgtctctcttcccgccatgggtcttcccctcttccctccggagttacttagctctgatgtgtattcttatctcgtcttatcttcaacttcattcatgtttttcccactgcttcaaatttcactctcccacttctcccctggccagctgctactcatccctcaagaccctgatcaaatatcatcacttgtatgatggcatctgcaaatcttggggggcaaggctaattgttctttgttcccacagggctgtgttccagtttaacatgatcacatgttattttggttcatttatttgcttaagactttttcagaaggctatgggctctttaaaatagagaacttacatcttgtagttttaagagtatttttagtaaaagtttagagtgacccccatctttctgccagcccacaaaaggaaaacatcaaaaagtgaatgtgtaaaaggaagagaactctgacaaaaccaggcagaaaggtttttcagcaagtctttttattttctgttcaggataacattaataattatccacgttggtttctcattctcctgttggtgaatatttttctgctaaatttaaaaccgtatcacaaactcaagcagagatttacaacatttcaacagcttttctacccctgccttagaagggtggatcaaaaacatttgtccatggtaaagcactatggacatgacttagttaacaattctctgtttgggtcaccatgaggcttcttcgtttatactcagggtcagcgacaatgctgatatgcagctacaatttctcatttcttactcagggtgttatgaagcagatttccactgttctttaatcgttattaaaatgtagtccaggtgcagtggctcacgcctataatcccagcactttgggaagctgaggcaggtgggtcacataaggttaggagttcgacaccagcctggccaacatggtgaaaccctgtctctactaaaaataaaaaaactggccgggcatggtggcaggtgcctgtaatcccagctactcaggaggctgaggcaggagaatcgcttgaacccaggagggggacagaggttgcagtgagccgagatcacaccattgcactccagcctgggcgacaagagcaaaactctgtctcaaaaaaaaaaaaaagtcattctcatgtaaaaattcttgtaaaataatctgtaaagtcatcctcttatctgttctagttcttcataagacttatataacatgtcatatgggcatggaaaggcctaagccttcccaaaccttgctcttttggggatgattttccaaatgtacttgttctcagttgaaaagagcattgcggccgggcgcggtggctcaacgcctgtaatcccagcactttgggaggctgaggtgggcagatcacgaggtcaggagatcgagaccatcctggctaacatggtgacaccccgtatctacttaaaatacaaaaaattagccgggcgtggtggcgggcgcctgtagtcccagctacttgggaggctgaggcaggagaatggcgtgaacccgggaggtggagcttgcagtgagccgagatcgcgccactgcactccagcctgggcaacagagcaagactccgtctcaaaaaaaaagaagaagaaaagaacattgcatcatggcacaaggacacaaaaaataccctggacctgcttcagtgagatggtctaagggtctctagcatcttctgaactgaactgaatgctttgggaagaattaatagatacacgatgtatattagttcgtttcacactgctataaagaacttccctgagactggggtaatttatttaaagaaaaagaggtttagttgactcacagttctgtgtggctggggaggcctcaggaaacttataatcatggtggaaagcaaaggggaaggaagcaccttcacaaggcagcaggagagagagagaaagagtgaatgggaagagccccttataaaaccatcaaatctcatgagaactcactcactatcacatgggaaaacagcatgggggaagccacccccatgatccaatcacctcccaccaggttcccccggattacagttctagatgagatttgggtgaggacacaaagccaaaccatatcacaatggaaagctcatgaatgggttctaagaatgaggaaatgtaccttagcattttgcctacttttcctttatgacatttttttcccggcaaatatgccaaatattacctacctttacatcagtgtccacatgcatatcccctgtcttcctccttttcctcatacattaacaaaagagtaactttgttttctccccatcactgttcaccctattgtataagagaagaaaagcaaaataggatgaaagaactatctaggcacacacacaaaagtcacactctccagaagaaagaatttgctctacttggtagtagacagaaattaactcactgaagatcaccagagaatcagatccaattatatcagcaggactttagtttacatcatggtactagaaccttctttaacattcaaaacttatgaatacctagaaatagttttaaggttaatatctctatgctgtgggctaaagagtacccacaaatgaatacagttgtgtctgatgagtgtctgtgattattttggaaattgtcctgctatttaaaatgaaaaaaatagaaatgtcttagattttcctatcattaacctattgtaaacaattacatcagtgtagggttgttttgtggttgcgtgggagtattttgaggtttttagggggtaaagtgggggatagaatgaagttgttgtttgcatttacaaccctaataattaaaacaagccagagggaattacctacatggctgttgtgatttctagtgtatgatcaaaaataattatggcactttgccatatgttcttgctttcttcttagatatgtgttattgggaaaagatgagacttgacatcaactaattgcttttttctaatatacaaccttgaaccacagtgattctctggaggacaaaaaatagcttagtgacaaagagattccagaaataagagcttttcgagcttttaactctctatgtaatatagacaaattgcacagattaatataaccaaatatgtattggtccatgggaagagagttacctatttgaagaataggagtgtattgtgttcatttagaaccattcagaaacatcaatgatattagttctgagttgactaaggataaatttttaaaagcaatacctaattggaaaattattcagttgttgaccattcctatcagtgctctgaaactaaatatctcacagatgccttaatgagttattataattatgttgctgtgatacatgtagcccaagtcagaagtcacttgctttgtatttaatggatggggaagacactggagcttggagggaagagaataaaaataacctagtttcaggaagatctatgctctaaccctgcttctgccacataacaacaactctatgatttgtataagttactttacctctcaaactcgtggtttcctcgataggggataaagaaggcctatttcatagagttggtgtaaaggatttataagggctgtaagtattagttcctgccctgtttcatccccctaccctacccccacccctcatcatggctctgcaaaaacaaatatgtctcagagttggaaagacccatctggtctttctcagataagggtagttttcttcaaacagactgattcctgcacataaaatataatataaaaaaccaaaagtaccttcaacattgtagacttttcatatgtggttgtctctgtgacttaaatgtacaatctagggtttgcatgttaaggtctttcaagattactgttggcactgatctgaaagatgtctcatgcaggaaatgctcacccaattatgagcactgaggctgtatagcaatatcagaaataatattgcagcacagtattttctatggattttagatgcagtattaaaaaaagaaaactcagcctgtctttaagactcgttttctctttcaacaccagaattaaaaggcatgccattcttttttaaagtttatgtgcagagccaaatgaatatcaacattagttctccactgggtccacggcttctttttaaaaatatctgaagcagtgttactctacccactttttctcaggaaattgtgtcctttagaactggcacccatatagtttaggaatgcttgatagggtatattttaggtgggagtcacctgtgcctatatggagctttgatgtcaatgcccttgtcatttggtgtcaatggttttgtcattctaatttatttggccccaaggtgtgtgtgtgtgtgtgtgtgtgtgtgtgtgtgtgtgtgtgtgtgtttgaaacacagcatatgtatttttttcttactccttgagaaatagaactttaaataacatttctatctttaaaatgtacttgtgaatagttatcactttcctgaattctaccttccaaaggtaggacaagagaaggatggaattaaatcacacatgcagctatttttataacttatgagcactcaatgatggtagcatccctcttctttaccttctctctgattctgaagccactgctgttttggttcctgtatggctgggactgcctgtccactagacttcctgccttcactctgaccctgctacatttaccctgaacaccatcctcccaataatcattaccagatgctattttcacaatgttacacctttacacaagaagctacagtggaatattatccttacagaatcagataaaaatctccaggcggcattctaagctctcattggctacactgtaccctttgaacctgaacttcctgagaactacctcttagctcctgcctgtagctctggctcccatcttcatgcagtaggtattcgttttcttttgaacggcctcatatcttctctgctagcaggattggagtcatggcagaaagtgagagggggactagaaggatgcaacattaatgaaacctcacaataggttaggcattgggttaggtacttggttgatctactcacatcatctcatctaatctttgccaaaaccttaaaaggtaggtattatcggccctacttatagacatacaataggtacttaatgcacatttttgtgatgaataaatattcgggaatttttgcattgtgactggatgagaagaaactaggaaaaacaagacgtagatgagaaagatacctctcatcttacttccaacctaggagatcttaaatgaactcatcagttttaaaaggtaatcttaagaatggagtcagagggtcacacaaggagagaaagcatcacgtattaccagagttcgggattgcttaaggcggtttgacagtttcctccgggggtaatccaccctaggccaggcatttttaaagattagattttgaaatgaagctttgcacttgggaatatactgaggcaagaaagcatatcccttctccctgctgagagagcatatcccttctctctgctgttgcagtgcttaagtgtgagaattttcgaatgagatatgaaagcaaagacaacaaaccctgcaggataatagtctctgaggactttaataacagccgtttttaaagcaaagcctgtggactcctaaatccatagctgctcgtttaagatgcaacgcaatgcagtggacctgaaaacatactccttatctacctagagcaaccaggctccaagccaaacagcagtcctcaaattaactcttgtttctcttgggacgacaactctgctgcttttaaaggtgttgcgtggccacatatagaataagaagggaaaaaacagtcacaccctcttgtgagtctgtatccaactgcattttctgatctggttaggaacctccggtggttagattagaatcctgataaggccaagactgtgggtccaatttcttcctatggattcttctcgaaaaacttgttaggaaagatccacttcgggtttttttttttttttttttgcgcttgttttaattcccaatccataatagactgatacttttgtaacatgcaataaaaatgaattattttaaaaattacaaataccagacatacaaaatttaagccgatgctttttatttttagattgctgtacacgtttctaaagatttgctttcaatttctgttcttatgtcttcataatagaatatctgtttctgtgtgtgtatacgtatgagtgtatgcaagtgtgctccaaaagctctactatttagagctcatgtttaatgagtcatgttggataaccagtctaagggagttctactttcatataattgtttttgttttatttttatttaaatcattaacaccttttcaaaacaactgtatcaaataacagtcatttggtcatttgaagcatttacatacactgctttcttcttaaacagattttactgaatgtaaatctgctttccctggctaattcagcatcatcatcctgagcattaactattttgcttcgctataaaacgaggtgatgccttcaagggctactgatgcatggagagctgttagtttccacactgtgtgaccctggtcaattatgcatgcccatggctccttttacacctttctgattctctgtaaggtgtcacttcttcctactctcaatttagccacttaggataatttctttactattttgaattgtatgttcctgaccttctaagttcttagaaatcagaccactttttttcccatcaagctaatttaaattagataaaaattatcagtaaggaggaactaatggccttataattattcatatactaactgctttcagaaaagcttagagataatctgtctataataaaattcttaaggagatttggtcacttattgttattctttctacaccattgtgtttgtttccttacttctcagctatattaaaatggggaagttttcatttgctgagtcctattttagagaccaataattccatttacataggaaaggaaatatgtggatacgattattcatgatgttctagaatagtatcacaaccatctgcttaatggttaataaaatggttaataataaaaagaagggtacagcactaattcttgacatctcccttctttatttttcttctagtaaaacatccataacttttcctattcttccccagttgtattattacttatgaacaccatggatcattctactttttgaatgaaatagtacaaatttaatattcgataatcttgtctttgtacttttctttctaaacttttattctcggtggcttcctaaaggaagactttattctacttggtttaagcagttggtctgcattctacctatttctctcaactctcattgtccattccaatcaggttgtgcaattcattgtccctgctcataaaccaaattcatttcacctttactccattcccatgctattctttttacctggaatattttcttttgttccaatttcccaatcgtatacatccctcaaggctcaagccaagtcctgtaacttcatgaaatctatttctaacatctgatttccacatggattatcttgtaatagtaagccctgcatttgctattatttattaaagatctcttgtgttctagacgctattcaaagtattttacaaaaattccatgtaatattcaaaaaattcagcaggtatgtattattatttcatgtttagtgaaaccaaagtaatgaaagagttttcatcattatgtggctaataagggaaagagaagagaagggtcaaacctatgtctatttaactgcactttgccatgagttttctctggaagctgagaaaggagattcacaacaagagtagatgagactcagataagaaggaagtgtggaatttgaaaaagcccttcagaaaacaggatctcccctactcctaaaactgctatactgtgaacatattgcttgtctcataactgaacttttttggtactctcagctgaaatttgctctataattgtacagaactttaggccaaatgtttcttttatggggacacacattatttgtttcgtttgcacccattttctcaattactttgtgttttctcttgttgtattggatgcatctctatccactgctacaaatctgtttaatagtctttatattaataagaccatgaaattgctctttgtgtgctgacatagttatcctttattttctaatggcagtgctagatttgctaaaatttaggtagtagcattattaataggaaaaactaccaccaacaactaaacttgaaaggtaatatagcctagtggctaagagcacaatccctgaagtctgactgacgaggttctaaatcttgctgcatttattagctgtgtgaacctgggcatttttagttaaccttacagtagtttcattatcttatatggaaaatgaagataatagtagcccctaccctagagggttgttgagaggagaaaatgagctcatgtatatacagtgctttggacagcacctgatgtacagtaaggttcatgtatgttgttgttcttgctgctgctgctgctgctatggtttttgttatgtaacaactaccttttcccctttgttcattcgttattgcttttcctaaagactacaatcacaaaaaagaagaaaaaaattagagagcatacagtgaatgcagtaatgaaggcttgaatgatcttttctagttaagtcagaagtgaaataaaactatccaaaaatttctatgaaaattatcctttgtccagattggctacccactgagaactccacttgattctccatatcaatcttttgctcttttgtgctacctgagtctgaggtgtagtctttaaatgatgagtttattggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatgcaacttacaagggatgtgaaggacctcttcaaggagaactacaaaccactgctcaaggaaataaaagaggacacaaacaaatggaagaacattccatgctcatgggtaggaagaatcaatattgtgaaaatggccatactgcccaaggtgatttacagattcaatgccatccccatcaagctaccaatgcctttcttcacagaattggaaaaaactactttaaagttcatatggaaccaaaaaagagcccacatcgccaagtcaatcctgagccaaaagaacaaagctggaggcatcacactagctgacttcaaactatactacaaggctacagtaaccaaaacaacatggtactggtaccaaaacagagatatagatcagtggaacagaacagagccctcagaaataatgccgcatatctacaactatctgatctttaacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatgtacaagaaaaaaacaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcatttaaaagtcaggaaacaacaggtgctggagaggatgtggagaaataggaacacttctacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaaaggatgagttcacatcctttgtagggacatggatgaaattggaaatcattattctcagtaaactatcacaagaacagaacaccaaacaccgcatattctcactcataggtgggaattgaacaatgagaacacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctgcacgttgtgcacatgtaccctaaaatttaaagtataataataataataaataaataaataaataaataaaaaatgatgagtttagacaaatatcattatggtagtattatattatgttatgttatattatattatattatattatgtataatgtatattccttgcagcctgccctgcattcccaatctatgactcatgctgccttattgatactgaaaaatctccactacagcatgccagcttttgaaagagagccttgggttctttcccaatacttaccttccttttagggcaacctatctgagtcctgtagcttgaaagatttcctaccagcctgccatcccaaaggaacatggatgaactatgtttatgctgatgtgtcaagtcatttcttggtatggttcatagtagtccacatggctcttgtagacaaagagatgaattactgatggcagaatttctgttctggcaacagggaaatttgcagaaaggagaccttttcagtgtgaacattttttgctcacaggtggtccaggatgcccaatgctaaatgagaagtgaaaagagcaatcagggccaggtgtggtggctcacgcctgtaatccaagcactttgggaggccaaggtgggcggatcacgaggtcaggagatcgagaccatcctggctaacatggtgaaaccctgtttctactaaaaatacaaaaaaaattagccaggcgtggtggcgggcgcctatagtcccagctacttgggaggctgaggcaggagaatggcgtgaacctgggaggcggagcttgcagtgagccaagatcgcgccactgtgctccagcctgggtgacagagcgagactctgtctcaaaaaaaaaaaaaaaaaaagagcagtcagaattcaatttttcattcagaacaaatcaatccacgtgggtaaacattttatcaaactcaagaatgctgtctttcagggtgcttttccctcaacagtcacttatttcctcttgcaagtagtatcttcgttcaggttcagtgactactgtgtattatatccaatgcttctggcaagtgggttggtggaggcagcccaagatcttctagaatcaagagaattggatccatttcccagttctaacacttatcagctatatggcttttaggcaagtcagttaaacatccgagtctcagtgctctcatctgcaaaacagaaaatgtgatgtacttcacagagccagggggaggaataactaaggtggtacatttgtacgtgctttgtaacctgtaaagccctttactgtacacgtgtcatttacagctctgtatcaccatcatgacctagaaaagcagtactgacagaagacttatcttcttgccaatgctaagataactttagccatttctgcatttctaaaggaaggagtctttatcccagtatctatgaagacttggcaggaattgccgtcaatatttagttggtaatataaacgaattaaacaaaaatgcacactaggttttaggaaaattaaagacagaactatcatttgtactcctcttacatttcccaaagtgctaaaactagacaataaatcagtcctcaataaatgcttgtttatcaattttatattcatttatttgttgataatacaacaaagatgtttatatgcagtataatatatatggcaaagatgaaaagtagcaaattcatgaatcaacatcctatttatgcttgagaagacaaagaaagtgttggtgacttcatggtatacataaccttaaggagctcgtgattgagcctgggtctctgctatcaatgtaggatataaatttcaaatgtactatcctttatatgtatgttaatgtagtaaacatagaaaactgatgctactagtgagaatacttttacttgaacaactaaaagtttgtctttaatcccctaagtgcatacacaaaaggaaagtactgtacaaatcaagtacaacagaagaagtaaagtaaaagacaagtgaaggaattatctggaacttagatctggttggctttttctcctgaagtacttagataaattaactcacttttctcttttgctgaagaagtgcaaattaggcaggcatgttattccacgtaggcaaaaggaaaaaagaaagaaaaacataaaatggctatatatttgaccaaacttcgttctgcaagaatcccaatactaaccttctaccatataaactactttcaaaatcaggctatatccttccagtacaaacctggtttgtactactcagagatactactcagaaatactttcagtatttcccttctttcaacttctgatgtgattctatccatattcccctgcctgtctcccagtcaaagagaatgggacacaactctctttagagtccatcagtgatgctttagctgccaaaaatagtgacaatagacattcattgtctgtctaccttacttgttcaacattcagaattctgcatcttaagaggctgtggctgaaaacttgagccagttcttcagaatttctaacatgttatttctgccactttttctcccttactttagcagagtaatttaattcaatttgagagagagagagaaaaaaaaaacttttctagttacacagatcaatccaattgtttggagcttcagaatgaatttttaaacttgttgaacagaagcatacaaatctctaagagcaagtcagataatatacaaagcctccattcattgtgtaggcagaaaggaatgctggtacccggcagctctctgaggaatgttcccttggctttgactattctgctgggaacaaggaaggaaacacatatataaaatgaatttataatgtctctggcttgtaatggcagaatgataagaaaagttggctgtttaatataaactgtcagttgcatattccaggcctcctctctttgaggttcctcccacatccacacgcctggctactgtttagtgcggagtacaaagtggccgtttattattattgactggtgaggcctgtgctccaaaattcattctgtcaacagaatgtaagcaaagttggcattttaaagcagggctctttcagtttctgggttttctcaggattgctatgcaacaggatcagtgctgtagtgcccggttcaagctgaaaatgttacacaggaagacataccatgtaaaggtcagattcttctactataataattttcttgatctgtgtgtatacaagtgaagttgaatgcataacctcttatcataactcttaccaaggtcctatgtactttccacctgtcaagcctaaaaatgtgtattaaatgggaaatcaaaactaataaatgtatgatgctgtactatatgtatgatgctataataccaaggtgaacttaatttgtgttgtcaagaagattttctctcccatgacagactcccaggaatgtgctggtgctgtgggccaagtgcaatcttgtttattagtctctccacgcttttatggtcagagttaactctacagattactacgtaaatagaaaatatgacttgatccatatagtaatgaaattattggcactggggtacactttatcatagaattttattgcctatcacttccataaaataatacattttgtccatagactagaagatataacttgtgaactttataaagttataaatacattactttccaactcataatggcaaggaataaatctattacaactaataagatgcccattttaaatctacataataacaggagaaggcaatacgccaagaaaagggatttgagatgtatcttcttgttagtttagcctgattgaaatgtcttttgaactaataattatttatattttgcaattctccaaattcacattcatcgcttgtttcttttgtttggtaattctgcacatattcttcttcctgctgtcctgtaggacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtaggaaaagatgtggagcaaaaaggccacaaatgaattaaaatggccaaattttcctcattgtcttagcacaagtaactggtatctcacatgtctacgtaaatcatccaatttcagaatgattcactgtattttgaataaatgaatcatttatttgcttggtatggagatgatacttgaggattcagattagattaaagtggtaatgttttataaacataggagacatgcatattaagacatcagagtgaatttaaatgaggagtgcagctattctagtttcataaatttctctcttggcatatcacagggttatacaaaaagtgataaaaaattaacggatatgtattatggaattatttttggcattagtctaaatgcataccagaggacagtctttaaaaccctttataacacattacaattatataatataaaacctgtaacacattataattaacagtttagaggagatagctcctacagttaaagagagactatagcaacttcctgtcttttgcttcctctcagattttgttaaaacacatcctctgtaaactaagcttttagttgtagtatactcacatactttatattttgcccccttctatgtgccagctttctttggagaagttagttaatggatgcatcatagcatctttgtaaaaagggcagagggaagttcttgttataccagttttgcaatagttccgtggaggaacaaaaggatagagatagtaagtaaaacgcccattgtaacttaaatgatctagcaagggcggggaatgaaagccaggcttcctgctttctaagcagttgcctttcttaattcatttctctttattaaaaatattttgtgctttcttctgtgtctagagaaaaagtgataatgaagggaggtagaagatgaccaaatggacttaataatagttatgggagtatacactaaatgacgggagtagttactacctctaggtagaaagattacagaagggagattttttttcttctttatagttcttctaacttgtccaaaattttaacatatatacttctataaggaggaaaatctgcatttttagtaattcagaagcactattgtaaatgtctgcatcaagtatgaaataatgatagcaactaatatttacatgatgtacctacataccacgcaatgccataagcactttccattcattgaccggtttaatgctctcagcaaccctaagaggtagattttattattgaattctttttacatttgaagaaagtgaggcacagagaggctaaataatttccttagggtcacttagcaagtggaagatacaagatgaaaacagggagtctgggtgggccaggcgtagtggctcacgcctgtaatcccagcactttgggaggccgaggcaggtggatcacgaggtcaagagatcgagaccatcctggccaacatggtgaaatcccgtctctaccaaaaatacaaaaattagctgggcatggtggcacgcgcctgtagtcccagctactcaggaggctgaggcaggagaatcgcttgaacccgggaggtggaggttgcagtgagccgagatcgcaccacttcactccagcctaggggacagagtgagactctgtctcaaaagaaaaaagaaaaaagtaaaagaaaaagaaatcagggagtctgacttcagagtctgaacttttaaccaccatatgataccgtagcatataaagaaagaaggaaacttctacaaagaaatgcatactaattgaaaggatgaaatagagagtagattttttctaggagtagaaaaggatttgtttttatgagaagtagattgctaggagtagaacaggtttatttttatgtataaggttttgttttgttttgtttttcacaagtttgcaccctggcttcccagacattgttccttatctccctattttgtatatgaattttgtgtcaacttggtggtggtacactgggagcaacaatggcaatagcattttcaaagatagggaggctctattagctttctacagcttaaactcttaagagaggtcagtatgtgtgatgacgtaggccactttgataaccttcgtcattaaaaaagaatgaaaatgtgagatggaaaaaatattggcaggtcaagttaagttattcttttctgcacaaaagaaaaagaaagatgctataattgttccgagtatcacttagtgccttttctctgcctcatgtgaacttgataaaataaaaggagaattgaaagtggcaaatagcatgtcagccaaaatatggactcttcattctcagcagtttcccatgtcagctaccgcagtttgattcttgctgtcattaatcaggtagaaaacagttagcttatctaaggtgctgccaattctagaatttaaatattcagatcaatggttttggcttttatataggcctatgtaataatacaggatatgttataagcactcataaaaagcaaagaagtaattctccacatcaaagcaatttagcttatttcctgacacttgattgaaattagggtattgatcaatctacagcaaatggcagggttcaattgagagaagtacagtataggcagtaattagggatgattatgaaatagaatagaataacactggaagagttagatatagaaccattagtggcactgataaacctgcattatgaatcttgtcacttcttccatgggggttattttaaaatgaaaagttgccacaattaaaaaatagtttcaatgatatactggaaaaataggcctgtgtttgcccaagttataacatattataaaaaattacagttggcccattgtttggtgagcgattctgaaactgctcttatatttcaaaaaaataaaaccattaatgtgtccatttttaaagaaacaaaattgaatttaaatccaaatgatttcgaagtttccctttgtattccattggctcataagagatatccttgtgcttccaaatacaagtccatattgtatcgttttccttccatttatttttcttctgccatacatcttttctcttcctgtgattaagattcttatttaagtcatcatgttatgccatattgatacatttgcaagaatactctaccttggacgctgtttatatcatattactcttttgttcaaagcttcaatcttgtaggtctccatatctccctcattcatttatttgttcattcaacaaatatttaatgaatgcctactatgtactaggcactcttctgggcacggaggatgcaaccatgaataaaacataccaaaaaaaatcactgctctaatgaagttatatttaatcattagaatctagtagaaccttctctctctgccaactgtgcctaataagtccttgctaactccttcccttctcttttctttttctgcctccagttcctttctcaccaagcatcattctgttactccccaacatagattctctgagccaagagaatcaataaattctattttctaaccccattcctactctccaacaatttcctcactctcccatatgagtatgtacccttgctggttctcacacttgcaacattctctttcctcttattctccaaattttgattcatattccataacaaatcttttcttttctggctgtttcctcactaggtcttcccaatactattctaatttacacttgataacatgtttcttcaagtgttcaagagttgctttatagggctatgcttactgcctccagctaacttatatgaatacaaaaatttcaaactcgaaatatgtgagtatggtagagtagaaagacatgggccagcagctgggcaacccagtttcccttctgttctattctgtcactaactgtcttagcatataatcttgatcaagtcacttaactgcttcagacttcaattttctccttcactgaaatgaagagtttgaccagaaatatggacagtctcttccagttctcttgcaatcgtacaattttattcttttagttctgcaatcacactttatgaacctggaaaattgtttaatttttctaccttggttttcttaattaaaatagaactgattgatttaaaaggcattatataaagtaattaagatgtctttgagagaaaagaaatttaattgaaattgtataatcctatctcataatttaattcaagaaaagtatatgctatcattccacatgcattattacatcacatgttggccaagaggtataaggaagaaaagtaagtagtcagtgataatttaagttccatcaaacaaaacgaaaacattaactgctttaagtgggagaaaaagagaaaattatttacttaaatgtacacacacatgcatacacacacagttactgatgacgttatccaatattaagatggtaattagtcaaagaaagtgtttttcattctaaaattccatatccacaatccttgcatttttaattttagaatattaataacttgagaagtggtcaagtcaattgttttacataagaaatatatatgaagatttcaatttagtctactactagattatttttccagatcattgtatatactattaactatgaaaatcacataatatgttatcaacataatttcagcagaatttacattatgtgagatttttatatttggcagaaaaatttgtaaatgttatataaaatgttcacatttatacaattgtgaacattaagaggcaaggacactgacattatatagtctgtagaagccataaatctattggggagtgcttgctattagaggttagaatagttagtgtctttgtataatggagaacaaaagaagggcaaaaagaggtggggtctacctttgagagaaaactgcaacttggacattgaatatctctgaccttctttctctctcttttagaatgttaattatgtttggatgttggagttcaagacctgtctagaaaaaaaaaatgttgacttctctttgggattctctctatttaaagagatagctcccattttaattctgtggttctttaattttttttgtttctgaagtacaaattcaaattattcatctgttgatgacaccctggagatttttctcagtgttctcttgtagtagtttcatggtttgaggtcttacatttaagtctttaatctactttgatttgatttttgtatatggtgagagataggggtctagattcattctgcatatggatatccagtttttccgcaccatttgttgaagagactgtcttttccccactgtatgttcttggcacctttgtcaaaaatgagttaactgtaggtgtgtggattcgtttttgggttctctagtcttttccatgggtctttgtgtctgtttttatggcagtattgtggttctttattatttctgcattcctcccttttctttctgcatgtttaagtgctattttattacatgagggtactaaagatttatagggatatatcattagttttataaaggaagtcaaagtgaaaaatgaattcaatataacacatttcactttaagaatgcatgcctttcagagtaaagttttattaaggatttcaaactaggcattaaccaaatcacagttgaaatatctgtgtctagagaaataacaatcactttatcagcccctataattcttagtgtcctgacactgaggagttccttaaagaccaagcaatatactccagcacatctaaaggctctgcgttttacctaaaccttacaaattgtggaaattatcagctttttagagattagcacttgccttgttaaacggtagtaacccctaagctcttgtcttcactaataaagattaatagacatagatagaagctaagcatgcccctttgaaccacctcttttattttccgttgagtgggtaggagtaagcagaatatatttgacaattagcaatgttaaaagacaaactttagacaaattccgttttgcagagtttatttgagcaaaaaacaattcatgaatcagacagtactcagaattagaagttcagaaagctccacccagcaaggtgggcaggcagtatttatagatagaaaaaggaagtgacatacagaaacagcttgactggttacagcttagaatttgccttacttgggcatagtgtaaataggcatttgccttatatggacatgagctgatcagtttacagcctgtgattagctgaaacttgactgctgggattggctgaggctcagctatttgttacaagaatgtactcttaagttgcatattgcttacatgccaagctgggttgcagtttgctatgtacagagtcagctttaggcccaatttaatttaatttaacagcaacaagcctttttgttcagagatcaaaaacatttggttaaaaccactaaggtttaaggattttctcatctaacaaaggtttgtaatttctatttcccatatctaaataggacagctcaagttatgtttttcagcagctgttttatacctttgcaatcttgatttctacatatgcaaaacaagaaggttgaactataatctctcaggttccttccaaccccaacagcctatgtatgatataaccagaaaaaaaagtcattacaaatacaaagaaacattttcaggaggagatattccacatgcaaacataggttaatcatttcaaaatatctggtatatacactcatgaaaataaaaatagggcaactgcttccgataaatgtattagaaatgtgacttgaaaacatttcacgggcttaacatggtcaaagaaaatgttttgagctcacaatgttccttacatttagatcttcaaaatcaagtcactgacaaatgccacctttgccctgtggagaccaagaagtaatgtttggggcatatcagaaatgctttaataaatgctttatcaaagaatggttctggagcttacctgtggaattgtgaaggttcttgttgaaagcagagattgttgatagaattatagaaagtctggaggtggcacctagcaatctcaattttaaacaagctactcaaatgtttcttatacacactatagtttgagacccagagctttaggttgaatacatttgtatatgctgttttaattcattctctggctgcctttcacctcttcagttcttactcagtgttctctgtcctttgtaagtttttcgcttcagtttttgtcctcctatcacatttttcctttcactcttgagctttaggagaggaaaaaaatgaagcaatttgatatgtagttaggatgatcaaacattctgaaattttatctaactccacagcttagaaaaaaattaaaggaagtccccttacccagatatgtgagagcttttcgtcttttgaggttccaggtccgtcttctgctgctgtattagctctcttgactgtcctctgtccctggcttctaacaacttccctatttcatgctattaagtttctcttagatcctttagaactgaattcccggctgggtgtggtagcttacgcctctactcccaacactttgggaggctgaggcaggtggatcacctgaggtcaagagttcaagaccagcctggccagcatggcgaaaccccatctctactaaaaataccaaaaattagctgggtgtggtggtgggcgcctgtaatcccagccacttgggaggctgatgcaggagaattgcttgaacccgggaggtggaggtgcagtgagccaagatcgtgccattgcactccagcctgggtgatagatcaagactctgtctcaccaaaaaaaaaaaaaaaaaagaactgaattccctaggtctcagttattttgctctctcttaggggacctaaaggggttcattgacccactaataatgagtcagcaccatttaacctagaactggaattttagcacttccttacataaacaaagccgcagcttgaggtcttaacataggcagcctgcccttcactatatcctcctctagacctctctgccacaaggatattttgtttcctctaccaggcagacagaggccaaacattagtcatcgttatattctctcttcccttcctctctccctactccccaatgtatcctagagacttaggggcagtcaataaatatttatttaatcagtgtcttttctaccatttgctgcttttccatgtctgagccctacctctctccacctacttttcaatatgtcctgcttgacagcctcttttcactctcaaagggaccaagctgtgaattccagacaccccaaggaattcgtttaaccattacacattacatgctattaaacagctaaaatcttgcatggggaattgtcgcttaggcttatcatggaaaagtggtaactgaaaggatggtacagaaacataaaagaactgacctctaattgtatgcaatctgcatgcactattatattcaattcatgacatttatggtatttcacgattcagttcttgggaaataatacccttagagtctggaacaatttaatttatcttatttgatggaaatgccttcatttttcctggacatattgtttatactgcaattatagaaagaaaatcttgacaatttggaaaagtagaaagattaagaaataaatcacctgtaaatctacctctgagggataacctggttgtcattacaaaattttttcctagtcaagcatgtgcatacaaatacatacacatacacaaatgttttagaaaaattcaaaaaatgtatttgttttgtaacctgttttctcatttagtaactgggatgatgaccttttccatatccataaatatttggctatgtcatcatattgaaccttgcaaaggattttactgtatgaatgcaccattatatatgtaataattcccttttaaattaagagctatttaattaaattcatatataaatttcattaatttctaaatttaaagcatatacaagtttcattacatttgaaaacaatcagtaggttggggttttgcatttctcaagcaattccctcatattgaatatttaagttgtttctgttttgttttatcaatcataaatgatgctatatataacatttttccacctatatctttgtatctttttccaatttctttgttagtataatttccttgaatttaagcctgtgggtcattgtctttgcacattttaaagacttttatgtattgtcaaattatccttcagaaagtttggaacaatttaatttcagtagataagtattctttggtgattctgtttgactaaggccaaaaggagaattgtatttgtaatgtcaagctaagttaccaaatggctaagggaaatgttgctccacctggttgctttgctttacatttcaatctttgcagcgttaaagtctttattatatttatgttataggtagcgttattatgaattaattagtaattgctgataatagctgagtgattgagcataatttctaatttacctgaagataaagctttgctaacactgcgtttcctctttgttttctggatgatgatttattttattaatttagcttctcatcttcaagtgaaatgtggattttatagcacagatcattcatttgtgtattcttaaatggcttctaaggattaacgtgttctaaatacagttgacggtaaagcactcagtctcctgcctaaattattcatgttcgggggaagctttcagataaatgtctgattttactcttccatgtgagttgttgtcttagtactttttacacaaaggaaacaaagcagaaaatgttgaaacttggtgaagacaaatcccaggtgcacacaaataaagaagggtagggggaaaggagacgcatttgggaagaggagcagaaaggaacagacgccagatggaagaactcaatggaaaaggctgcctagggtgtagaaatggaaaagtcaaaatgtggggagagacctttccatttctcaaggcaaaaagaattccagtactagcatgagtcacatgaaaacgaagtgtttttcattagtcactgcatccaattttttctaccagaaatattaagaattgttgactacaacagtatggaaaagcaatagattccagtgtgtatttcatgccaaaagtctcagcattctgcatgtggaaataaacatatggctaaacactgccttttctcaaaattgccatcaaactatcctctgttttgtggctctcaaaagtaagtagccagatttttattcaagactgctttgtagttcacaataggtttattgtactttttcaatggaattgttagaatcatcaattacacttctagatattctgacatggtacgctgctgttctttttcaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggtaggacatttttaagcctcgtgccttgcacatgttaagcacatagtaatccagtgactattttaaaattaattttgtttgaaattaagttgaatagaaatcttttttactcttctcacccaagggtcaattataaataatctaagccattacactgtaaatgtcaaacacatttgtgttaataataccctttaagaaatcgtccatctcttttggctatataaaaaaaagcttttcatgatgaaaaatattgaacatatacaaaagtagacagaatgctataataaaactcgtactcatcaagacatcaacaattatcaaatcacgtcagatcttatttattctatagctcttcccagattgttttaaaacaaatatcaggcgtgtgttattttattgttaatatttcaaaaggttaaaagataggattcactcttttaaggtaatcaccttgctactataatgcttttgaaatatcaataatttcatcatatcaaatatccagtccatattcaaatttccatttttctcatacatattatgcattttttaaactttttctggttttggtttaaataaaaattgaaatcagacccacaccttactttggttagttggtctttttattactttttgtttggaagtaattacagattcacagtaagtttctaaaatagaatagtttccctgtatctttcaccctgtttcttttcatcattatatgtcatgcaactgtagtacaattcttattgtcatttcaacatgcaatcaatagaaaaaatgtacatttacagcacatctcaattcaggctcattacattccaagtactcagtagccagatgttgccagtagctaccgattgaacagtgcagttctatagtttgattgtatttgggtttggctttttttggcaagactgcttcacaggtgttcgtgtattcttccatcatcaggaggtggtatataatgccttgttttctctttttgtgtgatgtttaatagctgttcacgatcagtggctaggggttgcagtgtgataattgcctatctctaccattccttcttcatttattcactggggtaggtctatgaaaaaaatgttttgcacttgtctcctattttggtactcagtatacctttcataccgaacaagcaaaatacgtttcaattttaccaatttttataataacaacttgttcactagcatcctccaacgatgaccaattatttctttgtttgtttgttttatttttatttacatttctatcttctctactaagctctgagtgaaaaaggcagagattttgtcttgttcacctccaagaccctagagtctagtaaagtgtctggtgtagagtggatactgataagtgttttggaaatgagaataaaagatacaagaacagaaatgaatagcaaaccaaacaaattactaccaaataataaaaacttgataaaatggtaccacttttgtatgttgagcatgtaaaggaaagatctctgtggagatacagccaaaggtggcatcttgaggaaaggtcaagggtttatattattctggagaagaggatataggaaattataaaaagggaagagaacatgaaagaagacccagggatctttgcaaaaaaaaaaaaaaatgccagggaaactgccagtttctcctttagccatttgccttcatatatttctgaatattaaattagcttttgtggtagggtgaaatgtaatggtgctatgtgttttaaatgttctgactttgaataaacagccaaaacactctggtgtacatatagaaaagcactcattgagaaggatgggccttttttaaaaaatgcattatgcgatatagtgaaatgagacagaatttctacaaaagatgaattttatgctagttccagaaaccaaagaaaatgaatcactggacatgtgcactaggagtcaggagactgagattctagtcatatttcttcataagatggattctgattgctattttgttcttcaactgtaatatgaggaaattggtccaaataattgctgtggtttcttccagccagtattttgttataaatactgcttcactattcctggttattagttttggttgcttgttaagagtggtaaaatgtctgtacttaacgcagtccttactcaggaatctcatgacaaagaacatgacttggggagatggtgatgctagagttatgagtgatactcaccagaatgaagttaatccgtccccacttggttagtgtgcttgctcagatagctacctgttaacctttcgtgaatttcacaggacttccagcccattgattactctgtgttttatacattagttcctctgcccttccatatttacctccttccaaatacaacttagattcaatcatctaaattttaataacttgttttcaaaagtctgaaaccctttgcttctttatctttttgttgctgcaatctacaaaactccaaaactctagctaaatattccgagactctaactaaatattttctcataccagacaacaatgtagttgtctggtacagtaccttttccggatgaccagccttcagccttccactaccaagacatcactgggtcaatttttttttttttttttttttgagactgggtcttgctctgtcaccaggctggagttgcaatggcacaatcttggctcactgcaacctccgcctcctggttcaagcaattctcccgcctcagcctcccgagtagctgggactacaggcacgcgccaccatgcccacctaatgtttgtatttttagtagagacagggtttcaccgtgttggccagatggtctcgatctcttgacctcgtgatctgcctgtcttggcctcccaaagtgctgggattacaggcgtgagccaccgcacctggccaatttaccttcaaaattgtttttgactgtctactattgttatcatcataattatagaagaccatttctcctaacctttctgcatctactcttgccaccctacaatgcaatctctacatttcagtcagaataatctgtgtaaaaaacataaatccaattatatcagtccttatcttaacactatagtagtcttctcagtgctcttggaaaaagaccaaaatcctcaacaagggtgacaaggcactatctggcttgtctggcctcagcctcctctttcctagatgctcttcccttgctgtttggatgccagccatactgcctccatttactttttccaattctgcgtgtccctcttatgtggggctttaaatatgttggtcctctgtctcaaacccttttacctatacccacccactcataatatcctggttatcatctaataatcctttacatcttggctcggacattgtgcaaacttttccctgttgtctacatttgaccagatctttctttacacacttctaaaattgtctacttttctataacatagcgttgtttgtcatcacgtacatgtgttactatttgataaatatcgactactcttgctaaaccatgtccttcaagaagatttttgggagggggaaagctgtcatttttctactcagcacattccaaagtgcctagtatacagtagacactggttagataaaggaaggctattgagaccaagagcagggaaagaaagaatagagtggtattcccttcttatttacaggagttttctgtttatttctaattaagcatctttttgtaaagtgtgtagagctactttgatgcacaggtttttttttattattatactttacattctgggatacatgtgcagaaagtgcaggtttgttacataggtatacatgtgccatggtggtttgccacacccatcaacccgtcatctacattaggtatttctcctaatgctatccctcccctagccccccaccccctgacaggccccagtgtgtgatgttcccctccctgtgtccatatgttttcattgtttatctcccacttatgagtgagaccatgcagtgtttggttttcggttcctctgttagtttgctgagaatgatggtttccagcttcatccatgtccctgcaaaggacatgatctcatccttttttatggcttcacagtattccatggtgtacatgtgccacattttcttaatccagtatatcattgatgggcatttgggttggttccacgcctttgctattgtgaatggtgcttcaataaacatacgacatacagcttttacttgtagtttggcgcaatgctttttcaagcttctcttggtatctttaagaaaaattcttgacacaaaacactctccttcctcaaacaacatcatcgctcctgagtgctgatgagagaacagtttagtagcctgtttgactcaaagttttgtcacatgtatgtggtagccctttcatatatggactgtctagttagtgatgctcttgaagcctatgggcaaaagaacaatggaaaatccttgaaactggatctgcgtatcagatctcctgaactcagttagaaaaagagaaaaagaacagaatcagtacaaaattccatcaagatctaatagttgacagatcttatatttgtggacttttgttttactttgccatgtttccagaattgtacattgtattgctctttatgggtttcttgatttaattgttgtttgtatagaatccttggtatcaagatgggtcactgtaattgtaaacttattccgcaagtatttagagtgccacttttttaaaaagtcatctgcttactctctattctaaattattaatatcctttgctgatgctttttatggggatacaaatcccattaaaatgtcaatagttgaaactaaaatcaaatgttgttcattttcactttcattttctataaatcaggatgtttacaaaacaggtaatttgtgtttttctttgtataccatttcagattagtgataatattttgtagcaaaatattacatatcttgtactcttttcttgtagagaaaatatacagtcaatatcaattgctgtcatggagagatatatggttcttctgtaggtaaaattccaagatactccacagacatatttggggaccatagtctcactcctcaaagcaattttcacacccatgggagtagatctgtgctccccaaaccagctgggcagcataacaactgcaactgaatggctctcaagactaattaataaaataatgctccagatgcggtgaagtgttataaataattaaagctcaaatatgccttagcaaatataaactgaccaatttttatgtcttttgaatacattatcctggcttttacagttcctcattacttgcctcactagactgactcgttttcaattagtgggtgttattctggtccagatatattttaaaaactgacttcctttgttttacttgagcagtcactaaagtgatatttattacttgtctacttctgtgattaacctagagagagttttaaaggagcaaatcatagtggggaatttctaaggagaactgcaataaaacatcagcttattcaactcccttcctcctaccccaaatccaaatggagattagatcttgattgtaacaacagtgtaggtaatgactttttgtttgcctttttactaatgaaattgtttgtcactaggttttcatctttcaattaaaaaaatctctataatcccttccctagagatcattaaggataccttcaaagcttcccgagattttctggttaagatttagatggaagtaatcaatacatacattattaaaagagtggacagaaagccattattgcttggatgctgttgacaaatgaaaaggcttgaataaagtagtttacttgttcatttgtcaggtcatatattatgcatgttcgatttcttcagaagtcaccacaaagtgagagacaggctgagaaattcaataaaattatcctgaaatcatgttgtagattatacatttatttaggctcattctgttatcagtgctggcctgcttacgtgggatacattttagtatgtatgttagcttgacgagttttctgtgttttctttttacagaaagagaaaatatctttggatgtcatttgtgaatgttaagatttaagtcagctctgtgttaagaaaaatgcgttgttccctatcacctctgaaaaacaaccaaaagttgcgatagagtgattcattcttttttcttttctttttatttattttttctttaatttttttttgagatggagtctcgcctgcagcccaggctggagtgcagcggtgcgatctcggctcaccgcaagctccacctcctgggttcacgccattctccttctcctgcctcagctgggactacaggcacccaccaccacacctggctaatgttttgtatttttagtagagacggggtttcaccgtgttagccaggatggtctcgatctcctgacctcgtgatccacccgcctcagcctcccaaagtgctgggattacaggcgtgagccaccgcgcccggccagagtgattcattctaacattcaatgacctggcctcttagagtttctaaaccacttgactgttagttatatctactctaaggtgtctttttagccgcgttggaggaaatagacgtctttttgatctattcttcatcatttttgtataagtttgatatcctatgcagtcatatttagggatgctgaatagaaatgacttaaaaattatttttagaactgcatttctaggcatttgagtcttctgaaaactaagtctaagtcttctgaaaactagctttatcatcaaaactgaagaactgagtcatctaggaattgctgctttgctttaatgactgtaacaagatgagatgtgaataatttacaaactgacttctctaccagtcttctctctcactttgtcaaaatattttgatgtcctgacaaatactctttaaaacagtatctgcatagtgttttgccttgacaaagcacttttacacacattattcatttaattacaaatgatccccttgatttttttctgtgctcttccttttgtcccccaaaaacattattttaggaaaaattataccataactcagattcctagaatttattggttctttcaagaactttttttatgaagagcctactctatgttaagcatatgttagggaacaaaatgagtctctgcccctatggatgtttagattttagtgacagaaatacatagtaaacccataaattaatatatgaaattatgttgggtagtaagtgctatgaagagaaaataaacaaagcatgaatagagaaagattgaggagtactggcctatgtgaggaggttattttggggtaaagacttgtgtgaggccgggtgcagtggctcatgcctgtaatcccagcactttgggtggctgaaacaggcagatccctggacgtcaagagttcgaaaccagcctggccaacatagtgaaactacgtttctaccaaaaactagctgggcgtggtgacacgtgcctgtagtcccagctacccaggaggctgaggtaccagaatcgcttgaacttgggaggcggaggttgaagtgaaccaagattgtgccactgcactctagcctgggtggcagagtgagaccctgtctcaaaaaaacaaacaaacaaaacctgtgtgagtgagtaaaccatgcaaaaaccttgaatgaagaggattctaggcagaagaagcaccaaattcaaaagcccaatggtaagaacaggttttgagtgttgtagaaatagcaagatgagctgtgtatctcaagggaaataagatcagtagacagtgataggttctagaaagagggaaaggccagataatgaatggtcttgcaggccatagtttggaggtggattttattctgtgagtaaagagacatcactggaagtaaggaaacatcactggaaggctctcagcagggatgatgtgatctgatttatgtgtttagaagttgactcttgctgctatggagaattgactataaaaagagcgaaactgaagacacagaaaaggagggtggtggagtcatctcagaaggaaatgattacttggactagagtggaaatgataggtatggtgaataattatttgatcgaagatatatttggagggtagaattgatagaacttaagatagatagaatgtggagtttgagaggaagcaaagagtcaaggaaaattctgaggtcaatggcttgaacaaataaaataatgatgttgccatctgagaaagacttgggaatgatcacgtttgagtgtatgtgcttagaatgaaccagggttccatttttggattatgttgatagacagacacaaagggtatgattcagatattatttaccacttatacttgacaatctcaaattttggctcagtatcttgagaacatacacaaattaatttgtcacagggttttctaataatccattcatttctactaacatttcagaagtaatttccaaatcttaaagtttaggcttaatgacctaagacctaattccctaaatggccacgggaactagattgagttttcaccagtgatctctcaaggtcagctcagaacttaacaacattattgtcagtaggaagtaacttccccagtgattgttggaagcagcccagccttagaattaagagtcaaacagctgttcaagatgctgtgtgcgcagtaaactattcctccatagtatcacagacctgcaagcaggctggactattctagcccgtgcccttgatctcagagaatacaatctttgttttcaaagacttccagaaaaataaatctcaacacagagtttgttaaacacattttccccttatacactcaaaaatgttttttcattgactataattagatttttaaaaaaaaaacataatttcaggcctgaaatatgttcatttacttttcaattttacatcaaatttattcaatctcatttataaattaatattgttgttcatgttgttgactatctgaaacaatgaatggatgtatctgatacttcaatcccttatcttcacttttattcagaagtggagtgaaaataaggcggagctttttgtcatcttatttagatgattatttagtcaaactcatagaagcagagagtagaaaaatggttgccatacattgtaagggcgagttgttgctcaatggatataaagtttcagttatgcaagatgaaaaagttctagaggtctgctgcataacattgtgcctatagttaacaataccgatttgtgcacttaaaaatgtgttaaccgaggtccggagatcaagaccatcctggctaacacggtgaaaccccatctctactaaaaatacaaaaaaagaaaaaattagccgggcatggtagcaggcacctgtagtcccagctactcgggaggctgaggcaggagaatggcgtgaacctgggagacggagcttgcagtgagccgagatcgcgcaccactgcactccagcctgagtgacagagcgagactccgtctcaaaaaaaaaaaaaaatgtgttaacagggtaaagttcatattaagtgttcttatctcaataagaaaagatgattatggccttttctttatagcccagatacccatgttcataacttctgtaatactagctgtctcaaatgactattaagggaaacctctctttctgttgtttgctccattgcctctttcttcaaatttttttcttccatgaacccctatgaatttgctttagattactgggggcaatattcttgccaccctgccatgtacatcctggattgcttgcccttttccaagacctcgcttttaagttaactgagcattgcttgtcccgaagtgagcatttggtaaaatattcttatgtgtttgagactcaataaatatggtggctctttaaataaagaaggtccttttggtgacagaatatattcagcaactttcttgtcagacatagaaacaatacaggagacataaaaaataaggtagaaataacacaggaacaagaatgatgacgtaggatggcaaaactagtaaatacagatcaagttacagatatgactgttaacatcttgttctatgcctgctcggtatccatttgttgaatgaacagaactgttggatcatcctacatttcagagcctgtctagtgtcctctcatctcctacctaatcctgcagactacagaaaaagccccaagcagcagttcaaaccatggaacttctgagtgtttggacatgaaaatctcctttaagaaatcactaggttgaagaaggcaatgctaatgggaccacttcttgaggaaattccacccagtaactcagcagtgacactcagctttggatctggaacatgagtagacctagaataagatctgtccatttttcccaatttacagcattaattttttcacttatgattcatgagtccaggctttcccctgcaagcctgttttgcatctaaatcaacttggccttcatataacacactctagtgttctaactgggtgttctgtatcttagtcaacaatgtttactgagcatttactatatgccaagctatggctatggtttttaagcatcgataataacgatgcttagcagagactctcaaactgccaccatagagcaggcctgtggccgattaatgatcttaacaaattgattatagtatatgagaactggatgttagaacttagataaggttttagcaaatgcccacattttacaaatgaggacacagaggagcaggaagagtttatcaccttttctggatcactgcagccaggttctggcccagcccaggcttgaagcccaaggcttctgccactcagaacagtgctcttttcaccacttcagcctgcctcccaggatgattctaggaagttctgcttacaaatatgggtagtatttctagtcattccatcagattttattctgaaaaacacaaatttaccatttcaatatgaatacaggtaaaattcagcgccaggcaagctgtacatgattgaaagacatctgtgttttgaaaagcacgggcttttactcacatccatagtaatatgatcctaaatccactgtccccaggagaaagcaagatagcttttctccctgtcatgtcattacctatgcccagagttctcctcttgttcctctcatgaagcaaatcaatatctcacctttcatcccctccatacgtggttctgagctacttctatttatggcattatttagatatttttataatataagcaggaagcaagagggacagaaaaaaataatcagtggccaggtgtggtggctcacacttgtaatcccagcactttgcgaggccgaggcaaacggatcacctgaggtcaggagtttgagaccagcttgcccaacatagtgaaaccccgtctctactaaaaatacaaaaaattagcagggtgtggtggcgcgtgcctgtagtcccatctactcaggaggctgaggcaggagaatcacttgaacccaggaggcagaggttgcagtaagccgagatcgtgccactgcactccagactgggtgacagagcgagactccgtctcaaaaataaataaataaataaataaaaataataataatcaataacttggttcttctctattactttcaggaattttttaagtttctgatttcttccatggccattaggattttccacttatgtggcttccaaattattctaagtcagggagattttatgttttgttatcactcactttcagcttcactttagaattgcaagatttagattcaaagtgtgtaattaactgatggccttaggtaaaccctaacttatctgtatctcaatttgcatggatgaaacattcataatataaaagtatacaccacaaatatacctactcaaccaaactattggctccttaatgacaaagattaagtctctatatctttcctaactttgtacctaataggttcaaaataaatattttttgaatgaacaaattagtgagtcaacaatcagtcacccggttggccagtacctatggtgttttaagtgcaatctaccagataattcaaccttcataataaatagatttatcttgagattatcattgctataatagtgtagtagcatacttcatataagtttattttgtgaaccttaagaagctcaaggacaaacatctgtgtagtattcctaacattttctaaattgcatattttattttcatagaggtgctctacgtctttagtattgcttctaattctctcatatcactattttggacccttgggtctggctgtcttggaaaggtgaaaagaaaggtatggggaagaggatgtgttttaacaaagataattttatctgttcaagggattcaggaagtaattatcttaacatctgaatgctaacatctgaatattgtaaatacgtattctgtatgtacatgggagaaaatatctatatctgataccttttctatcatcacataaaggaactgacttctctggtttaaaatattaaccaaaatttatatgacaaaatcagtatatatgagtatatattttctcaaacctctttcaaacaggcctttttgggagacaagacacttatcaaaatcaaggctcttgacattaaatattcttgtttgtctttttttaaaaaaaagtcttcatttttctttcttttaaaatgcaataaattatactacaacatgcagtttatggtgagttattagatactgaaaaattggctttccattattttaatgcagattctacattgctttttttttactacataaagccatttgttttaagctccatgctacaaagaccacagatgttcattgcctagaacagtgtctgatacatagtagttgcttgaagtttgttaagtgactaaattaaagaggatcttacatataaccatgtttaaaattacatattgttatttatagtttttcccacatgataagaattattgccattttctttaacctctgacctccttgaaccaactatttctctctttttgtgggagttttatccttttgtatttaatctgaatcttttgaaattctaaagatacaatcacttaaccctctcttccatccactttcttttcttaatttcaggcaacaatgtgaaaataatggtgcttatgtctttgtaataacagaactttctttgtcttttctttggcctcattttaatcttcaatgactcatatttaagaaatgaactgtgcagctgtggtggatctaagtccttggcaacaactcgatgggcaaacacgtggtctctcacaatggatgctccttagctttgaattatttactgtccagttttaacaatggaattatatcatcaaatagtgccttggactttttaagtttttagtgccttaagtttttaagtttgatgagacctttaagatccatttccggccgggcgtggtggctcacgcctgtaatcccagcactttgggaggccaaggcgggcagatcacgaggttgggagatggagaccatcctggctaacacggtgaaaccccgtctctactaaaaatacaaaaaattagctgggcgtggtggcgggcgcctgtagtcccagctactcgggaggctgaggcaggagaatggcatgaacctgggaggtggagcttgcagtgagccgagattgcgccactgcactccagcctgggcgacagagcgagactccatctcaaaaaaaaaaaaaaaaaaaaaaaagatccatttccttattttacagaccttgttccaacaattatctccaccttctgtcaaggtcgtaacatatatctagggtgaccaactttcctcgttttcctgagactgtccaattttcctgaaactattctggttttaacatcgaaagtctctcatcctgaaaaactcaatgctggacaaaccaagatggttggttaccctactgctagcttccgtctttcactctaggttcaaatcattcctatgctaaaaagaacttcttatccctttgtcttgttatcctctctgtcctcctgtcgtgtcttcctcttttccttctcagaaaaagaaaattgaacatttgattttcacttgaaatacctactccttcttccactcactcctcagctatgcctacttctgaggcttctgccctccactgaaattgctctcagcacatctagtgaacactctgcaatgctgatcttactttacttctgtgtttcattggactcacttggtcaccctcttcctctcaaaattctcactctctccttgaaatttctacactcctcatttcccctaatctctccacctatttgttccttttctatctctcaagagatcctgttcctctgtttgcccattaaactttgatatgtaggcactcaacgtatattagctgaatgagaaaataactcctaagtattttttttctcctcaaacctcagaatttattatttccttgtggaaggaatgttagctttccaagctgagcatatcacagtcccttactctgtcccccatgcacagaacaccccccccacacacacacacacacaccatcatgttgcatttttaatattactcttcaataattttatcctgaatgagcatgaggggttctgaatcagaggcagatttcatttaattaccttacagtaaatattgttgctgtgcccttcctttgcccaaagacttacccctagggcaacatgatgaacgctgatgaaacattttcctacttgagtggctgggtactccataagtgggagactaggaaaaatcattttttctgcttataaaggagaaggaggctgctatccatctctcattctgaaaggttctctgtggaaacataacaggcctgagtcctaattccagcttctgcagaaaccagctagccctgtgtgtctcatgttttacaatctggaaatgtctccaaggtatgggcttcatattttttgaaatgtaaatacctagaaagatacccactccagtctttctaacaacatagagttcagcttaggaacctaccctgagctataaccgtttgaccctcttggatcagagaaatgaactagacaaattgctacagatctaatctccatggtgtgggaagtttctcaggaggctagagctttctgtaggtgaactgagacatccaggaaagtttatttcctcatacttagttgaattgcacccagcgtttgctcatctactcaacctagacactaagtgtcattcttgtttctttttctctcttctctccagcatctattcagtcaccaaattttcacacttcagatttttagacatttccctatcctatccctgtcatttttcctggtaccattgccctgagtcaaatcctcataatcttgcactgaattcttacaattgcctcattatctctctgattccatttctgttcttctcaaatacatactctgtatttatatcaggaagatctatttgaagcacacatattcctgtgccactcccttggttaaaaccgttcaaaggttcctgattaccttcaaggcaacacctaagcctcttagtggaccatatgtgatcatagagaggcagagcttcaaattctggtttaaaaatctaatgtatttccagatagcaatagtgtctttttcatctttggacatgccctctccttgttctttatgctctagaaacactggcctgcttgagattccgatacataccatactgcactatgtcctatgactctgcacttgcattttcctcttcttggaatgttctctagcatactcttccttgaataagtcatgttcatgcttttgaattctatgtgattactagcttctcctggaagcttttcccgattttcttccccatattgcgcaagtctatagcactgtctacattgtattgaaattatttacgtgtctgactcttctattatatgttaaatattcctaaatagaaagggctgttttgcattcaactttgtatttccagtttcaggtacaaccactgacacatggtagttcaatagagggagccattattatttttataattagtaatgtcagtattaattgcctcccttcaggtccaaacagagaaactaggcaaaatgataatttacttgaatttgggaaacttaattgtatgaaaaaaaacacaagaatacaacaactgaacacacacacacacacacacacacacacacacacacacacacaaacatggagatttcaagtgaaatatcaggagaatcagctttatatgtaagcagagtaaataactcacgtatctagcatgattttagggtacagaaatatcccattattcagaaagtacttccctatctgtaggctgaatcctaatattctacttacagaactccagtattttggttcaaacgccttccctttctctattgaattgtaaatagctgtggatgatgaatcattttgcaaagtatcagactcaggattcttttgaatggtgaacaccgctaagattttattaataaatgtgtcatacaatacagctctggaacacttctgtaacataatggcatatctgaaattcaaggaagaatactgctaatttgtttttccccagtgaaagaacagggcttaaattcagcaggcaacattgctaaaagacagagttgaaaaaagttacaaaaattaagccctagatcagggcaaatattactgttattgttaaacagttatattagcatttatgtagcatgcacttaatacttttattaataccctcacttctgagatcaaagaatctgggtcaataactctcttcaatggtgtcagagtatccgttaggttattctaggctcacggtatacctcacgatccttttagcactcgattatgtgtgaacttactgttttcactctgcttctagtgttaattttctcccttctttggatctagaaactttttgaaggcagaaactattcattttgtttttctcttgatcccctggataaaggaagattacagattaaagattaattctagatctgttcatttatagaaactagtgtccgcaattcctacatccataatagctcaaaacatttctactattctcaaagaggtcacaatggatgatgtaatgactatttttcaaaagtattgagacttttctcttagcttacctattttataccttgtcagacattttgacagaattaactggtgattgtcagttggattcattgtatactttaatatagcctaaggtcctgcaaatggcccttaaggcttcccattatgttctggatatccactatttggggtatgtttaagtcctcattagccatgctagagttttgcaatatataccttgaaactttagctgtagatttgaagtatggctgtcaggttacataaacaaagcactcttatctcaatgagagggcattaactatccagaatgctccccccatctccccagaatagctttacaaacacagcgctttcctcattaacagatagacccatatagcctttaaaaaaaatcattttataaccatcagtgtataaataaaagagatagaaattgacctgggagtttcataaacaagttctgagcacccaggattaattttgagaagaatgccacaagccaaataagcacttcttttcatctcatttcacaggccttcaagagggaattgaaaactaaagaacctgtaatcatgagtactcttgagactgtacgaatatttctgacagagcagcctttggaaggactagagaaactctaccaggagcccagaggtaattgaatgtggaactataataacatattgatagaaggatcagtggtgacggagcagcccatccattcttgctgccagggtctggatagctctcatattttcttggttaaatagaatcaattcaaattaaacatagatgctgaaaaaaaaataaggactcataaactaccatgcataaatcagtttgtgcattcataaataaacatcaaaagagattagcaatcagttattggaacatttagaaaataataaacaaagggagttatctgtgaggaggaattctattgttgcaaagactacaagttaattttccatttaagagcctgcctgaagtaaattagagcttgtggtatgcatcctaacgtttttctcctcaatagcttaagtgaatcttaaattgtcggattgatataaggtagaaactcaggaagatatactttagatgttctgggctgtatcaaaatttatgccaaagtataaaaaagccgttaatcagtaggttaccctcttgttcaactgtactctttctttcttccagtatgacctttttgacaatgtttaaaaaaaaagaatgtggcctaaaaccttgtcatattgccaatttagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggtaccgtctacttctttgcttcagggccctttgagagactcaaaagagcttctaatctgaacttgagtgcagtgttatcttcccacaaagttaaagctagagaaatcagtccgtctttcacaaattcagtcttcattcacatggtattttctccaagagaagacagtgatctaattatttgtctgtcttcagttatatgaaatgaaatattaaaacagttacagggcaagaaatcactttgactttgatattaagtgattgtactaaagtctgatgtgtgtgtgtgtgtgtgtgtgtgtgtgtgtgtgtattggtgtattgcttgtgttacttagtatcagaatacagaaaaataaaacacttaatcaaaagccaggagtctaggtgttggcccttttgctaaccaaattacatgacttgggtaagttatggtttggtgaaataaggctgttaatgtgttgcccttcccttggaaggcaacatttgtaatacagtttcaagtttcattggcccactgcagaaatgagggaaaatcattatatatttggaagaccactgtctataagaccaaagttaaattcccttgtggcacaaagatggcaaatatattctgtagaaaaaaatacatatttaggagtatcattttgaaatcagcaactactcatctattgtcaaaatcacaaaaatcctcctagattaaaattcaaaagaagttaaattccctcatgcactcagcatgtttgccagcatctcagcatcctcattctagaagttgtcctcttccttggctttcatggaactgttccatccatgttcttcttcctatatttttctagattcttctcctagccacccctcaaatactgttgtgcccaagtttctaaccttagcctaattctcttttgattgtttaaaccctccctgtttgagatggcctggatggtgatgtatctacatctctagtccgcatctctcttctgatctctgaatccatgtggcattacgatcacaaatgcaactattctgaaaccaagttcatttgttctcctgttttccatttccctacttctgtcccctcttatctgaccttttttttcctgtttcctatttcagttaatgaatcatcatccaacaaattttccaggctagaaactttaggttcatccttaaacccttctgcattttcactgatggcacatgatggctcatgttacctcagaatagctcttttgtgttttctctcctcttttaaccaatgtcctttttaatccccagcatcttttacttagatgataacagtatacatctttaaatcccattcacccctctgtgtgcctggcatatctcagatactgcattttaaacatttggtgaattaatggatggatgaatggtttctttgctgatgttcctgcattacccagcttcttccaattccaatccaaactccttgcgggagaatacttgcctagagaatgaaatccaatgaataaggagattacgtggcccttttcttcctagccttgacttaccttctcagccatagctcctattctccagaccatttaatacactctgcccatatgatatatatatatatgtgatggcatatttgggaaaaaggggtgatatgggcagagtgtattgaatgtgtgtgtctgtaaagtatgtgtgtgtgtgtgtgtatatatatatatatatatatatacacacacacacatacatagttagatatatacatagtatatatacatatatacatagatatacacatatatatacacatagatatagatatagatatatctgcctttgcaaatgctgttctctctgtctggatccccctacgttgtctacttggcgaattctccttcagccctcaaggaccagccaaaatgttacctatctttgttgtctttcctgagtgtctacaacccccaactcccaccaagcagaagaaactgcttacagttggtactctcatagatcaccaagcatgctaaattgtcacacttaaatttcacatatattgtagcaacttgcttatgcatttttttttctcccagagaaagtgaagttgctaagagcaaggatcatgctgtacatctttgggctgctagcccagggccagcaacatatgaggaatctcattaggtaccttcatttattcactcaacaactgtttatgagtcattatataatgtgctggacaggtagttataaaagaaacagacttgatcattgccttcatgaagcctatggtctaatgttgaattgcatagctcttcattaaaatagtaggtaaaatttttaaaaagaaaagattaaaaatttgactctaatacttgtaaaatcccttctaccccaatgttttatgaccccatgtctaacatttaaagtaagggttaaccttgctgtgtactggaaaactaagggttttgaaatgtattacctagtattttaaaagcattaaatatgttgattttattcaaaaatatagggactaattttttgacagacttctccaaaaatgagaaataagttaggaaaatgtcccagtggaactaaattagttaatatgtcaattaaattgctcaatagataggctgtagagcagacataagggattcatttttagccatacttgtcacacaggtgcatttgtaagatactgagtatggatggagaagagaatgtgtacagcataatttaataattaaaaataactaaaagcataacagttcaagtatcagctggccttcacccaaccctatttgcggtattccttttagtttccctgtcttatctgttcttggtcttaagacaaacttcattttccataccctgattggtaaaactctcattctgatcccaatgatagcaaaacatataaacattaaacatacctttcgaaaaattatatttataacccagcacatctatctttctcagacatatatacacttaagttatggtacttatctgaatttttatgtactggtaatagtagatgtgattgggcttttgaatctgtgttgtattttatgcgtgtttcaaactatgaattacatgaattcatatatatttatctcccttcggtagctcttctttaattttgcagtggaaataaatcatttttctccactgcatcttattgacactgggtttgaaactctgaagctttgggggtagtagtttacaaagaatgagttttattaactaaaatttatttcagaaaaaaagtagaagtgtacttgaaaccactcttcccatttttccactcagcaatttaagccctcagaggattcatgctgtagggaacttttctaataaaccatggtttctctttttttattttattttattttattttattttattttattttattttttttttgcgacagtctcgctctgtcacccaggctggagtgcagtggtgctatctcggctcactgcaacctccacctcctgggctcaagcagttctccgcctcagcctcccaaatagctgggactacaggcgcccaccaccatgcccagctatttttttttttttgtattttttagtagagatggggtttcaccatgttggccaggctagtctcgaacttctgacctcaggtgatccactcaccttggcctcccaaagtggattacagcactgataactaggcagctagctagaagaacattttatatatccatatcagttcattttccttacccctagacactctatcatagtaccccccctccattctgatcttatgtgttaaataacttgttattcaagaaactaagtaatatgtgtttctgtgagatttagcattctgtaattgtattagcaaatgtggcttttggatttaaagaatgggtgaaacaacaatgactaagtccctggcctttatggaaatggcattattgctagctgatcatctgcgggtggtgaacatggtaaattaataaatggaaacacaatattaatattgactatattgctcactaagagaatctcagccttccaaacatagcttccataggaaaaaacagtagaatcaaatttaagttttaaatgcttctttacttttaaaattcatgatttatactgcttatcaaatattttaagggcaagatcatgacttttcactttactgaaaatagcaccagtgcttatttgactagacaaatattctaccttccttgtaatggggaataggaataactttttgaattactaggtgttccacatagatctgtaagtggaatatataaaggctttaataaagtagaataacttttaaacctgtagtctggatacaagatttttgttcttcaggacaatcccaaggtgaaaaggtttgtggattgttgttttctttttttttttttttttgagacagagtctcactctgtcaccaggctggagtgcagtggtgagatctcggctcgctgaacctcctgggttcaagcaattctcctgcctcagcctcctgagtagctgggactacaggcgcgcaccaccacgcccagctgatttttgtaattttagtagagacggggtttcaccatgttggccaggatggtcttgatctcttgatctcgtgatccgcccaccttggcctcccaaagtgctgggattacaggcgtgagccaccgctcccggccagattgctgttttttaatgttttgtttttgttttaataaaccatggtttctctttttttaatttttttttttttgagacagtctcactctgtcacccaggctggagtgcagtggtgctgtctcggctcactgcaacctccgcctcctgggttcaagcaattctctgcctcagcctcctgagtagctgggattacagacatgtgccaccacgcctggctaattttttttttttttttggattttttagtagagatggggtttcaccacgttggccaggctggtctcgaacttctgacctcaggtgatccgttcaccttggcctcccaaagtgctgggattacaggcgtgagccactgcgcccagactataaaccatagtttctctgtaccaaaagtggtatgtccttcttgagccaggaatatttcactgttcttagtttacctgttgactctgaacacagtttttcatacactgtaaataactctcccaggctgccatcttggaatatgcaaatctgtcgcatctatgtagttatgcatatcgcatttttgtcaaacttttaacttgcatttcttactgtgaaaagtcagggcagggattctatgagttttttctttaaagttcctacaatgaaatgttttgattaaaccttttttggcattcaaattgagattgatttaatgatgtgtgtagtaggctagaaattatgatgaagtgacgatgccatccttatttatcttcagcattcacatctaaagttttaagaagaaaactggcaaatccacctttttaggcttaccatcctcagtccctgtggctttgggtttttttgagaaatttgtcaaagaaacgctatgttagaatttgacattgaggaagccaagcatatttcctctgaatagataatgtgaaatgtgatataatgtattagaatttcatcttcactttggcaagcaagatacttgcaaccatgttcatgcaactatcttcccttattgcttttctcttcttaaccttggttctaaagttttcttcttattgtattaattttgttatgcttcccatttatatgagtcaagtcaaccttacttgatttcttatatatgagttatgtaaggaaaacttatcttttcttatagaattaggggatgaatgagcagatagaaccaacatgaacagggcgatcctaaaaatcattcaaaacatgtaagctctcccaactctgaataaacttgtgatatcttcataatgaataaggtatactgcctatagtaggaagaggaaaatttattaatgttttgtgcattgttaaagaactacaaatgaattgccgtgtggaggctttcattgttgttgttgtaaaaatgctatgtgtattaagtaagcctttgatggagaagaaaaaacaaagaaaaaatatttaatccttcataaatctgggttaaatatgaagctaattcctgttatttggagtaaccagggttttatctagtttacaaagcatgcaattgcaatgtttaaaagcatatgatttggcctttaatatctgaaaatatgtctatcaaaggccatattatagcgagtgtcactccatactttataagtacggtatatttttaatagaatgtttatgtactggtgataagagatgttactgggtttctaaaccagtactgtattaaggattttatgctattgtaagattatggattatgtgaattcatatatattgatttactttcagtagcttttcaatagaatatctagggtttaatacagcttagaaactaaagcaggaattattcatctttaaaatcctgaccaaagaagtggctggcaagatggctgaataggaacagctcaggtgcgcagcccctagtgagatcaacacagaaggtgggtgatttctgcatttccaactgcagtacccggctcatctcactgggactggttagacagtgggtgcagcccacagagggcgcagaagcacggtgggatgtcgcctcaccccggaagcacaaggggtcagggaattccctcccctagccaacagaagccgtgagggactgtgccctgaggaacggagcattccagcccagacactatgcttttcccacagcctccgcaacatgcagaccaggagattccctcgggtgcctacgccaccagggccctgggtttcaagcacaaaattgggcagctgtttgggcagacaccgagctagctgcaggcgtttttttcatatcccagcgtcacctggaacaccagcgagatagaaccattcactcccctggaaaggggactgaagtcagggagccaagtggtctagctcagtggatcccacccccaacggagcccagccagctaagatccactggcttgaaattctcgctgccagcacagcagtctgaagtggacctgggatactcaagcttagtgtggggaggggcacctgccattactgaagcttgagtaggcagttttcccctcacagtgtaaacaaagccgtcaagaagttctaactgggcggagctcaccgcagctcggcaaagccactgtagccagattgcctctctagattccttctctctgggcagggcatctctgaaagaaaggcagcagccccagtcaggggcttatagataaaactcccatctccctgggacagagcaccacggggaaggggcagctgtgggtgcagcatcagcagacttaaacgttcctgcctgctggctctgaagagagcagcagatctcccagcacagcactcgagctctgctaagggacagactgccttctcaagtggggtcctgacccccgtgcctcctgactgggagacacctcccagcaggggttgacagacaccctcatacaggagagctctggctggcatctggcaggtgcccctctgggatgaagcttccagaggaaggaacagacagcaatctttgctgttctgcagcttctgctggtgatactcaggcaaacagggtctggagtggacctccagcaaattccagcagacctgcagcagagggttcctgactgctagcatcaacatcaacaaaaaggacgtccacacaaaaaccccatctgaaggtcaccaacatcaaagaccaaaggtagataaatccacgaagatgaggaaaaaccagcacaaaaagcctgaaaattccaaaaaccggaacgcctcttctcctccaaatgatcacaactcctctccagcaagggaacaaaactggatggagaatgagtttgacgaattgacggaagtaggcttcagaaggtgggtaataacaaactcttacgagctaaaggagcgtgttctaacccaatgcaaggaagctaagaaccttaaaaaaaaggttagaggaattgctaactagaataaccagtttagagaggaacataaatgacctgaaggagctgagaaacacagcacgagaactttgtgaagcatacacaagtatcaatagccaaatcgaccaagcaaaagaaaggatatcagagactgaagatcaacttaatgaaataaagcatgaagagaagattactgaaaaaagaatgaaaaggaacaaacaaagccttcaagaaatatgggacgatgtgaaaagaccaaacctacatttgattggtgtacctgaaagtgatggggagaatggaaccaagttggaaaacactcttcaggttattatccaggagaacttccccaacctagcaagacaggccaacattcaaattcaggaaatatggagaacaccacaaagatactccttgagaagagcaacccaagacacataataatcggattcaccaaggttgaaatgaaggaaaaaatgttaagggcagccagagagaaaggtcaggctaccccaaaggaaagcccatcagactaacagcggatcatttggcagaaaccctacaagccagaagagagtgggggccaatattcaacattcttaaagaaaagaattttcaacccagaatttcatatccagccaaactaagcttcataagcaaagtagaaataaaatcctttacagacaagcaaatgctgagagattttgtcaccaccaggcctgccttacaagagcttctaatgaaggaagcactaaatatggaaaggaaaaactggtaccagccatggtaaaaacataacaaattgtaaagaccatcacactatgaagaaactgcatcaactaacgggcaaagtaaccagctagcatcataatgacaggatcaaattcacacataacaatattaaccttaaatgtaaacaggctaaatgccccaattaaaagacacagactggcaaattggataaagactcaagacccatcagtgtgctgtattcagaagacccacctcatgtgcagagacacacataggctcaaaataaagggatcgatgaatatttaccaagcagcaaatggaaagaaaaaaaaagcaggggttgcaatcctagtctcagacaaaacagactttaaaccaataaagatcaaaaaggacaaaaaaaatggtattacataatggtaaagtgatcaatgcaacaagaagagctaactatcctaaatatatatgcacccaatataggagcacccggattcataaagtaagttcttagagacctacaaagagacatagatgcccatacaataatagtgggagattttaacaccccactgtcaatattagacggatcaacgaaacagaaaattaacaaggatattcaggacttaaactcagctctggaccaagtggacttaatagacatctacagaactccccaccccaaatcaacagaatatacattattctcagcaccacatcacacttattataaaattgaccacataattggaagtaaaacactcctcagcaaatgcaaaaaaacagaaatcataagagtctctcagaccacagtacaatcaaattagaactcaggattaagaaactcactcaaaaccacacaactacatggaaactgagcaacctgctcctgaatgactgctggataaataaggaaattaaggcagaaatgaataagttctttcaaaccaatgagaataaatacacaacggaccagaatctctgggacacagctaaagcagtatttagagggaaatttacagcattaaaatccccacaggagaaagcaggaaatatctaaaattgacaccttaacatcacaattaaaagaagtagagaagcaagagcaaacaaattccaaagctagcagaagagaagaaataactacgatcagagcagaactgaaggagatagagacatgagaaatccttcaaaaaatcaatgaagccaggggctggttttttgaaaagattaacaaaatagatagactgctagccagactaataaagaagaaaagagagaagaatcagacagacacaagaaaaaatgataaaggggatattagctctcatcccacagaaatacaaactaccatcagagaatactataaacacctctacgcaaataaactagaaaatctagaagaaattgattaatttctggacacatacaccctcccaagactaaaccaggaagaaatcgaatccctgaatagaccaataacgagttctgaaattgaggcagtaattaatagcctaccaaccaaaaaaagcccaggaacagatggattcacagctgaattctaccagaggtacaaagaggagctggtaccattccttctgaaactattctaaacaataggaaaagagggactcctccctaactctttttatgaggccagcatcatcctgataccaaaacctggcagagacacaacagacaaagaaaatttcaggccaatatccctgatgaacatcaatgcgaaaatcctcaataaaatactggcaaaccgaatccagcagcacatgaaaaagcttatccagcatgatcaagttggcttcatccctgggatgccaggctggttcaacatacagaaatcaataaacataatccatcacttaaacagaaccaatgacaaaaaccacatgattatctcaatagaagcggaaaaggccttcaataaaattcaacaccccttcatgctaaaaactctcaataaattaggtactgatggaacgtatctcaaaataataagagctacttatgacaaacccacagccattatcatactgaatgggcaaaagctggaagcactccctttaaaaaccggcacaagacaaggatgccctctcccaccactcgtattcaacataatattggaagttttggccaggacaatcaggcaagggaaagaaataaagggtattcaaataggaagagaggaagtcagattgtctctgtttgcagctgacatgattgtatatttagaaaaccccatcgtctcaacccaaaatcttcttaagctgataagcaacttcagcaaagtctcaggatacaaaatcaatgtggaaaaatagtaagcattcctatacgccaataatagacaaagagagtgccaaatcatgagtgaattcccattcacaattgcttcaaagagaataaaatacctaggaatacaacttagaagggatgtgaaagacctcttcaaggagaactacaaaccactgctcaaggaaatgagagaggacaccacaaacaaatggaagaacattccatgctcatggataggaagaatcaatatcgtgaaaatggccatactgtccaaagtaatttatagattcaatgcagtctccatcaagctaccattgactttcttcacataattagaaaaactactttaaatttcatatggaaccaaaaaagagcccacatagccaagtcaatcctaagcaaaaagaacaaagctggaggcatcatgctacctgacttcaaactatactacaaggcttcagtaaccaaaacagtatggtattggtaccaaaacagatatatagaccaatggaacagaggcctcagaaataatgccacacatctacaaccatctgatctttgacaaacctgacaaaaacaagcaatggagaaaggattccctattcagtaaatggtgctgggtaaaccggctagccatctacagaaaactgaaactggaccccttccttacaccttatacaaaaattaactcaagacttaaacataaaacctaaaaccataaaaaccctagaagaaaacctaggcaataccattcaggatataggcatgggcaaagacttcacgactaaaacaccaaaagcaatggcaacaaaagccaaaattgacaaatggaatctaattaaactaaagagcttctgcacagcaaaagaaactatcatcagagtgaacaagcaacctacagaatgggagaaaatgtttgccatctattcatctgacaaagggctgatatccagaatctacaaggaacttaaacaaatttacaagaaaaaacctaatcaaaaattgggcaaaggatatgaacagacacttctcaaagtaagacatttatgcggccaacaaacatgaaaaaaagctcatcatcactggtgattagagaaatgcaaatcaaaacacaccagttacaatggcgatcattaaaaagtcaggaaacatcaggtgctggggaagatgtggagaaataggtgtgcttttacactgttggtgggagtgtaaattagttcaaccattgtggaagacagtgtggcaattcctcaaggatctagaaccagaagtaccatttgatccagcaatcccattactggttatatacccaaaggattataaatcattctactataaagacacatgcacatgtatgtttgttgcagcactgttcacaatagcaaagacttggaaccaacccaaatgctcatcaatgatagactggataaagaaaacgtggcacagatacaccatggaatactatgcagccataagaaaggatgagttcatgtccttggcagggacatggatgaagctggaagccatcaatctcagcaaactaacacaggaacagaaaaccaggcaccgcatgttctcactcgtaagtgggagttgaacaacgagagcccatggacacagggacgggaacatcacacaccggggcctgtcgaggggtgggaggttaggggagggatagcagtaagagaaatacctaatgtagatgacaggttgatgggtgcagcaaaccaccatggcatgtgtatacctatgtaacaaacctgcacgttctgcacatgtatcccagaacttaaagtataataataataaaaaaaaaatcctgaccaaattatttattcaatgtgaaattaattgtaagttagtgttgccaggagagcttattacttagttaccatgtattccctctcatctcctgctttgtttataaagctaaaagcaaattacttaggacagcaatgtcaaatcactttctttccccaaagcatctgattttagatagcgctgtgtgtgttttaaaagcccctacctcgacttaggcaaacagaaccttcgtttaccatgctattcccatcccgcctttgaaacttctgaaaaggcagagcggagtaattgtttcagacatctgcttagcatactttgaagtgcatataagttctttttcagtttcatttgaaccccagctgtcttcaccgaagtctataatcaatctgaattaagttgtcctacttctcctaataagtctcttattaagttctgcatcagcctcttagggagacttaaaagctaattcatgtagaattgccattttctactaattcacttgtcagctctccaaattccaacaaaaacaattgcaaagactattaatttggctcttcataaacaacttatgtaagtgtagtatacattggaaccaaacaaacgatttaaaacagtgggtgggaggaaatgagttgatggcattcaaaacgcttccttttttgactgttatgaaatgccttccacatcgaaagcataaagccatttatttaataagggaaacatccttctgcttttactttcatagatgagataatgactgaatgaactttgcttaaagacaggaaaaggctttagaacagttggaaaaggaacatgttctttttgtcattgaacttattttaatttggacttctttgtgttattttgatggactgtgataaaagaaggagctagaattggttattattgttattggattaaatcagagttgtacagctactcttctggtcatgggatatttaggagaacacgggtaatcaaaatgttcagctaatgagttcatctgattctactcaagaagtgtttaatcagataataaaaatttctccaaataataccatccttcctactatttgaaaacaaccatatcaacatctgatcctataatatgccaatcctgtttgctaggattttctgaaagctttgtttgtggtgggtaataactagaaatactattcctcaagagtctcgggtaataaaagattattcaaaaaacttaagtaatatactctcagtattagaggatatacaaatgcactcattcattaattcatgatatgattgaaacctatacccagagaagtctgatctcattatagagtgtgaacatttaatttatttcaaaaacaaaaattatattgagagttgtatagatggcatcttagttttcctgggaatattattatttagcaccaagctgagggagcaagaatttgtattagcttgtgtatacatgtgcatgtaccacattaactagaaacagtgctaaaatgtgagttatttatttaactgaaattccatatttcctaagaaaatggaatcacacagccaatatatatttttaattattttttgacatctaccaaagttgtgacaagaataaagttcacaattctgttactctcctaccgttcagtaaaacaggaaatgctttaagatcaaataacccaaggagttcgcttcttcctgtcatgcttgacaattacaattttcaaaatttaacagttagcattgacaccagtattatgccttacacaacctgaaattaactaagttaagtaatggcattgaataatttttcttggtaaatcagttttctgggtattatgggaacagttgtgtctgtgatactaatgtctctctcattttaatggggcctaagaaagaactttttcataataagattttttcatgttaaaataatatttttagttatagtttacacttactgcaggtttttctatttaaaagcatcttccgagagcagtgattcttaaacttatttacttcagttatcttaacagcatagaagacatagcctgacatctcccgcttccacttacctatctcctttttccatgagcatgaaatttctttgatgttcttgttttattttttaaatctcacatcaattttatggtattttccataatggattcatcatgttttaatatgaagatgctttttcttcaaattctgaagtaaggaatctttcagcacattcacctatggacatgaaagcgtaagttgagaatcacagtataaaggattgcccagtttttgcaggctttatctttttccatcaacttctgtcttttatgtacacagacaaaaagagcagacccttgctatttcaaatttatcttttgcaggttcatctgattattgtgatccaaagttccatgactagcagctcttaattttgaacatgtattatttcaagcttttgtgcatagtcacttaactaatgagttaaatggcattttaagtcaggttccatgaacgcagaccctgagaacaggggtctaggtgcctgtgatttatagagggtctgctctcaggagaagcctgtattggagttagggaaacaatacaggagaagaaagagcccagcaagtatgccatttcaggtgaaacctcacattgtgtctgatccagagagagagcaagccctcgagcagaaacctcgctgtggagttgtactctttattttattttatttttttgagatggagtttcgctcttgttgcccaggctggagtgcaatctcagctcactgcaacctccgcctcccaggttcaagtgattctcctgcctcagcctcctgagtagctgggattacaggcatgcaccgccacgcctggctaatttttgtgtttttagtagagatggggtttcaccatgttagtcaggctggtcttgaactcctgacctcaggtgatctgcccacctcagcctcccaaagtgctgggattacaggcgtaagccacaacaccgagccggagttgtgcctttataccagtcattgtctgtgtcactgaagtgctggcaaatatttgtcgactagctctgaggtgggatgaatcctggtgtgtatcaaaaccagttttcgtggtgtaaatactccctctaccactgatctccagctaccgacataatgccactgagtatggaattgggaggagatgcacacaattggctcttgggctctgctgcagcacaccactggctgtggtccactcctgggatatgggttacttcctgggctagggggctcccataagcagaggtcacatgtggagaaggcaggtagctataagacattaatagtcaaccatcacagcagctgaaggatggatgcccaggttaggtaaagtgtcccctgcaactaataagtaaacctagtaatccactcactcttcatattcaacttggctttttttaatgctgttttgtttttgcatgtacagtaattctttataaataatgagaattttgtttctttatggaaaatccacctaccctccaccctaccatgaatagcttgatagctgttcatcagaattagtgatggaagagaagagttaatgaatgaaaaagtctaagaaagtgatcactattagtaagaaaatggcctcataagtgagtttggctttatagttatggaatctgtaaatgtctaggcattcagacatgtccagacatcattgagaatgtcaagaattttcagtggcaatggttctcacctcagcatacatcagaatcacctggagggcttgtagaaactcaggttggtgaaccccttccccagagttcctgattcaaaatgtctggggcaaggctaagaagtcccaacttgttcccaggtgttcatgatgctgctggttcagagatacattctgagaaccaatattccatagtaaagctactgtgtatgtacctgaagacatattttgtgtagtgttagcgtttcttcaattacaagtaataaatatatcatttattatttcttttatatttatcaatatccagaagatttagtttaaaaatgaatgcaggcacacagcctcttgttggattgattaatagtttagatatgggagcatcatagggagcattgtttcgcttaggaaccttgaaatgaataaatggcttcttttctaaatctcacttgtggaagactttgacggtggtttatttcattttttcctgttggtattttaatgacactggtacaattttggggttgcttcagatgaccaacagcataacttgccttcccagtattaatttttaacgttaaaaatatttagtcatggccggccgtggtggctcacgcctgtaatcccagcactttgggaggccgaggtgggtgggttgcatgagctcaggagtttaagaccagcctggacaacatagtgaaacctcgtttggacaaaaaatacaaaaattaaccaggtgtggtggcatgtgtctgtagtcccagctacccgaaaggctggggcaggaggactgtttgagcacaggaggttgaggctgcagtgtgccctgttcactccactgtactccaggctgagtgacaaagcaagaccttgtctcaaactatatatatatttagtcacataacttttcactttgtgtaaatattttttgcatttaccaataaaaacaattacatttaaaaattctccttacacttttctaccaaacatactgatgataaaatagtactttatagagtttctgaatctaggatattaaaaatagttgggatcagtcaacactttttaagtaaaatctacttgctagatatgaatagctaacagcttctccaggagtgcctacattttataacttactttgtccaccccttgaggctctgtgttcagggggagggtatatttttgtgtatagaaatagagatgaggtgaaatagagatgaaatagagatgatgtgggatcaactgggagaaagtagaaaagagtcttagctgaagtggttgaggaaggaggatttttcccaaaatggtgcaaaaaacaatgtattaaatatctgtgaaaaagttcatggttgtggtatagggtgagtggtatatgaaaagagaattatgggataaactaatggaaacagatgtcttaaaatttgcttttaactttaaacaagagacatgaaacttaaacttttcccttatcctagaatctgggagaggagaaggatgagaaaaaatgaaattttacattagaagcaatttgattaatgttcaatggaaaatggaaatagctatggtcaaacccactcaaatcaagtgtacattaaataattgagttaactgaattaggcagagtaagggcacattgattttcagtgttgttgaaaattggtccacatatcattgttatgctttttgtttgtaaacctcaatatttattaagtttccacagtgtgctcagccctgaaacgccaaattctcttaaccagaatgaggctggaggatctaacactaagacagatttctattttcttttaaggaattgatttttatggtaattttttttcttcataaagttaagaacctgccagtcctgtttcgaaacacacttatttttagaagtttggttttccgggattatgcatcattatagactcaaatgactcatttagaacttttccctatcaaatattcacattctatcatcatgatcttaacacggcataagcaagttagtgaacagagtgaagtcaatttattggcaatatatgccgaagtacaggaattaagtagaaacaaaagtgaatgagagtctttggcaatacattgatgtgttttttttagaaccaatgataaactactgctgagtttcctttcatttacttttttcctactcttaaaacattgtaacccattttgagatctatccattgttgtgaacctaaagcctattaggtcttattaaataatacccatttaactgacctgtgatttaagtttcttatctgcccccaagcaagcagactgtatgcaacggcattttacctgcttcaccttctgcttgccagttggtttttggtcttcacatgtttctagcagggatggggctaaagcaagggagagaatggtccattgttttagactttcacaaacccaatatactagaatctccacaaaggttatccaatatcagggtgacttttgtgcatccaataaagcataaggttaaaagaaatacaggctaaacaaatgagcataaattactccgttggcttatgctgtgaataaaatattacctttggaaccatctcaattttttttttgtataaaggttgaaggaagacatttgcaaagtcgtttctcctataaaactgcctagggtttggggttgattgttgtatgcaagaggggtcttggtgaaatctgacccactttgaatctaaaattactgaattattagtgaaaagattattttaaaaagagttttgaactctttttcctactgaaattgtattctcctttagataatcaatgcagcatcacccccacagatttttgagggcactaaatcatactcctattttgaaaaagaaaaaagtctattactattaaatatatctgttagttgaatatcaatcactttttctaaagggtagatttggccaatgagtgatttttttttttttttttttttggaaatcacatctgagaacgttgtttagacagcttgacacttagactcatttgtgtaagtagtaatttattcatcatttgcatgtacttaactggacattatcatgatagcagttgtcataacagactattacaggatatgaatttagatattaccttaagatgtgatcataaaaatcagaataatatcttgaaaatatcaattttatggtgagaaaaatgacaaactgaataaactcttgactcaagaagctagacttttcacaacctcatgtattcacagaagtaaaaataacaactaataatgtgtccagagggcccacattgctcagaaatgaatacataagactttcttttcagcctcagaatatgatgaaaagaagatgaaccattatgatgttgcatagattttaatgaagaaaattcgttttctgttcctttcgtttgactttaagtagttgaacatcctgcttttttattttgtttgcaagaaataagaccattttagaaaggctaaaaacattaattacatttaggaactacaataatctgaaagtaaaattggatattaaaggacgtttttgcaatcctttttagccctcttctgtgtattatttttatcactgctcttaaaaatttgtattaatctttggttcatttctgccttagtatttctaagttaataatatattgaatgaaaaatcaaatcagtaaaaatccattttgtttcagtagtgagtgccttccccctagaaccaaaactaaataaatgtgctccatataaagcaaaccaggtacagcatattgcacgggtaactcacaattctagattcctctattaatcattattcagacatgcagaggtagcttaatttgctttaataagtgaaaacagaatctctttgagactgctatctgcaatattatactttgtcctgcattttcttggtcaaaaattgtattttatagccatgatatattttggcttggaatttgcttctttataagcctagttattaatagtcatcatttaaatgaaatgatatccattagccttaagctgcatgattacagagacttggtctatcttacgctgtatttccagtgcctagaacattccctggcatataataggtacccaataatagtttttggaataaatgaataaacaaatttgtgcaaaagcatagggcaaaatgctatcttttagatagcgtgacccttaaaaattattttgcaaataatttgctccatttgccaccagcttatttctggccattgttacttcttgtctctgcatacaaacactctgtgtctcttctcctttccacaatgaccacaagttatactgatctacttgagattttccaggtgactatttcatgtccagaggaacatgcctcttctagtgttcccctctgtgaatgatttcagtcaccttatctactcaggaggtctctcttcccctccatcagcatctttctctgcaccttccaaacccctatgactcaacttctcataatatggattgcattttttttaatgacccattaaattgtgtacctctgctaatgattgtgagtgtgttgagacttccatttttccagtggatgataggtatataatatatatatatatacacacacacacacacacacacacacacacacacacacacatatatgtgggcacagtatctagtggatataaagtaagtgttttcaagtgagtagtaattaaatctaagagttgccgagaaaatgccattcccgttttgtggacatcttcattctacattgtaaaggccacctcattcaagacccaccacaatcttgatcccagaaaacacccatgattcatcttttacagctgccctgtacttcatattttaagttattaaaggctatttgcttttcctcagacacacattaaactttcctacctcttaccctttgttcaagttctgaacacatatctttcttccccacactatgcttcctctttatcagtttcatgtacctactttccaatgtctagttcgaggagacgtttataaggctacatgatagaggttgcccctggggcgatgtgagaaatcagctccaaaaaggtagctacccggcaaaggatcttagtctgtgactctctcatggatgaacttattacctactgctttgcagagtctccctggactagcctgaataggaacttgtgtgactatatgtgaactaaaagaaggagaaatatgcctaaacttctcatccatctttgtaacagccctaaagtatgcatgttactatcccttttctacacaagtggaaaatatttgtaaatgaacttcgttacagtctaatatttgatgacttcttagttcatatcattatttaagtaacttttctttagtggaaaagcccaaaaattagggaggcagggagagagagagagagagagagagggatcatctgtaatctcagccccagcatctataatcccaatccctgcaagggcctctttgggcaaagaagaaaaaggcactgtgtttttgaagagatccccggtcctatgccaagcctaaccaatttggtagtagagcccaggctggatttcagttggtttgtagtcttctagtcttttcatatgtaaatatttttaatgcttttattcagtgttgttaaaatgccctccaaaagatgcactaacttgtgccaccaccaccaagcagaatatattttccttgaataggctacttcctctttttttcccactcactccatttttattttaaaaatccctggtagagaccaaaaactgaaatgttatattcttgcccaaagaatgagagatgcttcagaaattagcaaatgctccaatataaatcaagtgatagatataaataattcagatatgggataaggaaaatgggtagctttctcttatttaggaactctatgtcaggtttctgtgagaaactgtttacgaagcagtctgacaatagctattggtctgaagtattagtaattagtacagaagtgcctaattctcttgactgcttgttctttaataaaaatgtattgagggattatcatgtactatggcttggcatatactggtgaaaaacaataatgtaggattgccttaataaattttctggtcttgggaaggaacagacaatgaataaatgaataggcaaatatatatgtacttgcaaattgtgatcagggttcagaaggaaaatagggtgttgagagtcaaggaaaaaggagacactttacgtagggcaaccaactgggaataggctatctttaaaagtcacatctaactgagatcagaagtatatgaataagagccagctaggcataaagtggatatataaaactccaagcagagggaacagtgtatctgaaggttctaagtcaagagtaagcttgggccaggcacggtggctcatgcttgtaatcccaacactttgggaggccgaagtgggaggatcacttgagcccaggagtttgagaccagcctggaaaacatagagagatcccatctcgcaaaaaaaaaaaaaaaaaagaaaaagaaaaaactaacttaaaaatatatatatatcaatgccagtggtgtgtgcttgtagtcctggctaacttgggaggctgaagcaggaggatcgcttgagcccaggagtttgaggctgcagtgagctatgatcgcactgctgcactccagcctgggcgacagaaagaggccctgtctgaaaaataaaataaaaataaataaagaaataaaaagcttgatgagttctaggaactcaacattttctaacttcttattagaaatgccaaattctcaggcccaccttacacccactgaatcaaaagcactaagtgggactcagcagtctctgtgttaacaagccttccacatgacaatgagatgcacactattgtgtgagaatcactgccttagactgatgttttgagctatttaggggagggagagggcccattcagggacaatggtggttaacacatgtggctcagaccaagaaatgattgcaagcccaaaaacttgttaaatgtaaaacttcaggcgcagtggctcacgcctgtaatcccagcactttgggaggccgaggcgggtggatcatctgatgtcaggagttcaagaccagcctggccaacaaggtgaaacccagtctctagtaaaaatagaaaaattagccaggcatggtggtggtgtgcgcctgtaatcccagctacttgggaggttgaagcaggagaatcgcttgaacccacgaggcggaggttgcagtgagcccagatcgcaccattgcactccagccggggcgacaagagcaaaactctatctcaaaaaaaaagtaaaacttcatctgtctgaagtaacttctgaatttgaagataaacatcctcatggttgatattttaatggtttatggattattacttacttttaaggaagttaataggtttcattaactgccattttgcttcattttgtcacatataattaaaatttttcagacagaaaatattggtattttttctgtttccttagcaacctaaagcatgacctgcttaaatgacttatttgtgctcattaaaagcctttttgtgttaattgtgtatattttgtatttagcctctgtgaaacactcatgaactatctttttatttgttttaattgtgtcattggaaagcttgaagtattttgtggtttttttttttttttttttttttttgcttgttttttgtctataaaggggagataactggcagttgcagttaggattatagaaacattttcccaaggaaattaataaaatttgttcaagtttcttcttttacaaattgtacttatttttgattttttaaatagtggtaaaatacaaattacatgaagtttactatcttggctctatttaaatgtatacttccatggcattacatacatttacgttgttctgctgccatcaccaccatccatctccagaactcttctcatcttgcaaaactgaaactctatgtctattcaacgataatccccaccaggcatggtggctcacacctgtaatctcaacactttgggaggccaaggcaggcggatcacctgaggccaggagttcgagaccagcctggccaacatggtaaaaccccatctctactaaaaatacaaaaattagctgggcgtggtggtgcacacctgtaatcccagctacttgggaggctgaggcagcagaattgcttgaacctgggaggcggaggttgcagtgagctgagatcgagatcacaccactgcactccagcctgggcaacagagcgagactccatctcaaaaggaacaaaaaagaaaaaaccacagtaattccccattgcttcctgcccccagcccctggaaaccaccattctatttcctgtctataaatctgaatactcatttctatatcttctttggagaaatgtctattcaggttacttgctcattttttagtcaggtgatttgttttcttgctattgagttgtaggagttccttgtgtattttgaatactgaccccttaccgggtgtatggtttgcaaaatatcaattgctcctgctatgttcaacttgttcttaaaaataaaaacttttcctttgtggtcaatacttccctgttcctcatttccaaattttatacatgaaggaaatgtgagcacccagaaaagaaagaagatagacactgttaatatggccaagatataattcggcttttattataagaacattggagttacaagcttcatagaaagccatgtcctaaaagatgaagaattatgatcagtgcaaagagaaaatgttaaaaagaaaaagttatccttttatgtttgggtatatattctttttcgatattgtaaagagaaactagagttttttgttcttgtttttgagacagagttttgctcttgttgcccaggctggagtgcaatgttgcaatctcagctcactgcaacctccacctcccgggttcaagcaattctcctgcctcagcctccagagtggctgggattacaggtgtgcaccaccatgcccggctaatttttctgtttttagtagagacagggtttcactgtgttggccaggctcgtctgtaactcctgacctcaggtgatccacccacctcagcctcccaaagtgctaggattacaggcgtgagccaccgcacctggttgagattgttttttataaaaagatgtggattctttatggaaaacacagagcagttaattgctatttttttaatgtcacaaatttggaagcgtgttgagtctgagaagaaaccatagttaaaatataattactgataatcgcttgggaaataaaagccctaaatttcttcatgcctacaaacttaatattgttttcccaagatcttttttttgactttaacctttcttaagtgtttctgattatgctaaatctaggccattagttctgagtctgtttcattatttatattgttattcagtttactcgtcaaaagtgatcatgcccaaatatgaaagtttacaagaattgccctgaaaactgaacggaaggagacaacgaaaagaaactgcataatattttgccttcaggctatcacaataaaaactgttgctggaaaaaaatgcaatcacatcccttttttttttttaaagtacgtttcaatggcataatttattgtcgagaatgtctctaccagaagcataagtgatactaaaggcagagggttgtattcgctcagtctgcaaagtatcccctttgtcttagctccacacagtccctcagaatttggcagaaatgagggactcaactttcgagaaagggtgacaatcccagttttgttggagagctatgaaatagccccatagtgttagtaatgaaaattcacttaagaagtctcctgcaggcccggcacggtggctcaggcctgtaatcccagcactttgggaggcctacgtgggtggatcacctgaggtcaagagttcaagaccagcctggccaacatggtgaaaccccatctcttctaaaaatacaaaattagccaggcgtggtggcgggcacctgtaatcccagctactcaggaggctgaggcaggagaatcacttgaacccaggaggtagaagttgcagtgagccgagatcgtgccattgtactccagcctgggcagcaagagtgaaactccaccttggaaaaaaaaaaaaaaaaaggaaagaaaggaaggaaaggaaggaaggaaggaaggaaagaaaaaagagaaagaagtctcttgaaaaaaagaaaggaagaaagaaagaaagaaagaagtctcctgtataaaaaaaggaaagaaagaaaagaaggaaggaaggaagaaaagaaaagaaaagtctcctgaaaaaaaaaaaaaaacaaaatataagtgcttgacaactgaagttcaagggtaaaggctattgggaaagcagatgaagttaatctaagtaatggatgctgttggtgccccagtcagattcgttcactgggttggtgcacccattcctcagtgactctgagtattagctgctaaagcctcatggtttcacccctttccagagaacctccctcagccaaaaggaagccaccttgactggcatgtcccaccacaccttctctcttaaaaccaccaggggtacaaagggaaaacccctttgcctcatcatggcacctgctgttgtacaatttgtgatctgggaattcccatggggccagattgatgctggtctccagcccataccacatcccaacttaactttcttgccctgtcttcctgcttctctcactccctttttcttaagagcactcagactctgcttctcttaaacctggctgaaggcagtaggtatctgaaagaaaagctgtacctacattctgggcatcagagcagtcagggaaccaaccagaatgaaaagtcaaaaattacagataatgatggaagtctctgagcctgatacatttcatgaagggcttgcttacagctcaacttgtgtttctttttaattgtttcaacagcatttgagtagctcattccgcccaggtatttgagagattccagtaggcctctgatcctctggaaaaagcaagatacagtccttgactctcttggccccatgaggatgatatatctgctgagaaatgcaggagctgcaaaacatagctgggctgtacctgctgccaattcccgggtaattgcattctgtgagggcttccctgaaccacgaggaagagccccggaataagtactaaacaccagtatttataggacatgatttctaattgctcatccttgccttctcatgactagctcagcatgaagaatgctgggacttttctttcctagcacctcctctttttaggctgttttccaagagtcttggttaacaaacatttgtttgacaaggattcatggtagacagcaatgccattagtccctacttaagtaatatttgtaacataaatttctctgcacgtgtatgtagcccaagaataacacttcatttttggaacctagtaattttgaattcctagtaagtgagataggacgtctatgagttagcaggttaagattttaggaggaatatttaatatccctaagaagggaagtttttcaaacactgagtagcactatatatatttatatatatatagccagatttctatctatctatctatctatatatatatatatatatatatatatatatatatcacaccatttataaataaactcataagtggcaaatccagtagagctaatctgagcatcccagagtctcccctctctgtcgcttgtttgtgcagctactcctgctgtggccttttatggattatcctggacttctacaactgacccctctactttctctccatctacaagcttcattttgctttgctttcctcctaatccagtttagattccacagtatattttttcaattacatcctggctaatatcgaaactcccttatccctaaatgtgtgagccacagtcatctgacgaaaccccaaacctggatcaactgttttccccatgcttacatgcaacactgttggagaaaatgagaaagtcaggcagattggttctgctaaaaaatgttgaacctcatcctcaagtgggccctcaacactgtttgccaacctcattacatctcttaggtcaactccctctcacagtctctattacgattaattcaaatgttcccacttacccttaattcatgttttcattcagtgactattcattgcacaccaggcactgcacgctatgccaggcactgcagactatgccaggtctgttgattcctacttcacagaggaaataaaacccctccaagcagaattccctcaatttactctttctagtctttccaactgaccttctgtgctttgcagtaggaatgttctcttaactgtcaagtcaaaattcctccctcaaaaataagattcccttgttaatagacaattcctttattttcttagaaaagtagtagatgactataattttaaatgtgtatttgaacaaatccttagctacataaagataagcaaagatatgacaggcaatttaattttatatgaagaaaaacttattatatcagacttacctatcattctaaatcagtacttttgtatctataatcagacaacatttaatgaactgaaaattctgcctgtgagaaactagtcataataaaattagacttggtttgctctttcatggagaacatattccagatgtttaagtgattcaaagaaaacccacaatataatggctttcttcaatgttttctcacttactgcttccaaactagaaaaaaaacctaatgcaatcctgatatcacttaaatagcacctcgtattgctcagcgttaactgtgctttttgacattttaggtgtagtgtttaataatttaaacacaaatttatgtgtgtcatattaaaagctctaatctgtgaaatatagccaaaccaatgtcacatctatttaaatagcaaagtacctgtgttcaccctttacagggtgaaggtcttgtgactctgtgtttaggcggccatacttcttgttatgtatgctgctgggcactgagagcccacagtggtgagccatccttgggtggtaaaagctgctaccaaaacctaaatcaaatgccaaagtgaagactgacatgagcattctcctgcctccttttcctttttatctttcctaccatctgttatctcctttcttccaccttcatgcgttgagtgccctcatgatgatttctagctgactgaagtcctttagtctgctcaaccccatctagagacttccccaaagtgaacctttgcccccagttatctgtttatcaactgacctcacaccagtcaaagcttccattgtcaaatattttaacagaaatttaggaattcagattaaactgaatatttggcattttttcttttttttttttttttttttttggagacagagtcttgctgggtcacccaggctggagtgagtgcagtggtgccatcttggctcactgcaacctccacctcccaggttcaagcgcttctcatgcctcagccccctgagtagctggtactacaggcatgtgccaccacgcccgaataatttttgtatctttagtagagacagggtttcaccatgttggccagtctggtctcgaactgctgacctcaagtgatccacccatccacccacctcagcctcccaaagtgctgggattacagtcttgagccaccccacctggtctgggttgttttcttcatctttagcagttgtcttgttcacaactacttcaacaatatttattttctttttctttttgaagcaactctccagagtatttggcctggtttttatagaaataataacttttttcttttctttttaaactaatatttttatgatttaggaaatctttctttattaaattacataatcacaacagttactggcaaagataggtttgagaacatacacacaactgacggttgtaacaagtcaactgatgggagcagaaggtccacacatactgacaggcacctcgaacattttattgaggctgtgagaggttcccatcactgctgtttcacaaagagaatgaagactttggctaatttggtgagtcttaagtggagattagttcagagaacttccactatcattgcttgaaagaagcaaaaaaaaaaaaaaaaaaaaaaaaaatcccaagatcttatggtaaagtttaaagaagaaaagtaaattttaaaaagaaaaaaaaagaggaaaagggagagcattgcaattaattatgagtaccaaaacttatttttgaatccccttcatcctccaaaacattgaagcaggattaatatgtgtgctcaggaatttgggagagaaaatgaaaatcaaaatattctaataagagacatttgaaaatgtacattgtgtcacctaaagggaactgaaatctagctatggcttaacgaggtaggataatcaacttaatggcttgagagtcttgcttgtaaagagagatgattagcacaaaggactcacctgtatcactgaaagatgctgcctgctggcttgccctctctgcagaggttcctgtttacagtttcccctcacatgatatttatttgtggctactagaaatgcacgttattatccagaagagaatgatttcattttgtaaccgttgtccttgtccaagtttcccccattgacatttaagaaatctgttttctaacctttctattatgcaaaacaaaattaatatggatcatttccttttagagataagtattcatatatatggatttaaaccacctttctccatgggcccttattctgatacttttaatccatgtatttattcataaggaaatggaacaatatttactatccacccctataaaactttctgaatttcacactgattccagtgacattccactaacacgaagttgaatacagatgaatacatcacatatgattttttttttgcatgtgtatggtcagaaggggctctcttttgtttgtttttattaatatataattcacatactttaaaattcactctttcaaagtgtacaattcagtggtgtttagtatattcacaagattgtgccaccatcaccattgtttaataccagaacattttcgttatcgtccaaaagaaaccccctgattgcttaacgtaatgtttttaatgaccactttttaaaactttaagttcaacagagtgattatcacaatgttttgtattatctaagaactacacaacagtgttatgctctatacagcaccacggtttactgatgaagtattcaggttgatttgagaggataatgtcgttcttattttgaatgttcatactggctccttttatttggagtgggaggaaatgcaaggcttataaatgaggtcagtgtaaccaatggttttatcaacatagtgaaccagacagagaaataacacctgcccagatcaagcaagtcaaaacaacacgtatagtcaagtggtgctgtccttgtacacagacattacattacacaaactgttctcctaagtgagggaatttgtcccttagaaattgcttattggaacatttggacatcatgcatcatgttaaagatccataaatgccatctcgatagggtagatatgaggcgtggtaatatcctccccatatctgcatagggttcttctgctcaacggattgctatgatgtattgcatcagagactcctgctctagtgcttcaaagacagctgagaagccccacgggagccttctgaagtcattgctacaagggctaaaataccaggagatcaggaagtcattctgaggacttgacaaaataccctactccctaaatgaaactgttatgatgtggttggtgcaaagtatgcatgcaatattttatgactgaatatatctttctattgtaaaaaataaggatccatttctggttgtgacatgagtagaatttagaatccagcagcaatatatttttcttgttactttgccaatccagaatttcttaggggaagcatataacataatagttaagaatatatattctagaggcaggcaaacctgcatataggtatcccaggttcctcaatttttacccatgagagcttggcaaggtttgtttgttttgaaaacaaacctctgcaagtttgttttctcatgtataaaattagaattctccaactactggcctcataggattgttgggtagaaataaaatcagtttatgtatgaatagagctcatcatggcattaggcacctaggaagtgctcaacaaatagtagttatcattattcccccattaacaaatatccattgttataatactaccacaagagactgtcttagtctgttccagctgctataatagaaatgccataaattggatagcttgtgaaacaacaaaaacttatttctcactgttctggaggttgagaagtccaagatcaaaataccagcagatttggtgtctggggaaggcccattcctcatacaaagcaccttctcactgcaccctcacatgctgaaaggagctagctagctctctgaggtctcttttataagggcgctaatcccaaaaatcacctccctaaaggccccatctcctaataccattgccttaggtgttttgatttcgtttcctttttattttttaggatttcaacataggaatttgaggggggacacaaacattcaaaccgtagcatagagcaaacattactggcactgcaccctaaagagaataagcccaggtatcagttcttcttgttttaaatattctcatcttccaatttgcttttgactattgcacacaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtaagcacattgtaaacattgttgtcctttgttacagtaaaataatatacagataaaatttgtaaagaacaatgaaagtacttttttcatgtaatgttcatggtaatatttgtgaggataggatattttatattagtttataattcccatctaaacattttcaaattattaatattaattttggaagcaactaagacttagtatatgtcttagtctgtttagtgttgctataaaagaatacttggggctgggtaattcataaagaacaggtgtttatttggctcagttctgcaggctgtacaagaagcatctgcttctggcgagggcgtcaggctgcttccactcatggcagaaggcaaaggggagctggtgtacaaagatcacacggcaagagaggaggagaaaaagagggaggggaggtgccagttctcatgaaaactgctagagcaaaacctcgctcactaccgtgagaatggcaccaaaccattcatgagggattcactcctacaacccagacaccttccactaggcctcaccaccaacacgggggatcagatttcaacacgcgagttagagggaacatccaaactctgtgtagcagtattcttacgataaacagaaaataatgctgaatcatgatggaagatgtgaattgccaccatgcagttcctttgtactcttactgcttggattctcaaaaacatctttccctttagaatcctaatttaaacaagagtcaatagtaagatgtgtccaaaagtcatttaaagaaagagcatcctatcacaaacttacatgtggaagtttttcgtaggtttgcgtaataaatacaggcaatgtaagtgtgctgctcaaggtcacacttactagccatgggacctggagcaaattacttaacctttctgagcctcagtctttcatcaaaaaaaaaaaaatgcgataataaaattctctgcaatatcagtttattattaggatgaataagtcaaaataaatggaaagtgctcgggagcgaacatgccaaatgataaacactctacaaattctagctcttgatgttgttattattattattattacagtacacaggttttggaatccaacatattagctgagtgaccttgaggccacttaatctctgtggttgtccatttactcatctctaacatggttactgtaacatcgaatgagttaattcatgcagagtaatggttgtagtggtggaagaggtgcgtctaccttctcagtgtgaaggacaccatgttataccccaaaaccctaaaattagtttaaccgtagaattagagaatcattttctctcctttccaattttctcctttccaacaggatgcagaaggtatgcctctgaggaaactgggtttaaaactatttggttttaactttttaataagaaaaatataataaaccaaatcactttcctattgtcagtccatttaggggtgtgattgagaggcctgttaaagaattgctagatctttaataaagataagttgcaaatcccagacctcttgagatctcacataatttaattcttgttgtgatggatagtcctgaaagatttgtattctagattgttataagtggcatcgactaaagcaaggcgatatagctaagtgattatatgcctttctctgtttgctccatagtagttgagtactattaaaattttatctgttccatccttagtatgtttttcatcttaagtataaataaggaaagtaataaatgtccaaagaaaaccaatggccacattagtcccatataagtgttctagaagtatattttataatttcttttagagagcagaatgccacgtttgctttcagaacgtggtaaaagatttgtgacagtggcaggtagatttccaaatgaggtcaaaggattatgactagtaagaaaagtttttttttttttaatcaatgctaagtgatccattctagttgcactatttatttgcatttaaggtatcaaaaacagtaaatagcttactatgtagccattctttacaatgagtaaaaacttggttataagtacaggaaaacacatgtaaggagatagtatgatatagcgaaaagagcattggattgactattaggaggtctaacttcaaacttaagctcagccattatttgaccgtgttattgtgagaaagccatttaacctctctcagctttaattctcctcatttttaaaatgcagaaatctattttgtctaaggtcacatacagttcaatcttatgattctgtctctagatatctgggggagatacacatttgacagaatttagtttaaaaccaatgaagttcctttctttattcataatacaaatgtggtttgttgaaattatatttctccttgtataactctaacttttaatctcttcttccctaaacccacatatacacagccttctcctattaaacagttcagtttgtggtgtctgctctatattgtagcaaatttcatgtttctatttttgaacatgaccttaaagatatgcttaaaaagtgtttttagcagaaagctgataaatccaaggttttggtttgcatataaccgagtcaagttagttccattcttttctttgatagtaattctgctacattataaatgtgaggccttgttcagaaagagaagaaagcaagaaatgaggttcacatcaagcaatttttttcccattactggaaaagcaattcatacatcctgttgagaatattttatatttagaacaatgtatgtgaggctaacgcattatccaagttctatggcgggaagcttgagcccaccaccattatgacatcatatttttttaaatagtaaatgtcaaaaaagacatatttctatgaaaataaagaatttagtcacaatgctatgtcaatctttaaatcgtgataaaaaccaagtacaagttcatctttgcctctgtccactaagacaaagaacaatcaaaaagtaaagaactctctgggcatggtggctcacgcctgtaatcccagcactttgggaggccgaggcaggcggatcacttgaggtcaggagtttgacaccagcctgaccagcatggtgaaacctcatctctactaaaaatacaaaacttacctgggtgtggtggtgcgtgcctgtaatcctagctactctggaggctgaggcaggagaattgcttgaaaccaggaggcagaggttgcagtgagctgagatcgtgccactgcactccagcctgggcgacagagccagactcggtctcaaaaataaaataaaataaaataaaaatagagaactggagtagtagaaaggcagatgtaaacctgagaaaagaagaagagtcttaaatttgggcaaaatagtataatagaaagattagagttacatactatcaggccgtgtctacttgatatcagaatatcctgggttctttgcattatccattcatttaattttcaaggaaagccatgctagttttttagctgtctgtaatatcagtcaaaatggtgaaaccagttaagggatgtgagcaccaacaatacagtcaaacccagtcacaatttacctatgtatagaatcataatgtatagagaattccaaactgactttgaatcttctaatagaaatgtaagagacattggtttgcctgtttgaaattttctgtgggaatgaagtcctattttcttcctcaaagtagacacattggtatgcatgttactatttgaccatttgactttttgtggtgtaggaaaccatcactccttgcagttagaaaaagtcctcatgtgcattctctcatctaagaatcacaaccttgtgattttgtattatgattatgattacctattatcattattcccttttacgtgtaaggaaaccgaggcttagaaacatgaagtaccacagtcacagtcacataacttgtatcagtcaagatctgagtcaggtttttcgaactgctattcccatgctctttttgtctcctcttctcaaaatcctattacgtttggacttaacaaagcaataatggctgggtgtggtggctcacgcctgtaatcccagtactttgggagggtgaggcgggtggatcacttgagatcaggagttcaagaccggcctggccaacacatagtgaaaccccatcactactaaaaatacaaaaattagctgggtgtggtggcgcacgcttgtagatcagctacttgggaagctgaggcaggagaatcgcttgaacccgggaggcggatgttgcagtaagctgagatcatgccactgcactccagcctgggcaacagagcaagacaccatttccaaaaaaaaaaaaaaaaagcaatactttaaaactattttggacaatacaggtgtaaaatacttcacttttttacatgtatcttcttttttgaaatgattcttaggtatattaacttttaaatcttccttttataaaccaatggattaatgaacccagttcagtgtaccccttagaaatcacacttgtttcaaatataaaattttaaagcattatattcctcattgcctttagaactcagcaattgtactaaaatcagccaaaagtgatttcagtgaatcagctcttaaagccaaactaatgctaatatttgaccaagtagaaacgaatatctaaaccaggtgagaaaaaagttaaaatgatgataaacctttctaattttgaaatagtacacacactgagtaatgcagtcaatctctttattcaccaagcgcaagtagtatataaaggaatattataccatttttctttactcatgagtaaacccacaaatagcacaaaagctgcaaaaacactttaacataaggagtatttgttttattgactgtaggaactcatggaatgcaaacacctttaaaatctgaataatatgaaggcatttccagctattagattctttacatatgtcaaagaacagtatcataaattatgtatgttttttaaaggtttcctaagcttcttccaaagtcatgtagacatcattacactccatctgtatacctctgtggtaacttgctgtcgcagggatctagagcctcatcttttgcaaacttcattccttctttcatccctttgttctttcattcagtcagcactgattgagcatctactgtgtacctagaagacattgtaatgatcctgtttggtccaaggacatactaaacaaaactccctttactgcttatgctatattaagtaaagctttaaagatgggttctcttttattacttccatgatggcccacccctctcatcctttctcagtgttaaaaaccagaaatatacatacttacatactatcataacactgatactacaaaagcagtacccattattatctctggtttacaaattattcaataatttcttactggaaacttggtctatatagtcatagtagtaagctttgtgagaggatgtgatgggatcatagttagctaaacaataggagtatttgtgtggcttcattttaaaaaaactaaccagtttttttccaacaagcaattcttatatcagaaccatttatattctttactttggtgagataggattttctaagcaggtcttttatctgtatctatgtatgtttgttcttaccatcattgagcacaggatttgatcctttaaatgtgttgacagattttgaacattttcctcatatctttcttttttgttttttaatgatcctgtactaatcattttgcattatggggtcacttctggacagagagcctagccatctgctcttacaaataatgtcggcctatcactaactggggataaggagaagacatctaccgatgtctttctagcatgtccttcttgactttttctttctttaagaagactaaaatgattcagcttgtggttctaccacagaactcaggagaaaatgataaatatgaggccattctccaaataaatatgttttcctacattagtggttctcaaattttaacaagcatcaaattcacctggaaggcttattaaaacacagataactgggctccacataccaagtttcaaatgattcagtgggtctggtgtggagcttgagaatctgcatctctaacaaactttcaagtgaggctaatgctgctgaatcatggaccacactttgataacccctgttctatgttaagtacttgtcaggtacagacaaatttaaaagttaaaaaaatatatatatgacttctgtaagacactgtgaagggtttagactctggggaaattaagtataatgccatcccaaaaactctgtgttggaggagtgttcaagtgctgcaggatcatggagaaccaagcacttaacttttctatgaggcagaaagaggaagataaagggaaacgtggaggatgaagggaaactgttaatagatccccagaaacacaatttgctgctatatggatttatatttactgtatttcaaatcacatggtctagaactgtgctgtccaatatgatagctacatatggccattgagcccttcaatgtagccagtcgaaagtgagatgtgtagtaagcgtaatatatacacatgtaatatgtatatgttatatatatgatatagatgtaatatgtatgttatatatatgatatatatgtaatatgtatatgttatatatatatatatatatcaggatgcaaagacttagtaccaaaaaaagaatgtaaaatatctcattatttttatattgattacatgttgaaatgatagtatttttatgtatttgcttgggtaaaatgtcataatgaatttcactcatttattatgattattcaaacttggttatttttcttgaaaatgaatgaagtgagcctgttgcttcggctacaacaatgggcagtgtttctgcaaaatttttacatgtgcctactagaacatttaaaattgtacatgtagcactcattatatttctgttggatagcattggcctaaaagttttcaaaatctagcatggataagaatcacctgcaaagcttgttaaaccaatccgcccccagaaatttagtatcgggtgaggcctgcaattctgcatttctatcatgctcccaggagatgctgtctatttgtaaccacatatagaaattcattcccaaactacagatgatagagttttacagagaggtgcaaaaatatatttttgcatcaagcattgtctgtagcttgaatacaaaattatgttgcccatataccactggtttttgtaagtaaagcagttgtgttacaaagcatacaagtttttatcagctaatagccttttctcaattagcagatactaagtagtacttttattatgtggcaattctccagtttttggaatgttattgagaaatacacagggttaaaacaaattagaaagcacctctcccaaaatactgcagtaagatgtaggaaaaactgctctaacatattctaaactataggttgctcttatgtaaatatttcaactataatatctagtctgatgtgcccactggccagagttttgtaaaagctaaaagtaaaggaaataaaaaaaagaaagaagtatgtgtttgtttttgaaaaggttaggtcacagaaggatttgttgatattaggaatagaatgacccgtgaaaaaaggacaattaagttccaggaaaacatcttttcagtaaggagagaataatcatttatgcttaacctcaactctgttaggaaaaaaaggatgtaaacaaaaccctttaaagaattgaagaaggagagtataaatttaaatgcccaggttagtgaccacccttagagcatactgaggtcaaagcgtactgtcaagcttaagaacatttggttttcaatgtttgtacaactaattgtactttagtcaagaggactgttatcgaaattgctcaggtagccttgaaactaatatggcccaaatattccagagtctgtctttctcaccctaggagaagaatggtctggttttcaagggaattctctattttttttttttgaaggcatcaggatgtgtgaaactacagggggataaatgaacgatgtacagaatgtgatgaaaaaattatatgaagtataaaatgggaatgaagccatcaggagccaaagaaatatttatgaatttaagagaatgaaaagcatattattattttcagatattttataaagtgaacccaaatcattataaagtattaattaggctacttgattgcttgatctttatatactaatttctaatttgttttaatcgggaactatttttgctagttctaaggctagctattatggtaatccatgtaagtgtgtttattattgtttttaaaaatggaatgtgttcctagtaaatgtgtttaaatagcaaaatgtatttatgcatgcatgtatttattttagtttcctgagacctctagttccttactagaaacatgtatataattccaggcatttaaaattgccatgatggtcatgttttcttgtccttttcccttattctgcaactgacatttgcccttgtctccaatttctcactgctttattctttgttcttgtaagtgttcttgtctctctgggctgacctctctccttccctggagtttgaccccgccccaccctttcttctgcatttgtttgcactggttgttttcttcattgcctttcccactgccccgctgcgctgcatgtgaaacactccgccagtagctgctcacagttcccatgctacatcatacccagcattcaaagagctgctgttctcacatggccgccagtaagattcccgactcctccttcacagcacattcctctagaaagtagaaagaatcccctttcaggccacatgagaagctgcgtgttaaagccaactccataaaggggaatggaaactagcgtatgaaattcagaaatgctacttttaaaggtaaataccacaaagtgaatttcaaattcatacagtttatcataatacttctttatttttataaatgctataatgtccttaatataatgatcactgtgatataagttgtcctctcccttaatatattaattaatttactaaaggagacgggagggtggaaatataataaattagaagatgattcttatatcagaagtacagcctttatacatagttttactttattcagacaatcaatgtagtcatatggtataaatttgaaaataattttagtgagcattacgcttactgagattaatagtgagaacttacctagcacttactgtatgccattcacaattataagcacttttgcatgtgctaatgcttttaagcctcacgtaacccagtgagggaggtacaattttaacctcattttacaggttagaaaaatgaggagcccaagggttaagtgacttgcctgtggtcatatatcaggtaagtgagagagccaggatttgaacccagacagtctgcctggggaatctgtcagaactcctaactatgcagtaccactcctctgataaaaagttgaattgacatgacaacatttcctattcatttatgattcgaccctttaaacaaaaagaacagcatcattctcacatttattaatttgtcaggaatcacctggatcatgagttgaggaaatttaaagtaggagggttgtatgaatttcagaccacgatctcaagaattgcctgtttaactcagagcctgaatcattcacagactaaaaactagaatcactcttctgtaggaccaagagggttgaatcatcaaagtcttgctgaagtgaacggaaatcctcctttgttcaatcattcattcaataattatttttttctggtgtctactctttaccaaactctgtttgagatgatagggattcagtcatagacagaccttctctgccctcatggaggttatggtttcttgggatgacagacagtaattttttaaatctcataaaataattacaaatgtgtcaggaaagaaaatacaggacactaccagaatatatagtaaggacctaaatgtgtgtgtgtgtgtgtgtgtgtgtgtgtgtgtgtgtgtgtgtgtgtgtgtgtgtgcgcgcgcgctgcagtaagggtgagaggcaggaaagggcaatcaggacaccctcccaataaaagtgacctttgaccgagatctgaaggatgaagacaagctgagtgactcttctattcatctatatcttttgttttaaatggcctgaagcctgggactaactaaacagggttgtaaaattccagtatgtaaattgaataactagggatcatttgaagtaatggactgcagagttaatgtataattaagtcacatctagggaagatttcccatcattatcacagagagcatcctgtttgctttcttcacagcacttacgaaaatctatagctatgtgtttggtggcttgtttaatgaaagtctgtttcccctatctgaatgtgagctccataaggacagaggccctgaataccacatctactgacatttggcagtgtctttcatatagtaagcattctataaatgtcttgaatagatgaatgcataaaactaagttaaaatgttactgaaaactataaaaataagcagaaagttataccagaggagaaaaattaggggaaaaaaactataatttctgaagacgtagtacttacatctaaatttgtggcttcataaggttaaccaacacttaaatagttttgccaaaactccaagaaaaaaatgaccgggtgtcgtggctcacgcctgtgatcccagcactttgggaggtcgaggtgggtggatcacctgaggttaggagttcgagaccagcctggccaacatggtgaaaccctatctctactaaaaatacaaaaaaattagccgggcatggtggcagacacctgtaatcccagttactcggaaggctgaggcaggagaaccacttgaacataggaggcggaggttgcagtgagccgagatcatgccactgcactccagcctgggcaacagagcaagactctgtctcaaaaaaaaaaaaaagaaagaaagaaaaaaaagaactaccatttgacccagcacttccattacttggtatgtacccaaagaaatataaatttttctaccaaaaagacgtgcgctcatatgttcattgcagcactattcacaatagcaaagacataaagtcaacctaggtgcccatcaatggtggattggataaagaaaacgtggcatatatgcaccatggaatactacacagctatgaaaaagaaggaaatcatgtcctctgtagcaacatggttggaactggaggtcattatcctaagcgaattaaagcagaaacagaaaaccaaataatgcatgtgctcacttataagcaggagctaacctttgggtacacatggatgtaaagttgggaacaacaggcactagtgacaagggcaggagggtgtgggacaagggctgaaaaaactacctatcgagtactatactcactacctgggtgacaggttcaactgtactccaaacctcagtgtcacacaatatacccatgtaataaacctgcacatgtaccccttgagtctaaaataaaaattgaaatctaaaaatataaaatatcaaatcataaaaataaataagaaaacaattgaatctactgatatgtttcattgcttttaaaatatccactttgaattactgaatattttaatatttttagttttacacttcagcacagaaagtccagaaatccaacccttgagtttacaaagacaccacatgatagttcatagttcacacagctagttagttgtggaactagaacccaaaatttgctctctatgtctctcacataccttttccctttattctaataaaggcatttgtcagtctaaatgtacaatattcgaagacattttttaaaggaactacttatccaaatcccacctgtcttacaaggtccatgtgaagcaatgagataaggtctgtgaaactgcttccgaaactatcaaatgttataaaaatgttaagttttattattagaactgcagttcatctctatgaaacctttctaaactttctcacttttctgaacttgactacgcagcgtcttttctaatctatttgttctccctttataagaagaatttaatcctttccgccctgctgggttgtaagaaaaaggactctcttcttttctataatctattgatatttgattatattacacatctaatgggttcccaataaatacatagtgaatagaattgaaccaaatttctttctagacatgtgaaaaaaaatcctgatctttaaatagaaagggtactttcaaagattatatatagaacctcttggtattttgtatttgcaatgaaaatattttaatttgggccaggtgcggtggctcacacctgtggtcccagcactctgggaggccgaggtgagcagatcatgaggtcaggcgttcgagaccagcctgaccaacatggtaaaaccccgtctcaatcaaaaatacaaaaattagccaggcatggtgacgcatgcctgtaatcccaactactcaggaggctgaggcaggagaatcacttgaacccgggaggtggaggttgcagtgagctgagatcatgccactgcactccagcctgggtagagagggagactccatctaaaaaagaaagaaagagagagagagaaagaaaagaaaagaaagaaaatattttaatttgtcttatgttcaacagttgcatcatatctgcatccttttgttaaaattgaacaggcttctagtttcatataataatttctggccaggcgcagtggctcacgcctgtaatcccagcactttgggaggccgaggcgggtggatcacctgaggtccggagttcgagaccagcctgaccaacatggagaaaccccatctctactaaaaatacaaaattagctgggcgtggtggcacatgcctgtaatctcagctactcgggaggctgaggcaggagaatggcttgaacccaggaggcggaggttgctgtgagccaagatcacgccattgcactccagccggggcaacaagagcgaaactccgtctcaaaataataataatcataatcatcatcatcataataataatttctaccaacagctggcaggaaaaaaatatgagagcatagtcatgaacttcagattccactccccttacttttggcattccattcctctgaattatagcttatatttctttattatctcagtttgatttagtctttctaaatattcacctctgtttccatccataaatatcgactgaactaccttttaatatactatctttttgtaacagagaaaatcaagtgtaggtggattattgtaagtgacactgaggaaatataaaaagaccttgacttgtccaggcgcggtggctcacgcctgtaatcccaccactttgggaggccgaggcgggtgaattacgagatcaggagatcaagaccatcctgaccaaatggtgaaatcctgtctctactgaaatacaaaacattagccgggcatggtggcaggcgcctgtagtcccagctacttgggaggctgaggctggagaatggcatgaacctgggaggcggagcttgcagtgagctgagatcatgccactgcactccagactggtgacagagtgagactccctctcaaaaaaaaaaaaaaaaaaaaaaaaaaaagaccttaacttgcttcaaacaagtcaggacccccaattccaattcttaggtctggcattcccatcagacacttaaactgtaggggcagtaaagttgcccatgtggctacagcttttgtggctgtgctgtacttgggaattttaatgttaccctctttgaattaggtccttcattgatcatgcatctcaaagtatctcagtgccacataaaaattttctttcagagtcatattttcccattatgaatgctacctactgcttatctgttgagtgtacacttttaaaccttctgtgggtggtggcccctttgccactgggtgagttagatgctgatcctggtcattatcgctgcctttccagccttttctgctcttacaccaagcacaagaattctctgctgatagtcaggatctagggctgggaaaatgggatgagttgtcctgttagacaggcccaaaaggagtattgtttaatccccagggtgtggggaagaaagatactcttgttttcttttccccaaatgtgtccatatacacccttctcctttgctggcagccaccaggcttgttgaggatctaccctcctctgcatatcatgtgcatcaagggaagccccaacccaagggaatacataatgatagtcctgagctatttcatggtgctctcgcagtcttgattgccctcttcggaattggacatggtcatattacgcaattttaggtaataaaatacaaagggcattcagctaagggaccttctgagaaaggtttttctcgtctagagaactaaacaggcatccttctccgggcactatgcgtagttctttattctacctggaacattctttctccagaaatctttgtgactaactctgtcatttccttcaagtcttattcaaatctcaacttaaaaaaaaaaaaaaccttcttaaaatttgaccacactaattagacagcaactgccccatctccctcttcccagccatctgaatccatttcccacttacctttttatgatagctcttctaggaaggcactccctcctccctgtgaatcatgtctccaggcaattgttccttgtgtagaggaacacaccaaatctgggctgctcctgtacaacaaactgaaggaggtagaattgattctgcaagaagttcaaagctaaataagaaggagtcttgtagcttctgtcttggtcttctggaatgctcactctggggaaagtgatctgccctgtactaagtctactctaaggccactgtgctgtctacatgaagaagccacaaatctaagctagccacatggggaagctgcatggaaagacaaatacgtggctagcccccagctgttggccgaagatccgcagccatcccaagtgaggagccagatgtacaagtgaaaaaactgtaacagccattccaatggagccttcagatcaattcagctttggctactatctgactgcaaacacatgaaagaacccaagcaagaaacacccacctgagcacagtcaactcacagaaccatgagcaatactgataaatggttatttttagccagtaagttctagggtgatatatagcaaaaggaacatctgtcctgttttttctggtttttcctatcatacactcattctgcaggattaacatgtgtaatatactttttttttttttttgagatggagtctcaatctgtcgcccaggctggagtgcagtggcatgatctcagctcactgcaacctccgcctgctgggttcaagtaattctcctgcctcagcctcccgagtagctgggactacaggcatccaccaccacgcccagctagtttttttttatttttagtagagacggggtttcaccatgctggccaggctggtctcgaactcctgacctcgtgatctgcccgccttggcctcccaagtgctgggattacaggcatgagccaccactcccggcctaatatacttttttaaattgtctttcactatgagaaggtgagctccatgaggccagggatattgtctgttttgttagctaatgtatccaaattacctaagaatagatcttagcgtggtaaatatttgttgaatgaacgagtgaatagatcagaatttcagtagctacgttgtgagtatgtggacagttcaccaagaatggcagaatggaaggatgggaggaacctggaataatgtcattgtgcttctggattacccagtcctggagcagctttgcctctgtgggccttgactagtcaagacattttgtgttgggtttttatgttaattccatttgcatcactataaaggaatacctgaggctgggtaatttataaggaaaagagatttcattggctcatggttctgcaggctgtacaggaagtgtggtgacagcctctgcttctggtgagggcttcagcaagcttacaatcatggtggaaggtgaaaggagaaccagcgtgtcacatggtgagagatggagtgagggggtgggaggtgccacactcttttaaacagtcagatcccacatgaactcactctgagtgagaactcacttattactgcaagaatggcactgagccattcgtgagggatccagccccatgatccagtctcccccaccgggccccacatccaacactggggattacatttcagcatgagatttgaagggaacaaacatccaacccatatcagttttctacaacctgcagcagaaagcatctcatctggcacatggtcttgcaaataattctgacttagatgcatgggactcagatatgactgaaccagaagataaatctaagtagcagacaccacagtattctcaaaaccactctttctctttctcttgttgaccgaggcttttctactgagcaaagcacctggtttataatatgttctttcattacgccttctcctaagagacctccttagtgtccctgcaatggatgtctggggagccaccaatctcttagagatgactagacatgtagccccagaaatggttacaccttgagcttttctctcagtgcagatgagatacattgcccatcccaccaatttgccacatttatctaaatttctgtgttaagctgggacctctaccactcaagctgggatgcccctcaccaccaccacactgcaaaaactaaacatttttcattagcctcctacttgcaattaagtacataaaacctgcaaaacaagtaataaaattaaggcactatttggttaatgccttttctcagaaatcacttttgcatgaagttcagttcagtattttatcagtgactacattagtctcgagaccctctacccaataggagggacaaagatgtacatgacacaggctcccttcaaagatgattaatacatgaactacatacagtattacaagggctccactagagatgtgagccccccagaaatgatattaatgtgcagaagagttagcaataaattttgcacaaggggtgacatttgagcttagactcgagcaatgagtagggttccaagaggtaaagaaaaaaatggaatggttttctaggaagaaaaccaggtctgggaagatctgatataacctgaggtagtttataagtctggaatgactgagttatcgggtatatggtggggaaggcagcagaggtgaaataagtaatatctaagcaaatgaaaaacatgtaattaggggagatgaaatataattaaattatttaccttaattcctcttttgactctttacatttgtcattcataaggaaacaatttcactaagattgttttgacctttttaccttatttggccaagtaaacaagggacagaaagtttttaatgtaaaatattcattcaacctgaaagaacattgatgattccagaccatttaaagttaaatattttagagttctcaattatttctatttggatgagtagaaccttttttcagacttcaggaatatatgtttagtttttaacagactaattgttcctgctttcatgccagcctcatgggcatcagcaggttcaaggttagtaggtaggaatctgccccctaagaatgcagcctaagagttaaggaatgcatgattacccctgtaattacttgagaggggctctgaaattctggcagggttggtgaggccaccagataacactgatcaagaatgtacacgaggttaggaattcagactgtagctgaagtggggagttcgggtaaacaggctctgaatggaaaagatcaggaattcaaatagacagttaagtcaagaaaccaacatcttagaaatgtaaacctcactttaagtcaaaggctctccaagctaagacttcataatatatttgccaaggcaagagctagtatctgcttacctgagtggtcctggagctgcggccagttgaaacaggagattgcagatggaatgtcagttagaatactttcagaggccagtaacagatacctgactttaaagttcttaagtttgtctttcccaaggttttctggtcataagaatcaccaggggcacttgattaaattattaattcacaagccccttcactggagattctgatgcaatagacttgggaatatatttttttttaacacgaactccagtggaatcaggcaagaagtgaaaaccctatcgttaataatagacacattagaaataatagagacatttgataatctagcacagttcccaaactttagtatgcatcagaatcccctgggggcttgttaaactacaggctggcaggctgctcccagcgtttctgatgcagtaggtccagcgtggagtccgagattctacatttctagtaggttgccaagttatgctgctactcctgtggtcaggaactgcactttgagaaccactaatcaaaataaactgaagtccaaagaccatcagacctagagctggttaattcaacagattagctatatcaagacttgaggtcagcttctctgggattctcttgtctttttcctcatggtcccaagatggcttcccactgcgccaagcaacatatccgcagacaacaataaccaaggcaagaaggaataaggttcaaggataactgtattgtgtgcgtgtgtgtgtgtgtgtactcatgcctgtgtgtctgtgtttggaaaagcaaacgtttcccagaagctccccaacaaatttcttcttatgtgtcaactagaactggatctcactgaacctctttaagccaatcactggctatgagaaacaagcttactgtgattggcttagaccagattttaattttttcctcagagctgtgtcctttgttgcccaatatctgaacataattgagcttctttaccaaggaacaagaagtaaatagctgttagttaggcaaatagctgggtatgtccacaaatgggttctgaaacaagtgtgattataatgaggttcagaattgaaaatattagtacaaatgctagtaaataatgtatgatattggctttcttatcaccatttgcaacagaataacagtctcatgaagaatttggcacagccattgtagaaaaagtgccttttcagagctcacagtatgcatgtactcatcttgcttttattatacctgtatatggaattgcaagctgtcccttcaggtaatgaaatttagacaagttggaacctgtataacagcaaatcaatactgaaattataggcaaagcctgtacttgtgcagactaacacataggatagaaagactttgtgatcaaaattcaacaaatcccacatttataggtatccaacatagagagaaaactatatatagtggtgtgtctttttatgtgtttgcgtttttctccttattcattcctgaaagtgtattttcttttaacagactcacaactcagctacaccccatatgcccacagtcaacacagtggaaaactgagttgtttatttgagcctcaagtcatccaaatacttcgttaaacgttgtagtaaaaggtctcccctgaattcaaggaggatgccctaagttttctgcatccttttgatagaggaaagtattaactaatgtcagactatctgttgttttattttcctttacagcactagattttgttaaggacattgataattttgaaagagaagctaagctaaggtgacaaatatatcttctgttggtcaatatctaaaattatgtattatttcttttttgactacaccttacagtggttagtttgcactttacgtaaaaaactgatgtctaccatcttccatctttgtaagcaccatccagcctaatagttgttggtttgaataatgccacaagctttgtccagaaaccaaaaacctgatttccaaagactagtctatgtagctgagcccttcattccataatcattaaactatggttaggacacagtatccagtctcccctcaaccttgtccaatcacagtctatgcagagatcatgtaactcgattaaaatctagaaccatagagacatttcccttccctggggcaaatgggaattgcacatgggggaaaatggtgtggataagcaaaaaacggaagtttccaaagtgcaacagaatattgataattttagtacatttcaacatacagtgagtgtaatgacggcattttcctactgcttccttagttgtgaagattttgttttttcttctgggttcactgccgggaaaagagcagaaaatgttttagagcctctgccagcagagggggcatttaccatttgtgcataaggtctctggcactgtgccctggggttctcttttctatatgtttctaacagtcacacacagcagtgtgactgtttacagatactttaccgtcttctctgattgaagcagggactggtttgccagcaacttttggttgtttttgtttttttgaagaccatgcaactaacagatgtttgttgttggctccatatctacattctttgaaagctggagaatcaaattgctgacattcagacaacactaattcccatatccagggagcctaatttgccgtccctgagatcctgattcctggtgttcacgggtttaaaaaccatttcagtgacacaatataagaatgggcttgggagatgcagcgctgtctccactaaagataatcacattttataaacatctgcgtcattactggtatgattcatctctaagctgtatacagctgtgtttccagtttcaattaacaatcccttaattgcatatccatctcatgttactaatttagttaatttattcataattaagagtattctgttttctaccaaggtttgtcgagctcagaacattataaagaaaaatattttaaggcagcatctccgagggattttgtttcttataatcacatcacagtaaaatgtcattcatgcgcccaaaggaagatgaattgctaagggatttttttttccagtaaaataagaagctttgggaagctgcagtgtgttgtgtttttaaaccaagttaaatgcgatgcattttgttcttttctttctccttccctgacatcctctcaaaaaaattatcattttatttgtattattgcttaagtatcacagcaaatccagtcaccagtgcaaataaaactgtcattaccctgtcaggtaatggtgtctcttaaaatctaagctataaagtctgtacattttagaggacattaagatcaagaatttttaaattgcctaagtctaagcaagtggagtacacccttgtggaaaatggaaggcagatgaaaacatgatgccaggcagtgaattcattttagtttgatcttttctacaaaaatacatatatccgtgcagcaagagtcttgcctgtgttagtacatgtgtctgtgtgtcattcaaagcagcaataacaaaaaattaagaccatttctcactttgtttattgttcaagaactcccacctatagccttgacctgtgtttgagcttaaaaaaaaaaaaagtcttataactgcccagtggtttggagattttacacaatagaaataataagccatcttttgcctcacatgaattctactaaaatcaaaactccataggatactttccaaagtaactggtgaaaggaaaagtgtggtagtataggtatgcatattatccccatcactttatttctgagctcttctattttttaaaaattttaatttgtatcttaaaagggcaaaacataagaagaggtaggagtattctaaatttcagtgacaacaaattcatttattttacaatttaaccattgcccgtcaacatttacttaaaatttcagcatgggaggttttaaacacttctagagtcccatcttaccccatttccacgatgcttttcttctccatgtgttgctgcagtttaatattgtctgcgtgttttaatatgttaaacgagttaaacatagagtaggaagttaaaactgttagcagctatatgtttcccaagattgatgaaaattcaggtaacactccaacctgttaaagatacctgcaatctggccaggtgcggtggcccatgcctataatcccagcactttgagaggccaaggcaggcagatcacctgaggccaggagttcgagaccagcttggccaacatggtgaaaccccgtctctactaaaaatacaaaaaacatttagccgggtgtggtggcatgcacccatagtcccagctactcgggaggctgaggtgggagaattgcttgaacccggagcctgggtgacagagtaagactctgtctcaaaaagaaaaagaaaaaaaaaaatatatatatatatatgtgtgtgtgtttatatatatatatatgtgtgtgtatatatacatatatatatgtgtatatatatatgtgtatatatatatatatatgtgtgtgtgtatatatatatatatatatgtgtgtgtgtgtgtatatatatatatagaaagagagagagagagagagagagagagtaagcagggaggggttgaagccagaaaagactagaaattatctaggccaaaccctttaatttatagattaggaaatagtttctggttgacttagctgagacgttctcatttgttaaaagcaagatcagaaatcagacacaattcaacgctcttcactacaccttgtttttctctttgtggaaaacaagacgtatcctgttcaaaaatttatgctgtttatctgaaagcccaaaatgcctgtttacatcatattttccattttgcaatagcagctcattttggggattattttctgatgaaatctctaggtttagttgtacttgaatatctttttatctgtacacactggaatatgcatataataattgatagaaatgtggattttaaaagtagagatgatcattattattttatgatcctttaagttaataaaattcacctagaataaaataaacaagtttaactaaagttctcgcattttcccagaaatcgtagactagaaactagtcttatttgcttattttattccaaagcttattttacctctattattttgtggttctataaaatatttctgtgtattcctccaaagaacctcttggaaaagaaagtaaacatcacatctgaaaaatagctgggcattttttcattatctctgcaaggggaggggacgtgaaaggcaaccccatatagaaactcaactccctgctttttacaatgaatgaagtttttccactgcactgtcagaatggtaattcttgctaactactcacctatttcacaacattaacagagttccaggattcatgctttaatattgcataatggtccatgttttgaacatgaggagtggcagcggagattacactttgattccttggatttcatgtggcactggatgggagcaaggcactgattttaagttgagataaaaaggagaagtcagtcaatgcctgcagccagacaggactcttgtaatagctagggagtatgcctcatttggatatgcatgactgccgggcaaggacactgccatgaatcgctaatggcagcagttgtatgacataagagagatgtgtatcagcaactcacaagttgactttgttacatgttatgaacacattcctgtgggcactcattcatagaagtgagaaatgtggacaccacagtgtcccaggcctttgttaccttatggcctgggaatatcttgctttgctggaacatgaagccacgtctggttataagaagaagtttgatctgggagcaaaattgcctgttcacgcatgtctttctcacttctttaaaactaacttgctataagggtgattaaaaaaaacagatgtcaggtgagagttttgctttgcatcaacttcctacttgtagaggtaataacataaaccttgcctggcaatcattatttgtcatccagctgagggtgtttactcttgagaaagaagtaatggacaaaattgacttggattctggttctatgtttcccattaattgactctggacatatacatgcaatttaatccatcttactaaaaacatgaccaactcacaggatgtaaattctattctatagaaagggctttccctcagtagttagtcaagggacggttcctaactcctgtctttattgagcttattttccaaaataaatgtattattttctactttgttcacagagcaaggcagcataaagaaattaagcaacaaaacaatagtgtatttttacccaactttctagaaaacacccatttttcttaagttttgatatttttttgccaacaggcagtcaaaaagaagataaataaaactgggttaagttggtaatgacacaataaataaatgagatgaagaaagaggcaataaatatgagtggataccaacaagaaacatgttcaagccctgaaaaaataatgagaaaaggtagaactattaataatacatcccgctctcgtatcacaccttgctccccagatacatcctatctgtcctggcaccatgttgatgctgttgttctgtaagctatgccaatgaacatgttggatgacctactccagctctacctcaagatttccaaataagaaaaggacccagggatctccttgctgaggtctttatccatttactcaggtcacaagtactaattaagcagctcttatgtgcaaaatgttattgcttcaggtcagtttttcctatactgctgttctataagagaggaagaaggtccctgccctcagaaagccctagaatacagatctagagatgggttcaacatctttgttatgcaattatttcattccaattgtaatgagtacttagaaaggacaaaagcagagtgctgagagagtataacagagggacttgacctggtgtagtaggcctggaaagtttcctggggaagtggtattttagacaaacaacacacacatacacccatgaatgtatacgtgtggagaatgtattctaagtaactatgatgaatgtatttcttactgtaggtcatggtcaaagtttgaaaactattgttctaactagtattataattccagggatagtagaggtcatgtgacctgtttagcacatgcctgccttaacagtatctagtaggccaggcaatgtggctcacacctgtaatcccagcactttgggaggccaaggcaggtggatcacttgaggccaggagtctgagaccagcctggccaccacggtgaaaccgtgtctctgctaaaaatacaaaaattagccaggtgtggtggtggtgcctgtagtcccatctactggggaggctgaggcaggagaattgcttgaacccgggaggcggaagttgccgtgagctgagatcatgccactgcactccggcctgggccacagagtgagactctctggaaaaaaacaaaaaacaaaaaaaaagaatgtctagtaaataagtcagtgccaagcaactacctgataactgttaccaccttagtcatcaccgaaggcagaaggtcttgcattcattggaggagagttaccaatctaagacatttgcatgaaaatgtgcacagagccctcacctgataatcaaagcatgttccaacacttctctttggataaaataagagttacatctcaatgaaatcacttgtggatcaagttctcatcctttcgtaaataaagagaggggcagcaagaaatggaagtgagcacatataagtgtgggaacctgtactttcctaacctataaagcattggatgtagtttttgctattggtgcgcatggagtcatgtggccttggagcagttaggtaccttccctgatgataggggagaaggcaaagaaattgatgatacatctctctcattgtcattccctagtatattacacttaaatctaactgccctattttgtgattgccttactgctgtggcttgaatatttgtgtctccccaaaattcatatgtggaaacctaattccatatatgatggtattaggaggtaggccccttgggaggtgattagatcatgagggcagagcccacatgaatgagattagaacccttataaaagagacccagagagctgctttgccctttttgccatgagaacacaagaaggtgctatctatgaacaagaaagcaggccttcaccaaacactgaatctgccagcgccttgatatcagacttcctagccttcagaattgtgagaaaaaaactttggttgtctataagccacccagtttatgatattttgttatagcattccaacggactaaaacattcattttccagaaaatctactccatttataagccagcattcttttttttttttttttaattttctacagatctctgcagaaacatgcagagtaataatagggccaggcacggtggctcacgcctgtaatcccagcactttgggaggccacagtgggtggatcacctgaggtcaggagttcgagaccagcctggccaacatggtggaaccccgtctctactaaaaatacaaaaaattagccgggcatggtggtgggtacctataatcctagctactcaggaggctgaggcaggagaatcacttgaactcaggaggcagaggttgcagtgagccaagatcccaccattgcactctagcctggacaagaatagtgaaactgtctccaaaaaaaaaaaaaagaagtgataatatatttgctgtatatattagttatagatagttatattgcagtactatcagaagctatgccacatattatttacgtatttcttaagatatagaaaacatccctcccctgcagtcattagtacttttgcattcaaacttcaaatgaaacaggactttagaaattataggcttggtgccatcctggccaacatggtgaaactcgtctctactaaaaatacaaaaattagctgggcgtggtggtgcacacccgtagtcccagctactcgggaggctgaggcaggagaatcacttgaacctgggaggaggaggttgcagtgagccgagatcgcgccactgcactccagcctggcgacagagcgagactccgtctcaaaaaaaaaagaaaaaaaagaaaaaaagaaaagaaaaaagaaattataggcttggtgatttctcaggcattaactcaagaaagcagcctttataccgattacctacattcacccagcacttaccccattaatttctaatgttgcttggaacaaatgaacattcctggaatgcaagctaaatgaaagagccccgaagaagaacagggcatttcctggttcctcatattgacaaatttaaaagcctgtgctataatatgggctcctgtttcctttcaagtttgtctttgaataagtggacagagtagctgaaagcagagtatttaaagctttgaaacgaccactttatttcagtctctgttcttgctgggaccactcttataaatgaggagattagaaaatcacctagaactatttaatcgttgtgcagaagaccctcttaccccaaatatttacttaccgctcattttattggcacactgcctcaaattccacctgctgtgaactgacctaagtgaatttaggtcacgtgcaactattaggttctttttgggaaataatggagaaccacagatgtgtttgaggtggatgaggaatggctacctcaagccgcagcttcatgcttcatgctgaagtcctccacaagtgcaatcatgtcgttaaccaacatttgttagaaggcaggcagaagtcagcttacagcctgttctacaatttttatgaagtgtaggattttaggcttaaattgacaccattgcaaatacagtattctcttacctttagatttggcatcaggtcacaagaattcttcctaagccaatggttggatacaaggccattggagaccagacgtaaaattaaaagcccaagcaacaggttttgctggattcttatatcctgtttatgcaatgttaggggatgtcattaaaatattttagttaatccatgtatcttgattgtcttaaattttactaatgagatcctatagggatattcattgcaatccactatttccctcagcaaaaacacatttgcgatatctattacatgcattacaaaatcctccaaggttcacagagatatatagtagtagcagtctctgggttttggcctttttcataagatgaaggctgtgctgtcctagaatatgaattcctaattaaaataaccatttgcctcaagcctctagagttgaaggttgcactaactgcacatataaaatatccaactatctatgttgagatatttaaaattaattacagatattgtaacaccattatttaacttaaattccattacaggtcctttgagtatgcaaaatatttctttgagatgtggtaacccctttaactgatcaggaaataaacctttattatcaagttgttatcccaccttgacaggcctaaagcgcagaccacatatcagaatcccctgggcagcttataaagctcctcatgcccaggctgcatctcagaccaattcaatctctgggggtgggctccaagcatcagcatttgttgaaaatccccaggattacaaagtgcggtgaagtttgcaaacccttgtaataagagaatgggaggagggatggctgtttgccaagcagaaccaggaatgaggaaggatattggtaaacaaaatttatccataattgacttttcatgaatcacagtcctactgagacccagccttgtctcatgagactttggctacgatgatgagtgagaaaaggactcctcctaatttaccagactcttgattagaagcaaatgaaattttggaaaagagacaagtcactttcaaaagaccccagcctgtacctgaccctacctctggactccatagtaatggcaggtagtggtcattcctggagtaactctgtatttcttaaaggaacatttgcataatgaacctacagcaatctggaagacgactggggtaaatagagaatttgttgattttagatggctgaatactatccgtgcagagcaattaaaaggacaactgtcagaatcaagtaagagaaaggaaataagagaagtctcatgttagtagaccttgtttgatcaatgtgttttcatcttgtatatgattaataaaataagtttgggagttaggatcaacctttgtttactcactggagaataacttgcatatagaatgaagctgggattgtccaggctggtttttttccatttggaagtttggatacaatacaaggaagcctgaattccaaactgtttctcttaaagagtgcctttctgagccgctattaaggaatgcttattgtttcgaaaatggtagcacagaagtgttataactagagtacaccttgtgcctgcaattaattacccagtgtcttcaaaaattcttgtcttttgctggtagaaaacctttgaaactatagttgtctgtggtattcactgcagcaccttagatataaagagagaaatttattttcagaggaatcttgagacagtttgtgtgtgtgtgtgcatgcctgcttacacatctattggttttccccaaggattgtagaaatcccattaaaattccagcttcttaaggagctactgaaactccagtttttcatattttcttttataatatttggatgcgtttaggtaaacttgcagcattttaattatgtctgtatcagatgagcggaagaaatgtaaaagggtttggggagagatttaattttagatagcggcgtaattaatagcatttggaaaaactagtggaactttaattaaatgtctctacattaatttagtcatttaattgaacatgtagtgggatagtccttacaatttttcacccttactctttgaggaaaaatgatttttgaataacaaagcatcagtatgactactttttattatttagctgtatgttcactacttggcactttgtttaatttttccccccatatgtttcgagctttttaaaacattaatttggcttgtcgcttttatcttaaaaactataaatctgggggccgggtgcagtggctcatgcctgtaatcccagcactttgggaggccgaggtgggtagatcatttgatgtcaggagttcaagaccagcctgaccaacatgacgaaaccctgtctctactgaatacaaaaaaaactagccgggtgtggtggtgcatgcctgtaatcccagctacttgggaggctgaggcaggagaattgctggaacccagggggctaaggttgcagtgagcagatattgcaccactgcactccagcctgggcaacagagtgaaactccatctcaaaaaataataataaaataaagaaataaagaaaactataaatctgggagaaaccgtatttggaaacattgagcaactgtttcttttcctttattttagactttaatattcactagagtcatgttgtaaagttttcaccttaatattgtaggctttttttttttttttactttgccaacttaactggcttttttaaagtggtgttatgctgcagcagtgtatctgaatttcagcagtgccttttacgtggctgctcacaatcttattaaactacatgaattatacatggagagaaatataatttggtaaatttggtgatgtttcaataaccatgcccaaggaggaatgttgtgttaaactgtcaatttgagaagtgttttgtggtgctaaccacagagtgaattcagttctacttcatttcacaaccctccataaatagtgccccctaaaagtggtgcctccttgcctgtactttgacccagatttttgtcatttttctagataagcatatacattgtgcacttattaatttttcaaatgacacaaaggtgagaatgggagtcaacacactgaaagatcaaaatcaagactcaaaataagattataacagactgggatactgtaccaaaataaaaaaattaaaataaaatttaacaagaacaagcaagatgtcctgcctttaagatttttaaagtcttttgtacaaatataggctgaggaacatctgactttgtggcgctttatatgaaaaacaaattgggattttaaataaccacaaggactgtattaatctccagtatgatctggtgtggcttactgtacgaggcaatacagtattagattgcattaatgaaattcacaaatgttccattaatctcttcactagttaaaccacatctgcagtcatattgacttatgagcatcacgtatgatgagaacactgaaaaatcataatacattgacagcagggcaaccaagattgtgaaaggtatagcgatggttatatgacaaatatttgaaagaatctagaatgttcagtaagaagataacatgaaaatacaggacagcttcttcatgcatctggggagggtgggtaaaggacacagcacacttaattaagtaagattgtagaagagaactatgggcaagtgttacagtggagcttactctgagtaaggaaaatgtaaacgttagagttgttattaagtggcatgggctgcttcacaaatttccatcattttttaatctgattcatctgctaataggacaaactgtaacaatagcttaaacaatagagaaatgtaggtctctctcatgtacaagcccagaactaggtagatcaggcctccttccgctattctgcttcactaagtccgaagtcctcctttaccttgtcctgccatggtggcctcaattctcgttgtcaccacatggtccaatatgtctgcttcagctccagccaacacatctgagttccagcccccagcaacatggaagaaggaaggaggcacagagagggcgtgtgccagcagtgttgtgagaaaatctttcagaaactgtcatgaaatgtatcccctgatagttccttcaccagaactttgtcccatgattatatttacatctatgtgaggctaagaaatatattctttccttcaggcatctacatacccaactgaaaattatgagttctattgccacaagaaaaaatggaaaatatatggggacaatcaacagtacttgcacaaagatgttttacagagaattactcttttacctgggaattttacaagataaactttaagatcctatcaactctctctctctctttttttttttttttttttttgagacaagagtctcgctctgtcacccaggctggaatgtagtggtgcgatctcggctcactgtaacctccacctcccgggttcaagtgattcttctgcctcagcctcccgagtagctgggactgcaggcgcccgccaccatgcctggctaatttttgtatttttagtagagacggggtttcaccgtgttggccaggctggtctcgaactcctgacctcaggtgactcgcccgcctcgacctccctaagtgctgggattgggattacaggcatgagccaccacgcccagccagatcatctctggaggcagggggatcacttgaggtcaggagtttgaggccagtccggccaacatgacgaaaccctgtctctactaaaagtacaaaaattagctgggtgtggtggcaggcaactgtagtcccagctactcgggaggctgaggcaggagaatagcttgaacccaggaggccaaggttacagtgagccgagatcgtgccactgcactccagcctgggtgacagtgagactctaactcaaaaaacaaacaaaaagagtctatgatcctataatttatagacaacatacaacctcctttctctacaaagagaattggttctcaagggctgtttggaaattcatttccttttaagtccaaaatgacatacaaaagtgaccaatatatacaatgtacacccttctacaataagttctcttttgttgccgtagtaatcgcatgtcttttcttaaaggaacacttttttgactcttttgtacttttgaacatagcggtgttaataataatatttataaaacattatgaaaatatgcacacaaaacacaacacaggctaagaaaacctaatggtggcctaaagtaagttctgatgtcctctgttggtggtattcttcattgccatgcttctgctgtgcctgggacctttattgctacctatgggaagttgtaagtagagaagtttctttactacagggatgtgaacaatcattgtaagtaaggaataatgaattcacataagttcacagagcatgtttttctgccctggtaatactgcatttctcactttgcatttaaagtacctacgcccttacacagaaaaagttatcggggttgggtgcagtggctcacgcctgtaatcccaacactttgggaggccgaagcagggggatcacttgaggtcaggagttcgagaccagcctgggcaacatggtgacaccctgtctctactgaaaaaaaaaaaaaaaaaaaaaaacacacacacagaaaaattagccaggtatggcggtacatgcctgtagtcccagctacttgggaggctgatgtggaagaatcgcttgaacctgagaggtggaggttgcagtgagccgagatcgcaccacttcactccagcctgagtgacagagtgagattccatctcataaatatataaatatatatatataattatcgattgattaatattattatatggtccccattactctaaactctcaaaatgtaatgtaggtcaaaatcagaaaaaggccatactgtctactccttcctctgtttcattccaactataagagaaagggagagggcaaaacaaagatgacaggaggccaaattgtacatagaattcatggaaattcttacccaacatgtaaaattatgatagtataaggaaaagtatactgcaaaaattaaacttctacattgtgaaatggagaacatttttacatctagctctattgcttctccctgtggagctgttctaagcacaaagttcccattacataatgaacaactccttaaatactgtgcaactatttctcactagaagcacgatgcagcaaactctgtttctcagtaaccatttatatcatacctagtggtaccgagttctataataaaagggtgatatgtgcatattttgtggtcatagagtgcaaagttgacatctacagtttaaagcattgcattgcatgaataaggtcaaaatttaaatacttttctatgatcatgttctttacattaaaggttaaagatgcatgccgctttaaaaatggtttaagggccggacacggtgactcacgtctataatcctggcactttgggaggctgaggtgggcagatcacccgaggtcagacgttcaagaccagcctggccaacatggcaaaaccctgtctctactaaaaaatacaaaaattagtcaggcatggtggcgggcgcctgtaatcccagctactcgggaggctgaggcaggacaatctctggaacccggaaggcagaggttgcagtgagcagagatcgtgtcactgccctccagcctgggcgatagagcaagactctatctatctcaaaaaaataaatgaataaaataaaataaaaatggtttaagaacttcaaaccatctggcaccagaaaacacctaaattgaattaaaaatctggaaatttaatttcacaacttgtcctttttcaagcctaccctaagttttgtttacttaatggggagaatctgttttatttgttcctatgtagaagactgctgattttatcatgattgtattagggcccaaggatatttaaaatatttcagtagctattacttatactttatatctgcattgcactttagagttgactgagcattttcaaagtattatcttaccaaattgccacaatagtcttgagaggctagtaaatcatgggagaagcccccatttccccactggaaagcagagaaaacccccattgtagtaaaggaggggttccctccagagctcttgtggttgtgttgaggaggaagtattaatgctgctgggcatgacttacaagaaataagtcaattcacttaagcaaaagtgctatgatcctgtataccatgtgagcagctctaggatggggtcacccagcattttggagcagacattagaacatctggagggagtaaacgcaaagaaaatgggctagatacctttccttggatgggaaaggataacattaagataccaagatcaaatgttcaaagagcacatatacaccagagaatactatgcagccataaaaaatgatgaattcatgtcctttgtagggacatggatgaagctggaaaccatcattctcagcaaactatcacaaggaccaaaaaccaaacaccccatgttctcactcataggtgggaattgaacaatgagaacacatggacaaaggaaggggaacatcacacaccggggaatgttttggggttgggggagtggggagggatagcattaggagatatacgtaacgctaaatgatgagttaatgggtgcagcacaccagcatggcacatgtatacatatgtaacaaacctgcacgttgtgcacatgtaccctaaaactttaagtataataataataaaattttttgtaaaagcattgtataataaaagtagtaagataaaccagtaaaaacaaaacaaaacaaaacaaaacaaaaaaaagttcaaagaggccgggtgcagtggctcacgcctgtaatcccagcactttgggaggccgaggcaggcggatcacttgaagtcaggacttcgagaccagcctggccaacacggtgaaacctcgtttccactaaaaatacaaaaattagctggatatgatggtgcgtacctgtaatcccagctacactgaggcatgagaatcacttaaacctgggaggcagaggttgcagtgagctgagattgcaccactgcactctaatgtgggcaacaaagcaagactctgtctcaaattaaaaaaaaaaaaagtttaaagaaaaataagttatttctccatgcttcaggagatatgtttcgcaggagaaagaggcttaatagagaaaacagatccctacaaacatttgtggtttttaaaactgccccattggttactaagtggataacatgagcgtgatgccagattcagtactctagtgagccatgcagctttgctgtgctctgcacctgatgagtgtggcctcacttcttataaatgcctgtcattgctaacaggggtccttgctgaaacaacagggctggactaatgctctagttcccttcctggaaaacctatcccaaagctgagatcctcatgatgccttctctcatatatgaatgattgcaggttacgctatcatcattaaatcgaaacattttagaccactttgcgtttgtttgtttgtttgtctcattatgtccagttttatcctgtttcataatttaataaatttttattgggtctgtcttctggttaaatgttgtgtgtataaaaaataaagtcaagagagagaacaggagttatggaactaatgacaaatccatccttcagctaaataaaattatactatggatgatttgagctgtacgttgagtgataatttttaaaaataagatagatcgggtgcggtggctcatgcctaaaatcccagcactttgagaggccgaggcggatggatcacgaggtcaggagttcgagaccatcctggctaacatggtgaaaccccatctctacttaaaaaaaaaaaaatacaaaaaattagccaggcgtggtggtgggtgcctgtagtcccagctactcgggaggctgaggcaggagaatggcgtgaacccgggaggtgaagctcgcagtgagccaagattgcaccactgcactccagcctgggcaacagagccagactctgtctcaaaaaaaaaaagaaaaaaaaaaagggccaagcatgctggctcacacctgtaatcccagcactttgagaggccgaggtgggtggatcacctgaggtcaggaattcgagaccagcctggccaacatagtgaaaccctgtctctactaaaaatacaaaaaattagctggacgtggtgacaggcacctgtaatcacagctactacggaggctgaggcaggagaattgcttgaacccaggaggcagaggttgcagtgagccgagattgtgccattgcactccagcctgggcaacaagaacgaaactctgtctcaaataaaatgaaataaaataataataaaaaataagataaagtatcacaagtaagatgtagttgaaacttcatgcatttttctatgatgcctatgatattcaaaagataactgaatttcatgagcagagttcaagaacttctgagtatacttttcattgatgacttaatgtaatggatttctatgatgatggcactatattcttttggtgtttatggtattaataaaaaattgtggtaaagcttgtggaaatgaacatgccttggattagggtgccttaaatgtgcctttgtaaatgcagctaggagactccaagtcacccttctagtctaactgctactcctttcttttacaaactacatgccaactaaactgaccttgatctgtttatgaaaaggcggtataggaacaggggctctgcaattggacagatccaattctaatcaatccactccattgatagatatataaccttgagtccttcctgtgcctcagtttcctcatctgtaaaatggaattaaaaaccaacttcgtgaggcttttggagaatgaaaatgacataactcaaagattattgggtatcagaaacaataatgttatctatcactgtctttactgttattattattattgtcattattattattttctctacctggaacaccaattccacaaactcttaatgtcaagaccatgctgtatcatggagccttccctgattcctccatatgaaaataattaattctcatattaataatattacttttctagttgtattttctttttttagcttttattttaggtttgacggtacatgtgaaggtttgttacataggtaaacacatgtcatggaggtttgttgtacacattattttatcacccagatattaagcccagtactcaatagttatcttttctgcctactcgtattttcattatccccaagtatactatacatatcttaaaattaggatccatgttgaaaaaacattgatatttcctatggcttctaacacagtacattgcacttagatattcagcaactctgtattgaatgtatgggtacaatctgctcttagtttctaatttggtattaatatgttcaagcctcaagagctcatgtaaatgatggtttgactatattgcccatcttttgttaagttgaaaagctgaaattcatgcactgtttgttagtgtagtaatttgtgacaacgtctagctattaagtcttttctaggtataaaacctttatatctgtcattgttcccctcttgtgtttttgctttaatatcgttgaaagcatctattattggaactttcacttctgaatagtacttttgagaacctgtatagaatttcagaggccttagaaaattgtcatagattgcttttagtatatggtttaccactgtggtctcttaacttttcaaaaagtatttccaaagggcacttacatccataagtggaaattgatttacatctattattgctgattgttcactattctgaacttcggctaaacaggtgatttaggcagaatttttttaaatattagattttttcctactttctaaatattttgtagctctttcttattaatttgagtcaacttatgctcgcttttttttgtcaattatagatggttgtcaggggtttggcaaatgtcatatgaaggtaattctttaaaagttgggatttttgaactgtttatttctactacttttgattttgctggaaattatcattctattaaagggacaaaagggtgctcagaaatatgcattgaaaaatttcttacagatttatcaaccattgccctcaggcactgatattcagccagtatgttccaatacatccatgtctttccattttaaaccttttaattctgttctaatttttcattgcctgtgcctgattgttctgtatccatctgatacgaatggttaagtacaacattttaaatatcactcttgcctatacatattatttttcttgtcagatgatataattgtagtcattacatgtttcttaagcacaactgaaatcttaatttaaatcaataagtcttgtttctgtggccattgtttcccagaactctccggatttctaagcatggtggttattcttccaggaatagtgccgagagtcttcagcagcatgcatttctctctaattgacattatttcacactctccattttccttactattgaaaactgtatttcattggtattttgccaaggatcctgctctgtttcataataatgttctgttcgcactctctgcactgacaaatacctattccatgcatcaattgcataaatggcaatttgaaagcatttaaccacagctggatatttttcattgattcttttcatctgaagatcattcattaggcttctccctcctgtttcttctcacatccatacctcctttcctcctatgtacatagtgtcttttgcattttctgtatttaagtgtaaattgctgactacagttatgcttttacctcattccatggtcataatgaaatcacaaatttaaaaatgtactactttttaaacctgttttctgacttgtccatctaaatgcaattttataattcttcgacattcagcctcctggtgaatgatttctgcaatctctccaagacatctgtgcagtgttatggattatattgattgcattttgtccatgttcaaatttgcagaatgtaacctacagaatatatattgactaataaagaaatgcatccacatggtggatggttgtaaagagaaaatatatattggtgtgcagcaggcgcccacacaaatgaaatctagaaaacagcagcttgccatgtcagagttgcaaatgaaggctgtggctacaaaacacagaaagtctggagtgtatgaaaggtttttcttccaaattcattcacacataaaaatgaaaaaattgaaaaatcatatatgtgcaccttaatttttatatcgcattggtgtttgggcatacgaccctgagattttcataccctcgatttttttaatataaccacctgagcgtttcttcccatggggttactttagaagatggggggtgtacacactacgtatgtatgtcaataaagaaatgaaggaataaaggaggaaagaagtgaagaaggctgggggtaggaagggagggagaaattcagtgattcattacttattcatcatcctaaactggcatataaaataatatgtttaaatcagtctaaaattttcattgtataatctctgaaataactagtccccactccctaaactgtttggtgtaaatatttatctatgtctaatcatttctatgcaaaatagccttatatatattttcattttcataagatcatctaagaatcaaaggaaaagctattttaggcaatgaacataggcagtgatttcaaaatagaatttgagaaatgcaaggatagatggaatcacaaaagatgatctcattcatggtgttttaaaccctacaaatagatttctgtttagttgacctcatttcaatagcttctcatttttttcagaagtgtatttgatgtgtatatttctaataaacttatttttctttttgtacccagtattaaggagcacagcatttatatccactgaacaaaggataactgaaaggaaactccttgatatccaacttggagtatttgtttctcgaatgaatatgagtttatataagtagtttttttcacatacataaaattagaatttgtttgtattattgatattatttcagaacagcggatttaacgtcatagatgatctagatgtgtcctttccttagaaatctttaaaatgaatcacatagtctagaaacagatccagatactacatgctctcatcagaaaggactttcttctcttcgtgtcaagttcagtgttggcaccgtatagacaaagcgtgttaaaatagcagggttcttgttctctgacacattacaagagaggcaagattataaaactgctatgtgtctcattataattcccattagtttcatttgcttcaaaacattcacttctgtgctttttgcaaaagctttcaaacttattttttgatgattctaaaagtaattcttctatgtcttttcctagtgatactagcattagttttcttttccaattgtactaggaggcatgagagattatcgatgccctattttcttgtctaaataggcaacccaaataatcatagtgacctgttcatttatattatctttatttcttgcctcatacttcttcatatttcttcatttcccatgtttccttattctttggagccagaaacgatcacgttaatcactctttccattagttttctcctatacattttctgatctttctctgagccagttaagagtcattcagccatttgataatggacactagtttactttgaccttgcaaacacaaataccctgtttgatctttatttgctgagagcagtaagacagaagaattacaataaactttttagcacccttctgttcaattctttttcagaaatcgttccctcaaaaagcctattctaggctctttcttttggcagtttcctagaattttcctttgcttttcaccaactggaacattatcactagaagtaaactaagggaccatctaattcaacaccctcgttttgtactttaggatactgaagccaagagaagctaatttttttgcctgccataacacaactagttagtgaagcagccaaaactataagggatcttgccaccataagctttatcggcccatccgtttatctcctcaaagcagccctatacctgatttccttatttctgttctctaagtaagccaagctcagaccttagagtgaccttcccctaatccaccctgcctgacatccaataaactgacaaatccagttgattatgaagctacagtgtttttcaaaccataccataattgtctaggctgttgccatgctctacacaccagttttcttattccagtccctccctgccccagtcccagttcactctactcagcctctctactgcaatggataaaatcacagtttccagattcacaaagctcacagctctgccactttctagccttgtatttgtgtttcagttgctgctgaaactctctaagcctattttccatctataaaatggaaaccaacccagaggctcgttgtattacagagatattgcatgaaaagcatttagcgcagtgtctggcccataagaagtcctcagtaaatagtagtcttggggaagcagtagggtgttgtagtaagagagcagagcaggggacagcaaactacaggtctcagtacaaattcaacatggggcctgggttttttttaatagcaggggagctaaaaacagtttacttgttttaataagttgtacgaaacccaaagaagaatatgtaacggagatttatgtgttcctcaaagccagaaatatttactttctggccctttacagagaactttcattaattcctgttgacagctgtcagggtatgaatcctctctaccacttagaaactgtgtaaccttgggcaaatgttttaacctctccaaggtttggtttccctgactgtgaatagtacctatgttacagggttgttatgagaattaaatgagatcatttatatcaggtgcttagctcactagctgaaataggatttaataaatgttagctgacatggttacgtctactcattgttgcagataaatagcctctaagtgcagctttaatagtgattgtttcttaaaatttttgaacaaagtttttctatttcttatccaattaaataaatattccacattctggcattcaatatttctaacgacatcaagcaactctaaaatcattgaatgttttaaagcaacaggaaaccttagaaataactcatctaaactcatatcatagatatggaaactaagggccaataaaaccaaggcttctaggacctgaaatcagatcctctctttttaggtagtgtgatcttcatcgtgcttctgccatgcaatctcagaatttaaagggatttaagaatcattcattttcttcctaaggcaggattcgaccctataaaatccctgtcagtttggtcattcaaacccagtttgagtacagtcattgatgataaatcacccttttcccagggagcagttctggttgtttcaaagtctttataataaatgaaaattggctttcctgaaatctctatatattgatctattcctgcccactggagccaaagagaaacgtcacttctctacatctgtaaaatactcgttgtcaattttcgtatcttctctaagcatcctcgtttcaagctgatgtgaactagttgggtttttgattgttttcattgtcctgctaagtcgaaaagctaagaaaagcttggctctttcatcactgttatatatcccactgtgtaacagaacttgagttcagggtatacactctaaataactgcttttgtaaaagtattcaattatattgatttttttcgttccctctgttgttcctcataattaccctcagtcaagactttcatcttcgtctttatcttcctctgcaagaattaacagtggtcccttttgtgaacttcaaatatctgagactggtctcagttaatttaggaagtttattttgccaaggttgagaatatgcacccatgaaacagcctcaggaggttctaacgacatgtgcccaaggtgtttggggcacagcttggttttatatatatttagggagacatgagacatcaaccaatatatgtaagatgtacatttgttccatccagaagggtgggacaacttgaagcaaggaggggcttccaggtcacaggtaggtgagagataaatggttgcattcttttgagtatctgattcgcctttccaaaggaggcaatcagataagcatctatctcagtgagcagagggatgactttgaatagaatgggagacaggtttgccctaagcagttcccagcttgacttttccctttagtttggtgattttgaggccccaagatttattttcctttcacactttcaatataagctatccagaactgatgataatattccagatatggcccaaccaatggaaatgattgtgtttcctacataccatatcacaatcaaacctgttttgcaccttgcatttactttctttattaatgatgtcattgcaatttagaaaatttggggccacatttacttcttcctctctattatcttcagtttttatttggtcactaaattctgtttgctgactcttatatctaaaaataaaaacactcaaatccagctattcctctctaactactctgcccttccctcagtcctttctcagtgactattaatgatttggccttctaatgattagcctccctgtccccagacttttatccatctttatcactatggctagttatcttgctaaacaacagatctaatcctagtaccccattatattaaaaaaatcttctatagctacagctttctctccctccaggtcagtatccatagcctgtcaagatgtggctttgataaaggacagaaggcagggaaattctgggcagaagagggcaggtccccattgaggacccaccctcaagccaaaaagcctggaaccatggcccaaagtgagaacttacatccctgttttccctcttgaagggtgccttttccaaaaccatccattaccccccacccaccccccaacctgtgcctataaaaaccccagagctcagctggcagaaggaggagaagcagatggatgtcagaaactacagttggacatcaaagagaagcggcttgactttagagggacagtttgacagcatagctttggagaggagtccagctgtggatggtcagactccaggggaagattaccttcccactccatccccttttcagctccccttcccactgagagccactttcattggcaataaaatcccccatatttaccatcttcaatttgttcatgtgacctcattcctcctggatgctggacaagaacttgggtgccatgcgtgtgggtgaaaaaggctgtcacactgaccctccactgagctgttaacacttaagccatctgtgaatggcaaagctaaaagggcgctgtaacacttcctcatgggcaccctcccctagaggctgctgcagggcccgtacggtgttcactcttgccagcactcaaaaatgctggccccagctgctgcacctgctcacctgtgctcccccttccatgaggggtggaccagcgagtgagtggagtttgctcccctccagttcccacccacgaagggatcagggaaatatcctccttcagctccagtgaggcacagtggtatacacctatagtcccaactactgaagaggctgaggtgggaggatctcttgaacccagaagtttgaggctgtaggcactgtggttgtacctgtgaatagccactgccctccagccttggcaacatagcaagatctcatctctaaaaaagaaaaaatatatatgatgtggctccaattcactgatctagcctcttaactgaattccttcctcctggctgggcacagtggcttatgcctgtaatcctagcactttgagaggccaagacaggagaattgcttgagcccaggagttcaagaccagcctgggaaacatagtgagacttcatatctacaacacattttttcaaaaagaattttttcctccctgctccccaccctacccccttgcaaccttatttactcttcggcctctggccctctcgctatgtctttctcagcttcatgcctttgaaaatactctttctatgcctggaaagcccttataaacctggaaattcctattcttattcaactctgagccagtccattttagtggcttagttcagaggctctagatttaaattgcaattctgtcagattctgtctgctttgccaacctcaatcaagttatgtactatgcctcagtttcctcatcagtagaatgaaaataatacagtagtgcttttttcatagggttgtagtgaggattaaatgagatgaagcgtataatcctcatgtacataacacagtacatactatatgtgttgcacatagtaagtgctcagttctttttctttgcattattcttagcacataagtcaagttacatttgctctcccttacgcaaggtcaattgttcttttttatgtgtttacccgttactttgttcatgcatttgttataaccactgccatcataaagcaacttgctatctttgttcataaaacaaatcccagattcactgagctcaaagtgagagaaggaaactttgcattatgtgcagttcctatgcttttctccaaatttcacatctccgttggggatctctcactagttatccttgccatacccccacaccagccttacaattttgcattatgtttcctacatcatgattctaaacggtcctcctgttcgctttctctccatcccatatcgttgcagatagctatttcctctttttaagacagaaacacatttgcattttgcctaagctacatttgtaaattttacagtattttcgaaagacacaatggaatctaggaaagatgcaacagataaagagattaactggccaatttttgagagcaccatccgtaaagtccacgaacaagtgaggcttccttgtcggagaaagcaattcagtcaccataaatgatcattcaagcctgatctcattccctcttgaaactggaaattgaaagcttgttcctctgacagttgtgttgtcagtggatatgcccagtgtgcaaaggactggacaaagggcaaaagtacacatatcccatctggaattctgagtcatccctgagacatcattttggatttgtctactgagatgaaattaaaacatgagtaatcaagcccacacttcttccccctcaaactcatctctttggtatcatcaagaaaatcaaatgctaatagccattgacctcctaattctagtgctcttagctatgataaaacagtcattaacttaatctaaatgttgcaaataaaggagccccatcaaagctgaagccccaaaattatacaaatgagttaactgggaaggcatgggggaaacaacagttttcataagacacactctaaatctagtttattctcttaggaagacttttctcatcaatagagagccacataaagatgccttacctgcctttcacggggactatatcaattggctgtactgtcactcactccaaaactctcaaaatgcctaacacagattcttgattttattgattgcattagatgttacgttttctaaattttcagcaccctggaggtcacctcaggaaatcatgcagtttttgaatgattttccttagaaatacacgtgtagctatacatatgcccatgcgttatttaatcagttagtgaaaggaggaaaacagcatttctattattgacctttctcaatctctgaggagactgtatgtcttgcctacagtccaggattgaaagcaaaagaaaaaggcactgacaaaatagcattttattttaatagcacattatggagagacaaaaaaaaaaaaaaaaaaaaaaaaaccctgggatttcctttgtctaagtagaattgacgtatgggtgagatcagtctctattttactcagtacaagtgcacacatatttatgtacacacatataattgtcatctttgggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccgggcgtggttgcgggcgcctgtagtcccagctactcaggaggctgaggcaggagaatggcgtgaacccgggaggcggagcttgcagtgagccgagatcgcgccactgcactccagcctgggccacagagcgagactccgtctcaaaaaaaaaaaaaaaaaattgtcatctttggaagctaagggccctgtatcagagtatcagaatatacctatatccaggatgcaatgttctccagttttgcattaacatcagctacaaggttcactgccatctaagactaatcaacagtaatagctaaaggacaaaggtcagttcctgagagatatgcctaaattcatctggctatatcttctgttcctcccaaaccctaaccccataaattcttcattgtttagaaggattcatattttttgtttgtttttcatattcccattttattggctggggttagaattgcaatggcagcaaaaaacacagaagctatctacagtggcttaaataaatagagttttatttatctccaatattaagatgtctggaaataaggtgctttgggcccaacagtatcaggactggcatctgtatattttttattgacttttcctcatgcaatatagcagccaccattatttcacagggtgaaaaagagaaggcaaaaagggtgtactatctgagtcttatcatttttataaagccaaaaatttcccagaaaccttttttgaaagacttctacttgtatatcattgtgtagaactgtgtcacatgacagccaccaacaaaaagatggctagggagaagtggttttcaacaggtattgaagtagctaaccggcagtgtctgccggtcttcagttataaacaccagcagctaactctggctaattcaagtcagggaaaacaaaggggatggggtaggggctctttatttaaaagatactcatagaaatgaacgaagtaatttgaaaactaggtctcagaataggacatgaagtataagagttctaaaatctcaaaagcaggaacacatgcatcttctttttaagtgttgtctttgaaatactaagctccaaagtctttccaaccttgtattattttcttcctttgtcagcttcctgagtggcagagtctgagtaacctatggggtctttgaactctttaggggaattgaggaaggcaaaaaggtaccatgattggcagctctactagagtcacaagaaatatggggaaagcgattcctcaaaggaaaaacaaaaacagaaacaacaaccaggcagttagtagaaggatgaaatactggacccacaaagacaacatatgtcttctcaccacacttggtctctctctctctctctctctctcacccttctctctctctcatagtaatgaaactaaagctgcaaaactaaggcctagctattcattgtgatccttatgagatcataaaaaaaatctgtatttaagtggagaaaaataaatggaatatcaactttaaaaaattttttttgagacagagtctcgctccgtggcccagactggagtccaatggcatgatctcagctcactgcaacctctggctcccgggttcaagcaattctcctgcctcagcctcctgagtagctgggactacaggcacgtgccaccacacccagctaatttttgtattttcagtagagacagagtttcaccatgttggccaggctgttccgaaactcctgacctcaggtgatccacccacctcgacctcccaaagtgctgggattacaggcacgagccactgcacccagctggaatatcgatttaattgtaagagaaaaatgcactagtttaaaaatgtgtcctctttatcctcaggttttaaaaatatttttaaggtagtttagaaaaactgaagtgattatttgataaataaatttcaaatgctatcaatggaacaagaatggatattagatatcctgctaacaaggatcatatttttacaagttgtttctccaaagagaacagagctacagctgagattctggtgcgcataaacctttccatcagagctgtagtcacctaacaattcttatatcacaatcttcatatctcaatcccttttccaaataacttcatctttcttaagttgcatacaaatgttataatctaatatttttgagatggatatcatgtgtcataaaaagaaagccattgtaatattaccaataccaagtattagcaaatattgacatagctttagaataaaaataaacagagctcaggttctggctctgccatagctagctagatttatcttaagacttcagtttcctcatatacaaaatgttgatagtatcatcatcttgtaagccttgttgtaaagagcaatttagctaacagtaacagtgtttaacatgcataaagtgaagactcctttctgggctgataagaacgctagtttattcatttgcttatttctatatttttaagcttagagtctgaaaattttcagagtctgggagtcaacgtgtggggtgtgaattggaacttcaccacttactaacaactcccttttgtagtgcttccatttatttatctgttcaataggagtaataatagcactcgctcaaagagttgtctgaggattagatgagacaatgcttgcaaaatgcaaagtggagcacctggtgtatagttggtattcaataatttctagttgttgatatgatgatgacgatgatgatgtattctcttgatatgtgaatgctcatcacaccatcctatggaatatttgattttaagaaaaagttgggtttgttttttttttttgtttttttttttttttgagatggagtctcactctgtcgcccaggccagagtgcagtggcgcaatctcggctcactgcaacctctgtctcctgggtttaagcaattcccctgcctcagcctccagagtagctgggactacaggcgtccgccaccatgcccggctaatttttgtatttttagtggagaccgggtttcaccatatttggccaggctggtctcgaactcctgatcttgtgatccacctgcctcggcctcccaaagtgctgggatgacaggcatgagccaccatgcccagccaagaaaaaatattttaaacaagttaagatcatttactatactgtgccctaagatgaggtgaacatgtagatcatgagatctaattgattttagatgcagttcagttttttaaaagaatgacctgctttccatattaaaatttcaaaacaatgatatgtggagatgatgacagaatatggctgaatgaggtaccttgttatcctcaaccttttggctcagagacctcttccttgctggaaactttcctaaccttttaatgatttattaacattttgcatgcactctttatacctttcattaatgactagttcactgcaaatttttctttgctttatttcctattcttggtgtgacattcattctctatctgtttctatggaagcttttgtgatgcctcagagagaaagaattctgagtctttgaaataatgaaaacattactaaaccataaaacctagatttcaggagcctaatagaggattagagctttattacgtacagccatcttacagtttagccttcaagtctcaattgtggaatgatcttttgtcctttctctccagtgtgcatgtgtgcatacacatatagacacagttcgcgcttcagtcatataaatgggaagccacaaagcttcctagagtacccagatgcagaattagaagacccaatcttgacaccagggtcaggggatctgtggtttggggggacttgtgctggctatattgttgtcacagcaggaacagtttgtgtcggtatagaggctttaacttctagtaaagggatatataatgaaaatgtaagcaaccatcgtttatttttctcacataataggaatttaagagaaagatatacccaaaattggtttattagctcaacagtttcattcagaatccaatgtctttccatctttgcatttgctatccttagcctttggctttggtctttggaattgtcacgcgatggttataaaatggctgccacactccaggaattgcatcatgacagtgtgaatggaaaataaaggaagagtggcagttcttgtcatgtttcagaagcaacagcatgtctccctaacatctctttggccagaactaggtcaagtagctgcatctacctgcaagggaaactaagaaattgactatcagtgctttttaaacttttttttgtgtgtgtggaaatagataatcactagagaaaaaagggagagtggaatggttgttgatgaggcaaccaacagtgtctaccactctatttataaaccttttcttgatttttcctactaaatgtgtggccgttttttttgcttgctttttgttttttgtttttgagatggagcctcactctctcccccaggctggagtgcagtggcgtgatctcggctcactgcaacctccgcctcccaggttcaagcaattctcctgcctcagcctcctgagtagctgggattacaggtgtgtgccaccacgcccagctaatttttgtatttttaggagacatggggtttcaccatgttgatcatgctggtctcgaactccagacctcgtgatccgcccatctcagcctcccaaagtgctgggattacaggtgtgagtcaccgcacccagccaatgtgtagccttttagttcaaggacctttcattataaatcttcatagtccaaacacccggcatattgtctggcacaaaataggaagaaatatttttggacgtgccaaggaatttgcaagacagtgagacaaatagccagtaaaaatgttagcattaatatattattaaaaatagtgagaaatgctccaggcgcagtggctcatgcctgtaatcccagcactttgggaccccgaggcgggcggatcacttgaggtcaggagttcaagaccagcctgaccaacatggtgaaaccctgtctgtacttccagctacttaagaggctgaggccggagaattgctggaacccaagaggcggaggttgcagtgagccgagatcacgtcactgtgctccagcctgggtgatagggcaagactctgtctcaaaaaaataaaaataaaataaaaagaaaaatagtgagaaatgttatgaagacaaagaataggctactttggaagaataatagtgggaacttcttcatagtctaggaaggcctctctgaaaaggatatatttaagctaaaatctgaaggttaggtcagtcatatgaacagggaggggaatggaataatattttcaagacaatgacctaaaaggaggcaagtatggctaggagctaatgactgagggggtgagtggtacaggacaaggctggagagtttattttatgggtaagcagagaaataatataatctgacgtacctgtgaaagtacacctgagctgatgtacctgcaaaacatcatacaatctgatggacctgctgtataaatgagagattgaatgtggcaagagtagaagcaaagaggccaggtaagaggcatttgcagttgtcttgatgaaagaaaatgactactgggagtaagatggcggcaatggaaatagagagaaatgaacagatttgagatgtattttcgagacaaaatctgtatgacttggtgatggattagatgtcaggcatgagggattgaggatgactcccaagttttttttgtttgatcaacttgttgtactgtttgctgaggtgataaagatggaggaggaagcagatttggaaaagatcaacagttcagttttagacatgttcagtttgaaatgtgtgtgatatgtccaagtgcagaagtcaaattcaattatagctcaaaggagagacccgagctagaagcgtaaatgagaaaaatattgatacaaaatggaatttagagcatccagaatggaaatcacttagcatgtaaagagggaagggaagatggcctaggaccaaaccttgataaacttcaagaaaaagaagtcaagcagaggtaggagaagagaagtcagtcaaaaatcaaaagaatatgacatctcagaattcaaggatgtgaataaatgtgtaagtgatggatggctttcggtctgggctttttgttttttttttccattttaagttccaactttgctacaatccggctacgaatcccacaccctcccaaattatctgaggatgttaattgatacttgatcagaaagcagtgatttttaaaatcatatacttctaaattatctgagatatgaagcaatgagatagggaagtggctgaaatatgtttctctggctcagctgtcatgagggcttgctctagaatggcactcaagcacatgtttatccactgagctctatatcatttattccattagctgaagaaggaatctctcacactctaacttcagttctgttggacatgggaataaaagttagatgtatacagactaaactaaacagatggtagaaaaacaaaggattcttaaagtatattggagaaatgcatttctatggtcaattttcttgaatatcctaagatcaggtttcatgtatataattctttacatttcacaaagcacctttagatgtgtctattccatttaaccctcatcctaactgtgtgaagtagggcacagaagtgtagaaatgattttttaaaactcactaagctaatcaatggataatctgtgattataatagaatctgagtttcggcatctttatcttattccttactgcactatatctggaatggtaaatattgttcatctcacaagcaagctcttattgactgatatcagctgcctagagtggtttattgtaaaagagcataaagcaaattggggaagactacaatacagtgccataggctgattagtaatttctaccattggtattaaatgagaaaataatggtacaagtgctttacatttgtctgccattcctaaactaaggcacctcctgttatttataaggaagaatattctgagaagtttaaaagtctcttgttaaatcatttgatgacgttggataaaatggcttaaaataagaatatgcctgttgcacaaataatctacactcccccaagataatgaataagtcagctggagcatctcaagtttcaatatgtagaggatcaaaatgaaatagtcataaaaccccttgcagacatttcttgggcaggcaaactaatttcctagtaaaagaagttggaagttggacaaattgtatatgggaactttctatactacttttgcaaattttctgtaagtttaacttttcctaataggatgctgagattcagctcttccaatggtctcaaatgttttttggttttgttttgttttgttttttgagacggagtctcactctgtcacccaggctggagtgcagtggcgtgatcttggctcactgcaacctccacctcacgggttcaagcaattctcctgcctcagcctcccaagcagctgggattacaagtgcctgccaccatgcctggctaatttttgtatttttagtagagacgggattttgccatgttggtcaggctggtctcaaactcctgacctcaggtgatccgcccaccttggcctcctaaagtgctgggattacaggcatgagccaccgctcctggcctcatttaaccattttgactttcactttttctgtcttcaaaatgaggtattgagctaggtaaacttaatgtcttttttcgctttaattatctaataattctgtgattctcaacttggtgtgttaaaccagattacacctaagaaaccctgaagactttttagctaggagtttaaatattcacttagtcattcaattaatatctattgtgggtctgttatatgccaggcgccattttaggtattgataataaagcagcaaacaagacaaaacccctgccctcaggagagcttacattcttgtaaagaagacagatgataggccgggcgtggtggctcactcctgtaatctcagcactttgggaggccaaggcgggtggatcacgaggtcaggagatcgagaccgtcctggctaacatggtgaaactccgtctctactaaaaatacaaaaaaaaaattagccgggcttggtggtgggcacctgtagtcccagctactcgggaggctgaggcaggagaatggcatgaacctgggagctggagattgcagtgagccgagatcgtgccactgcactccagcctgggtgactgagcaagattccatctcaaaaaaaaaaaaaaccgaaaaacaaagaagaaagatgataaacaagtacacaattatcatataacaattttaaatagtgacagcatgttgaaataaataaagcaaggaagacgctagagagttgttcatggaaggaattgtcattttatataaggtgatcagggaaggttccactgaggaggtgacatttgaggaaagacctgaaagaagtggggagggagacccgaaagttcatgaggaattgtgtcccaaacagggcaacacataaaaagtccttgaggcaagactaagctgattatataacatttaaaagaattaggccaggtgtggtggctcacacctgtaatcccagcacttttggaggccaaggcgggtggatcacctgaggtcaggagttcaagaccagcctggccaacatggcaaaaccgcgtctctactaaaaatacaaaacttagccaggcatagtggtgcatgcccatagtcccggctacttgggaggctgaggcaggagagtcacatgaacccaggaggcagaggatgcagtgagccaagattgcaccactgtactccagcctgggtgacagagcgagactctgtctcaaacaaaaaaaaaaagaattaatttacatatcatgagatcatctagtctaacacccttactagacaagttcaaaaaggttaagacttggccaagatgacacagctatttaatgtgatatctgggttagaattcacctcatctgaattcctctcaaattgtgctctttgaggtcaatgtgccttttaaaaaatgacagaaagcatggctgtagatttcagatcataccaaatttgatggaacaatgaccatttttagcttcctatagagtctaagacttgaacttgccaagggagtcacagctggatttgtaagcatcaaatccacaaatgtacttaatgtcaaccaaggattttgtgtcacctgtaatgctcccccaggaagcccccaagtccactagtcctaatcactgtgtttggcttcataacctgttggcccaaacattacgcaaaaaagagcaatattcccaaggtggtcatgttagttgtggtgagatgtcaaccataagtagatctgaccgaggaaatgccttaaggaagcagctcaggaacacctgagtatatgtgtctagaatgaagcctattaaaaaaactactgcagagctaaagacagctgaaagccattatgacagtcacaactacttgatagattgaaaccaaagagttcctttgtgattagatagatcaggactctaaatcatgtttttacttcatgtgttcattcattcatcatacagtcagtgattcagtaaacaatattgagcatccattatgtgccaagcactgtgttaaattctggaaacacagagatggattagacccctgtccccagggagcataaagactagcagagttagacctccctcccatatgaagaaattaaatgaggtaaggcattaaaagtgctatgattacataatacagaacccaaaggggaaggcattttctgaaaaacagaaaactgaaaataccagcttttcagcctcacacagacataggaaaaccaacccccatcaacatcatctcttcttttttttttattattactatagtttaagttctagggtacatgtgcacaacgtgcaggtttgttacatatgtatacatgtgccatgttggtgtgctgcacccattaactcgtcatttacattaggtatatctcctaatgctatccctcctccctcccctcaccccaaaacagtccctggtgtgtgatgttctccttcctgtgtccatgtgttctcattgttcaattcccacttatgagtgagaacatgcaatgtttggttttctgtccttgtgatagtttgctgagaatgatggtttccagcttcatccatgtccctacaaaggatatgaattcatccttttttatggctgcatagtattccatggtgtatatgtgccacattttcttaatccagtctatcattgatggacatttgggttggttccaaatctttgctattgtgaacagtgccgcaataaacatacgtgtgcatgtgtcttcatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgctatttctccacatcctctctggcatctgttgtttcctgacttttgaatgatagccattctaactggtgtgagatggtacctcattgtggttttgatttgcatttctctgaacatcatctcttaatataaaaagcataatgtgctgatttcacattgcatgcctgtatcaaaacatctcatatgctctataaatatatacgcttaatgtgtacctacaaaaattataagaattttttttaaagcaacaataaatatcttcattagtcaaccaaattaaatctattaatatatccatgtttgtgaacaggatggccacagaaccctgtggatgcttaccacttaaacatttcctgaaacaaatatgtttccaaaacatcttgcctgtctaatctgacaactgcagacatcctaactaggctctgaaggtgctctccatagcactgatgttattgattcagttgttaacagcgcaggcataaatgactgatgataactctctaaacgtcccttcctactgccgttgaaatggctctgggctttatccaagcagggctgctaaatgaatagtagatgtaccagcagaggagaaattggtcctgaggtgaattaactctcctgaggtagatttgtttgtgcttccaacaacctgtacgttaaaccttgtgaaccttcatgtaggaattttgaggagaaatgggcaatttttggaaagcctaatgttttatcagccgctttttcttctcattgagacctgtgtattctcaagggactttggaagtttgccattttaagaacagacttgatgagaattatttgaagtcctccacgtttccatttatcagttttcctaatacagacatcctacgcacatcgttgaaagaatgttctttttgcctcacaggtagatcacaaaagtgggcccataatcattgggtagagggtttctcagctctgagttaaattgcagctgggtattgtttttctgtaataggatcttctctgagtgaatggtgaaacatgcccatttttgaggtcatgagagcagagctttccacatcatggacagaaaagggcaaccggccatggtttcagttatacagggagaggaaacaataggttttgtctctgctttgctattgcttcaacagcagcatactgttggacactcagacattagggcacaatttagacttgtttcacagctgtcatttctttcctcaaaaacaacaaacctgcatgggggaaatgagtctacatttcagggtttttcaagaattgataacataacatgtacttcaccatgaatttatattccacaggtccctgttctcttctctggtcatcagagtacaaaatcacaaccaaaaagcaagaattgatatctatgaagctaaagtagtagtagtagtagtagtagtagtagtagtagtagtagtagtagtagtagtgaagcaggatattaccctgatcccctcgcgggcgggaactggactgcatagccgcttcggtgctggcaggggcagactccactggctcagtctcactgagttccacccctcatgggagaggaagcacaggtgagtgggtacaggagccagggtgagtgcttttgggcgccagcaggaacaaaactctgtgtgggccccatggcagtgtctaggagggtgcccgcgacccttgaatccccagaaggagtgttacagggcccttttatctttgccatctgcagatggcttaagtgttaacagctcagtggagggtcagtgtgacagccttctgtactcgcacttgtggcacctcagatcttgcccattttccaggaggaatgaggtcacacaaactaattggagatggtaaatgcgggggattttattgctgatgaaagtggctctcagcaggaaaaggagctgaaaaggggacagagcaggaaggtaatcttcacctcgagtccagctgtccgcaatcagactcctctctgaagctatgctgccaggctgtccctcggaagtcaagccacttctctccaatgcacaaccatagtttccaacatccagctgcttctcctctgtgccggctgagcctgggatttttacaggcacaggatggagggcagggtgggctatgggtggttttggaaaaggcaacatttgagcaggaaaacagggatgtaagttctcactttgggccacagttccaggcttttaggcttaagggtggggcccttgccagagacccgccctcttctgtccagaatttccctgcctcctgtccctatcagtagtaatagtagtagtagtagcagcagcaacagaagtaatactaactactacataccaagcattatctacgtacttcatatctattcaccaacctaattgttacaactttcactcgcgtccgtgtgaagagaccaccaaacagtctttgtgtgagcaataaagctttgtaatcacctgggcgcaggcgagctgagtccgaaaagagtcagcgaagggagataggggtagggccgttctataagatttgggtaggttaaggaaaattacagtcaaaggggggttgtcctctggtgggcaggagtggggatcacaaggtgctcagtgggggagcttttgagccaggaagagccaggagaaggaatttcacaaggtaatgtcatcagttaaggcaaggaccggccattttcacttcttttgtggtggaatgtcatcagttaaggcaggaacaggccatttaaatttcacttcttttgtgatttttcagttacttcaggccatctggatgtatatgtgtaggtcacaggggatatgatggcttagcttgggctcagaggcctgacattcctgtcttcttatattaataagaaaaataaaacaaaatagtgttgaagtgttggggcggcgaaaattttcggggtggtgtggagagataatgggtgatgtttctcagggctgcttcgaggtggatcaggggtggcgtgggaacctagagtgggagggattaagctgaaggaagattttgtggtaaggggtgatattgtggggttgttagaagaaacatttgtcatgtagaattattggtgatggcctggatacggttttgtatgaattgaaaaactaaacggaataagagaaggagaaaaacaggtattaaaggacgaagaattgggaggacctaggacgtctaattagagagtgcctaaggaggttcagcatagccttgccagcaaagattatttactttaagagttaagagtggtggtttggggatagcaccaagagatatcagctgtgatggcttggagaaacagtgtaaaccagcagtgtaaacaagagcagggcatttatgactagttgagactggtgaataggagtatgactagacagaagataggagggatgacaagttttttggggtgcagtctaagttggtctggtgtctggaatgagactggggcctaataaaaaggagcgtccatacaggagcttaaatgggctgtaccttgtagcattctgaggacaggcctgaattctgagaagggcaagtggtaaaagtattgtccagtcctttttaagttggtggctgagcttggtgaggtgtgtttttaaaagaccattagttcactgaatactaagagcctgagaaactgcttgggtgatttgactaataaagtccagtctgttataggaccgtatagaggtgggaaggccaaaccgaggaattatgtttccctgtgggaaaggcctctacctatccagtgaaagtgtctacctagaccaagaggtattttagtttcttgactcggggcatgtttagtaaagccaatttgccagtcctgggcgggggcaaatcctcgaacttgatgtgtggggaagggagggggcctgaataatccctgaggagtagtagaatagcagatggaacactgagaagttatttctttgaggatagatttccacgatggaaaggaaatgagaagttctaagaggcaggctagtggcttgtactatagcatagcctgcctttgctggtgtgtggccattaggcctggtggaactgccatcaataaaccaagtgtgatcagggtgaggaacaggaaagaaggaaatatggggaaatggggttgaatgtctggtggatcagagatacagtcatgggggtcaggcgtggtatcaggaataatgtgggaggccggattgaagtctgggccaggaacaatggtaattgtgggagactcaacaaagagtgagtacagctgaaggagccggggagcagaaagcatatgcgtcaggtgtgaggaagaaaatagattttggaagttatgagaactgtagagagtgagttgagcatagtttgtgattttgagggcctctaaaagtattagggtggtggcggctgccgcacgcagacatgagggctaggcaaaacagtaaggtcaagttgtttggataaaaaggctacaggacgtgatcccagtccttatgtaagaatcctgactgcacagccctgcacttcagcggtgtgtaatgaaaagggttgggatgagtcagggagagctcgggtgggagcagtctctaaagctgtcttcaaggaatggaaagaggagtggggaaaggatttaggatctatggggtcagctaggtttccttttgtgagtttatataatggttttgttaggatggcaaaaccaggtatctaaagtcgaaagtatctaaccatgcctaggaggaaaaaacttgttgttttctagaagggattggggtttgggagattagtcagacatgatcagcagggagagcacgtgtgtttttatgagaattatgccgagataggtaacaggtgaggaagaaatttgggcttgactgaagtaatgggggctgtctgtgaagccttgaggcagtacagcccaggtaatttgctgagcctgatgggtgtcagggtcagtccaagtgaaagtgaagagaggctggggtgaagggtgcaaaggaatagtgaagaaagcatgtttgagatccagaacagaataatgggttgtggagggaggtattgaggacaggagagtatatgggtttggcaccacagggttgataggcaaaacaatttggttgataaggtgcagatcctgaactaacctgtaaaccttgtctgcttttaggacaggtaaaatgggggaattgtaaggggagtttataggctttaaaaggccatgctgtagcaggcgagtgataacagactgtaatccttttaaagcgtgctgtgggatgggatgttggcattgagcggagtaagggtgattaggttttaatgggatggtaaggggtgcatgattggtcgctaaggagggagtagaggtgtcttatgcttgtgggttaaggtggggagatacaaggggagatgtgaaggaggctttgaactgggggaaaaggcggcaatgaggtgtggctctagcctaggaatagtcagggaagcagatcatttagttaaagtgtctcggcctaatagggaactgggcaggtggggataactaaaaaggagtgcttaaaagagtatcgtctaagttggcaccagagtttgggagttttaagaggtttagaagcctggccgtcaatacctacaacagttatggaggtaagggaaacaggcccttgaaaagaaggtaatgtggagtgggtagcctccgtattgattaagaaggggacggacttaccctccactgtgagagttacctgaagatcggcatctgtgatggtctagggggcttctgaggcaatcgggcagcgtcagtcttcagccactaaaccgagaagatctgggaaggagtcagagagccttgggccagagttccaggggctctgggagtggctgccaggtgagttgaacagtccgattttcagtggggtcctccacagatgggacatggcttaggaggaatcccgggctgcgggcattccttggcccagtggccagatttctggcacttgtagcaagctcctgggggaggccattctggaggaacccctcgcagctgcagttcaggcatttggagttcttctgtgctggagatatggctggggtttgtctcacagtggagggaaggaattgcaactcagaaatacattgctacttggctgcctctactttattattgtacaccttgaaggcgaggttaattaagtcttgtggggtttgagggctggaatttaatttttggagtttaatgtcgggagcagattgggtaataaaatatatattgagaataagacggccttttgaccttttagggtctagggctgtaaagcatctcagggttgttgccaaacgagccatgaactgggcttgtttttttatttgatgaaaaagagcctaaacgctatctgatttgggataaagaaaaaggagcattaaccttgactatgcctttagctccagccacctttttaagaggaaattgctgggcaggtgggggagggctagtcatggaaggaaactgtaagccggaccgggtgtgaggagcggaggtgataaaaggattatagggtggaggagcagaggctgaggaataattgggcctggcgaggaggggagaggtcagatgggtctgtagaaaaggaagattagaaagactgagcgatgcttggggttgggactgaggggacaggtgggagggaaagaaggaagatttggaaggagttgcattgggaacagagactggggaggggcagatgtgtaaaagaatgcctggacatcaggcacctcagaccgtttgcctattttatgacaagaattatttagagcttgtaggatggaaaaattgaaagtgccgttttctggctatttggaactactgtcaagtttgtactggggtcaagtggcatcgcagaagaaaataaggcatttaggttttaggtcaggtgtgagttgaagaggttttaagttcttgagagcacaggctaagggagaaaaaggaggaatggagggtggaaggttgcccatagtgaaggaggcaagcccagagaaaagggagtagagacacggagagaaggggtggggggttcttgtcccccagaaaagcggagaaggggtagagacatggagagaagggttggggggttcttgcccccgagaaaagcggtacttgccgctaaaggtgaaggaccaaggcaggcgtccccgtgtggtcagacacctctgaaatgtgggtgaataatcaggcaggcatccccgcgtgattaaataccaagggaagactcttccgagtccgtgaccggtgccggagttttgggtccacggataaaacgcatctcctgtctctaccagaaaaggaaaggaactgaagttaagagaagggagagattgaagtggggcgccaagattgaaaggagaaagaggttgagggatagtgagaggttggaggagagagtaaaaagaggccgcttacctgatttaaaattggtgtgatgttccttgggctggttagtctgaggaccagaggtcgtaggtggatctttctcacagagcaaggagcaggaggacaggggatagatctcccaagggaggtcccctgatccgagtgatggcaccaaatttcatgcgcgtccgtgtgaagagaccaccaaacaggctttgtgtgagcaataaaactttttaatcacctggatgcaggcgggctgagtccaaaaagagtcagcaaagggagacaggggtggggccgttttataagatttgggtaggtaaaggaaaattacagtcaaatggggggtggttttctggcgggcaggagtgggagtcacaaggtgctcagtggggaagctttttgagccaggatgagccagggaaaggaatttcacaaggtaatgtcatcagttaaggcaaggaccggccattttcacttcttttgtggtggaatgtcatcagttaaggcaggaacaggccattttcacttcttttgtgatttttcagttacttcaggccttctggatgtatacgtgcaggtcacaggggatatgatggcttagcttgggctcagaggcctgacaacaacgatcttgtagataggtactgttgtaattcccagtttacaaataagaagactaaggtatagagagattgagtaatttgcccaaagcccacagctagtaagaagccaagattcaaacccaggtaatatggctgcagacctggtaatcctaaccattacattaggctgactctcgatagttaacttatttaagctagtgttaatcacatcttaacaagtttgagtaataaaatcttaggttgaaaggggccttcaagatctagtctaaatcctttcaggagttcttccacatttctgctagaaaacactttggcctaggcttaaaacttagtgatggggaactcctcactttgtaaagcagcctgttcagttcacaaacaccctaataattaggctgttatctcttgcattgagctgaagttgatcttcccataacctctgcctttctgtctatatgtatgctttggaaatatacacagtaagtgtaaaccctcttggcaaagacagcccttcaaatacttgggaggcattcaattccccccgccacctcccgctctactctcactaccaagtctttagaatagagtacaggtatcaaaatcaaaacaaacagggagtagaaacttagtgccagactttaagtattttttacttataaaatctttttgtgtaacgagtagagcaactcctaactgcatatatgtactaagtttgcaaatggggcaatttgtttttccccatgcactggcatcagaggtggtaaatgctggcctgtcagattcaatgcattttgctgggttagaaccgcaagggctttccaggggaccaagctctctctgctgtaatcattaaaacctgcagaatcctgtgtgactctggggagaagcccagtgctcttggccctcatccaccctcactaggaaagctgcttaaaactaggacagaagaaacaaccactggcttaggatcagtcctcagacctgccttggcactaccccttttattccaaattttgcagtggcacctccaacttcttggtcacgttttgtaccttgtctgtttcctcatataacttcattccaaattccaacccatgctctgacatttcctctccattcttgctagacaggaatttctggatattggatattggcccctgcccataccctgactctgtatattcttttgtcctgctgaccagtttgagcttctgaataacaaaaactccccaaccactttaaagtcctctactttagcttgatgggtccctctcctgtattttctgaccttgactctgctctctgtacaaatagtaattacactcacccccaagcagagaatctgtgtcaaaatccatcaggatatctaagcacatcattatatctgtcaacttccccagactcctgatctcaatcccttattttcaacaacctggcaccgacagagtataatttcttttgtatcatgatgcagtttgatgtgcttttcgaaaggttatggtggtgattttaaagagatctgttttgttagaggaaggaaggaaaatagtgctgtttgcttccatgcagttcctcagagcctatgccagggtgatttcagctcatgagagaatctaaagtctaaagagatgtgtggagattagaaacattggtgtaaaaaatcagattacggagacgtaatatccagggtgtcagaggaggcagggagcttcaatcatgtttgaaactataggtcccacccaacaggatgagaaaatacaggagaagccagaaaaggtacctgcttgtgggtaaaatcaattaaatggaatcaatggtatggtagccatcatttctttcttttcaaattgtggtaaaaacacataatgtaaaatttaccattttaaccattttttagagtatagttcagtaatgttaagtatattcatgttgtcatgtagtggacttgcagaactttttcaccttgcaaatctgaaactgtacccattaaaccacttctcatttcctcctttcccccagcccctggcagccatctttctactttccgtctctatgcatttgactattctaggaacatcatgtaagcggaattatacagtatttgttcctttttggactggcttatttcacgtagcataatgtcctcaagtatcacctattagctgtcattgcttgaacacggttttctgccaagcacatgatctcgttttattcccagcacaactctcaataacaactgtgtaccttttttccctttcacagattaggaataaaaggctctccaagactaggctcagaagcagaagcagttggagagttgcttgcagaaggattattgtcatactgggaagtgctctcaggatttacacctctaagaaactgaaaggggcatgactgcgcagaggaaaagctggttcaccatgcagttgcaattatggctgcagcaggagcatgcagggaagctctggagtaggtttggcctttcagagttgtccccagtaaatcaaatgggtgaagactttaacccatttatgctggaggttgcaaaaatgttttgtgaaaagtcagaccttggcgatgaccttgagcagtaggatataaaaaactcccacaagcttagcgtcccaataatggaacactaggcataaatgagttaatccctgcatcagccagtcattggccctaggtctctccctgagggaggggatgtagctgtgtgaggcagttccctgagggcacattccaatgaaggccccagctgtgagccagcagccaataaggcagcaggtggcccatgcatgcaaaggccctaaagaggaggtccagggtggagcgccacggtgtctactacagatgctgaaagagtaaatacattttatttatttatttatttattttattatactttaagttttagggtacatgtgcacaatgtgcaggttagttacatgtgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggtcttttgtccatgtgatagtttactgagaatgatgatttccaatttcatccatgtccctacaaaggacatgaactcatcattttttatggctgcatagtattccatggtgcgtatgtgccacattttcttaatccagcctatcattgttggacatttgggttggttccaagtctttgctgttgtgaatagtgccacaataaacgtacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgaccgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccactttttgatggggttgtttgtttttttcttgtacatttgtttgagttcattgtagattctggatattagccctttgtcagatgagcaggttgcgaaaatttttctcccattttgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctgaatggtaatgcctaggttttcttctagagtttttgtggttttaggtctaacatttaagtctttaatccatcttgaattaattttcgtataaggtgtaaggaagggatccagtttcagctttctacatatggctagccagttttcccagcaccatttattaaatagggaatcctttccccattgcttgtttttctcaggtttgtcaaagatcagatggttgtagatatgcggcattatttctgagggctctgttctgttccattgatctatgtctctgttttggtaccagtaccatgctgttttgcttcctgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaatttccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgcacattgcttttgtatcctgagactttgctgaagttgcttatcagcttaaggagatttggggttgagacgatggggttttctagatatacaatcatgtcatctgcaaacagggacaatttgacttcctcttttcctaattgaataccctttatttccttctcctgcctgattgccctggccagaacttccaacactatgttgaataggagtggtaagagagggcatccctgtcttgtgccagttttcagagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttgtaaatacattttttaaggtcacacaaatgacatatgggacagaacagtgtttaacttcaaaactcatgttctttctgctatactgggccttctctccgaaagaggcctaatttgcacactacagtcaagcttagaatctattcatagttaaaatgtggagtcaaagcccaggaactatgtccttcaattcatctttcattacttacctattccttatcattcccgctgacaccaaccattttttctgacccttgtcatgaggagtgaagttgtatcattgcagcagctttctacttgtactctatgcctaaaatctctccttcctccatctggtcagccaattgctgtcaagttaatcttgcaagaacactacttttgccagtttaatttcgcaaaactcctgctgtgtgccaggagtgtcccagacatcaggtagtctaagataagcgatagtctctgcccctaagccgtttgcaacctttggagagacaacgtcattatcaccaccagcacccccattaagctcagagctaatatatgccagatgagactctgccagtcactgtgctaaggacttgacatacgttatctcccttaattctaacaactactttctgaggtacctctgatgagtagtatcatttttagatacaaaagcagaaacttagcgagttaagtgctttgcccagtggctctcagttgagaaacgaggtagtcacaccaggcagtccaacttcagtacctgagttcttaatcatcatgtttacaactttggctcaacattgtcaccaagatcgggttcaaatacatccattatcaatattctttctgtctccttgtatgtccaaacaaacaaaacaaatgcttccctcctgatgaggaaagtctccaaatcttgatacctgctgtgtctggacagtttttcctgctatttgctgagtgctggaaggattccctcaatccagatgtgattgcagatccagctcaagctcagcgtcctccagggaacctttgaactaaccacccagaaacgagcctttcaccggacactactcattttcacatatctagatcttatttccccatctgaactgtaagtgtcttaagagctgattttgttgttttttaataaaaaataattcttagttttttttcttattaccaaaaaattattcgccattgaagccttctgaatttttaataagaaaactattggtatattgcttcaaaaagaaatctaagcttctagattcttgaaaagggatagtgacagaaccttagaattaatattcaatataactaatctgatgaaaattcagtcattgatacattactgagaactactagatctcagcatttttaattgtagattcacatggagttgtaagaaattatacacggactccacatacctttttaccgagtttcctctaatggtacacctgcaaaactctagttcaatgtcacaaccaggattttgacgtcaatattgtcagtatacagaacattttcatcactacaaagatccctcctattggccttttatagccacacccacttccctgccccccctacctcctacttccagcaactactagtctgttttccatttctttaattttgttatttcaataatgttatatgaatggaaccatacagtatgtaatattttgggatggacttgactcactcaacataattccctagagatttctctttttatatgcagcaagacttgtttcctttttatcgtgagttgtatgctatggtttggatataccctagtttatttaatcactcaccccttgaagacatctgagttatctgtagttttggactattgtgaataaagctaccaacattaatgtacaggtttttgtgtgaacataagtttttatttccctgagataaatgctgaagagtgcaattgttaggtcatatggtagttgaatgtttagttttaaaactgccaaacttttccgaagcgtctgtactattttatattccaccagcaatgtatgagtgatccagtttctctgcatcttcaccaacatttggtgttgtcattattttttatttttagccattctgatatgtgtgtaggaatatctcattgtgcttttaatttacgtttccctcgtggcaaatgctgttgaacaacttttcctgtacttgtttgccatatgtatatcctcctcattgaaatgtctgttcatgtcttttgtctattttctaattcaaaagtttttttatagttcggttttgagagttctttctgtatcagatactagtcctttcttgtgtatagggttttcaaatgttttctctctcatcttttcatcttcttaacaggggatgaaaaagaattttaattttggcgaggttgaatttatcgctttttccttttatggatcatgcttttgtgttgagtctaagaatactttgcctagccctggatcccaaagattttctcctgttcttttttttttttttttttgagacggagcctcgctctgtcgcccagcttggagtgcagtggcccgatcttggctcactgcaagttccgcctcccgggttcacgccattctcctgcctcagcctcccgagtagctgggactacaggcctccaccaccacacccagctaattttttgtatttttagtagagacggggtttcaccattttggctctcctgttttatatgtcttatagttttacattttatgtttaagtctgtgatccatttgatttttatataaagtatgaggtttaagttgaggtttattttttgcatatggatgttcaattgctctagcataattatttgaaatggctggcttgattattgaagtaaggtcagacttatttctctcctgggcttcagacccagccaccttctatgtttcttgtccaccacaacctgaatgtcccacagacacctcagacttaacatgtccccagcagctcattattatcctccttttgtcccaatccaccctcaacatttttccctccctaattgtgctgttcttatgaacgctacgcttcacccaattgcccaagtcaaaaattagggtattatttctgaatctacttttatctttaaatctaacatgatgcattgccaaattctgtcagctctatccccaagccatctcttaattcattcccttatttacacctcccttgactccaatatcttttgactcaaatgctacatagcctctaatttatctccctgatattgttcttgcttccgaatcccttttccacaatgcgcctatagtaatcctcctaaaatgcagatctgattaggtgactctccttattttaaagtctttcttattgttttctcctgccctaaggcagaagttccaacaaatcttgttatcagattctggattaaatcccggcctcagcagtgggacctaagatagtgcctgaatttccatgaacatttattgatgacaaagagggtcttaaataatgagtgatgtagactttccactgtcaacatcacagattctggtttttaatggtattcacatttgccttctccaagagtccaggtttaatgatggtgagacctatcctaagacctggctttgtagtgaggggttacctcatcacagaatcaagaagggacctcgggccgggcatggtggctcatgcctgtaataccagtactttgggaggttgaggtgggcagatcacctgaggtcaggagttccagaccagcctggccaacatggtgaaaccctgtctctactaaaaatacaaaaattagctgggcttggtggcacacacctgtaatcccagctacttgggaggctgagacaggagaatctcttgaacccgggaggcagaggctgcactgagccgagattgcaccactgcactccagcctgggcgacagagcaagactctgtctcaaaaaaaaaagggcggggggacctgggtgcaagtaattctaagaagcaggaataagagaacaagaagaatgaagcgacaaagaaagatgagcaattctctggaactgttgagaagtgtacagaagaaaacaaatctggatataggtagctacagcctgaaatatggaaagccagagcatgtgtatacctgctcctgctcccactggttgagaattgattcctttttcatctgatatgggcaagcattggatctgagtgggacacatcctctccagtgcacccctgccttttccgctgctctgaacttcacacaacgtcggaaagattcaaaacaatgtagaaaatctaagtataaatacaaaaaggaaacaagaagtttttctatcaaagctgtgaactatatgatatgagtaagctcaataaacactgtgcagaagttgggaggggaaaaagagaattgctgccaaagcactaacccctgtggctggctatgcttgcccacccaggaagctcccatgtcatgggggtcaggggaacctagaacagaaagctgaaaggctcagggatcccttttgagaagggatgctggctatacagcacgagttagaacttgcacagaaccgtccactactgctgacactggaatcacaggtgggctgacaagatgtgatgcaagcaccagacatatttgctacaaacctcaaagtggagcagagcagcggcagtgtcagtcttcttggtgtcaatagaatacctgtttatttgttgaattctccctatatgaataataataatacaagaattcaaagcaggataggctttgtgtcattggaggagtatggagaaccatcagtgcagtaagtgtcgtgggaggtttctagacagtttttaaaagtcgatattgagtcaaccatcaaatgtgaacaattctgatatgccagagcatttgtattcttaactcatggggttattacaaagatcaaatgaaataatcattataaagcactttgtgcagtgcctggcacaaagcacgcactcaatacatgttaatgtttatacaattattattattgattgtcagaattatcagccccacatcagcaaagaatagtaggtggtctgtcagcaggaacatggaaacattctcattacatagaagtcagtgttgcagggacagtcattaaaacaggatctaattttagtcttctgagggaaaatgctaggttctccggaaatgttgaatccttcctcgagcatgtagtttaatttttcaaaattatattgcatatcctgtaaaatgaaaatgaaattgtactgctgttcattaaaggcccccaaaaatcttaggcactatacaatataaatgaaaaaaaaggcgttatttttccatagggcataattagaaataaagaagcaaggtcactcacaaatttccgagctataaaggaggaaaggaacaagattttcccccggttattttatagctgccaggttgaactcatacttatccaatgagccccagaatggaataccgttctacaccaactgtactgatgatagtgattcagggagtaaatgataagattccatccttctaaagtgcttttgggattggattctagtaagtttcattttgctattggccaatcacaaaagagactacaatagagaaaagtgaagacatcatgctgaagacagactgctgcatagaaaaggaagagggaccccctaatttagagatatggatggagaaaaaaaggcacttatgctgtagcataagggaaacattaaataaagctataatagaggagaaaatgtctttgaatagaagaaaaaaatcagacagacagaaatagactaaaatgctaaaaaaaaagatacaaaaggacattgaaggggacatacagtgattattacacaaattaaatgcacacagttaaaagggaggtgaaaagcttctaaaaagaatgagtgtgtagtgaacttaattttatcatctttactaagacaaagttaaagtccctaaaatattttaagacacttaaaaaaaaaagtcttaaaattttgagagcctttcagctctgtcaactctagactttccctcctacttaagttttttttcttttttttcttttatcttttttatttatttatttttttttttatgttttttttttttttttttttttttttgagagagagagagagtggatcagccttaataagagaatggtcttctgccaggtggtattctcctaatccctttccagtgagatccacaagggttcaaaaccactttctggggtcttagaggcaccacttatctctcttcctctgctcatatctttctgctccagtgcccgcatagtttgtgttatcagtggtgcgtagcctgagacatccacgacctatgccagctctcgaagtaatgtgattggcatccaaagaaacacaagaagcccatgatttcgtccctttgcaatttaaaatcatatttaaaatgccttttggtcatacaaatttgaaaatgatcttgtaaatcacttccgggaatctatggtcaaaactcagcttagagttctctacttcttaacagagtgcctgccggtaactagtgactgtcaatgagtttgaaaacataaattgatgtgcaaatgctagataatagcaacatcctgtgcaactgggcagcatttctgttgtttggcttttttattttcgtggactctcccaatctgagagaaaatagatttgagttcctttttaatcggtttagacccagacaaggatttaattggtttagaccccattcacctacgtgtgtcactctgtctccaacataacagaggagatgaccaagacaacatgctctccagccaggaggtggggaatactttggtgtcatagcagacaattattgatggaaaactcatgttagaaaatgtaaggtaccttcttctagacggagtaaaaggggcagctgcccagactttcattttaaatagggagcccatgatacaaatcttttaatacaattttaaaaagaagagacatagggggtatctcttaggacctgtcaacaaccaaccctctatcaaatggccaaatcacaggtggtctgcagcttagccaaaatgtccaagtacctttttgtaacacagaatctcctttgaagatccagctttcattaatgatccccagcagctctggtcaatgtgtcttttcacaaatgaagctttttaaaagctttcagtggacaaatgtggctttgagttttcaactaaatctttctgtttaaaaggagtgctgaaatgggcatactttataatcttaaatgctgcacacaaaatactgaaatattattgaccctgagaggttggttcaaatcaaatagcatactcacgtaaacgttctcttttcctaatattagcaacagggaatgtgaaatagagaggggcgggatatgctggataggggtgcaccaaaattttcaaaaagcctcgaaactagtgtatattgataaccttgtggcatctaatatctagtattctttttttttttttttttttgagatggggtctcgctctgtcgcccaggctggagtgcagtggtgtgatctcggctcactgcaacctccacctcccgggttcaagtgattctcctgcctcagcctcctgagtagctgggattacaggcgcccgccaccacgcctggctaattttttgtatttttagtacagacggggtttcaccgttagccaggatggcctcgatctcctaatctcgtgatctgcccgcctcggcctcccaaagtgctgggattacatgcgtgagccaccgcacccagcctagtattctatgtctattatttcttcataatgagactgggggaaatctttggagaattaatgccgcagttggtaaaatcattctataataatgggtaccattctgctctgtcccacatttttatgaagtctctttaaatttaaaaaggcaatgtgctttgtggttcttgagcaacttaaatacgttgctctgaatagttattgtgatgaggtaatttgtaacaacttttaggatcaatgctaattttcttaaatgtttctgtagtttcccctttattataaagtatattaggctggactcttggctgtaagtgacagaaaactcaactcagattagttaagaaacaaaagggtgttggtgacagtggtggctttcagactattgctgcaggcccacctgccatcctcttaacaccctcaacataccctgcagaaaagagagagctactctgacccgagagcttaaagactggtcaagtatgggcttgactctttatggcccaaattgggtcacatgcccacctaggctaggggaatggaatcgtggaattgattgattgattattgttgcaggttgagtcctccaagaagcagatgccagggcagatttattgcagaataacacctgtgaagaaataggggtggaagcagaattgaacaagggaagccatcagatcacaatgcagatcttctagactctgtgtcagcacaacaaggaatgccagagcaaagactgccaattagaggaatactgaattgggcagatctgacaatagtctgtatataactcgggactgttaacttctccttcctcaaccagttatagacatagaataggactctcttatctcaaacatcaatatctgtgtatatgaagtagagggtgaaagtttactgtacactagtggttctcaaccaagagcaagtctgtcccccaggggacatggcaatttctggagacattttcagttgtcccaactggtgaggaggtgctactggcatctagtgggtagaagttgtggatgctgctaggcattctctataattcgtgggatagatagcacaacaaaaaattgcccaggccaaaatgtcaataatgctgaagttgagaaaccttgctctataaagatacatgtcttggccgggcacggtggctcacgcctgtaatcccagtactttgggaggccgaggtgggcggatcacgagatcaggagatcaagaccatcctgggcaacatggtgaaactcatctctactaaaaatacaaaaattagccaggcgtggtggtgcatgcctgtagtcccagctactggggaggccgaggcaggagaatcgcttgaacccgggaagcggaagttgcagtgagccgagatggcgccactgcactccagcctggtgacagagcaagactctgtctcaaaaaaaaaaaaaaaaaaaaaaaaaaagatacatgtcttatgtgtactgaaagaggccacggaaaccttttgttgatacattcttgatagtttttgttcttatatgtagttatgaatacttgagattccatccaatttatttaacttttgaccagaaagggtagattgaattggtgaaacatctatatcctgaatatttaaaagattctgttttttaaaacaaatattaacttgaattaacgtaaatattcttagtagttaaagtccttaaagaccttagtttggtgaacagataagaatcatctgtgttcagcatatgcattgccttatgaagatggtaagtcaaaagtatgagtttatttctgatatttaaatatccctgaggtatagatttgtttactctggaagtttactctgttgtttgtttgtttgtttttgtttttgttttttgagacggtgtctcactctgtcacccaggctggagtgcagtggcacgatctcggctcactgcaagctccgcctccggggttcacgccattctcctgcctcaacctcccgagcagctgggactacaggtgcccgccaccatgcccggctaatttaatttttttgtgtttttactagagacggggtttcaccgtgttagccaggatggtctcgatctcctgacctcgtgatccaccagcctcggcctcccgaagtgctgggattacaggcctgagccaccgcacccggccttactctgttgttttatttcttcattatatattacaaagttgaatgttagggccaggttagatcggaaaacaagttaagtattccttatccaaaatgcttgggaccagaagtgttttggattttttatttttgtggattttggaatatttgcatattcctcatgagatatcttgggatgggacccaagcctaaacatgaaattcatttatatttcgtatataccttatacacataccctgaaggaaattttatacaatattttaaatacttttgtgcgtgaaacacaaaagttttgactgtgacctgtcacatgaggtcaggtgtgaaattttccacttgtgacgtcatgtcagtactcaaaaagtttcaaaatttggagcatttccgattactttggaaaagtctagaaaaagtttgatatcagtgcactgaaatcattttcaagtaggaacaatagcgatactagccctttactcatgcaaaattcacagtttttatctaaacaacacaaaatcattcaatgcttttatatttaatcatctatattcacctaaccataaaaaatcaatttcaatacagtaaggaaaagacaagaaaacgaatcattctaatcactgtattttgaaagttctttgcaaacaaccgtgaaatggttaaaagataggaggatggagaccagcctggccaacagggtgaaaccccatctcttctaaaaaatacaaaaattagccgggtgggttggcgcatgcctgtaatcccgggtactcgggaggctgaggcaggagaattgcttgaacctgggaggcaggggttgcaatgagctgagatcatgccactgcactccagactgggcaacagagcaggacgtctcaaaaaaaaaaaaaaaaaaaagatggtaagagaatgatgacttgttgcttactaaaataaaggaaagattgacactataagtgatactgtttgaaatctcaggaatctctgaatcattaagattatatcacaaatggcatgcaaaatacctgttcaaaaaatactcctcatggacatgagatgctaagctgctgatactgagtctgacctaggacaatgatgttctgtgtcacctcttttctgatgcctcccagattgctcctggcctcactgctgtctcacttccaaaaatacatattgcccttattggtcataacacagagactatcagttcaaaagtctctaattcgtctcagctgcagtcatctcccagcaagacacaaggttcttgagaaaagaaatttttcatgtcccatctttgccatccaccacacgatgaacatacagtacagtgtacatagcagcccttgaaaatgctggtggaatcattgattcttgaacccaactgtcatactttccagatttaagtcctggtaaatgattaaaatcgtatgggttaccctcaacaaaccagctcaagtatttactataaaaaagggaagctagatatggaacttcccctaaagatgggtctgtcaaactcaccccattgtattctgctctgacaccatgttttttgtttgtgttatttttttttaagagacagggtctcactatgttgcccaggctggtcttgaactcctgggttcaagtgatcctcccacttcagcctcccaggtcactgtgagagattacaggcttgcaccaccatgcccagccccaccttttaatacaaataagtaacagttaccatttactcagtgctcaccttataacagatgctgttaaacgctttacacgccttagctcatttttagttaaatacattgtttttgccccagctatggtagggatcttgctaacaatgagaatgaatgataagaggggctttaaggagaattcactgccacacctttcataattttcccatcattcctccagtctttgttcaaccgtccatgatttactgatttgctattacatcaaactatgctgcaacaaaccagtggttccttctgatttttatccatctcctcctcacctagggtgagagtctgaggcttccttgagtctactttctgatattgttacatttaacacagaacatctcttgttttcgtttctggcagcttatcctctcttcgctttctccatgctttcattcatcctaaaacaccattctgacaatgatatttaggttggtacataagtaattgtggttttaccattaccttcaatggcaaaaactgcgatcacatttgcaccaacgtaatatttttcttacttaaaaaattaatgtagagtatggaaatacttgccatcagggaatggggaagaaaatggctagagagacatggtgaaagagagacttgatttttaaataactttttttgtttttcttgaattttattatcatgtgaatgcatttgaaagaaatacaattttaaaataattattaaaaaaatatttgaatgccttcccatgaacaactaaatgaagtctctattcttaaacctgacagtcaagtacagctctggtttgactccaagctacatttctagccttgtattattcaactctttttctgtttatccttcatatccgggcctttactagtgccaaaaaaaaaaaaattgctcattctactcttgtcacccagagtgtttcttctgtttttgcccatcaaaagcttacccaattgtgaaggcccagtttcaaagcaacctccttcattaatttcatccagatactctgtaacccccatagctgtttaggcttgttctagcaatttgcagttatcagaaaaatgagtacataccgagtgccagaaagtggtctctccaactgtgcacattacaacatctcattctctgtgcctccatttcctcatctgtaaaatggtcactatggtgtactttcctcatagtgatgttcattctttcaagtagttagttaggtacctactatgagacaggcactgacctgggtcctgggggtacagtaatgaataaaatagattgagtcctgccctcatcaaatttaccttctgataagaaagacataaatgaaatatacctataatgctcttgaaatagcacttgggatatagtaaatgctctataaatgtttgctattattactgtcattgttggtagtgttgttatgtggtatttctattaacacataaagaaactaaggttcacaggctgttagataagatgctggttaaatagctagtaagggactccaactcaggtcttcctgagtcataaaattcgtggcatttccactacactgatggatgtataccaggctgtacatcagaactatctgtggagacttaaagaaagtaaagattctcaagcctcagcctcaaattaactaaatcagaaattatttagacgagctaagaatctgtatttttttgaaaagttctcaaatagttgtgatacactgtcaaattggggaatgactgcactacattaaaatctttcccataatactttattatgcttatttgtaaatatcaaatctacaaattcactaaagaccatccccttgttttcttatttatttttattttttctgcttcctctcctagcaaagtgccttataaacactcaataagtatttgagtaattaatggcttaattatttaaagttgcacttaaaatgcaaatactcacagctgtggtactggaagcctgttatgaacaatcatttatcttcctagggttatttactaatcagctaaggacaagcagttgggaaagaaaggctgactatttgggaacagaactgagaaggccctcaaaccaaatgttagccacgttattgaacagcctagggccccgccttaactttacctacacttcgttgacaatttcaggtaaaatgcagaaaatatacgctaacaatcaggagattcctccctcacaccattgtagtttcatttcttttaagccgacacatgtctctcttatggaaaatatgggaacaacctgttttaaagaaagaaaaagaatcctttattcttgtcacaccacaaacatggagttcactgctatacgttaagattataaagcaaaatcccaaaaacgcagtgactgattattcacagtagacatatgaagtcaggaagcttattttttctctctttgctaaggcacaaagcctggggctatatgcatttttattacactgtactgtgttgatttcacttgaggattaaaaagagagttgaggcacagtgcacgtatcttgatggattttaggatttcttgctttcgtgaaagaaagaagcttataaagtacctcagattatcgcccagggaagtgtacctacttccatgatgacctagaaattcaatcttttgtttctcctataaaagatcacattgtactttggatgttttccctgtagttttctgcactatgtaaagccacatttggaaaaacaaaatagttttagtttagagttgaagtgaaaatatctgaaatagttcaggaaagtcttatgagcatttggggagcttacaaacagccttgggggtggggtgagggggaatgagggaagagggaggcagggggagagaagaggagggctaggtcagaagtgtgcaaagaagacagagggagagagaccgtagagactgtgagtccatggcagagttttaattctggttctcacacatctacacagagaaacaatggaagcacattgctccatcccctgtcctttactaagaagcgtgaagtaaataacttgtggcttatgatatgcgaagaagagagaagacagaatgttgtaggatttggaagtacagtagatgagatcttccggtttattgatttgtaaagaacggcttgatactggtttgtcagttctgcatcagtgagagaaaagaaaggcgcttttcagtcacttgccagaggaggagagccgggaagtggaaacagggtcttctggcggacaagcttccttgagtggtggtcaaattgactgtgaagggagtcaaggtcaggaagctttggaaatgctgcaaggatggtacgggatttaaggagggttgatttcctcggttaagggttgttgcagacttcagcaaattcccccttccagcctttattaaagaagtgtttagtagaacaaactgaaaatctacaagtatattgttacccaaaatataaaagcttctgccactgagatgaaaatgtttgatttccagtgctttatctttttgcatttatctacctgtttcagtcattcgttaatatgaatttcctaatatatgccgtcttttttttttttttcggacaataccagttctatggtatctcactgatgattatttcaaattgccacttttgttccttggaaatactcctgtgttcaaataccaggaggcataattatgtaattaccatgtgaacattatgctacttatgggccaaaatgcccctagaaaggaatgctccaatggcctcagaaaatttctgtgagaacgatatcttccaaatgtggtataaataaagctcaagaataaatagctaaggctggaatgtaaatgatttaatgtaatgatgttgtaaggtgagagccacttgactttagttcctgttgcaaatcatgagatacattaggaaaacttttaaaagggaacctattttttaagataaaatctgtatcaagttacatcaccttccaggcaaagtaattcaactttcctcttttctctctgagaccaaaaaaaaaaaaaaaaaaaaaggcagaagaaatgcttcctatgatctcttctcttcctgtcacaattttcataagtctgtagatgtaattaaaactaaagattttgacaaatgaaacaggataggaggttgattgctgcttttctaaattaaaatgaatgatacccttaaggtacttgggtctatgaagtcaatttaatgttgatataacctgactccattatcacagaatgaggcagttgcataagcaagaaaaccaataaacaaacatccaaagtgcattttagaaatcggtgaggtgaaagattaaaggcttaacaacggacaaagagcttgctgttttgttctctcttgccttccagtttgatggcagagttcatcagaattagaggaagaatgttcttggagaagcgttgggctggcactaggctaggagtcctattcatatcctgcctcgcttgtcttgcaagcatgcacagccccttcatttgaggcactgtttgcctcagcagagtctgtgtactcttctggtaggttgtatagaacataataaagggggagggctggaggagaaaggacagaaaaaggagggaataaaaaaaggagtcagattaagaaagaagtcagcacagaaatataaaatggaaggaaaaaaagctgtgatgcaggaaccttaaaaggtagattaaggatggtctcagatggcacggcattagtatcaatgccataagtcacacaaaatctattaagaattatgctcctactcagagtgagtgccatgttagcactagttgtttcccgtgatctatcctgaagtcaaacgcaagaaacactgtttaactcctaagtgccctaatgtcaggaaaacacagaaataaactcaaaggaaagacaattcagttaatctttgcattcaacaagcccaggttgttttgccgcagagctatacctatcacaaaacttcattccagaagatggccggtagaggtggctcatgcctgtaatcccagcactctgggaggcccaggagagtttgaaatcaagaccagaacttatctcagactttttttttttttattattttttcagttacaactcaaaagaatcagaattagaataataatggattttaactgaaagggattaccattagttaaaaggattttaactgaaactgtaatcagtctcaggagcgtttcccggataatgtttgggcacgtatttatgagtgttacttgtgaggatttgggagtaagaatgaacgaggaagttcctcccccaacacagacacatgcacacagaaactgtacaaactgaaaaacttcaggacaaaaactcgtgaatagactggagagtcatttgtgtgcatatgtgtggtttatttactagcatcacagcacaagagtttctgtcttttgcttttgtttttgttttaataggctcatttgtgtaagtgtcatgtctgtttcttgcattcccatggatatttatctagggtctagacaaactgagaaccagaaaatcaaaacatacgttcctagttacatattttctctagactggagtaaacatgatttatgtatgtagtaatcagtaagatgtagcttggacactaggaagaaaccacattgcctagcagtgtatttccacatggggaggtaatgcctgtctctcctaaacttctagtgaagataaaactcaaagtagagtaattaacagaaaggtcaaaagacaaagtggaagcccttgagaatctaaaacaaagttaaagaaccaacatttacatttagataaatttatttgaaataatttctaagagccatgatgttgttatcggtcctttttctttctttcttttattcttttggcttatttaaaagcaatgttgaagaaaaaatgaaataaagcttatctttcacaatacacagaggaatggactgagctttgggaaacagtcacagcttggaattaagagtgtgtgtcgtatcgtaatttagttggatgatttggtgctcattcattatacccagaattacgctttcaagtctaccgtattcatacttatctcagtgcctgacaaataagaggaactcaaaaagcctttcattcattcatccattcagtatttcttgatcatcttctatgtactaggcattgtgataaattcttaacaagacagataagatctctgtctttgtggacaataaacttacattctagtcaatatcttttgaatgaatgtagtgatatttcttactgaagctaagaaaggaaggtctctgcaaacagtatactgtctacagaactcatctgaaatgagaagaccaaggagaataatatatagccctcataactctcaaatcttaaatatgattatttaaaaactagagtaaaacaaatgtggaggagatttggacttcagggttgttttataaattgccgttttacatttttaaatctagtattataggcaaaattgaatctaaatggttttcttcttttcttttttttactttcatcatcaaaaatggaagaaaggaagaaaaggaggaaggaagaaaagaaggaaaggaagaagggagggagggaagtttttcaaaagcttgtgtcagggatcttgaaaaagaaatgattcattcaaaatatagttgttaatagtaaagatccgtgaataaacagtacattaattcattcaactaatattaatttagcacctattatatgccaggtactgtgctactcactgaggatttagcagggaaagatgtgtccctgtcctcatggaacatataaaaaaggacctttttttcctgagatgcttttactgaagaattgctgcaacctagattatgagttctcatggaccagatggcagttttctgcccatctgggatagttctgaagaatagaccctcgtgtatcaatcaaggtttcttccagttctaagctttcgtgatctatgatctaatagttgaaacaggatgtatgcttccaaaaagatgttatatttgtattacttttataaaaggaaacagagacatgccctattaattcagaagagattgggttcctcctggctgtttaaatcattctatttaaactcctttatctcttctttcttggctcaccttccaaagctcactcttaccccttttagtctcacttccctttcctttctttaattgctgagacaaattgttcatctctaactggctatacatgacatctccagttaaatgtttcactgttaggacaaattcattatgttccaaatgaattcatacatacatatgctatttcttccttttctgattttcatattgccaccagcaatatcttcattctcccagtcttccttactcgaaatccaagagtttatttgcttcttcagatattaatctccaacaccaaattggatagttcttcctcctttcaaaataccttctcatatgtaccttcttttacattgaatacaatacagccttaattctaatgcatatcaacccaagtctagtaagttacaacagcctctttctgatctcagtctcaggtgccctttcgaatctgttttacactatactgatcttcccaaaccctaactttcctctaaaatagtgagtcatgtcacagaaattttcagtggttctctttgcctgcagggtaaatcttgagcctcagagtctgggacgccttgctttgcatcatcggctttcaacatgactaactaattgtatctcactgtcgtcctcaacaccactgttctgcagccccaagcctttcttcagcttgtcactacttcttacctccaaacctttacacttgcagagatcagggactatagcatttgttttttgcctatctctttcaatattaacaaatacttataaaatgaataaaccaccaaggaaagaactgattgtgccagaacataagacacaggtatatcatttctggcttttgcttcctgttttgtatataccacggtatattgatttaacatacagccagttagaaagatctaatgcatggaggctctcgtttaatagattatcaaatttcatttccttgcataattgctcaaagaataaagtgctttgttcctaagtcccaagctaaagctttcgaggactttggttgctttcaagtttttctcattcataaatttgtttctttatttagccagttgtgcattcaatccacacaaaacctttctccagtgataatttgtggaaagaaatattttatgcttaattcttctcgctgtcataccttctcttaagtttgagttatgaagatggaaattcactttgatctcattttaaaatcttgacaatattgaatgtacactggaaactaccactggagcgctccttgtataagaaggcaaaattcttcagagagaagattgggagtctagaatgaactttgatgctgcatcggctcagtccctatgaaactaacattcttactagagaaagtggcctatggcacagtcataatcctttaccatctacatcttccccttgggatttctttctcagtatgtgcaaagatttctgatcagtgtccactcccatatggcatcttcatcttctcctctctacccccaaacactcacatttatctctagattgatttattcatgaaatgacccattctaaatttagaaataatgacatatgcccaacatttatttgcacgcgttttcccacaacctttctctataatcttatggtatcacattcttcaagaccaggaattgaccttgcattgggccataaaatacgttgaacaactgcagtttcatcgatatgcacactagaattggtctgcattcaataaactgattaaagaaattaaaaagccaattacttattaaatatttataaaatactttttttcaactttaatcttcaggatagcagttaagagcaagacccagactgaatgagtttgaatcctagctctgccaatttactaactactgaagcttaggcaagttttttttttttaacctctcatgcctcagtttttatgtcaatgaagtcggggggaataatattaactcctattgcagagttactgtgaagatgaaataacataattcatattgtcatgccacatattgcttaataaacattagccatttttgtattgtatgtggtgccctgcacattatagtctattgctctccttttttgctttttttttttttttttttgagatggagtcttgttctgttacctaggctggagtgtagtgacacgatctcggcgcactgcaacctccacctctcagattcaagtgattctcctgtctcagcttcccgagtagctgggattacagatgcccaccaccacaccaagctaatttttgtatttttagtagagactgcgtttcatcatgttggccagaccggtctcgaactcctgacctcaagtgatccgcctgcctcggcctcccaaagtgctgggattacaggtgtgagtcaccatgcctggcctattcctctccttttattaaccataatagtagcaagaacagtagctggtaacatttattgagcaattaccacgtgacagaaactaggctaaatgctttacattgtatcatcttatttaattcccacaaaaccctataagttatattattttccacattttactgataaggaaagttaagaataatttacccagggacattgattagtcaaggttctccagagaaatagaagcaacaatatacatatgtatgtatgtatgtatatgtgtgtgtgtgtgtgtgtgtatatatgtatgtctatgtgtgtgtgaatatataaaattaagtattatctcatgcagttggagactaagaagtcccatgacctgctatctgcaagctagagagccaggaaaattggtagtgtgatttcagtcccagtctgaaggcctgagaaccaggggagttgatgatgtaaatcccagtgcaagtgcaggagaagactgacatcccagctcaagcaggcctgcagggaaaaaaggaacatgcctttttgttctgtttaggacctcaactgacaggatgatgcccgcccacattggggagggcaatctactgaatccactgaaccaaatgctaatcttgtctgcaaaacaccctcacagacacacccagaaatagtggtttacctgggcaccccatagtccagtcaacttgacacatagaattaaccattacagacctgcagtcagtgcactcagtgtcagtaggcatacttgtttgttccgcatcgcttctcttctcttctctctctctctctctctctctctctcacacacacacacacacacacacacacacacacacacacacgtaccacatttactcatttactcatccatttgtttggtcaactagtcattaaacaaatatttgctaccatatactatgtgcctcctgcagaaagggttggagacattcgaagagaaaggtaaacaaaaaatggtccctgctatcaagaagtttccaatctattgcaagacacactcatgtccatataactaaaatgaattatatgatagaagtgcttcaggtataaaccatatactgttagaatgctgaggaagccattaattctaacctgggagatgaggaagtaaacatataaacactaacagcattgatctgggagagaagtggggtaagagcattgccgagagaaggagcagcatgaagaagccacgcacaagagttatattggatggaatagtgcaggacaggcaggtagttttggtgggcttagcaggtagagtttgggagtgcagggtcataaggttgggaaggtaggtttgatatgtccctcatgcttttgtgtatataaaataaagtaaatcctgcattgtaggggaaccccacttggttatccacgtatttgggccaagcaaaaatgggcaagtctagggagagagtgaaaaaatgagattgttctggatatacactaggcacttaattgatattggaaggccagagttggtttgagaccaggctacctgagccacttttctgatgagattaacatcgatttttacctctcgggaattctgcacaccacgggaactaccccctgagttctgattgctctgtgcaagctctgatcaacccctagtttagcatggactgttcacaactaaatcaaaatccagagttagagagctaggatgcctggagccaccacttatattggattggcaaaatgccaaataagtaagtatagcatgtcacccgtaaaattattcctttcttccccaccaagaatagaactcactaagttgacagcacactgtgtcaatatattatagaaaaacctaataggaagaaaagaatggcagttttcactgcatgccccctaaaggtatatttcttaataatttccaagtccactgaaaactgaattccgaaaattagttttatcttactacccaccctattttatcccaaatttaagccttgcctgtacttctttgatacttaatatttttttctttgaggtggagtttcactctgtcacccaggctggagtacagtggcgtgatctctgctcactgcagcctccctcctgcctcagcctccctaggagctgggactacaggcatgcgccaccacacctgactaatttttgtatttctagtagagacgggttttcaccatgttggccaggctggcctcgaacttatgacctcaagtgatccagccaacttggcctcccaaagtgctgggattacaggcatgagtcactgtgcccagcccataattaaatattaatcaaccactggttaattaataattatcaataattaaatatcactcaatgatttattatctattaatcaatattgcttctttaaaaatttgtcaaaaacaatagcctaagacttaaagacaagacatgtcatttctgagattctgtagtcacctataccaaatgtcaccctccctaatgtttttgtgaaagtaaagatttgtatttttttatggtactaattgaagcagtagttcatttgtggctgccaatgagttgactgtaaaaaaaaaccaaaatctcattttaacattgtcgagagaggaaatcctttgtgtttggccttggattgataaaaacgagtctggaatactatatacggtaagtgaatattaaaactagagttatgaaatgttgctttagtgttctcagtcttggagactcaaagtatcttatcagaaaggatacattgttttaattgttcctcattatatagaatgagagaacatcatttctctccttttcctcccaggtggccgtcgaggaccgagtcaggcagctgcatgaagcccacagggactttggtccagcatctcagcactttctttccagtaagtcattttcagcttttatcacttaactttattgcatcttgattaataagaataacagttgaaaaaacaaaagaattaagagttgaattatagtaatcttttatcagatgcagtagaagcataaatcatcctgaaatataacttggttgataagttgagaaggttaggaagaggaaggccaattggatcattttgtccagtcttcagctaatgcataattgtttcctgcactatattctcaaatgttaaccatattaatatttttgagtctttttgaaaaatgtggaacactttgctcaggagccatgctagtattctctgtatcattattccaatgttagtatatgggctgctgaagcaaaaacatacttttgagtttttaatttctgcctatcagttcagttcataaagctaataattatgatatcatgtaattataatatgatcatccaatatatgttactgtgactctataattctttaaataattcattaaatgatccctgccttatgaaatgagtgacaattctcaaaagaaggcatacaaatggccaacaggtatatgaaaaaatgctcaacatcactaatcaccagggaaatgcaaatcaagaccacatgatatatcgtcttaccccaattagaatggctattattcaaaagacaaaaaataacagattctggtgagaatgtgaagaaagggaactcttttacagtgttgatgaaaatgtaacagtaaattagtaacagtatgaagattctcaacaaactgtaaatagaactaccttaccatctggcaatcccactactggttatccatcccaaagctaagaaatcagtatatcaaaagggtacctgcacttgcatgcttatcacagcactgtttaaaacagcaaagatgtgaaatcaacctaagtgtatatcaacagatgaatggataaagaatatgtggtatctgtacacaatgaaacactgcaagaatgaaaccatgtcattcacagcaacatggatggaactggaggtcattatgttaagtgaaataaccctggcacagaaagacaaaaatcgcatgttcttactcttgtgggagctaaaaaaattgataataaacatagaatagaatgatagatactagtggctgggaaaggtgtgtgggtagagggggagataaagagagggtggttaatgggtacaaacatccagttagatagaaggactacgttatatcatttgacagcagaatagagtgactgtagttaacaacgatgtgttgtatatttcaaagtaccaagaagaaagggcttgaattgttcccaatacatagacaaatgacaaatactcaaagtaatggatgcctcaaataccctgacttgatcattatgcattctatgccagtaaaatatcacattacctcataaatatgtaaaatattatatatcaataataaataaatactatgcctccaagttgaaacctcagcctatgggcatttcctttccctaactgtttgcatccttcctttttttttttttttttttttttttttttttttttgagagggagcctcattctgtcacccaggctgtgagtgcagtggcgtgatcttggctcactgcaacctccgcctcccgggttcaaactattctcctgcctcagcctcccgagtagctgggactacaggtgtacaccaccaggcccagataatttttgtatttttttagtagagacgaggcttcaccacattggtcaggctggtctcgagctcctgacctcaagtgatccactcgccttggcctcccaaagtgctaggattacattcgtgagccttgtattctccttttgttcttgacctctagccattctttttatttactggttttgctattttattaattatgtttttataattaatactaagagaaataaccttggttaactgaaagtttaagtattagaaaatcctatttatacaatattgcatattaaattggcaagcacctgttttcctctgattaatgttaatttataccactttttatttgattataaaagtatatgtgttgagttttttggtatttaaaaagccatactttaccacatggagttaacatctgttagcattctgatgtatttccttgtggtcatatatgagtatatatgagggtttatccatcattttaacgcaattactttgtgcctagaaatgttacagattttaactagtttaatccttatagcaatcccttcaatcccttaaggtaggtaccattattatacccatttcaatgatgaagaaactgaggcacacattcatacagctagtagatgagggagccaggattgaaactcaagaagttggctccagagtctgtgtttttaagcatcgcactgtaattttacttaatttatatattttatagagaggaagtaattctgtatgatctccattcttctgccatattctttcattgccattttctgatcatttcctttcttttccattctccacgggttaataaaaagatccacgctcacaaatactttaaagtatttgagtagatgttgtcatgtgtgtctccagttggctgttgtctttttgaacaaaatttcctggaaggtgttggtcctgtgtttttgtcatacatcgataatagattaagaagaagtatcttattttctggactggctctaactttattatccgcatgtggtctagttatttggacacagtttcacaatgctttggagttgccaagaaaaagggataagttaaagcagtttatctaaatgagtgggatcgtggcttttaggaacggctctagaaaaatgataaaggctacagatttcgtcttctgcatctttccaaatctctggtctacttaacttgccttggtgacagccattctattcgatttaattgagattaaatgtgataacatactcctaagcgactcataaaccataaataaaaaatagtactattatgaatattaattactcctcagacaccaggtatattcattcatattttcttctccctgactccccctctgaattcccatgtcttacccattaaaacctattttcagaaaatgatatactcatttaacccaagtgataggtaaagtttaatgtgtacttctcctgggttatttgcattttattagtgtgaaaatccataagcctgaggtggtagaacatcggccataagctctgagctgtgaggaaggaactttgaggggccaaggggagcattctcacacctttcaaaccatatcacatcagtgcccacttccagaaaggtcaggcctgttagacacaggtattcataaagagactgatctacctgcctgaatggagccagccccggaagtcatcagtctcttggatgcccatgtggaatatcaatatacgcttaaaagctttgcttgcaggtataaagaaaataccaacttggtttaagggatatttaagaaataggacggtgagactaaggatggattgtttctttacattgtactttttaaaattacaaaggtactctatacacatcaagaaaaatttggaaagcccacagtacaaacaagaaaagaaaaagtatccataatcctatgactcagagataatcactatcagaaatttggtttatatactttctgtatttctcttgtggttgcgtgtgtgtgtgtgtgtgtgtatcaaggttctatcttttatttttttatttttttgttttttgagacagagtgcaatctcagctcactgcaacctcccccgtcctgggttctagcgattctcatgactcagcctcccgagtagctgggattacaggaatacgccaccacgcttggctaattttttgtatttttagtagagacggggtttcactatgttggccaggctggtctcgaacttgtggcctcaagtaatccacccactgaggcctcccaaagtgttgagattacaggcatgagccaccacgcccggcctctctcttttcttttaaaccatgcgcagataaaaacatgctacagttttatgagctgcttttttcccttaaaactatctttccaatattttcgtgtgtttaaatattcttcttcagagtaatttttctaatgactggctaatactctcttctgtggctgtaccaaatttaccaacacaattctaaattgctcaatataaagattatttcacaatctttattatatcgagcattatggctaatatcctttttatacctttacaaatatctcagattctttctacaggataaatgcctaaaggtggaattgtcatgttaaagaatgtttacattcgtaagccttttcaagtgtattgccaaacttacctctagaaaattgcaccagaaattgggtgtgccatccaaaccgtatttgagctaggcatggtgtggctcatgcctataatcccaattctttgggaaactgaggcaggaggatcacttgagcccaagaggtcaaggctgcagtgatccataatccacccccccccgcactccaatctgtgtgacagagcaagaccctgaccctaaatttaaaaaaaaaaaaaaaatcaccatatttgaagcaggacatctctgaagtcacgtatttgctactataaaagcagcttccccccaccaatgaataaaaatatgttttaaatattcctctaaggtcatattaaatgaatttgaattgatacttttttttagacaggcctgagttgatacatgtttagtaatgtgctttcaggttactataaataataatagggtggctcctaaagcttagaaattacaaagaaaagaaaaataaggaggaactactaattgcacccgccagcgtaaacatgcttactgtctctgtttatcttattctctctctctctctgtctcgcacgtgtgtgcactctctctctctctctctctcacacacacacacacacacacacacacacacacacactcccctttggaaattatttggaaattacattaccagctgtctgttgtttatcagaagacagaggcagccttttactaaaaaaaagaattcactgtttcttcctggtggcccaatctctacatgttaaagaaattttttcttttatcttagatctaagagaaaatgagaagagaaaagcattgtgaaatatgacccttctccgctgatagacactaacttgtccttacttctagttttaatacactgctactcctaattgacttctacaacttaaaccaagaaaaaggagaaattctaatagtgtgacttcaaatatgtatataatttacaataaaattatcatttaaattatttaaattatatactaatttatagttatatatgtataattggtaggtatattgtcagtctcttcatatgtctgtgattaagaaagtactaaagtattcattggttggcatagtagtctgaaaattgtccttttcttttgaagagtttaaagatttgttgggcgtggtggctcacacctgtaatcccatcactttgggaggctgaggtgggcagatcacttgaggtcaggagttcaagaccagcctggccaacctggtgaaacccccatctgtactaaaaatacaaaaattagctgggcgtggtggcactcgcctgtaatcccagctgcttaggaggctgaggcaggagaatggcttgaaccctggaggtggaggttgcagtgagctgagatcatgccactgcagtccagcctgggtgatagagagagactctgtctcaaaaaaagaatttaaagatttttcctgaccattatttcaattctctggtcttctgttctaaattctacttttctcaccaagaaagatcactatatatttgggtaaagggagaaatcattctataacagtaaaaagaatccatggttttcttaatattttacaagttccagaggtcccttaaaagaatattttccaagccaggttctttaaaacattaatgttatattaggttttgataactgtcccttgaaaaaaatagtactgattaataagattggaaaaacactaggtttcaaagataagcaagtttatttcttgttagaattcttggaatttttattatacactgagactctaagaggataaggagtctatagttctccagttttaggtgactgtggaagcctttttcaggcacaccagttaatttcacactaaactttatgccatggatcacagtgaatctttgccttaatgtggtatttgccagatgctttaatgacaaaaaatttctgctaaaggttgtagaaacgtgatccaattaaaaagaaaatgagtatttatgaggcaaaagggtcaagtccctctctttactgaagttcccagccccactcccacccaggagccctcttgtgctgtggagtttcctaactggagataagcttagaaagtatctataccagtagtttccaaactctgaggtgtggctcattagcaaatcctaaaatcagtttaatgacttacaaccaacaatttttgactggtatggaatggaatggaatggaacagattagaaaatatcagagtgcattacctaagcaaggttaagtgttgttttggcggtggttaatttgttagatatgtgtgtacatgcgtgtgtgtgtgtgtgtgtgtgtgtgtgtgcgcgcgcgcacgcacgcgcgcacgccagatcacagtgtaaaacgtttttcttctgtgggttgcagtcgaaatagtttgagaaacattgaatcattcgagccctttccttattttacagataatgaaataggtgcagaacgatcaaatgacataaccaaggtcacaaagatagttataatactgggactggaacccagtttctggacatccaagccacacatcacactgccttacccgttaagaagaaatgcccaggccaataactgtctagtctatctgctattgccaacgattattctctcgtatattcctcttcgtttggccatcctaagttgatttacataacctaaatttttctctcaacacctctgggctaaaaactgccttatcaaaatggtatcgatagcggttaagagtaaaagctgtaaaatgaaactgactgggttcaaatattgactcagacactttatgcttttttctttctctttattcttcatctttaaaatagggataatagtaacatatttggtcaattgtaagacacacttttccacccacgtttcaacagttctgaaatcagaatgcaccatacgaccaatgggatattgaattcggtgaaatatggctgtattatttcatagggttacagtgaagatcaaacagttaatatttgtaaaacccttagagtagtgcctggaacatagtaagtgctattcaagtgtttgctattagctttagcattagtatcattattactatcagcttgatagtataacttaatgcatgcctgttagagtcaaactagtcatgaaagtttcattcattctcttgcatttaatggtcagtataagtagttcctctcctttctgaagatgatttccaaggatctaatctgaaagtccagtgttttgcacattagaacggctcaatagttgtttgtataactaacgagtgataaataatcaaaaagatagaccttaatctctaaaatgtcaggatagtattagtcttgttgacagttatattctacagtacctaatgtggtatgtggtacttggtagatgttcagtaaatatttacagaatgaattatgtcttatacccaaaagaagaagaggtaaattcactcttgacattgataatacacagaggcatgagatttagcatagtggctatcacatagtagacactcaataaataatgtgaccttttctgttgcttctcagcaaagactaatagcattcataactttatatggtcgtttttatcaaagtcgactgtaccatgtaatacattaagggaaaaggctgacttcaaaattacagcatgatcacaactatattacaaaataaaataaaaataacagaaatgtacacataaaggaaaaatggaaaataaaaagataccaaaagacaaacagttattgcatcatttctttctttttacttttacaaattttctggtaatagcatgtactacctttgtaatggaaaaaaaacaataaaggtaacattttatactccagcttttaaccagtgacctcttgcagtggcaatgggactctgaaagacaaatttcctttttactatttattctgaatttaaaagctgtttcattgagtgaccttctcagattatgagacactgtaaaaagaaataactgatccattatttcttgcaggctttacaatcttaactgccttaatcatatccctggttaagtctttttctctcttgtcaaagtgactcaagcttttacagtttctccttgatacatagggcctagcagtttgtttctatcttgagagttgccaagctttcatcctggacattccccactacacatacacacttaattttaaaaaataggggaaacctttaagcacatctaataattgctgacatttcacttaacagtgctccaacctatgctaccagtgtcctcaggggacagacaatttgaaatatgagtggggcaataatttaaagcttcagattggcttaaataagccatcatgaggccgggtgcggtggctcacgccagtaatcccagcactttgggaggccgaggcgggcagatcacctgaggtcaggagttcaagaccagcctgaccaacatggagaaaccctgtctctactaaaaatacaaaattagctgggcgtggtggcatgcatctgtaatcccagctactcgagaggctgaggcaggagaatcacttgaacccaggaggcagaggttgcagtgagccgagattgcgccattgcactccagcctgggcaacaagagtgaaactgcatctcaaaaaaataaaaacatcaaaataagccatcatgataaaagtcagaaagaattttgcaggtccaatgtgagatgatttgcaggctaaaattctctttcaagtaaaatctcagggtgaaatgatttgagccagtttcttcagcagtcacatgttgtcccaagtgttaggaatttgggacaaatgccatgtgacctaccagtgatgctgataatgcccctataaattcaaagacagcctttccaatgcccataaaaagcagctacagcagtaataattatattctcttcttaaaatgtgttgtcatggcccttttctcctttagctcaaatgtatactccccaataagctctcagatttatttgctttacagtatcattagcaaccagattttgcatcgttggccctatatatcccatcaatttgaacacatgaggaaacagaacgtttttgtttctgctatgggaatttctgtgctggggctggcttacaatggctcaagagagccaattgtaaaatatacaggaattgtgagctagttattaagcctacctttggtagcttgaaatcaggcatagtgggaagatttactccatggaaattggcaaatactacaaattggggcactttgttttttttttttttttttttttgtgcatagatggtttcccagaaatgactaatttatctatgttatttggatcactcaagtccctgtaggcaaagaatcttcataaacttagcaggaaggatgctcaggatccaaatatttatgtgcgttgcagagtgaccactcatcctggtttgtctgggactttcccggatttagcactggaattcccattttccaggaaatctctgtagtcccaggcaaaccaagatagttgctcaccctagccttaggtaaaatccctagaagtagagccctatttagatagatggggcttcttgtagaagtaatttgttcaggtgaaagggagtgagggaagcaggataaagtaagaaggatgctggtcaaggagttaagtgggaaggaagagactcacttcagcttgatcccacagggagctctggagaacaaattgtccctactttgagataaggggcctgggctttttgtttgtttgttttgagatggagtcttgttctgtcacccaaactggagtgcaatggcgtgatcttggctcactgcaacctccgcctcccaggttcaagctattctcctgcctcagcctcccgagtagctgggactaccgcgcctggatttttttttttttttttttttttgtatttttactagagacggggtttcactaggttggccaggctggtctcgaactcctgatctcctgatccgcctgcctcggtctccaaaagtgctgggattacaggcgtgagccaccgcgcccagccagggctgggcttttattttcccgtgtgaattagtcattggctgtggatttctggggagtaggagatagcaaagcagttcccatttggccaagggaggatttctggtgaaaggaccaatgaggccttagcaaccaacactcacaacaactgcggctgggtgaaccagctcagtaaaagggatctgagtggaacaacaatagtattaacctctcctagactttatgaagctgctatcataccccatgcataatctggctttagagctgaatgggcgcatttagctggatcactaaccaccactccttcgtcacggacttacatggaaattagcccggtggcatggaagagatgagacaaatgtctgtttctttcttatttcatcttcctcattgtgacagattcttctgggcctcatgaggagctagggccaagagaccagcaccagagttctgaatcagttttataacatgggcactattttggtggaatgctggctctgaagggtgtatttttacactacccagaaaatgaaggcatttgtgaatttggcctggggtagcattttgtcatctgtccaaaatacaaagctttgcacaacagaaatagtgggatcacatccctgtgggcaagaatcattactttcgtttttccatttggatgttttccattttcagaacacaaccagtttgggattacaaagtactttctggtgagaactttgaagtgaggacaaaaggcattttgttctttagtagacttacataaactgttcctggtttaaaaaccattctagatttttaaatagactttcagatatctgcagtaaaaatcatcttgatttcaggcgactgcaggtactgctctgttatgtgctatgtctccttaaggctgtaagggacagggataggcttaggtgataaggaacattttcaggatacagagaggcatgaagaataacatgggccgggcgcggtggctcacacctataatcccagcactttgggaggctgaggcgggcggatcacgaggtcaggagttggagaccaacctggccaacatggtgaaaccctgtctctactaaagacacaaaaaattagccaggcatggtggcgcacacctgtaatcccagctactcaggaggctgaggcaggagaatcgcttgaacccaggagacggaggttgcagtgagccaagatcacaccattgcacaccagcctaggcaacagggcgagactccatctcaaaaaaaaaaaaaaagaaagaaagaaaagaataacatggaacaacagacaccacgaaacatgtttgcttctttctgtatatgcatttgctgccatagacttcagactattacagtatcatatcttctctcttctctccacctaacaccttctacttatagtttctactttcttatgacttccattttcttcctttgttatccgactttttaaacttccccacccatctgtcatctctgtttatctctgtgtattacattcaagctctccaagacaaagcatctgattggattagttatttattatccatctaagggtaatgccatctcacaggccacaggccagactgtaaactaggctttcttgacctgggcactattggcatttggggccagataattagtggaatgctggctctgaaaagtgtatttttacactactcagaaaatgaaggcatttgtgagtttggcctggggtagcattttgtcatctgtcctagaatacaaagctttgcgcaacagaaatggtgggatcacacctctgtgggcaaaaattattgggggctgtcctgtgcattatctctggcctctactcactacatgccagtagcactcccctcccttagctgtgacaaccaaaaatgtctccagacattgtctgtctgatgtcccctgttgggtgaaattgcccctagttgagaatcactcctttataccaatgcctgcacaatttgtggtaatgaaagtcatgtggaacactaaatacagtgacctatgcctgaggaattatttgaagttgcttttctgcatccttagggaccctttagtctctcgatgaaagggagtgtcctcagcagacaatcttcaggaattgcatcagctgcctcacccaagatcataccccttacaggggcagctcttcctgatcagtgtaggggaataatgacctggccattttggcccaactcaggagaacattaacattctagctcaagagctcccatggggttgaatgagactgtcactgggtctgcattcaccttgacttctccctatttctattcctgtttctttcacttcccttccacagttgtctatcctgctctctaatcattgccttagagttggcttcctggaggaagccaatctgtgagggggcaatgaaattgacaggcatttagaagcatctaagaaaaaggtattataataggcccattacagtcactgggtaatttgatttactcttgctttcataatgaggttgattattttgttcaggataagtagtgattattattatttaaggtgtccaacctcatgatctccattaataggtaaggactttggggacagcataaaattacatgaatctcttaccttaaaccttaagctcagcagcatacatgcccatgacaggcaagagttagaacgtaagatggtcagtaacatagatcttgaaaggaaatatgttggagtgtgagcactttaagggcatagggcctgcattacttttttattaaaaataattttgcatctaacacaacatcttgcatattagatgcaggatatgccttgattgaatgaataactgggcacttaaaagattgttcccagtctaataaaatgaaagaacttagcctggtgcttagtctaatgtccagaaagagttaatgaacttcactttatcttcagtcagttaagaattgattcactttgttactcaacaaatgtctgttgaatgaccaatgtaaatcaaactctgatctaggaactggggaaacggcagtaaataaaacaaagtttatttattgtggagcttacattttaacaagagaagatggacaatcaggtcatgataagtttgatttaaaaacaaagaataaagcaggctaaaggggctagaggatgggagaaggggacccttttagtggagtggtcaggaatggtgacatttcagtagagatgtgaggaagtacaccagtcagatattgggggacaaagtgttccaggtggaggaaacagtaaaagtaaaggatccaagatggagcatgcttagagggtttgagaaatattaatagcaaggaagccagtatgactgaagccaaggaagaaagatggtgaatgataggaggtcagtgagtgaccaagggccagacgaggaagggtcttatcaactatggttggctatcgttaaaagcctttggcatatatgctttgtgagaagggaagtcatagaattctgagctaagaagtgacatggtgcctgtagcattgttacttactgtgcctgtagtattcattcattcattcctatatttattaacaaaaacgagtcacctgaaatatgaagataaaaagagaattattgccttgggacatttaaataccaatcacaaaagacagacctataaaaaatgacctcctacagtggtagtaaatagtgggtgcaatgggagtagaatggaagggaggaatccattccacagtgagagaaaggagatgttctatctagttgagtattaacgcatattgtccctgaggctacatgcaaatccaaagtagagggtattccttttgataggaacttagcaaagaatgtttataattgcttggtccctgatctcacctagcaagagtcacaagatgcattcagtgatgaaaaatcagtttctcccttctacttagccattctgataagatgaatatctcgggccgggcgcggtggctcacgcctgtgatcccagcactttgggaggccaaggtgggtggatcacctgaggtcaggagttcaagaccagcctgaccaacatggtgaaaccccgtctctactgaaaaatacaaaagttagctgggcatggtgacaggcacctgtaatcccagctacttgggaggctgaggcaggagaattgcttgaacccaggaggcggaggttgcagtgagccgagatcgcgccattgcgctccagcctgggtgacggagcaagactctgtatccaaaaaaaaaaaaaaagatgaatatctccctttccagtttcgtgtgtagtctccttaccgcccttctgttcagaaaagggatttcttacgtatgtataatgaatataaatataggttttagagagcactaatgttttaatgagatagaaataggcagacgagagagaataattgaaggattagtcaacatgagggcaatttgatagggaaagaaaaagtctgagcaggaaatgtctgtggaaaaaaaaaatcgaagaggaatggaatgaaatgagctcatttatggtgtgagttagggacagaagggatttattctcaggaggtgaaaagtgaaggagttcatgttatagaattcgacctagaccagctatcaagggaaagaaagtaattcaaaagacttggtccaggagatctggagcagatacatctattagaggaagattcagttttgaactgcatcttcagttattcctggaacccaacacaaaagctcatgacaaccttgttatcttcaggcaaaaaaaaaaaaaaaaaaaaaaaaaaggcgggggcagcaaggcttatgtcttaaacaagacagcacataacttcaggtcagagaattccattaacatgaatcacccacaccaatttaaataggaaaaaaaatagtaagcttggttatgtaaaaatttagtttaaaaatcagaaccaacaattgaaattaaacaagaatgttttatttatttctaaaaatatttagctatttattttgaattctgaagcaatactaatatagtatataatgataaaacacagttgattttcatagtaaacatcagcatcagaatgccaagaggaagatttgtctccgttcatgttttattactctgagaaccgcgtaacattttttaaagagtcagaaaatggctagaaaaagaggaagaaagattatttccttaactagttccctggtcccatgctttggtggttaacagtcagtttaactctagaaccatggaaagtctctgtcactttcctggttaccctgggattcctcacattggcagtaagttcgtgaatgagataaatatcctgataactagctacattaatgatgaaaataattataaacgtaggagttggaatttttaaaaagtatcgagcgctctgtgctcttaacacagaggaagcattttgcatagattaacccgtttaatcctcacaccaacctttaaaataaggactgttattgtctccatttcacagaagagaaaactgagactagaacaatttactaacatattcaagttcatacttgtaactattatggattatcagccttagaaaaggggttccagacaccagtgaatagcaacccacacgtctcaactgcacagaccaaagaggatgataatccccattaatctttgcatgttagtagaggcagtggctagtaacaaatgggagagactttggctggaggatattttttattctttaatctttatgatactgtttcccctctccccttctctctctactcctctctctgtcagctgtatccacaataatgccacaatataactactatacaagaatataaagcttctgttctcatgcttatgggtctacaggtcaactgtaattcgggtgatctggataaaacttgactggaaagctctacttcatactgaagcatgcctgggttcgcctctaggctgtgagttcagtttagatggtttctaaatgtgttgggttgtgagccccagactaaaggatcagaagcaacctggggcatgttctcatggcagattgccagtgtgacaagcctctgttcacatcatatctgctaaagcaagtcacatggtcaagcaagccaaggtcaaggagctaggaagcacactgcgctcaccatgaggccatggctaaggtatacatgtttagttctttcacaactgagtgaaaaatgggccccaaattcaatctctcctatactctttttgcgttaattgctagttctttctcactcttctcgctttctaatggatgtacatcccatctatgatcatttggtttttaatatctgagttgctccctactgtctcaggtttcaaattttactttccttgaaatttccctggtgcctaatacaatacctttcacacagagagcgttcagcaaatggtgtggactgcctgtcgtcttttaaaagtacatctgcagagacagtaaaggcacctggcgatattgcattgacttgttagtaacctgacttaacccagatggcccaaagactgtaaccaccattacctggaggaaagttccctggtaatgcagtcagccaattatgttcgaatttactcgaaaattccttgagcataaattattcatggctctatttatgtaggtatctatcttcctatatctgaccttaggaagcttgattgctttcttactcttctaataatcaccgtgatgtttttgaagttttctataagtcggttagaagcagcttttttttctttttttttttcatgagtaatgccgcccaactttggctattagactttgtgtgactgtgcagccatcagcactggatattagatatagttttatctctgcaactcagtcaccttgccaagaattttagtatgaactcttgacttcccagatcaaatgtgagcctgatactctaaatgacttggcaatctactgacaaatcccatggtgtggtattctgttcaccatgtgcaatggtctcagagctcagcattatctgtctgacagctcatataatatttacaggttgttattcgttaggaattttagttagccataaagattttcacagctatggcagacattagaggtctcattcatcactcttgtgaccttcctctctggaatgtagcccatctgtctctgctgttgaaatctttatggaaagtctgcccatctttgaaagtttagtaagtgatcttaaagttttcattgaatctttacttttgatatacgatatagacatataaagcactatccttattttaatttaacgttttgaaaagtgttaaatttaacttggcctttcatttaaatgacagaaaacttactcttgctacaggaactatatgcgtcacatcaaaagaaaatagaaatcatacagaaaaaaattggaatgggaaaaattacacatatatacatatatattcaacactaataactacatgaaagcttaaatactgtattataatcctgattatgactttaggaaatgaaaacgatagaaatacattttgcatataatttaacgttataaagaaaccctaagcaaattcagtaatgaagtgaactgaataggctgggttacagagcacaagagagggatgaccaacaatcagatgttgcccctttccatttctgttttcctctttttatacacaacttctcaaatgcttgcttcccctccgtctactccctccttcagcctctgatcactagtgtgaaattgcccttttgaggtcaccagtgatcgtgggatcaaatacatcttcttcttctacacccttagtctgtcaggctcaagaattgcttatacttcaccagctaggctgttcttgtgtttcatcccactttattctagcttctgtattatttttctttgacagcagttctactgccaccgccatttgggggcatttgccagggtacattcccttttgttttcctccactgtactcatctttttttttttttgtacttttatagctttcttggggtataattatatgcaaaaatatgcatatttaatatatgtaatttggtaagtttggacatatgtatacacccaagatactattgccacagtcaaactaaagataacgaacatattcattacctacaaaagttttgtgtccctttgcttttgtgtgtgtctgtgcatggcaagaacacaacatgagatggaccctcttttttttttttttttttttttttttttttgagatggaatcttgctctgtcgccaggctggagtgcagtggcacgatctcagctgactgcaacctccacctcccaggttcaagcgattctcctgcctcagcctcccgagtagctgggactataggtgcgcgccacctcgcccagctaatttttgtatttttagtagagatggggtttcaccacatcggccaggatggtctcgatctcttgacctcgtgatctgctcaccttggcctcccaaagtgctgggattacaggggtgagccaccgcgcccggccgaggtggaccctcttaatccccttaagttttaagtgcactacacagtattgttaactataggcactatgttgtacagcagatctctagaacttactcatcttgcataagtgaaactttatactcattgaataacaatttctcgtttcccctgccctgtcttctggcaaccacttttctatttactgcttctatgaggttgactatttcagacacttcataaaagtggagtcatacagcatttatccttctatgactggcttatttcactgagcatgtctgcaaggcccatccacattgtcaccaatggtaggaaccttcttttttttaatgctgaatggtattccattgtatgaaaatgtggtgtatacatgcagttctctttgtacgatcttccttccttaaagagtccagccattctcatagcatctgctatgattctagtacttatggtcttgtcctttcacttgcatttcagtgaaaagaaccaaacttatgctgatgcaaatacctgtacacaaatgttgataccagctttattcatgattgccaaatgctaatcagtctatgggcctctgattttcactgcataaaatatagactaatctgtttatcattcatgctgatgaatggtggataaatggtctagctaagaatgaaagatctgttgtatagatgtcattggtctaggaagacagagatgtagaaagaagtaccataagcccaggcagttagatactattcaaaggcatttctctctgccatactttatactacatgtggcacattaacagtagttaggagtggattcaaggctgcagataaatgctgcccaggtgagagagaaagaattggttccacaattaaccatcattcagacaacacatcatagctatgtgattacaaacattatttgtgtggtgattaacattttacaaagcaatttcatattgatttcctcattttatcctgacaacattttggtgagggagatatcattattcccattggaatataaggaaaataaggcttaggcaggaaaaagactagcttaagatcatgaagtgataggggagtcaggactcaaatccagttcttctgaatctgtactctggacattttctgctatatccagctccctctcaagatgctggattgggctttgaaatagaaagccaacatcctgagtgcctttctaaactctgagttttacagtctatcaggggaagaggagagtgtgagaggaatgttcccaaataatctactgtatcaagcagtatatctaacttgctttgagaattatgccaactaaatactattgacctgcagaaaattgatttttctctttacacttatatcaataaagagaggcttctgctgccataagtgtaatttatgtaaaatgtttttaaaacattcatagcctttaatcaagtaaatatacttctaggaattttgctttaaaaaagtaactaaaatatgtgcaaagatttatctacaaagatgttcactgtggccttacttagaacagtgaaaaactggagacaacttatatgttcccaaagagggaatttattcaataaatcatggtacatccataagtgggaattttttagcaatgaaaaatctgttgtaaccctacaagcccactcttaagcattcatcttagagaaatgaaaacttatgcttatgcaaacacctgtacacaaatgttgataccagctttattcatgattgccaaatgctaaaagcaacctaatgtctttgaacaggtgaatggataactaagctgtagtacacccatataatggcatactacttagcaatgaaaagaaacaaatcgttgatacagcaatatggattatgcattatgctgagtgaaataaaccagtatcaaaaggttacatactgtatttatatgacattctggaaaagacaaaacaagtctagtagatcctccctaatgccttttgttcaaccccagaggtgagttttctattttacctccagtgattgctgtatcggttatttatctaaactgtccccacttttttgacccacctatgttatcaaactccaaatccaccaagtatgagaaaagtagagagatgaatgaaggtatttgtgttggaattccagaaagtgctcttttggcatgtcttaaaataacattagcattctttttaattttctggttaggcccctatgttgattaaaatatgacttaacaccagggtgcatcacttggaacattctgttcatcatgcatttaaaaacggctgaaataacaacttcccctaaataatgtggcctgtgcttgtgattttcaaaactaccttgggcacaatattgaatcctgtcacctcaaggaaggaaaagcatttgaagatagaattgctaccctttcttgctcttaataacatactgtgtctgtaacacaaaaggaaattcagaggttggttttgcaataaataaatgcatgtgtagtttgctatctaaattcagtggacaataccccatgatgctggtgccgtatgataatggttgatttgtacattcaagaatctgaatcacaaagctgccctggaattacacgtagtggttataagcacatctgtataagaaaataccaaaggacaacccggtgtcatatagaaactatttgccgataaatttgcttttgatgggctactaaaaatggacacatcaggcataaaagatgtgtgtgtctattacgtaggctagctttatgaagaatgacaagcttccactggtacactgagataagaaacagctgttgttggcatcagtactgctacaagaaatgaaaaaattctgtggcacacttgtgagcactgccacatatttgatcaacttttgaatagatggaagaccagaatcatctggcagccccaaatgaaattgtcgacaacccttaagaatctcttgagaaggagcactgaacccaattccgtagaactatcatccaattgtgtgttatttctaaagcaagtagttccagtgtgtgtgtatgtgattatgatggggcagggaaggaatgaggggaggctgttgttattttcctttttttttttttttttattgtgtcaaggacatttttgagcataaaattgtaaggtttcaaacaatgactgcaaagcagttgcttaggtgaatttataaactgtgaatcaaaggggaaaaacatctttcagaaaaaaaatacactgaatctcaccattggacctatttgatggctacacataagacaaaaagcttttttaaggaaaataaatgaacacttaagaactgcaattacaaaagcttgaaatttcatattgatctagaatttataatatttttaaaattctttaaaaatattttcagctatttagttcaagcatattctgataacttctctgacatttaattgaaaattttccccttttaatgtaaacataaaaagtcaactctagataccctacgtaggtcttcccattagctcagccaggcaacgccaattttcctctgtctctcgctgcttagaggttgtttctttcaggccgaaagcccctaagccaggccaggcagccagcagccctctccagcacacttctttctgagagacgcctaagaatagtgtaggaaatccaaagtgattcttctgctatcagaggatggtctagcatcctccaaattagaaagaatttctggaccactagaatgataaaaaaaaaaaaaaactagaaaggtataataagagaaattgtgaggcctcagcccatagatacctttaaggaaagaatagccattcttttctcagtttaggtattcacaggcttggcattcacagccagtgagggctggaccaagagctctctggagttctcttcttccttttatgatgctggtattttaagaagaaggtacactgagcagccaggagctataatttctggctctccaccatgtttcctgctatagagggctagctttttaatatttccataacaacagactctgaccagataggtcaggaagtctagcccatggtttgtttgtttgtttgtttgtttttcagttggagttttgctcttgtcgcccaggctggagtgcagtggtgcgatttcagctcactgcatcctttgcctcctgggttcaagtgattttcctgcctcagtctcccgagtagctgggattacaggcacctgccaccatgcccggctttttttttttttttttttttggtatttttagtagagatagcgtttcctcatgttggccaggctggtcttgaactcctgaactcagatgatctgcctgcctcagcctcccaaagtgttgggattacaggcgtgagccaccacgcctggccttagcccatgtttttaaatcagatcttatttactctgtgaacttatttggacaggagagctgcatcctacagaagaaaaaaggacaagagaagagttgggaagagaatgagaaaggcaaagatggaaagggaagcagggaaggcaggaggaagggaaaagaaaggaatagagaaagaaggacagaaagaaatggaaagtcagagactacttcaaaacagcagctaaatgtcttttttctctgtattaaaaatttccgtctgccaaaatgaaaaagcataattaccggccaaatacaaatccatttcctatatcgtttaaatgacatatctccaaggtacaaaacagcatgtctggttaaaggttgggtgatttgatccctctattactctatataaaacaaagaagctggagtttcattacgcttaaattgtctggcagtgggtgaagttaacttttattagaagctgttctttcatattatacagtgtagtcgaggatatattagctttgacgttttcttacatctcaatacactgcggagtgaatttactgtgagactaatttaaaagggagtttttcataggaggaaataatggtcagcatcagctgtgcttcaaattattagcagaatgaaaattcaggggaaaaagtatagacacataaagttgctagatattaataagaatgcgtcttttatttctgtttctgataatattctgtgtttcttaaagctccagtgtcttaaaactatattcaggaggaagattatattgttgaggaaatgttatagtgcctcctcaacaagattattttgtcttaaagaaagaaaaaaaaccatcagatcaaacagtatataaaatatatttgtagaggttcagctttagggaagaaatcctacaacttaagcctgaaaaaaaaaaaaacaatgcaaagatcattcatttgaccaatacacagtgaagtcataataaaacaaattcctagtatgtgaaatgaaatttcacgtataggattcatcactcataacaaaagtcttattacgctctgatatcagtagacattccctcacttttggtcaccttttctaataagatcacactggtcagctgacattttgaggcaccaaattaagcatctatttggtaagtgaatttggattctctttaaaccaataaagataaaaacaaccatatcagagtgataagcatattactttagcttcaataacttagaatgtaaatatatcacagagggatatttcagctactgaaataataaaatccagtcagtcaaatagtaaaaaatattgagaaccagcaacaggaagtattataaaaaaaagcactcaagggagacacatacaagaaaccccgtcagtctactcattcagtttcttatctgttctataggtttagcagtggaaatgtttgtgggttttttttttcttcgcatttatctttgtgcctgaatgagttcagtttcgcttagattaggacagaaatttcagaacagcaggttaatccatcctgtcttcatgggcagctgagcaaacagaccaatatcagtgtaaaattgtaattctggagattaatgttgtctttcctgtttgcgatgaatttgacctccttgcctttctttttttcctcccttcttttcagcgtctgtccagggtccctgggagagagccatctcgccaaacaaagtgccctactatatcaagtaagttggaagtatcacatttttaaaagagcatttattgtgactaacctgtatattcacaagtgagtttatttttaaaatgcgacattagcctggcctacaatacctgtgtcttttttttcctgaggaagcttggataaaaaacttattctaaaattaccattgtaaatttgctgatgcaatggggaacgacttttaagaaaagtttatttaatgcaggatatatggtgtgttttgtgacagagggggcggatttttcacaatagaaccaaaagctccagataattttattgatagtgggagtcaatctttgcgagaacaatttcttttatttaggggttttctcacatttcttcttccgtcaaagatagaagatttccgcagttatatgtacacaactgttttgggtgaatgaatactacatgtttccaaaaggcagaaagcagcagtcctcgactcgtagggcttagttgttcattcttgatacataacactcagtatttgtcacctaacaacagaaagatactgttttctggaaacatttgtgccagtcaaaagaatacgagtgcttggaagcaccttctgtagtattttgcatgaaatataaatgacaatacattgggtcaacgtggaagagagaggagagaggatattgagtgattacgataccttcacagtctctcatccattgtgcactagagtctaacttaaatttaactttgaattggaaacctcaacaacaattacaatttactgggttcataaaatagtcctcgataccaaccgaagtctttgaacttgcttctgccatgagtctgactaaaaatattagatgttttcccatttttttccgcctgccatcttttatcgaatctgtttttattctttcactgtccatcaattcttcttaattcggttctaaagcaataacagcagtcctagatcttcattactacagtcctcaagaaatttgattttatgcctctattttgttaactcagaaaaatgggagtgaaggtagtcttttgactctttcaggagaaatacatactttaggaaacggtttaccatttgtcttattacatttttccagatgaggtatctcttaacttgaaaattcttttttagtatgtttgattctgctttttagttttcatattttatgaatttaattttattattgttatatttaattcattagtcactcaaaactgtacattttaaatacctatttaaatcacatgctttattaaataatatattgctgtagacatgcactgtatattaccttacatccactgtatattttatggaacaattttcttcaaactctagacagtgatttcctacatcagtgtctttgtcctcacaaatttttatttccgactaagatgtttgagacctgctacttcttcaaccaattcataaagctctcacttttatccaattcctttatgagctgaaataaagactctttttctcctttcatagatgaggttttaggatcactggagaattcaagacacctttaagctattattctccaaatgactacttgtttggggctcactagaggtctcacatggattgctagggtctccccggtcccattgtcctttccctatatattcatcttctccctgatgttacttctactacaagagatcccagtacattgctgtgagggaatggaaatgaactccgtccaaaaaataataaagagacaaattccagaaaagctgtaattcccttctgtgtattagtctcttgctgtttctcagtggaattagagagcagctacatatcctatttgtccaatgctccttcatgtacctaaagaccatggtgatggtattgataagggcacagatctatgaataagaaaacttcaattttagtcctccagtctagtcttagaggctctgtcattaggcgactgtatggctttaggcaagtcacttaacctataaaaatcttggtttctttctttttttttttttttttttttttttttgagatggagtttcactctgttgcccaggctggagtgcagtggcccgatctcggctcactgcaacccctgcctcccgggttcaagcaattctttcgtcttagctcccgagtagctgagactacaggcacctgccaccatgcttggctaatttttgtatttttagtagagacgaggtttcaccatattggtcaggctcgtctcgaactcctgacctcaggtgatccacccgcctcggcctcccaaagtgctgggattacaggcttgagccaccatgcccagccaaaccttggtttctaatttataaaataaagagttggactagatgatatctaagatcctttttagctctaagacgtaatgagcatgactcattcagttgtcctgtccaaacttaaaaaccgaagatctcagcttttgttcgataatatctttatttttaaaattcattattttaatgaacataatgtaaattcttactttaaaaaacaggaattttatttttccactgtttaattagctttagatatgccctatcaacccactccaatttcaccacacacctctttaaagagctcaaatcttggtatataatttaggattattatgcttcctggctcatgataagagagagagaacaataggcaggaaaatttgccaaaaggtgagtatggagaccttaaaagcctctgaaataatcagttccttgaaatgaggaaattacgtaatttctcaaaaatatctctgaaaccttatggagagcaattctctctacaattataatctctttgaaattagggatggtataatttctcaaatatgagtgtaaaatgttaaactgtaatatagggaaaacatacatgtttataaaatgaacattgtcagtaagcagatgattaatggcacttgtgtcttattagccattactattatctaaaatgttctatggaaaccaaattaatttgatgtacaaggttcggtggactttatgcacagcttaatgccgttcataatctgagatgccgtcttggtctaaaaagaacaaaaatacgtttacagtgacagtgcttcaaccagtcctcatttttcctcttttttatcttgtttgtcttgacttccagtcaagagtttttaccacagatgcccagctgcaaaaccaggtgtcttctctggctatgtttttaatgctttgtaactttttcttttcaatgctgggataaagggatcgcccacataacaagaggtttctataccagtggcacagttcctgttggttgttgaattgtgcactcattcttgagattttaagtcattaacatcttttgctctagtttgcaaatcaggcagtgtttatgcctgcatcctgacatcagcttttcatatgaggctaagaaccttgattttgatacttcaaactacgtgtttgtctagtttatttgtccacagcatacatcattgttacagttttcatattccctctcccttggggctcccttattcctgccagcatctctttcaggttatttgattacagctttcattgccactgaaaaaataatcaccaacaatgttcaacctgttacaactgccttttctactctctgccattttgtagttttttggcctactgtcaaactcatgaaaatttcaatataatagcctttaaccagctgctgcattctgttaggatttctttcacctttttatgttgcatgctcccatatgggtaaaccaaacagagccaagagctgggactctcttgctttcttaatgagttagaaaattgttcttctgtattctggactgtcaaaagaatttaggaatcccaaacatgcatgcaggatgttccagtatagatgtcataataaaagcataagaaatatcacactgggtcagaccaacagggcaactagcccggaactctgtcccagatgaagataccaatggttgttttgtcaggtaacctagtacattttaccttaaaaattcggatacatcatgaccacttcttaataatgcattgtaaatcaactggcagtgagtttatccaatggtgtcaaacttttcctattccccacttcagctttgtcttaataataatatgttccataaatgtaccgacttctatataaatataggcattttaatttctcttgaatctgcatcctttaacctcaaggaatggccttaattaaattctttgaaattcagtaaaaacatttatatttatccagagtcgactttagcctcacattcccctactaatgcttttcattttcatcttcccagtctgagaaattctaatcctttttagtcttttagtctgtccttgacggaaagataagctttccccttgattatcttagttgtttttccctggatcttttccagctctgttatatcttctttgggatgtcgtgactagggtggcccaaatattggttatgaaatttgttagcattgtctctagtttccactcactcatgaagaaagtaaatgttatttgctgtctcccattggtgcagaaatggagagatcaattgaggtcataacctcttctgcatatattagttctagccgaaggttggttttctgctacttttctgtaataccagcaaaagtgtttgaccttatatttctgccagctgtcccttaggaaggatttgatttttagacaagctggtcctttcctccttcaaagacgctgtggttgctaaatattgggaagaattcactaatgaaactcaggagtaaacctgctgactccatcagcagtaatgcatttcatcaggttccctttcgaaatatctctgaagcccttcacagaagagtgaaagatggggttcttgggaacttgctaactgctcagctttttttacatgcaatgctcaagaagcaactcatgtccaaaggagtgtttatcttttcctgctggtaattttgaatgttgtatatacattgctgtatatgttgcctgatgaccttgatcgacccttctcttcactctcaatctcaggcatgtttccacaaccatttattgcatctgagttttgctcacaactttctgctgcttcctgcttagcaaaatgcgatataaaaccttattggatgaagttaacagttgcttcagtcaacatttcttgttactgttgctgtttgtgctgacaaaattgctgatttgggttctgactgtcctgtcttcttatggcctaccattcctatagctctatttgtacgagtatttgactctctgcctggaactgtggccatctgtctagatttaccttttggtatatgtggctctctgtatcctgttggtctacattctggtttgaactcacggatcttggtctggtttttagtaccagtgttcccctaactccagtagcatctgaatcttgacaccaccttcccctgccccctactgtattgcctctattactactttcatggcaattttttcggattccaaatatgtcccatgcttaaagcatatcttgctctcattcttgttctagcccctgttggtaccaggcattgctccaattcaagttttggttggttgatttcttccttcataatattgattgctatttcagtacctgtatttatatacagagggagcagtgcctaactacatcttagccttaacagcaatcaacgtgttaaatatccctgtgttggctggtttgcagtagacacgtcttctgacaatgagatgggctcttattataaagaaactggagtatgatatcaacatagaaaacatttcctcaggccgggtgcggtggctcacgcctgtaatcccagcactttgggaggctgaggcaggcagatcacgaggtcaggagatggagaccatcctggctaacatggtgaaaccccgtctctactaaaaatacaaaaaattagctgggcgtggtggcgggcgcctgtagtcccagctacttgggaggctgaggcaggagaatggcgtaaacccgggaagcggagcatgcagtggacgagatcgcgccactgcactccagcctgggtgacagagcaagactctgcctcaaaaaaaaaaaaaaaaaaaaatttcctcatttcttattccagacacctcactcttctaagaatgatacaagtcttctgacattgggtttgaaaatcagttgaattttgtcataatctttcatacaatgtgaacacatcatgtagtatataattttgtgctatttctggtaagatccttcttatgtatatttttcttcaaaatataccttttagcagctaagacaacattaaataggggaaattttaaataggctaggcatcgcaagacttgaattctagttccagctttactgtcacctagctattaatacttgaccaatgggaaattgcttattttctgtgggcctcagtttctccctctgtcatttaaggaagcagaatgacatgatatcataggtcatttccagtactaacattttctgattttgtgaatgttgacttcgaaatagaaattgtttgtgatcattttccagagaagtgaaaatgaatcttcatattgcccttgaggattcttattgcaccatcaatcttatcgggatagaaaggacaaataatattaaatgtttcacttaactatttagcactattgatgataagaagtggatgcaacagagaatcagctgtctaatttgatctgtcagtctttgaggatgctggtgaatgattcggggtaattaaatttttgaaatcactgccaaaagcctgatgctctgacttttcaaaaggctttagtacacaaagataacccagaggtcaatcttctctgctgtgttttctcctctgccatttgatggtttcaaaggtcacgttacctgagtctcagtaagctctggaaccacaatgaaggaatagttggtaatacattattgatgatataatcatgaaaacaattcaggttaagatattaactgaaagagagtgaaaggggtgccatagtgttgtgcagagtgctgagtctggttttggttttatagatcttgttgggagatgtagatgttgatatcatctgtgtctcataggttcatgaaaaaaaccctcacatccttttttgtagtttcataagctgatttgtatcaccttgactgaaataacagactccaggaggatagctgttgttatctctttttctagcatagtgcctcacagataacaggtacttggtaaatattggaatgaattcatgaacatatgtcagtaattctatgtgcttttcagtttgctgactcatttcaccttcaaaacaatcttgtagtatttgtgtgtcaatttagatttaccactcaaatccatctctcatgccctctagacatgaactttagtgttaggaagcatgccgagtgtttgatagagtttctcatagctcctacagtttggtgcttaagggacagtccttggcatggatgtatgaatggtacataccaaaacatgagttctagattccgttctatcttaatctaacaatatgataaggagtataacttagctcaacctcaatgagaaggttgaactagataatgcctgggaccactctcagctctagctttgtttcagtagaactagagtctgtttttcctaaatatcattcatgaggcttcttctggttttctagtggtcaatagagctttaaattgatcaactactgtttttcactgagcattgtggacaggacctactttttgggccaggatatagtagccactgagtcttaacagaatgtcatcaatgatacatttttattttacagaaaaatgttgtaacattctatatggcatatgtcatgtggaaaggtggcaacatatatacatacacctatacatgtggcagctaaaatttaatgtgtgtatggggaaaataatcctgtattataatacacatggtatagcattccctgcctcattcgtggcacttttggaaatgtgagaatgagcatagaacatattcaagttggtttatccaaaagaagaggagtaaattatttcagctatttccccattttctttttctaactttcttaaacatgcactttcttacataatcacgtgttagaaaaaaaccagtagtcacatcaaataaatctgcatttgaaacaactgtatcatatcccaactctgttcgtttgagccatttgcttaacgtgacacccattctactttatgacacataaggaatattgcttaagaaatgttaattggctttccttttctcctctgaaactggattgaagtcttattgacctctattagatactgagtgttcaggtttttaggaaaacactcatagagatatagccccagtgtgagctgcatttttagaatattttctagaacccaaatatgtccctaatcaaagttagtttattttcattcttagcgttcccacgtaatttggggtatgtgtgaattcccaaacattcccgggcctctcctaggcttctctaattgcttcttattctgttcccctgggaagcagcatcctgttcccttcacaaaggtcagcagcaacagcccaggcaatgttttaaaataacttaataaccctgaactgcctctctcttctttgggataatttccttagagcattagtcctttgaacactgacctggttgcagaaaatgcccctttctcagtgggaaaactccaaatcccattcagtcttcccctccttccttccaggggatagggtgggggagtagggggtagggagagggtattaaatactttcttcaggaaaaatgttaacacggtaaaacactctctctctctctctctctctctctctctctctctctgtgtatgtattcttttttaaagaaatagactgtgagtgcattgtataaatcagtgctgtcacgttgcaaattttttaaaccgttgtacaagatagaaaaacagtatctctggatattgactctggaaagcttctaagagcaggtcctagatgagacttagctcactgtcggcattcggcaaatgatcacgttttctgtgataccattaactcctggggggatgaaactgaaaagcctcgctgctcttcctgaaactctcaactgcttttttctgtttttctttctcagcttatccacatccatcttggtccccaaagccattgcatgtcagatggtcagtgcaatgtgtaatttttaacttgcttctttgttgctttagaaggaatcgttttgttgttttctttccttttggtcactatttcttgttcatgagttttctgtaaacagtgtgtctcatagataagtccatgtaatctgctagacaggaagaaaagcaaagtttaatgtgtgcctactatgtgctaaatgacaaagtgtttcatctgtatcttcccatttaatccttgtaacactccacttattatccaataaagaaaaaaacggctatcagtcgggcgtggtggctcatgcctgtaatcccagcactttggcaggccaaggtgggtggatcacttgagctcagcagttcaagaccagcctgggcaacatggcgaaaccccatctctaccaaagatacaaaacagtagctgaatgtagtggcatgcacctgtggtcccagctactcaggaggctggggcaggggaatcccttgaaccagggaggcggaggttgcagtgagccgagatcacaccactgcactccagcctgggtgacagagtgagaccccatctcaaaataaataaataaataaaagttaaaaaaaaaaaaaaggaagaaacagctgagattcaaaaaagttggaggcttatccaagtcattctaataaaggggaggggggagaattgatacttaaaatcatcatgataagaaggatagacattggagattcagaagggcagaatgctgggtgaggggtggataatgagacattacttaatgggtacaaggtgcactactttggtgatggatacactaaaagcccaggttcaccactatgcaatacatccctgtaacaaaactgcacttgtacctcagaaatttatacgaataaaaataaataaatcaaataaaataatcatcatcatctcagctattgcttctagctgtttcaactttctaatgtttttgattgaaaactggccatttgtataaccaaatgtggccaatccaccactgtgaggctgccatcttgggcatcaccaaaactactctagtagtccttccctgcactgttaggtggattttccttggcgtatcttcgcaatcaagttgcagagacctaagttactctttgctgctttgggcaataaaggggaacaaaaaacaaaatgaaacaaaaacttggccagccctgatgtaagcactcttctacctccctgcaggctgagaaaacaaagtatttcttttttttttttttaatttttaaaatgtttgattctggtctaaatcaattaaaatgagatctccccccttcttttttctttttttcttctaaaaaaaaaaaacacaccaaaaaaccgagatacatgtgcagaacgtgcaggtttgttacataggtatatgtatgccatggtggtctgctgcacctaatgacccatcgtctaagttccctcccttcaacccccaaaccccaacaggccctggtgtgcattgtttccctctctgtgtccatgtgttcttaatgttcaactctcacttgtgagtgagaacatgcagcgtttggttttctgttcctgtgttagtttgctgaggatgatggcttccagtttcatgtccctgcaaaggacgtgatctcattcctttttatggctgcgtagtattccatggtttatatgtaccacattttctttatccagtctatcattgatgggcatttgggttggttccatgtctttgctattgtaaatagtgctgcaataaacatacatatgcatgtgtctttatagtagaatgatttatattcctttgggtgtatacccagtaatgggatggctgggccaaatggtatttctggttctagatccttgaggaattgccatactgttttccacaatggttgaactaatttacattcccatcaacagttcaaaagcgttcccatttctccacagcctagccagcatctgttgtttcctgactttttaataatcaccattctgactggtgtgagatggtatctcattgtggttttcatttgcatttctctgatgatcagtgatgttgagctttttttcatatgtttgttggccatgtaaatgtcttcttttgagaagtgtctgttcatatcctttgcccactttttgatagggttgtttgtctttttcttgtgaatatgtttaagttccttgtaaattctggatattagacctttgtcagatgggtagattgaaaaaatgttttcccattctgtaggttgcctattcactttgatgatagtttcttttgctgtgcagaagctctttagtttaattagattccatttctcaattttgtcttttgttgcagttgcttttggcgtttttgtcatgaagtctttgcccatgcctatgtcttaaatggtattgcctaggtttccttctagggtttttaggatttggggttttacatttaagtctttaatccatcttgagttaatttttgtgtaagctgtaagggaggggtccagtttctgttttctgcatatggctagagagttttcccagcaccgtttactgaataggagatcctttccccattgcttgtttttgtcaggtttatcaaagatcagatgtttgtagatgtgtggtattatttctgaggtctttcatggataggaagaatcaatatcgtgaaaatggttatactgcccaaagtaatttatagattcaatgctattcccatcaaactaccatgaccttcttcacagaattaaaaaaaaaactgttttaaatttcatgtggaatcaaagaagaccccgtatagccaagacaattctaagcaaaaagaacaaagctagaggcatcacaccacctgaattcaaactatactacaaggctacagtaaccaaaacagcatggtactggtaccaaaacagacatatagaccaatggagcagaaaagcaaaggatttctaagtcatattccaccacctccatcagggcttccctaagatagagagtatggccaagaccatacttaataaatgtcatggaatgtgtttctcttcataccctcaattgtaagtctttctgaaaggtagcgcgtggtcaatttagatggacaagaagtgctctgcaggagcctttgcaacatttgtgcatgtccttgattttgacaccaccccccgccccccattccagaacagatcgtctcatccttcccttaagccagaggcctatggttctagctttactaggcaaatatatatggtctgtggctataagtcacaatttctcccaagccttgagctgggggaatactgagtctgcccatgtattacatgcagaacatttcatcttattgcagaatgatactttattcttattgcagaatgatattcattattgcagagtgatattctttagtctttattttttatcattataactacatggtgcaaaagaagtatttctcatactttttctcataatgactcaaaattacaaaagcaatctgggcaattaatatgtttttgaagataaataatggcttatgttttctgaagattaagaaaaatctctgtctgaatatagctgggcacagtgtctcaagcgtgtaatcccagcactttggggggtcaaagcagaaggaacacttaagcccaggagttcgaagccagcctgagcaacaaaatgatacctggtctctacaaaaaaaaaaaaaaaaaaatccttggcatggtggcatgtgcttgtggtcccaggcacacaggatgctgaggcaggaggattgcttgagcccagggggccgaaagttgaggctatagtgaaccgtgtttgtgccactgcactccagcttgggcaacacagcaagactctgtctctaggaataaaaaaaaaagaagaaagaaaagaaaaatctctatccgaaaaatgtaggcaccctgtgttaatatgtaaatacaagtgctttatcaaataaaggctagattaattgttttttctcgctcttacttatatcaatactacaagaacttttctgccaaaaaaaaaaatcaaataatagaaaagaatgaatcctagatagagcaggaggggctgagcaggcacagcaaaagttcaaggtggaaatatctttatgcatccaattaaaagtaatttgtgtacattttactcatatatctatatgtacacatacatacatacacagacacacacacatatatatatatatatatatggagagagagagagagagagagagagagaggacaacgaagaggaaactaaagagaataaagggtattaacagcaggtctgtgacttattccctgggggatgtgaagggaataaatgaccttaatagaccacttcataaacatgttaatgacctcccagaccttcttgtttatcttgttaatagtggttaactagaggaaagatacctgcaaatccctatctataaaatgattttagtagggtatacctggcctggctagatagcttattgtaaataaacctggaatgtttggatttatgagtcgtggctggctggagaatagggcatagctacatgaacgtttttctatttttgtaattgacagattataaaatggaaaacttttgagactgaaatgatttcctttcaatgtttctgtgtaaatttttaaaaacgtatctgttaatatgaaaccaaagcacatcataatgggaaataacatggatgttttggaaacgcatgtgtgattatttcaggttccccagggaaataatgttctatctgtgcccagcacttccctataattctttcagtcattaataaagattggtactagataagaatctgagatttgtgtgagtctgatgtgagatccaaatgttatacttacacaatttgtgtttattttagtttaaaaattatctttgccatgagcaagaggggaaaaaaaggaggatgagcgggcctacatatttttccttaacatcttgtcccaagttttaggaaatcacaagtctaagaaaaggccagggtcaggactaggaagtgatataacagttatacatgtctacctttaaaattatataagtaataattaatttttaaccttattttaagcagatcctagaaatagcaagagcctctataacgtcccagctaagaccccaagttttctttcttgtttaactcttgaaatattttgttaattttcagatcccttgtctcctcagttcagctgtaaactctctgacaacgcttgtgccttatgcatctttgcatcatccctagcatgtattatatatctcacatgtaaaaataataataaatacttgatcatttgttttgattttgatgattaagcactggaagctgagctatgatcccaataggtatgcttatttaaagaaaaatagatggcagtccaggcgtggtggctcacacctgtaatcctagcactttgggaggctgaggtgggcaaatcacctgaggtcaggagttcaagaccagcctgtccaagatggtgaaccccgtctctactaaaaatacaaaaattagtctggtgtggtggcagatgcctgtaatccccactactcaggaggctgaggcaggagaatcacttgaaccctggaggcagaggttgcagtgagccgagatcgcaccattgcacttcagccagggcgacagagttgagactccatctccaaagaaaaaaaaaatcacacacaaaaaaatagatggcacggcacagcagcttatgcctgcagtcccaacactttgggaagccgaagcaggaagatcacttgagtccaggagtttgagaccaggctgagcaatatagcaagactccatctagaaataaataaataaataaataatttttaaaaaatagacaataacagataaagaagttccatgttatttttttaaattctagatagccccactggtgttacagtttattaaattacatttggaagcgattttttagcagtccatttattttgtatatttcagtttgttgagagcagatggggttgagtgttgatggggttgattgcctggctagattatgctataaactataaatctttgaaagttactgttttgaagaaagcatctttaagtgaatatattccttcagtagctcctattaccaaaactgttgtgagaatatcttaggaaaacaccttaaaatcctcttctatcaaaactcccaagctttcttcaggagccagcattgttcagtgaatgcatgtaagcctatgtcttaatagagggatccctaacctctggaccatggactggaacagcaggaggtgagtggtgagcaagtgaacattactgcctgagctctgcctcctgtcagatcagtcgtggcattagattatcgtaggtgcacaagccctattgtgaactatgtatgcgagggatctaggttgtgacctctttatgagaaactaatgcctgatgatctgaggtggaacggtttcatctcgaaaccatacccccgcccctgcctcccagtctgtggaaaaattgtcttccagaaaactcatgcctggtgccaaaaaggctggggaccactgtcttaatagatcttgaaaaaagttggagtaaggtaagtggtaaatcctaagacatacattgaggcagagctgcagtggtatccagtagggaagaaaagacttcaagtttagaattcagttatactcaaccagtttttgcctttctctgttaaatattagatatcattaccagacacatacaaaagattttaattgcatgaatgcccgatgttgatacaagagagccgatttttttttcacacatagttttttggggtttttttggtagggagaaacatcatctcatgatatcgttttaaaggtgctttattatcaaggaccttagagctttttctctcactcatatttcatatactcttagtcctcaagccatttctttttactgaaagcactatagagtagcaaaaggcatcattatattgctcagcctcattcatcatcaacaaaattgccaattatattccaagtccttgaatgtattgtttaaaaagatgtataaggtgaaaggaagcagttcaatgttgaggtggaagatgaaacatactgactggtagattcagagcatactaatcttgttttcacttgtgaactggaaaaaattaacatggagggatggagaaaacatgttcaaactacaaagtcattttttctgagaagttatctgactgtaactgtaactgtaactataactcagggtatatcagagggctcaaatgtggaacacttctttaaaattaaaacctaaaagtcctgatgtgtaatagaacgtgtaaaaatagcagcctctgaaggatctgagatgagcagaggaacactgaataatataatctgacagtatgggccatacccttacagtagttgccgtggcctggaaactatagaattaattcagtaaaacatcagaaaaaaagcaacataaatataaaatattttaaattaaaaagactgaataagaacagaaaaaaatcccctagcaaatcaatattgcttggggaagcatgaatcccagaccagcaatattttaatccaaataacttttagttccatcgtgaacacctttatcaccaagttttataaagagtggagtgaagaaaaaaagtacttgaggttgttggaaacacttctcaaagttggtggctttattcagagattcatgcttgactgtaccaacttctgtttaatttatacgtagtactttgtcaatttaggaatttggtttacttgtcctttcctaaatatgtgtattacaaaacaaaaaatagagaaatgataaaataattacaaagatgattaagcaatagtgttggctatagtgaacagattattgccattttatagagtaataatatacctaaggaaatctgtgggaaatttaatttgggatataaaacacagaagtcaggcggagatgaaataataaaccaataggaaattaaatttaggcatgagagtccaaagatgtaaattctatagatgttataaaataatatgtatgcccttacataatttcattactctctgaacttcatttctcagtgaaatatggggaaatgatactgaacagtgcagcagctcttccgcttatgaaccaaccagaagatatataaacaactcttaagggttatacattataaagatataatttagtctggatttttttttaaatttgaaaactaattttatataaaccctaattgggcaattctccattctttgacttgaatattatagtaaatatgttttcccaatttccaagtttcatgtattattttcaaagaaaaaagacaaacttttaaatgtccagctacctgggacttcctctgattatcttttaaggtagttcaaatatatacaatttcaaacaacaacaacaacagcaaaaaatattttgccagacaatatgtcttgtttgtttttaatgttcacaatgtaaagtacacttattgccaaacctcactttcaatggtgttacaaattagccaagtataactagtttgtaaatactaataagaaggttgctgaaattcagccctgaatatttcttttctgcaactccaaagaggaaaatttttgaaatgcaaaccttgacctttatcaaagcctaggtgaagtttgttggaggtgtttggttttttgctggtgctttgttataatgcagtttgaaagtagactagattggcaagacataattggctgctgtgtggagaatgcatttggtggaacacgtgagttaggggtgaggaaatatgaagagccagagtggaagcagggagaccagatagtagtgtgggaagcactggtgttagataagatctagataaaggtagcagtggagatcacaagaggtggttggaatcagggaatatggtttagaaacaatcacaggtcttgctgatgcattggaggtcaggagggacagaaagagggcaatccaggtgtctcctcggctttcagcaggaacaggtacttaaagaggaacaaatttggtagggaaaatcaagttttagtgttccattgcagtacatggtaaccatggctaataataatgtctcatatatttcaaaattgctaaaagaatagatttttaatgttctcaccgcaaaaaataaatgatatgttggtgaggtaatggatacgttaattagcttgatcaactctttctacaatatataccaagatcaaaacatcacatcgtatcccataaatatacaaactattatttgtcaattacaaataaatgaaataaataattttttaaagagatgtcttaaagggtggcttgaagagcttctgtgctccaataatacctgcccattagccatactttgcttccagcaacaacaggaaaacatttaatctaaacaaaaaaaaattgcttgtcaactagatagctactcttccgtgtagaaaccctagagctgcctgggtttagacatgtttaagtttgaggtacttattgggtatctagctgtgcagttcaaaatttggatctgaagctaggggaagacgtcaggacaagagctttaacttttgtaatcatcaatatatacatccttcttagagtcatggggtgggatgccatcatattgggatgagggaggaaaccctgggacttcacaatatcgagctagtttctgttttgcaaaaggcaaatgtattaatgaattcattacattaattaagcaaactatatttattgggggctattgtaccagctattgtaaattttatattttatattatatatatatatatataaaatgctcacaaaataaaggaactaagtcataaatatgcatatgatttacataaaggagctaaaataaggatctctgtttctgtttcaattctttattaaagatctatctaagactataaagacatatataacaaggtacaggaggtaaagagtatattcttaggcatctaaaaatttttcctatgcttttgaaatctgtgtgatttactttcttgaattggcctgtaatataggagtacaatatcattgcagagattaattagtgtgtttgtgaactgttctcaaatgctaaaatgaaagcataaaactataaaatggcatcattattccttaaagaagcatagtttccaagggtgtctctgatcattgtcacagcataaatgaccaatttcacccataattagccaagttagtaagaagttattttttactgggtatattttgtttaacctcagttatatttgtaaaagtagaaactgctacttgttactgctttcagaatttctcacaaatgctaaaatgctttttaattctaatgcacttaaatggtttgattctccttacctaagaaaaacatttatctaaagatatactcttgactgattcattcattgattcatttgtcaatagatgtttatttatcagaatatgtgcaccagatacattgctagatgtaaagggtacatttggtgagcaacatgcatgatacctccaaagtatagccagggaatagataatggaaatgacactaagaatgaatacatattaacacaaaaagagagagagagtcatgtgtcaaggcaatttagcaggagggaacttgtcaatacaagggattaaaaggacagcatgactagggctggaggaggtgaggagaaaactcaaaaagtcctctggctgatgcaaatgaattggatgaggagcctatgaatacaaacgtttgaaggttactgatgaaagccaggtgagagaagatgggatttggaccaagatgatgatagtttggatatggtgagaaaggcatagatttgagagatttttaggaggtaaaaatccttaagatttgaggatagatatcataggaggaagggcgcaaagagaaagcaaaacatgtcaaggaatcacacctagatttctgggcaatgcacagttggtaattctttacagtgagttagggaactctaaagaaagatcagatttagggtggcaatttgattgtaaatgtttggatttcaaatgattggtgacatccaaaaagcactgtaaatagacagatagtgtgcacctaaagaaagaaggaggcgcatctgggttggagtcactaatttacatattacttgtatatagctagtaactgaaaccatgagtgtgaatgagattctgatgctaaattctggaaggtcactttttaaagtgttttgctttttgaagtacaggtgcaatactaaaaataaaaaagactaatttttaaaaattaaattaaaatgaaaagcctggaaagataaacaccaaagttatgatactagttgtagtatgggagagggggcatcagagaggatcggaatttcatcttgaatggtgtattttatttcaaaagaagctttgagcaaagataaaatgttaattctgagcattagaaggaacacatttgtttttttgtactgtggatctttttgtatttcctagaactcttaatctaaatcaaatattgcaaaatatatcactgtaaacaactggttggtcactagctttttaaatactttgtagcaacttggttgcttgtcagaggtcttctttgagtgaagtctttaatttatagttctttatgcttgatcagcataattgcaccaaactgttacttaatctgaaaaatagctgtttcctagagccctacttaatactgaaaacctactgtgtttgtattgcaattgcatttttttttttacttttccccctgcttttcagtttgtataatttctgttaccctatattcaagttcactggttctttccttgtctttgttgaatctacagatgagcccatctaaggtatttttcttttctgttactgcttttaatttctagcatttccatttgattcacttatagtttccagctctatactgaaatatactgaaatatagagctggaaactataagagtgaatcaaatctaatcttgcatattgtcttctaatcttacatattttctatctaatcttgcatattgtctttcttttccctcaagagtctttaaaatattaattatggttattttaaatttcctgtctgatagttccaacaactgttacatatctaagtctggttctgattcttgctttgtctccttagactgtgatttttcttgcttaggcatgctttgtatctcaggggtaaaagtcaggcatcttagatagcgtaatagatactgaggtaaataaacctttgacatggtaatttatcttaatctgactgggaattgggctgtgtttgatgttggtagttgctttggttgtcattgttgagttttgttgctgctgtggccaccagagacttcaaattcctctggtaactttgtttcctcattggaagcttgttagtgtagtggttgagtgtcgggcagaggcattctctaatgtttgaattaatacacagttggcctgggtcttggggatgtggtctttacaattatttctttcccttcctccagaggtagagtaacttcaacctcccattcccttcctggagctgcagtggatatccaccagtgttctcagtctatggccccaaggccctttctcctgcataaggctgaaaaacaacaacaacaacaaacaaacaaaaaaaaacaaacaaaaaaagaacaaaacaaaaccacacatagatgagatctggtgttcccttcccctaaaatgcagtggtatttcctcagtgcctgatatggtttggttctgtgtctccacccaaatgtcatgtcaaattgtaatccccacatgttggaggaggggcctgatgggaggtgaatgaatcatgggggcagatttctccgttgctgtacttgtgatagtgagtgagttctcaagagatctagttatttgagagtatgtaggactttccccttcactgtgtctatcctgctgctgtgtgaagatgtgcttgcttcccctttgccttctgccatgattttaagcttcctgagggctccccagccatgcctcctatacagcctgcagaactgtgagtcaattaaacctctttgctttataaactacccagtcacgggtagttctttatagcaatgtgatgtcttttcctctgaagagaagggtataagcagattcatggtgactagctactgtgacccttccccaatcagcaacacagagggtgttggggaggctttctccagattcttcgcatcctccttgtgaaggcaaggtacagttcctgaaggaagaagcttgcaaaaggttgggactccacctatggcagtagcccccaggatcttcacactctcaggctagctcccacatgtcccccaacaatttaatctccctactagtttatatggcatctgctccagggatccaaatgctcaggcactgcttctggctaaaggccaatctctctccagatttcaggttgttctataatgtcatttctctgatggactgatgaaaagtcattaatttatctgtccagcagttttcttgctacaagtatgggagcaacctctttgcagctctccatctccatctccaagttgaaactggaagtctgagcaatacattttagaaattaatatttgtaagttttccgtgtcataacaaaaataataaatgttcactgtggaaaacatagaaaaagattaaaaatatttaagtgcccatcaccacctagacaactgcaatgaacatgttggtaatgtcttcttccagttttttaaaatctgctgataaaatacaaaagatattgtttatataactttgtatcctaccttttcttgagcaatgcaagtttaaacctaaatacgaagatactctaacttcctactttacatttttgacggcagatgtcagctgtcttcccaagtgcagtacccttggcttaatatcaggtagacaaataaggccaccacaaattcacctttcacctcaataacacaggtaatttgatagttctacagaccctataatattacttgactgaagacccagaatacaagtctttcaaggattactctagaaactatataaagtattggtatcatctcccttcatcatatcttgccaaatccaacaggtttggaacttctgtaggaagatttttgtaacatgaaaaatgcgtgttgcaccttccatatccagcaaatacaccatcggttttttgttggctgcaccaatgacataaaatgatttcactgaatagggggtgacccagaatggaaatgtagagcatcgaaaataaaatcaaccgacgcagtctttgcagcaaaccatgtggaaacaaatttaaatatggaacatactctttccaactcatcttcagatgttgctttaaaatttgtgcaggtgaaaaaaaaatctttattttaaggtaactcaatcttttaccattggagagaatagaattatttttgtttcctcttgtatattcccagttgtttaaatgttctctgtttccttgtgtggacacataaatccaaatatatctaatatcaaggtatttaccatatgcagcactttttcctcagatagttattttttgaaatattcaaatagcttacctgtatcatcccccccatccttttttttttttttttttttttttaagacggagtcttcctctgtcaccaggctggagtgcagtggtgcgatctcggctcactgcaacctccacctcccaggttcaagcgattctcctgcctcagcctcccaagtagctgggactacagttgcatgccaccatacccagctaatttttgtatttttagtagagacagggtttcaccaatttggccaggatggtcttgatctcttgacctcatgatccacccacctcagcgtcccaaagtgctgggattacaggcgtgagccatcacacccagcctaccctattttctaaacgaacaattagttgacttttcttcagttcttactcagaaatatctgaccctaggttccaacttttgttttgctctttgcagttagtttttatgtgtactgttagggagatgtgctttttttttaccttcaaatttaaaagagagagttttcaattccttttaagtcaaaatacaactgttctactctaaagctttctttaaaaaaagaaaagtaccaaatcctcatccgtagtaattaattttgacagtgtaggctcagtagtgattcacaaacctgtattttgtgcatcagcattccttattattctaattaaagtggaacattgtgccctcgctaatcattaatgggttttcattttgtaaatgacatttgcagaagttaaaacagcgagttcatgtgaagtccacaggcaacggtgttgaaattagcatcaccatagcaacagtcttccatcattagcattcagggcaacaggaggtgttttgttgtgttttgtttcccaaaaaaagaaaaagaaaaaaacttcaaaggtaaagcctacagaaactctctcagaagatatttatgttccttgtgtgtatgtgtactgtactagacctctaagtctacatagaattttttttaaaaattgcaatgtggatcatctcctttccagatttgtgttttgcctagtatactagctaaatttcatgatctttctccagctgtacacgtctgacctgctgagcagcatttactcattgccaacctgctgctcaccaatagggtttcctacgtggatgaagagagtctgtattcatgaaaatatttggttcaatctaaaagtattatgtgtattcatgagtttttaatttaattcatggaaaatagatttatgctgttagatcctctggtgaactcatttagtcatgttgtagatataggtcaatgattattctcattcatgtttagacggaattaaagaggagtcaaatagagaacaatattatcttaactgagtctctggcagtggtattaccactattactctgtatgtgtgtgtgtgtatgtgtgtgtgtgtgtgtgtgtatgtgtgtgtgtgtgtgtgtttgaattctaatattctgggaaactttaaaagtggcatatctagcacttatgtttttctcagtactaaaatgcataaaagagcaccatattgacctaccagctgcttctaaatcacaccagtagtaggtaattatgaaattcaaatgaagtttaattttcatttattatacaaaaatgtcatagctcaaacccagaagtgttacccccaagcttggatatagacaggtatgtgtgtacattttacttttcaagatgaatcatagcagtcttctccattacatgtaaggactagaagttgtacattccactcaggtacctaaaggcaagcctgtgctagcccacactaacaaagcaaaatgaagcaaaggatctatctggctttcaatcagggatgcatctatgctatcatcagctctgtcacataataaatgagtctatagataacttgaactactcagccaatgggctgtaacccagtgattctgtggtattgaaaggcagcaacccccagaagccacatgtctcagtgtgcactccaggactgtaggcccatagaacttgtatgtatgcacacatgcatatgcattccccacttttctaatggcgatccaatctaggcctaatccacagctagtccagaaaagaacttttttaggttttctgtctgccatcactttgttgagaggcagtacaagccaagcaggtgtctgtatttataatatgcacaatgttaggataactcaaactcataagggaaagattaatggctgactactatgaaaaccgcttctagccttgtgataccagcacctactatcttcctttttctcttatatgatgaaaagatttcaatgttggcttttcattctgatagaatgtgcaagccaaaatctaaataaagtccagtggcaatgatccccttaaacattatatctttcttctcgatatgctgatgttttcccttataaaaatctatgtaagtttcaagatttatatgacagacaaaccacacaaacaggaggtccctcacattcactactagtcacttgctctatcactctgggaatagcggtcttcagattgcatctctactctacctcttgctcttttcaacccctctcctcttttttagaccatacagggcatcagacaaggtttagtttaccactaaactttgggatttggaagatggtgtataaactgatacaggtagtccactcacagatgtagtatataattacagacttgagttttcaggggctcttctccagtttcctgtcaatcaatttccctggctgagacattagcatttgtcagtgaccatgcttactatatacatacacaattgtgtatacacaattgtaaaattaaatacgggctttagaagagattattttttcttaagagtaggttactctataaatgccaaagcatgtgttatgacatagaaattcaaatgactaagaatagctaattgtttagaaacatcttacttgatgtctattgttccaaaatttgatccaatttagagtggtaccaatccatggtgtagaatataaaagctaaaggataacaaaaatcctaggaatctcatgccagtaagaaagttctaccagtcagatgagatgttgagagcatttatgacttggcatcaggaatattataagtaaaattcatgtgagcagtaattgcagctatgaaccatgttatttgttcccacttgtccaactgtaattctttcacttagctcagagtagttctttgtaacattagggcccactcatctgcctttaggtagggttttaaaagatgcctagaaaatagttctgtgctagaaatcagagactcttgacctactgtaaagggagcagtaagcacgtttcctcaggagaatctttctacatactgcagattcccataaaaatctttgtgacaaaattgcctttactgaaaccatcatccattggattaaaaaatagcttaccattagctttttgaaaatagaaaacgttgagccttttcaatgatactttcaatagtttttcacaactatgagtcctcaagctatcagtcttatttttagataccatacttataagatagttatagaatttatagagtatggtttaaaagactattcaattatagagcaatcattcagtttattcccatggcagaagtaaatggaaaccactccagatcaacaagaatctactctcttctgattcagaaaagagatttcctatcttttcatgaataatccatgttcaatgtttaacacctcaggaagattttcttaatagcttcttctggtcataaatccttggtctgtcatcagggacatattgaagagttagttaccaaagttcttaatgtctcccattgtaaaaaaaaaaaaaaaaaaaagtcactttttggattgtttctttcatagagtccatgcttctgtacgcttaatactttagcttttgacttcaagctttaggtaatgcaaatgaagctattacatcaccaaagttaaatttttcttgtaagtatattctcaacattcacaattgagagctgcctcttctttggctggtataaggttttaatttattgtagcactttcaccctagaatggcaaaaaatgttgaaatcaattccatatatcaccaatacaaagtactaagtcaaggccgggtgtggtggctacgcctgtaatgcaagcactttgggaggccaaggcgggcagatcacttgatgtcaggagttcgagaccagcctgaccaacatggtgaaaccccatctctactaaaaatacaaacattagccaggcgttcatagcgagcgcttgtaatcccagctacttgggaggctgaggcaggagaatcgcttggacttgggaggtggaggttgcagtgagccaagatcatgccattgcactctagcctgggtgacagagcgagtctcaacaaacaaacaaacaaaaatattgaattgtacaccttaaatgggcgaatcgtatggtatgtatactaaatgtcaataaagctgttatatgaaaaaaaaatgctaacacacacattctgaaagtatattaaaagcaaacctacggccgggcgcggtggctcacacctgtaatcccagcactttgtgaggccgaggtgggcggatcacaaggtcgggagatcgagatcatcctggctaacacggtgaaacccagtctctactaaaaatacaaaaaattagccaggtgtggtggtggacgcctgtagtcccagatactcgggaggctgaggcaggagaatggcgtgaacccggggctggagcttgcagtgagccgagatcgcgctactgcactacagcctgggcaacagagtgagactccatctcaaaagaaaaaataaaaataaaaaagcaaacctacaatgtctcttacaaacacaggcaactattcaattccgagtttacactactgaaacacacatgaatatgacactaagagaatcacgtggatctgcactcttcaatcaacactacgtctctgagcacaagaattttacatctgatttccatttggggaaatagattcagaatgccataaaccagatacttcttgccttcctttagtggtcatttctgccattatcatttaagggaatggatctccttctcccaaaactgttaccctaagattacaagcttgtcctttaacttatctctgaaagcacacctctataacgggtcatcagtattcagtcagctaattagactgcagaagtacgtttactcaaatgtgaggagataaaattgtgaaatgtaagaggaagaaagaatgtcaaagataatccaacccaaactcttcatcttacagataggaaaatggaagtccaaaaggggaaagtaattttagtaacatggctaaactggtctagaaaaccagatcttctgatacctgatcccatggtctttctaatgccatggatgttcgggtagaggatatattcaggtagataacttatagatagccccatgtgtttgtatagcactttatcgaacactttcacctctattatcacacttgattcttacaatatcccatggaatgtttgagtatcatatatgattattcttattcccacagacttggaaactgaggctttgagatgtctggatctatcttagatcatttgctatggactagaatctgggactaagttgcttttgtctaagctgtgtgtttgttctgttgtgccgtattgttaattcatttctgttggtaaacaacacaaaggaaaaacttctataattatgtttctttttcatcctcaggtcatctatcctactttttatctaagctttggaaaatattatgtgctttccttttttttgtattttcttttcgtagagatggcagcagggggtagtctcaccatgttgcccaggctgacctcgaactccttggctcaagcgatcctcctgccttggcatcccaaagtgctgggattacaggcgtgagccaccacacctggcctattatgtcctttctttagcttgctcgtttaaccatttgtttggcagggggagtcagaactgtgttttacttagtcgattaactgataggacaatttaatatctaccctgcactggcagtaacccccatagccccgctctgtgtctcattctgtgccctgaacaaccttgtcttaaaaacattttaaaagcagcaagtatggggagatttcttatctccatataatacagaagcaagtgtagagtatggctacggaaaacaaccagcaggtgaggctgtgacataacaattttaacccaagcctcactgccacattgaggtatccttgttcaataaatagatcagaaaatatggtgtagtttttccctaacgctgtctaaacagcaacaacaaaaaatcattacccatagtatttcagtaatgtgttgtattgaatgcattgttttcgagggcgttttcaaaaaataagttgattgaatctcttttttttgcttgaagaatgacccacattcagaaagtatacagatgaaacatgttcagctcaatgcaattatcacaaaatgaatacacctatgttcgccatctaggacagtaaataaaacattatcagtagccctaaaccagattacacacacacacacacacacacacacacacacacacacacactaaaccagactacacacacacacacacacacacacacacaccgggttgggggagtggtgagagagagagagagaaagcgaatattatgttaacagttggggagtctaagtgaatggtttatgggtgttcttttaacatttcaattggtttaaaattttcaaaatgaaaagcttgaggagaaacatagaatataaccactacctcagaaatcaccaccctacctcacccacattccctctcccaatcactattcctccctcatcttaaaggtaactgctactctgccttataacactatggttgagttttgcctgtttatttgaactctataaaaatggaattgtacagtatataaccttttgtatctaggactcaacattgtgtttatgagattaactcatgttgttgcatgaatctgtcatacattttcattgcaatttgatatcccatttaaaatgtatactataatttatccattctattgttggggaacattttggttctttccagtttgaagacattatgaataaggcctcctatgaacattctttaatgcgttttttggcacacacgtgtgtacaactgtgtttggtatatactttgcagtaaaattgcctatgttgagggtaggcatatgctgagctttagtagatactcctggttttccaaagtggttgtaccagtttacaccatcattagcagtatatgaaagttctagtagctccacatctcaacaatacttgatacttgttagtctttaaaattttcgccattgcagtgagtgtgtgagtagaatctcattgttattttaatttgcaattgtctgattacttatgaggttgaatatttttacgtgtatttattgaccattttggatatcctgttgtgtgaagtatctattcagtctcttgcctattttttttattgattcatccttctttttcttattgatctgtaggagttttttttacatattctagtttgtagccctttgtaaattgtatgtgttgcaaatatcttctcccattttatagctttccttttaattaaattgtttttttgattgatagttcttaactttaatatagtccaatatgtaaatttttccttagggttaattcttttgtgtcctctttaagaaatctttcctaatacaagataatgaatgtatcctcttttattatcttctagaaacttactattttttaacttttccatttagatatatagtacacctggaattgaccttttgtgtaatatgtgagatagagattgagttttatttttcataatatggatatctagttggcccagtacttgatgctaaacattcatttagaattcatttgatagtatttcctttagagttattgcatctgtgtttattagttatattggtctgccattcttgtcaaggtttggtatgtggattattctggtttcataaaggcaagtagggaagcattgcctcttctagtctctggaagagtttctttaagattggtatttctgccagtgatatgatttggccttggaattttcctagtgggaaaatttataattacagtgtttatttcttaaatagtacagggctattccaattttctatttcttcttttgtcagtgtcagttgacttaaagcacactaagatactctaagattgctatggtcagcctttgctggtctaaaccagaggttgcaaactgaaatgccaacagaggggctagcctgctactgtaactgggcaaggctagcgaagcgtaagttaatgggagctggtagggactatagaatacatgtgccgttatagaatggtggctccggaaagttattgtcatgcaagaataggagcccagcatggacaaatcattccttttaaatgagaagtcagaaggttggattattctgtaaaatatctctgaatatttaaatgttgagtaattcagattaaaaaaaaaaaaactgtgtgggctaatcaaaacatttgtgcatgccaaatttagcccaaagtctgctagtttgcaacttgtactttcaactaatgaaaagcgtaatagcacagatataattccattttcaaataatataattcatttatagttgacatttatttaatttacacttaaatatgaatttgtcatttaatttaccatattaaaaaagtttagattttaagacatccaagtctgcaaataactagaatattttcatttactctcatgtttgtgtacttatttttccttaaatgttattttcatgatatacttagtgtcttgtggacattccaaaaaactgatttgacttaaattgtcctcactccaagctttaaaattgcttagttcatagcctaccttgcctaaagcaaacctggtagtctcatttcaagttactggattttttgtttgtttgtttgtttgcttttgccttgtttcttttcaaggttatatagagtgaaggaatatcagacttcttttaatttttgcagggaattcagattgctgtggattaagatcctatatataagatgcttaggatagaggcatcatgaatgaaaaattattcatatgaacacactttttagagtattatttttattcattcagcaaataatcatagctgccatactaggcaggtagggaccatgaagactactgtccttgtagtctaaagtcttgtagactaataagatatgtataactgttaaatagtacactgaaaatacaaccttaaacaatcaaaatatttgcaaattgtatttagttgacatgattgcataattgtatttatgtgacaattatatttgttattcacatatttagggagtcaatatgtacttaaggtaatctttgagctattttcaggatgaggtattagctcattactattaatactaccatcaccaaatgcattacctacttatctgcatttccaggaaaaattcaggaaattaggatttttaaaataataaaataatagtaaataagactgggcatggtggctcatgcctgtagtcctagcactttgggaggccgaggcgggtagattgcttgatgccaggagttcaagaccagcctggccaacatggctaaaccccatctctactaaaaatataaaaatcagccaggcatggtggcgtgcacctgtaatcccagctactcgggaggctgaggcatgagaattgcttgaacccaggaggcggaggttgcagtgagcagagatcatgccactgcactccagcctgggcgacagagtgagactctgtctcaaataataataataataataataataataataataataaacagaataataacctaagtgactatatttgatatatagttaagtgatgtttttgtagactttactaaactaaaaaataaattagcagttatttaattttctagtttataaagtacctacttacataaagttgcatatattacttcatttaattttaaaagaatatcgtaaaatatgtaggatagatttccattttatagtcaacaatacttattatttcaatacattatgtgattttttttcccccagtatcacagtgttagagcccaggttcaaaccagcattttctaactgtaagtctggaagtctgtctgcttactctatgtaagatgccttatgaagttcatagaggagacagctcagtggattcaggcctggtcttatattttgctgttcatcttgttttaagtgttatgttaagcaaataaaacataactttaaacattctgtttacttttaaaatttgatttagagctaacaaaaattagaatttgtactccatttacaacgaacagaacaaccaaataagcaaaattgtatttgcgttgtcaattacaataaataattataatggtatatcagagtgttaaattttgatttttttttttttgagatggattttattttattttttattttttttttttttgctctgtcacccaggctggagtgcagtggactgcaacctccacctgctgggttcaagtgattctcccgcctcagcctctcgagtggctgggattacaggcacccgccatcatgcccagctaatttttgtatttttatagagatagagtttcaccatgttggccaggttggtctcaaactcctggccttagatgatccacccgcctcgacctcccaacgtgccaggattacagatgtgagccgccacacctagactaaaattttatgttcttatatttctttaaggaaagcaaaaatgttgacagagagggttaatactagttatatatacaaaaaacctaaaaataagattttggattattctattatatgattattcatttattgaaaatcataaactaattgaatgactgagagcagcactaatgtgattactttggtaggaatctgtcctccaaagttgtcagttgtcagttattcttagcattttgaactgaagtctatgtaattaagtcacctgttgtttctgacaaaatgagcaaacacacataaaatctcttggttcgtcttcatgtctctgtggcagagaactgaccacattattcagttcctttgtcctttttagacaaaagccacctctacatggccctataagtcttcaattcaaggactatagccgttatcttaatgggattgtacttggttatctgataaattgtcgggaacatacccacattgcttcctttacctgacataaaatttagtcagctggggctcaacgattgaccagctttatcttgcacgtagtgaagggaaggactttcttactcctggatgtgcctaaatttaagcctttgaaaaagattgaagataccaattggcctacctgccctaagtagatgcttcccacagacttaactggtgaagtgcttgtctaaggtagacagaattttttctttagagaggagcaaacaaaaacccaaaaatactggcgtgttcttttgatgttctatttcccaattgatttccgggttcacactactccacaacatcttactgtcccattgcatcttaaccctctctcctctcccgcccccactttttttttgtctgtttcttctgcttccaccgttgcttctgctctgaagcaatcattttctctcccttcaaccaagggtggaattggcacacagtcaattggcttgggagactgcttactgatctgtcttttttgaacactggaatcttgacactggttatcattttgaggacagcctggtttggatatttatctattaagaggaatccttaattggtgtctttgactggagtatttgaaggagtctttaattgggaggttttaaggcaccagaaaagattcattaggaatgactgacctcatgttatataaatgagaaatatttaccatttgctgtacacgtaattgaagcatgattatacataaaagcatataattaaaaaatgtaaataaatacctaaataaataaatgcctataactagcatggcaaaggattctgatatcagctttcaatctcttttagtagagactggacaaatcagaaaaagaggatttatacctgtcctcctatagattatgctttcttctcccatcatccagttttaattgaatctcctcattgtgctttctttcaatcttgagctgcacaagttgttttctcctgtcagagcttttaatacacattgacaagaattattagtctctatctgcagttgttccaagtgcaggtttgaaataaggagtcgtcatcaatgtgctaacgcgtgctacttttggtatttatacaaagtgcctgctgccagttacttgccacttagaatgtgtttttcttttcctctcttgcgttgtgggagtagaaggattctctgtttcttttggcagacagagaaattttcagattggggtctaatgaaagaaataggttccattatacagatgtacagatgttctaaggtcacgatacctcctataatattcttatgtgaaacctcctctttatgttcaacctgtgtacgttacacttatacatagcaggcatagtagccatcaatattagttactttaaaacccaggcctcctaggctgtggtttgtactaaaacatcatattcaaataaaagcattccaatacaaagtggagaaacagggacaggcatggtggcttaagcctgtaatcccaacaggctttgggaggccgaggagggcagatcgcttaatcccaggaggtttagaccagcctggccaacatggcgaaacctgtctctactaaaaatacaaaacttagccgggcatggcggcacatgcctgtaatcccagctgtaatcccaggctgagttatgagaatcacttgaacatgggaggcggaggttgcagtgagccgagatcacgccgctgcactccagctttggtaagcctcggtaacagagtgagactctgtctcaaaaaaaagaaagaaaaaacgtgtagaaagaaagagaggatctgattaagctcacaggaacattgcttctcaaattttaatgtgcatacaaattgtctgggaatcttgttaaaatccagattatgagccagtgggtctaaaatgagacatgatgttctgcatttctaacaggtgatgctaatgctgctaatctgtggaccaaccacactttgagaaggaaggaagtagactattatatttactcattcacttgttccatgataactcttaaaacagactggtgactttaatacaattcagagcaccaaataaagattgtcatatgccttatttttaacctatcgtcttatatcaaaattatctgataaacttcccaagtgtgcatatatattgtcattttaaataggtttcaataaaatgaagattcgtgagtaagaatataggaataaatgacattaaaatctttctttataatttatatttctactttcttttgaaagaatttgtagtggcttaaacataagagcacaagatgagccagtgacaggaaaaaccaagtgcatctgacatcttagcttattaggtctagaagacaacctccattacttggtagcaagcggctgggaatattggtgttcaaagctgtgctttcctgaaggcaaaaacagcatcaaaatatgaaaagctttttacttctggcatgagtgataaagatgccgatctgagaagcaggtgaaaaaacttagcttatgcttctaaaggctaattttatataagtgttcttgtccagctgttcttggtaagtccagctgctagttgaacaggacaggtggtaatccctgttcagtggctcattatcacccagaggctttgatctggctaatacataatcaatcagcttctgaatattaatattcttcctattttcatttcacttgttttacctaaatttattttccaaagttccagtatgtttttgttttttaataagatttttgatcatttatttattttgacataactaggctcatgatatgccagctggagtttattacacccctgaatcacaaactttttttcttccctctttatctccttacaagatccaaattgcaaaacctaaggataaagttctaattttggaagcacaaaagactgaaactattttagaggagagcgttaatgaaaatcaatatctaaaatcctcattttaagactgtgaaccctatagtctatacttctagtgtcttcagagttgtgatatgcatacattaaggactaagaaacatttttttaaatagtcagatttgggagcattagatatgtttgtagagggaaaaatcaatttatgataaaaattactgacaatggtttaatttgtattagttttgcccacttccctgttatctcagaatggcacctccatggacagtggaatggtcctaacagcctaaatatggtaagctttaaaaacagatggcttggggccattctgcttattatatcattgctttcaatagcataactgttcttctccaatggccctctttgttgtttgcttcattactggcacatttctttaatatgtaatctataacattaacatgaaaatggctctcaaatactattactttctccatctgtgacccagtactgtttatcatcatctaatgatcattcttattgcagatggccctctttaaatgtttcagaatagcattttaaagacattgagggtgcttcctacgtacattggcagactgaatgttttaatatcgaaaatctcggtctacacgatgtgtgataaatgactggagatgcaaggcaccagtcagttccaaagcaaggtgtaagagggacaggaggagagtgataaaaaagaatacatactttgcgtgtgtgggtgtgggtgtgtgtgtgtgtgtgtgtgtgtgtgtgtgtgtgtgtttaagccattagatttatctttaaggaagcattatctttaaggaaagttggagtaggaagaacaaaatttaatcaaaagaaacagttcttggccagaggaggtggctaatgccggttatccgaacactttgggaggctgaggtgggagcattgcttgaggccagcagttcaagacctgcctagtcaaggtagcgagacaccccacctctgccaaaaaaaagaagaagaagaagaagaagaagaagaagaagaagaagaagaagaagaaacagttcgttattgcagttcttaaagaaggagtttgtgtttcctttctgatcattcaccatggcagtgatacaaaggagtgatatcaaattgataaatgagttccctaaggctcaacatatactaaatgcctatgctgaacttccaggtttcaagtccctagagcctctctgtctgaagatcctatcaccaaggattctttgtcttcatctagtactttctttctcctctctctattctttcctcatttgcggatgcttgctggggcctgtcaatcaaacatagatgatccctgacttacaatggttggatttaggatttttttacttgataatgctgcaaaagtgatacacattcagtagaaaccatacttcaggtatccacacaacccctctgtttttcactttcagtacagtattcaataaattacatgagctattcaatgctttagtataaaataggctttgtgttagatgattttgcccaactgtaggctaacgtaagtgttctgagtaagtttaaggtaggctaggctgagctatgatgttgagtagattaggtatgttaaatgcatttttgacttagaatattttcaacttatgatgagtttattggtacataacctcattgtaagttgaagagcatctgtatctgggttggagcagaagtattgctagtaatgcatccatgagtcaactgtttgcttaattggtatgctaccacacatgtcttgagcttgttcatcccatggcttgccattgtgttggaaaggaaggtgttacagcattgccgttaataacatttctaaatgggaccaaaaacagtattttctttatctgctagatctttttattttcttctttctctgtatacgtgagctgttcccaaaatttagcacacatgttttatgattctcaacataacgtttatggtccttaacattaatctcatattagaaaataaatcatgatgaaggtgaaatatagaccaagcaggggcagttatgaggaccaaatcgtcagtataaaacttttataattaatattttcatgaattgatagcacttgcttcagagagctaaactcagaaaaaagagaaatattctaacctgaaaatatatttttaaaaactcataatttaaggtagggggcaagtagatttggccatattttgggctttcttcaccaattcagacacgataatgactacatttgtatcctagatttaaatttgctagatggaaaagaaacacataaatataaaccccatctgcgcaaacaaacataaccattcacattcttatgcaggattctggggtaggggagggctttttttgtattataacatagcatgttaatttttaagataaaatggaaatatttttgtgcttttgttaatttttatgttaaaaatgacattttaggcacctaatcaaattctctgagttctttcactaaagaattttgcctaatatttgattaaattcattattattaaagatcaatggaatttctttcagtttgaaaagttgaaaaaatgagttgacacattgattcatagaaaaagttatgaaatttgagaaaaattattgaaccaattttatttaaaatacatatagatattatgtgtatctgccttcattttcaggataatgaatgtcagtgttaaatgtggaaacattctaaaattggaaatcagactccacttggttcaaagaacaccttattttagataagccttttaaaataatgattgaaatccagtcaatccataccctcacacataatcctcatgcatgatctttgtttttccctatctctcctctaaatgtcctttacaaagatgagaaatgttcttcccaacacaaaattcctttgattgtatattagaaagaactgacactttgcagcaaggtttaggaaaagctaacgtaagtagagcttctctgaaaactgttttaccaaaacatactggatttactgctgttaaataatggatttttttttttttactatttatatttgctcctcattgaaacttgtaaatgactttattagtcttaggcaacacatttcattttgcattggataaagatgcttcttcagtaaagtgttcatttatagcattgagaatcttgaaatataaccggtgtcatcaaagggtaggaaggtagaggcacagagaagtgattaatcacttttccctccaatgaatgatctactgtcaagttcaataatcatatttcatctataaagagcactttgagcaaagcctgttttgcacacgtcattacatttgattacaattaagtataaatatatgcctattatttagctctagttaaaatctgcaaaaatatagaaggcttgtgggtgatgtaaattggagatttgcataggtttagggtacaatattagaaaacactgtagttttatttttgctttatgactaaaaggcactagctatgttatctcgtttgttcaccaaactaaaaaacaacagctaaaaagcaatgtaacaaatttcctctaaccttcttaacccatccactgctgtcgcatgactctcacaaatcagaaataaagaaccatttctctactgaaggtcatcaactcatttgagggccatagatcagtaaaaaataacttagtctgagacattcaaatcacttgctttttaggtaaatattttggcttttaaaatgacacaaatctgaccaaaatgttactcagctttatgggaacgggattcttttctagataatcttagggacgatcttaactcatattgtttttgttcagagactaggtctaatttgttagaagtgctgccatgggatctcattctactcaacaggagtgcattcttcttatccagtatccactaaaagtcactcctcctcccatgaaaagagttgccagtggaaaactcagagaaaacatgggaagggattggtgatgtcatataaggagattagaaaacatttttttaacgtttaaaaagtaaagagatgaattttaaaatttacaaaccaataagtttgatgttgatgagcaacaaaatcctggaaaatgacatcgtactgattattaatgattacataggataacatgctgctgggaatcagcgtgatactctcaaaatctgccatgtcacatgcacctcattttcattttttttatggctgcttgatggttagatgagaagactgttagagacagcataacttaggattttacaccacatttttcaagttctcttttgagaatattgggtacaagataaagaacagtggggctggctaataggctgaatttgaagctgattaaataatgacatctaaagaatgtcaattaatagatctagatcaacacaaaatagagtctctgtcgttggccctgcctttgcacatggctgtttcttcttcagtcatctcttaagctcaactcagccctctgcctgaagacctcatttggccagttttgcccattcattactactgtgaactctcttttgttatttttttcctgttttattctgagaatggattgagctagatatgtggaagttatgggaaagcatattttaactaaatattaaagaaacttttgtaatcgagctctccaaaaaataaaatccgccactttgaaaagcattaaactccctgtacagtagattttcaagactgaaatgactgtctcacccctaaaggcaatttctgtattggatgagaggatataattcattaacctttaaggtcacttgtgaatctaatgttttgatattttcggaattaatcagaagggaactgacagcatgacctgaatctgtcctatatttatgtaaacatcctgtgtgatgcacctcattctttgtgcagttgtatgcatttttgaatgttaaatttgattttagggcaaacgcttttttaaaaaaattttaaaataaactttattaaataaaaatttacacacagtaaactgcctccatttaaagtggttcagcgatttttggcagatgtgtacttgtgaaaccaccactgcagtcaaatgacagaacgttcttactcccccaaaagcctccttgtgcccctttgcaggtcatttttcctttcacccctgattctaggcaaccactgatcgtctttctctcactgtgtattactttgcattttcaagaattttctataaatagaatcatacagtatttttgtatgtatctggtctcttatattcagcataatgattttgtttccagcttgaggatattatgaataagactgctaaaaattgtatacttgtttttctaaataccccttataaaatcttacttttgagaagcatattactaaaataacttcccaggttatatgtgtatttgttctttctgttcatttcagcattatcttattaacaagcaactggaggacatgcaccaaggataaattgactaggtgctaactgaatttgtgagaaaggcctagtttctaacgttctttcttgggagcagatgtgtaacagctacttttgctgtataacagaccaaccccaaaacttactggcttaacactgaggtcagcaaacattttctgtaaaggacaacatagtaaacactataggctttgtggagcactttgcatctttgttgcacattctttttctttttacaactctaaaaatgtagtcatacttagctgagaggctgtacagaagcaggccatagaccaaatttgaacaatagttcataaactctataacacaatggccagccatttacttagctcactatttgatgggtggattgggccatttatgtggtgtgaccagttgtactactgtttgccaggcatgcttatgcatctgtagtcagctggcagctggataagctatcgtgacctgactcatatgtctgatggttgacaggctgtcatctaggaacagatgcaactaggtttgtgtgtatctcatcatccaacatgctagttcaggctagttcacatggaaacttctcaggtttctgcttgtgtcatgtttggtagtgtccattagccgaagcaagtcatgtcatagggccatcccagatgtaaggagtggggaaagactccacctgttggtgggaagagatacaaaggcacactgcaagagctggacaccaaggagagggctagaacttttggccatgttgcaagatatcacaaaatattcaagaaaagttacaggaaggttcctctgtggactaaattctcttctgaatttagatgtaggtaaaatggagtgtgctgttaaaattcatgctttgtgagtaatcattgctaggctaaactgtttgtggcttcacagccaatggtagacatacagcatccataatctagtgcttttaaaaatataagaaatactgattacaaacatagttaaccacttattagtactgggaatttaatgaaagctgctgtgattaaatactgaaaaaagaaagattgtgggtttccttctggtaactttcaaagctggtcactcttttgaaaggaattttattcttaaagctgttatttttactcataatatgcttaatacccccatggctgcagactgtctaaaatgttcctacaattatatgagaatacttttaaaaatcatgataattatcagtcttcatggacacttattcagattaatttccccaagcacttaataggatgaatttataagcattaaatagaatggggaccatccagccctaaaatgtgaccattctgtcaggcacacacttgccaatttgttggcgtggacctgagcacactagcaaggactttgaattaggtctcactgcaagatggaagcagaagggcatttctcagtttatgttttgaagtgttttgttcagacaggcaacgtgcagttgtgtatagtagtgtgagctacctgttactccccttaacaatacttttagcagcaatgtttttcctcctgcaatgtgacaatatcaccatgccatttggaagaaaacaaaaaggctgagtgattcctggtatactcccaaacagccacccaaacgaacagctggcagagaagacaccccctaaaacttggagcagattctcagcccctgcagcatctcatgtggttagaacttcagacttgatgaacgcctccccaacttgctccccctcctgaatcttttaatcctcctccagtctcttgtaatgttccagcccttaccagggaataagactgcaaactgtcttccgtcaacttctttccaaatcctagtctagagaaattataatgatgcatgattgtccagtgggcatgtatagtttgtccatttctttatgtagtaaagcctgtagctttcatcttttttgccaatccactataaaaattaattttatatgtcatcctggtacacacacacacgcacacacgcatctatatctgtaaatctttttctgtctattcatgcttgtatgattgaaagaaaagtttcacaaaacattacttacccataccaaatagtacactttcatattttttttttttttttaatttcaacttctattttagatacaggaggtacatgtacaggtttgttacatgggaacattgcatgatgctaaggtgtggggctcatgacctgttacccagattgtgagcatagtacccaataggtagttttataacccattttccccactccaacctctacactgtcatattttctattcttttctgtttcattaagaacaatactggtaatgatccactatatagatttcatgacgtactaagggttcatgacctgcagtttgaaaaacactgtagttagttttatctccacctcaggccaggtcatcagaaagctgcattcttagaccactttgccttggcccccataagattgcctcaactcaggtgtacctcggcatcatgttcctggcttatgtcgaggggcactgaaaactgctgaagggatttttctgaaagtcgacaccatgcagtgtctcccaccttagatcccatgcagatctgtttattcaatctaagtcattccagacttggattttcctttgtttcacttacactctttcctccttatcaataatccaaataataaaatcgatcatatttccttttatattttttcttttgctttgacatctacaaaggccacaaccaaattatacccaccttttaaaacacttttttactgaaatatattaggcatgtagaaaataagggagatgctggttaaaggatatgaaacttcggttaggaggaataagttcaagagctctattgtacaccatggtgactataggtaatgaaaatctagtatagtcttgaaaattgctaagagagtagatttaagtattatcaccataagaaatgataagtatatgaggtaatgcatatgttacttagcttggtttagccattccacagtgtatacatatttcaaaacatgttatacatgataaagatatacaatttttatttgtcaattaaaaaaaaagaaaaaatggcttaaacttatacagttcagtgaattttcacaatctgaacacactcatttaaccagcatccaaataaagaaacagaacattaccaacctttagaaggccctttgtgtgcccttctgatagttacctgtcctccaagggtaaccacaatcttgattttgaacaccattaaatattctggcctgttcttgtcctttatataaatgaaattgcacagcatgtactcttttgtgtctgacttctttaaacctggattcatccatgctgttgtatgaagtggtggattgttcattctaattgctatgtaatatcccattgtgtcaatatcctgcagtatattatatactctactgtggatgggcatttggtagaaaaaaatgatgttataaacattctaagacatgccatttgatgaatatatgtatgcattcctttgaggactatatcaaggggtagaatttctgggttatagggtctgtgtgtgttcagcttctgtacattcttccaaacagttttccaatgtggttgtaccagtttgcactcctactaacagagcatgagagttgtagttgctccacatcctttctaaccctgtgttgtttgtcttgctcattctggtgggtatgcatagcaaaattttcataaccacatcatgcactgtgatcttcaaagctgtgttctggctgggcatggtggctcacacctgtaatccctacactttgggaggccaaggtgggctgatcactagaggtcaggagttcgacaccagcccggccaacatggtgaaaccccgtctctaccaaaaatacaaaaaaattagccgggcgtggtggcaggcacctgtaatcccagctacttgggaggctgaggcacgagaattgcttgaagctgggaggcagagtttgcagtgagccgagatcgtgccactgctctccgacctgggtgacagagtgagactccgtctcaaaacaaaaaacaaaaaacaaatctgtgttctaaattttcctcgcttcttaaagttttatgctatttatatttccttagtgctgggttttattaatttttaagagttatacattgttataagttgccctaaagcctttacagaacaatgcacagtataaatatgtacatagtatatacacaaatatgaatccatgaatgcacagctaatagggccattatcaaaaatcctacacttttccttttcctctagccctcacattcaattggctcaaaagtagcattgattttattctataacctgtcatgaattcagcctctccacaaattcccagtgctcctttcttagttcagactttcatccactcttaactgggctgttgtcatcatctacttggcatacatttccattctgatccctaccctcttttccacccttgtttcttcccacctcaaatttaattctattttaaaaagaaagatattcaaaagtacaggtggtgccaattttttcttctctatccatcatatgcaaagaggcttccaattctttgtcgacctgtttctaagggatgagagtaggtcaagctgtgaggacttcaattcccacgtgaaggtcttgttcatattaactcaataatgtgctttgatgtcctaatggggaaagtagtattttctgccagttagccttcccaagatatcaaatccaatattggccaaatacatttttgaattcctaaaaagcctaaactgatgtcgtaacacagctgtatattaacataaaaactctgtaccttagtaaattattaatatgagcgattagctcacagagtcaatgtaagaaacttgtttcaactcttcatattctagcaaaaagaacacacacacacacacacacacacacacacacacacacacacaaaacctgatttaagaactaactaggtgattaaagcctacttagtttttaattgaagtgcatattctctaatcccaagaggccaaactaatcacctttccctttttgctgctttttttctctctatttctgtaattattataatctgtctgatactgtgtttagctatatatgggtctatcttctctcattagatcataagctccttaaggaaaaggccatatttccttgggatcccacttaaaaaaaaactggattacaatgttgaaatttttatatatttccatgtcattctccaaacactccccagtttttaccaaccataaagaaaaaatgagaagagtttaaatgataagcaaatacatatgtaagtgttccataaatacactatgtttgaagttatttaaagaacttaatataggataatatttaatagagaaacttagtctagatagagcacataaaaaacattcttggaaatttgtggataaataaaagttccttgcatctgtattttcctttcatcttgaaaacatgccttgacaaaagtaagccagagctggagtacaagattcagacattggtagatcattaattggttaaactggattttatcttatttccccttttatggatccctgtctttgtgtggaattcctgccacttgctggctgttcaaggcttgccaccaggagactttctccatcaagctaggggatatttctccctcactgtcccccaccaaatcaatattcacttgctctctgactactccaggtttctgctgtctgagaatatgaacatggatataccttttaacatgcgtgaatactattcatattttaatctcggccccactgaatgatagcaaacgctgtgaattttatgcctatctcaggctacagctagtgccttatcttgcacacacacaaaaaaaatcttacttttcctacttgcttccttcttaagtgtaaaaagcaaaaagaggaaaggtgccttttgtaaactgctaaagagcagtttacagaagagcagtttactaaactcagacctctcattttccctcacacgacaatctaaaacagaatgttaaagtgaatttatttggttctgtatacctaactattcctgaacatactgagttctcttttaagaaatcatacctgcctgacaggctgctttgcatgaacacagcattccccagccttcaaattgctgtcagagccgttgtgtcattttgacccacaatatggcagtattatccacattctatagatgagttaacaaaagcttccaagtggttaagtgacttgcctgtaaagggttaagtgacccacctctaaggggtagaattggtctggacactctgcccctctatcttcatgcctttgctataatacacagctacgcttgctgaagattaaggaagctgcttttgataaagcgtgattcttgtagatattcatctcaggaaaaaaaaaaagaaaaacgctggtgtcttcatctgtagcatttgattattacattttccttatctgtttcaacttaggatgacttccttgttcgcttaattgactggtaattcctttgtttacttttttccaaatctcaagaagcaagtctagagtattaacaatggttacattagcatttaaaatttttttttgaaatttgagtatttcagaaaggggtaatttaggcaggcatgtatgtagaactttgcattttaattaaaaagactcaaaatgaaatgaacctctgacagtaacagatgactacttctaaaagctgcattactacttgatatatgctcagtattttcttgtgggtaagtcctacgacttgtttcaagaaaagtgacaggactaaaacaattaaaaaagacaaagctgctgttttttaatcatatgttcataaataaaactaggttgtgaattgtttccagagaagcaattgacaaagtatgagtaaatcactctaagaactaaagctgcgttgattttttttaatgttcaaccaaacatctatccttgtccaatgatgaattttctttgacaaataaatatttacaaagtatgaaatatagactctgtgcctttcctaaggccaaagcatactgtttaaactaaaatttaattttttttctcacctcaaatacaccaaaataagaacataactaaaaattaattctctcttgtagtagactgtccattaatcttttgttagataatattagcattgtgagtgtcaggtagaaagaaaaactgtaatttctagattgatcagaaaatgtgagtatttatggatttgaagaaaacaataaagtctgataaaatagaattttctgtaacctcccttatggagtcaagaaggaggaatctttcaacatcctcccattttgcagtgaaaagtcttcatgcagtaaatagtttgcttgggtagatcaaagggttaatttacttctgatttgagaagagacgcagacttccctgatttttttacaaaaatgtgttgtgtgggaggaaggtagaggcctcagaatgaattcactaattggggttttcacctgctgtgagtctaatcgaatacaaagccttatttgtagctgaagaggaagagagattatgcagagtgtaagaatttctgcccagttttgaaattccgcttatttggcacaatcggtggggaaaggcagacaaatagttacaagtttgagctgttaaggtagaccaggaatgctgtagtcagatatacttgaaccacattaaccagtgatccatttttagcaggaggtggtgtgggtcatatacatgggttatcgctatagctggcaggctaataggtactccaaattctttcccatgaagcaaccgtcggcctgtgaggttaatgaagtatggctttattttagtgaagatgctaaaattcacatctttttagatgttcggcttgatataggtggctctgtgaagctttgagaaatcttattaaaagaaaactgtgtgagagtgaagcagagctcgactttatctggaacctgtctggtgaaatctctggtttagatggcagctggctcacagagaactttcctgagtctggcttactctgcctccctaaagagacagggcctggaaaaataggcttttgtgtgggtgtgaagtgctctgtgtctgaacttagaggcctcttcatttgctggttaatgtgacctggctggatattcttacatccagaagatgttggtttcagattgatctagggggattgttatatatatatttcaattagtatgctataatatttgccctaaccagcaatgattcaccatacaccaacccatttgttagatgtctgagtcactgttcatggttagtacttgtactatgcaaagaggaatatggaattcttatgtctttattgtatacccaaatgctgacattttactatagaatatgtattcgagttaattgaagtgatacctatactctaaatgaatttttataaagtgatgcaggttatactaaaacttagggcgcactatagatagagagaagctgaaccctaggagttggtgaagtctctcgggaccatccctccaggcaagtacccagttcaaaccattccttgtctttgtcctttcctatgccactctgcatttttacacagctagcatcaggccaacattgaaaccacatgcaacccagaaaggaaaaagatgtgtttgtggaaggtaggaacagcctagtttcagctgttggcccttcacagcctccactagatgggctcattcgaacccaagacccttccaacagtacactgcaaatccatagctccaattcagacatcttccctctgagctcaagactcagatgtccaactgtctcttggatacctgcacttttacatcaccacctccaattcattatgttcaagactggattcatcatctctttcctaaccctcttctgccccctcctcctgaaattcctagctcggagaatgctactcatccaatctttgttgtcactcaaggacaatggtccttaaccttcactgcatattagaatcacttggagagtcttagaaatcctaatgtccaagaccaattaaattagaatctcagggtggtgagacccaaacatctaaatttattaacaatccctgagtgattccaaagggcggccaagcttgaggactattgctttacttcttccctctcttccattcatacatccagtcagtcaagactcctgtagttggaaccttattgtatcatttctccacctcctctgccactgctgtaattcagatcctcctcatactgcaatctccttgtacctgatgtctgaatttcagactcttgtcttctgatcaagcccccataccattgcctgagtgatttttctaaaagacaaaccggacagagccacactcatgctttaattctttcttccttaaaaagctccctcatacctttcaggatacaagtcaaactccagattgtcacactaagccctttccagtttgcccatttctctaacccttatcttgacattctctccaaaagatcaagcagaccgttgaagctcttgtaaagaacaagctggttgcatcctttttaccctcacatctgctgttgtcaccatcataattgttgatatgcctttaccctcaaaaggccagaagctctttgtgggcctacagaggaggcttctctgaatatttatccaatgactgagtctcatctgctttttagccccagagtggggggatctgactttctcctctatcagtagtccccactcagcatcaagtctattgccccagagggtggctttggctggatgggtctcagtttggtcagggtcctgggagaaacagatggtacattcaaacggaacacttgaagagagtataatgaaaaggctatttacaaggctctaggcaggctaggagaaaaaaaaaaaaacaaggaatggtaaacttttgcccaaagggataaagggaggaatggtttgcgtaactggtggaatgctattgctgtaggaaaggactggccaacaagacttgtggctgcaggtcaaggaactcagcagctgccaggccagagatcagtaggagggaacctgaagaataaatacccaaacatcaccttcctcctgtcctttcctctccttctgtaggcctttcatcactgcctcccaattggctgaaagcaaaaggaagccaaacggcaggaaagcctgattgatgtccccacagaggtccaacctcctgggccacagagcagaatggagaaggacaaagaatagagatggatgggagaatggggaagcatcctgcacagtcccttaggtcagagatgcccttattctctaaagataccctcaaagtttaagtggttcaaagaccagagttttggctacgggaaaatgtactgggtcgccttctttgacctcatcccatttcatttcttctttatctctatttctagcaaatttactcttctctgctctgagccatcagtgagattgtctatgagtatactagaaaaaacacagacctttctcacaggaaaagaagccatgtctcttcatggcagcatagcagaatagctaagcgcatgagtcttcgagctggattccccaattccaatccttgcaccattctagacagtggtactgggaacaagtaggtcatggctgattctgaagtcaaaattttagctgaagtttgttctggtagcagagcttcaggctcttttcatgtccgtggttcatatcaaaacagtaataataataataataatataatcagaaggaggagaagaagaaacatctactataaacaaacaatatattatcatacatggcatcactacataatttacatatgacacgaaggtatatcaattatgttcttttccaaatgctttcctctaataagcaaaattcataatctgactgcaattgaacaacaaaacagtctctgtgatgcccgcgtcatttcttaatactttcagtatttaattataatatgacgtcaagatttgggaacaagtcttcaagtgcctataactccagtctaaaaaagaacttaaagatgtatttttgaggattgccatctgtcaatttttttaaaaagtctgaatagtgatttcttattccattcttttttcttgtcaacagattattcttagtagttttctaattggacactgagaaaagagacttaagcatttatagagaagcgtgtcagaactcctgaattttgagcaggtaatttaaaagtgtaaaacaaacaaacaaaaaacaggaaaggaagagagtgacaaatgtcttactatccaggtgttacaaatccttagtttatcgatttgtaatatttacaaatgtccatgctctgaggcttctgtcttttcgttgaaataaacataaacagtagttaagtgatttgccacactgacacagagattggtgtctctgatttactgcaaagggcactacttcctcattacaggacactaatccctcttccccaaggatcggagcagacctagaatatactattagaccaagggacaacttcagccaaagcaaatcttagtgtgcccccctcagaccgtaatagcagctgcctccacaactcactagcttaaaattgctaaagggcaacactaagtaatctcagtgtatgagccagaatgccagaagaagtgccatatttgcttaaaaatagcaataccgatcatacttacatgcacatatctttagtgataacatttacctttatatttggtttgttaaaggtaataaagaatcctggcattcccttttgcttttgtccagatactttatttttgcctcttttgccatgctatagcattagataaagcaaaacgggtgtgcttccacctaaaacattctagggggaaaaatgttgagcagaaaaggattatttcaaaagaagccggatatggtggcatgcacctgtcatcgcaggcacttggaggctgaagtgggaggattgcttgagcccaggagttgggagaccagcctgggcaacacagtgagacccccatcccttaagaaataaattttaaaaaggggaccacatttaaactgtagaccgaagtggaatgaatcaatcggaaaggagagtggaaagcaaatgtttgaaagaaaataaaaagaaaagcaagccaacaaaataaatggacaaagaagggcagtgaaaatatcactaacagtttatcgtaagatgctctttggatgctaatctaaggtgttatgtgaagtttgcagaaaattcttgtgctaatgaaggctttcttcttcttttgagtatttccaagcttgaaataattgtgtgtagttaacttctatcatcatactgcaaactctaaaattagaattatttgaactgttcaggccctgtaacttttccaataaaatattctattagaaacaagttccttctagatcttcctaaaagaatactaaaggaccaaaccgtgcaacagcactggtggtattgtcttaatttagagagtccataccagtgattctcaaacattagtatgctcagagtttctggttcaataggtctgggccgggcccagggaattttcatttctaagaagttcgcaggtgatactgataactgctgttcccagggtctacattttgagatccgctgctatgtcacaaatccaaatccaaagtctttttaacaatcccttttagcccaggatgagcctaacggcaatttcacgtccttatcgccggccactttaatcttcaactgaggaggaagggagagtgagaattatgtatataatttttttcttttattttttaaaaagaaaactccaagcccacactcttaattatctgggatgaggtcatttgcacctgggtcatttatttagacaacaagtagtcttgctagaggctttaaggaggtgttagcagagcggtgtgtggcttccaggttcctgggtctaccttaaatccccatcctctttctttctttctttctttctttctttctcttttctttttcctttccgttttgaaagccccaactgcccagtctctgggtgtccgggttcccaggtccctaggtgggggcggagcccgacacggccccgccccgtctgcccgcagcgccccctccccggcccgcccgcgccggctcctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaagggtaagtggatcgcggccccggccccgtctgatggccgcaatccgtgcacttgtggcgcgagcagggggcaagctgaggcggtcaaaacttggacaggcgcggcggctggacccggggcgccgggcggctgggcgtctaggaacctctcccgcgggttcccgcggcgcggctgcaggtgcgcccccggggtttctccccaggcgccgggctagtgggggaacctcttccctcggctttgggacgggctcggagagaaaaagctgatttctccccgtccccagaggggataacgcgttcctcacgcggggattggggccgggggagcttttcactcctttccaggctgccagtgtggacgtgagcaaggctggctgttcctaaatcgtcgctcttactcgtagaaggaaggggcgcacgcggcgctaccttccattgcactgcaagtgccaaaaggtcaactttctgcctgatttcttccgaggattccaactgacatttccctcgctgcattttctaccgtgctcattccatgccccaagacctgcagaaatcaggaaagaaagaacaaacaactaaagcccagaagtcaaagatttcagggggtggggatttttgtttgtttgggcttttttttttttttttttttttttgcccttcgggattgggtgtggagtcatttctagggtgttctctcgcatttctccaggtgtctgtgctcatcttcaagcaaagtttgtcactcccaatcccagcacggcaataaaaagggcagaacactttgcttatattagtcaaatttgaagttaagtttgaagctttaaattgaaggggtttagttgctcgagggaggcataatattaattataaactgtttttacatcatgaaaaaaatccatccgatttaagtggtgaacttttaagtggcgtctttaagtgaaatctacatttttccttgggcaataaactcttcttggtcttctgctttatccctgtcatctctccttgtcacccaccccccccccccccacacccccaatcaacctttctttttttgcctagcttttttattgccttttactcaagcccctctttggaggatacatttgctgttggagaagcgagtggagcaaatgaagcaacacggttatatgaaaggtctctgacccttgaacaccgtggaattggtttcagtcatcattgtttgatctccgattggacacgaccctgaaaagaaattgctttgaccaaagttgagggtgggtaggagttaaaccttgaaaagcaaataaaacggaggacaactaacagctggaacagccaccgaggcaatcatctttgccctggctttagccagacagaataaaatggtaaatatcccagggaacaagaaatggggaactagaatggatttctgatgcttatattgatgcccacccctccaaacccctgccccacggtagcagaaactttaaaatatattttaccatccacaccctgccagtattccagcaatgcaagccaagttcaacaattcagcacgcaaatgccaaggttcctctagaaaaagagtctgatcctcagattaaagggaaatcatttgtgtgtgtggatcaatgggctccagattatatatgaaaccaaactctaatcctctgcaaatcgcaagagaacgctccctttttatattgctgcatagcgattagttttctccctgggaagtagtggacagatagttttttaaaaaggcaactgtttggaatattttcagtaccaaataacaatggtggcagaagaaatcttattttaattaggcaactgccattttcccagccacagcagtagatatttgttactttttataagtgtttaatgtttgtttttaagaaactaaaaaagcaattccaataagtctgattattccagcactgacagcaggaacagctctgaggcagttataataaccttgcacactacttgaaactaaagcaggtgagagaaaatttaaattgtatggtaggaaattaggtcagccttgtgctcagtagagtaatgctttaatttcttattattgacaagtaggtgttgctggggtcttttgtcatagtcgatgactttatattttaatttgcatcagggtcctatcaccgcctcaaataaaagggaaaaagattatcatggtttgtagaaagaagaaggagaggggaaatcttcgtataaatactgctcagagaggcatatctgatgccaggctttggaaccagcagggccaaaatcaataacattttttaaagatgtaaagagcgttttaaggattatttatgaagctgatctctgtgttaatgtacgtacagacttgtgatctatgttgaacattgttgttctcagaaaggccaaacaaagatgtacccattaacatgtgaacaggtttcagaatttcccttttggttgttcatggtatatggggagtgtatttccgatgtggagagtgaaatgcagaaaagagacaattaccaaaacagtgccacccacccttccactccctcctccctagcacaccgtgtttttctatatcgtctgcatattccaggtaaatgtgggctcttctcatggagttactgagaattctctactgttttagaaggcaggcacagagtaagaaacgaagctgtaaaatcggtattgatcacagacaaaaatgtggtttgtccttcaaggtacaagatagatatgagttatgcagatttgtgcttacagtttcatccagtccatattcatagttcctatctattttggagggttaaatgtgtcccagtggggctctggattcatcacaggtagaaaataacaagccgtgaagtgaatatttggttcgtcatatagttaccaaagaatctgaaggttttttggctacgttgccaagcatttttagcattaaatgattaaaagactatttttctcgttttaagaattagtcacaccctttattcttttcttctttccacttgtgctcacttcttttgcttagaactgatttgcaattgaagtgaaactaagactgcaaaggtgaaatctaaatctgtttttctagttcttttgcattgcttagaaataaaaggtttgtgtgttgaaggtgagaaaggttagcttctggaattgtttgaggagttcatttatctatgttattcaagtcccccagaatcacagataactgggagaatagtacctatcaaggactagtatcttaactcacaaatgggcaatggaattgggggcttagaatttcctccttcttccagtaaaggagattttcagttttgccgaggactgatggattaaaaaaaaataatttctaaaacccttttcataattttaaccttcaaaataaattctttaaaaaggcaggaatgtatgtatgccaacagtcatgaaatttctttagaagatggggagctccatgaagccctcattcattctatgtgggattctcctgtaaattgtacacactgtttccctttccttttagaactgtgtttggtacaggtttatttcttgcctatgttcctctaatttgaagtccattccagatggtggcttttcaccgtggttccctgtctctgtctgatcaggcttatcagctcagctaaatgtttttctgcagacctatagaagatgctacggtccttacaaatatcctggagatgggacattgttgttacacagtgtgactagtaagggcctgtgtgagcccttgtacatgtgggcacacatgtgtgtgcttcctctcttcgctcttcctttctccctggtgcttatatcacatctggatgacctttggaaatagaggaggcctgaatgcagggtggtctcaatagaaggtaacctttccttgctctgcacttatatatggaattggtatacactcactttccgagctgagaaatgcctgagaacaagcaacactttttccacgaagctgcaagctgcagcctccttgtgctgtgcatgtaaagtaccagtcctgcctaccccttctccagatcataaaccggcttggtcatggggtgtcctaaaaccccttaaagcatagagaccatatctcctgctcttcttgctctttaagacttgaatgtcactctgttatattccctcaactgataagcccttgttatagtcctcaaatgtgagttgtctctatggaaaagtaaaactgaaataaacgtatttggaagacagtgaaacagcacttcacaagtgaacattttcttgcaaattgatttcagtagccctcactgttcaatcactgactagtaaatattacagggatggtctttgaagttgtacagtttggatgatttccatatgtctttatgaggtttatgattgtgttccatttcttaaaccaacttaaacggttgttttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcaggcttgctttaaatttcaccgccagtagggcgcagagccctaaaattcaaaacatacgctaaggccattcgacattgttgcctctccagactcctctttctgtgtgaggcccctgtactttctggtcctctggaaatgccccagtttaagcgatttctcttttttccttccctccccttcccctcaaaagtttatgaataggctctgcatatgagtacccaaatatcattcagaactgcattttactgtatcaaagcctgtcatgcaatccctgaaaactggaaatatgacgctatggtgatttatgtagatgggccaaagtaaggaaaagtatatgtagttatttctccagggtttattcatgtaattgaatgaggaacaaaggtgttttgttctttttgtggcaggagctgatagccagcaaccacacttcaagaaatggaagacagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatattgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaattttctgccgtctttccggtgctcacaattcctaaggcctggcgggtcattaatgtgaacatttaaatgatttctttagtatggcttgttttgtgtttatgtaagagcctgacagttctgttttctttcccctcataacttgaattattttgaatgggtacagagcatacaaataagggtttgaaaacaccagtctttttacactggacaaatgtccagatgtctggtttgtcgttttagatctacaaggaatattctgaaatgagttatcttaagttgcagcttgttttgggttttgttttgggacagggtcttgctctgtctcccaggctggagtgcagtggtgcggttatagcttattgcagcctcgaacccctgggctcatggcggttcttctgcctcagcctcctgagtagctgggacaacaggaatgcaccaccacacccagctcatttttaaaatttatttttatttatttttgtagagatgggtctcactatgttgcccaggctgtgtttttatgtatttttttaatataaaaacgtcatgtcttttctactttttcaagcctgcatttctgtgaatggacatattgatagaaaaacacataaggcgatctctttggatttaaggttatgtgatgaacactgtgggaatcagggtacttaaacataaattctgtgtaggtatacgtaagtggggtgtgtgtgtgtcagggggtacgtagctattactgcttttgtgtcatagattctcacaaaatgaattgcagctatagagacaccaaggactagagaagagatattagccaaaaaatggttttattaaacatttttctaattataaatgattaaatgtcttctagaaaacctgaaaaatgtaaataaaaaacatgaaaaaggaaaaacaaagtcacttatactagccagagagatccaatacatttcgagtaatattatgtcatttcagtctggttataagtgtgtaaacgtttaaaattttaaataaaattgggatcagctaattttcaagtgctacatttccagcccctacagaatgtttttggcttataattgtggactgtttataccacaggtggaaaacgtgaatgcttatcttttggcaaatgagagaatgaaaaggcttcatctgaagtgggcagcagctgtcctgggcaagctggtctttctatcccagtactcccaggacccctgattgtacaagagaaaaactagaaatctgtccacaaagagctaatttaaattagtctgtgggcctcctgatcgtaacctgtggtttacacagatttagcccacttctaacatttcctactctaattacagtaatttctagttgtaatattttaattcactcttattttaaaatcattattattatagaattaatacctattcatatttttgaagtttaaaaatatagacaggctaacaataaagaagagacaaatcattcgtaaccccacttcttagagttagctggtgtttaatagtctaggatcttcaaaaatgtctttctatacatatatttttatagaagttgaatcattctgtcttataacttgctttttttttttccactggaaagtaatgtattaccatggccatatttccattttgttgtatagtattctctaccactttcaattactctgtaatgagaaattgcaaacatgtttgatgaaaagctaattatggactatcaatgaatacatgtttgctcctttaatacaaattaaatatacatttaatcattatatttctaaaattttctccatactttagatgtggtgataaactcaaaactgataatctctcatgacttgtgacattgggcttgtgacatcactcaattttgaattataacagaattttacagttgcaggggattttagaactcatttattgcaaactttctcttttatgaaatcaactttcaggtataatttttatataataaaaggaagtcatcgtaagtgtgtgatcaattccagccccctttgaaattctgtttcttgctagcccaataacaaaccacttgcaagtgaactaagtgttgaagtttgcttttcacctttcagagttaatatttccaatagttttgtaacaatcaaacattcgttgggcttttatccaagtggtgattcatcagataacatctcccatttattgcgggcctattgtatgttttccacatgggatgtgccagcaaccaacctgcatggtggatggtatcaacatccacatttcacaggacagcgaagccaggctcagggaggaattgatcagggctacacagctatgtggggctacacctggatttgtcctcagttttctgttagtactttcactgttctcattgattttatttactaggtaaagtatatttatgttggttactacatacctgctacacgtatataggaattgatagttttacctatgaatagtaagttacttgagtggtatttctggaaatggtatggtgggtcctaaacaatgggcactcctttcactgttgcctggcacatatagaatgattgttatatggctacatccttttttgtttgtttgttttttgagacagattctcactctgtcacccaggctggaatgcagtggcacgatcttggctcacggcaacctccgcctccccaggatgaagtgattctcctgcttcagcctcccgagtagctgggattactaggcacccgccaccatacccagctaatttttgtatttttactagggacggggttttgccatgttggctaggctggtctcgaactcctgacctcaggtgatcctcccaccttggcctcccaaattgttaggattacaagcgtaagccacagcgcccagcctgcctacatccttgagatcccatataagattaactaccagcactgcctttccccctctccaaaattacagtgtttcagagtcgaaacataagcataaaatactgaaaagaaacttttcattgattttagtttttacttattagtttatatttttcttcttcaagaggtatccctttaggtccaaattgctctttgagctggatgaaatggtcggaagccttcaactacagtcagttggtgaaaggtatcttgaaagcagaaatggtgttgtggtctggcgtgtcaaatgtttaagaccacatctagccccctctcctaatcgaacctgaacctcatgtctctggtgaggtgctgaaaatatcaagatgttgctttttccctctgtacccccactccaggcatactctaccgtggaagctacagtggttcacagtatgcatggtaggttacacattcctagagacgcccacttctaaggagatttccattctctaatttgccaaagttcccaagcagcctgttcaacacatgtttatgttacctgccttgccctcaaaagcattcaggtgttcccctgcacccagggtttgaacacaataggattagaaggtgaaaacattttgttagaactgaaaaagtagcaagtatttactgatgaaaagctataatattgcttgagatattaccattggagctctctaatacattctgggtggttttctttttcattccttttccactgattttctacaatgaatttatattatttacagttagatgtttggtaaaaaagtttcttcgtcgatacccccattccatttcttacttagtgtctctatagctacaattcattaactaatgagaacttatgacagaaaagcagcagtagccacacacacacacacacacacacacacacacgccccacatatatgtagataatttatacttaaggaccctgattctcatggactttgtcaggtaactttaaactcaaagagatcatctcatgtatttttagtctgtatgtccagttgtgaaaaatgcagatgtagacattttagtggtagagaaaatagaacttttttgattaaaaaatagataaaaaacaatataagataattaattttagattatttccaacagatctaaaatggctttgcagaggaggtttccatcaagtgttagaaatattgtgtttccctcatttatcggctgtgtacctacacaaaaaattgagagaaaatattgccagagtcctacacaaacaaagcaagacatagtaaagaaataatttaaaggttcactatgatgactgaacagtcattaggaatttgagtccccagaaaattttttacatcacattaatggtttgacaaaagcattgtcttggattttcacagggaataaatcactaaaagcaactggaaatcagttttctttcagcatttgtctgtgactacccccaatagtcatagaatggtagtagagaatagtagtggagtaagtgggatataagagaccaagtgtctcatgtctattttttgtagaccttggtgctttatctttaaaatgtgaggatattggggctgggcacggtggctcacgcctgtaatcccagcactttgggaggtcgaggtgggcggatcacctgagtcaggagatcaagaccttcctggctaacatggtgaaaccccatctttactaaaaaaacaaaaaattagccaggtgtggtggcacatgcctgtaatcccagctactcaagaggccgaggctgaagaatcacttgaacccaggagtcggaggttgcaatgagctgagatcacgctgtagcactccctcctgggcaacaagagtgaaactccatctcaaaaaaaaaaaaaaaaaaaaaaagtaacgatattggacaagtgtctaagatttttgtttttcttttactttgggctgagggtggggcaggctgtttctaaacttgctgtgatcattatttttcaagaggtacctttcggctaactctgcagacaagtggatttctaaaaatgtaatcattcctatgttttaaaatgtacattctgagaaaacaaacaacaggagaagattatgccacccatccgtgtcttacaggctgagtgaggcaagctgttgtcaaatagagaggctcttgagatatttcccattagactcctctgggtcattcatttgttattgagagggtacattcttcgtcactccctagaagtaataatatgtttgattcatgaggtgagttttagatttctattagcatttttacaaatgtaatggaaagactgttccaataggttagcttggtgatttaaaactctgagctcttcaaggctccagaaagcatttacaacatcagtagatgttagatagtaatatgctctggaatttattttgaaatactaatataatattgatttacatgaagtgcaattatgtggttaaaagcctgtccttttctcacaatttatgtctaggtccctaagttcattactgaaattttaagaaaatattttttaaaaagctcaccctgcccccacacacataatatatgctgcttagagatacttttattggggtttttttttttttttttgacagcatcttgctctgtcacatagactggagtgcagtggcctgatcatggctcactgcagctttgaacacccaggctcaagtgaccctcccacctcagccttccaagtagctgggactatagccgtgtgccaccgtgtctggctaatctttttttaaattttttgtagagatggaggtcttaccatgttgcccagcctggtctcaaactcttgggctcaagcgatcctcccaccttggcctcccacagctctgagatcccaagggtgagccactgcacctggccttcacaatttccaatgtcaaatcttactacaaatttaagtaatcaagagtatttacatatggacagatatactgaccaacagagtagaatttaggctgggcacagtggctcacatttgtaatcctagcacttttggaggccgaggcgagcagctcacttgagctcaggagttcaagaccagcctgggcaacgtggtgaaaccccgtctccccatctctacaaaaaatacaaaaattagccgagcatggtggcatgtgcctgtagtcccagatactcaggaggctgaggtgggagggtcgcttgagcccgggaggacgagactgcagtgagccgaggttacatcactgcactccagcctgggcaacagaacgagaccctgtttaaaaacattatttcttagcctgtcttattgggggggggtctcttaattataaatacaataaaatatgtggttccccaatggttcctttttaaattacaatgtgagtttttttgcatttgtgatactgtcagtatagtacaagaagaccagtttatgaaggagacatgtaggtaaaaataggataatgtgaagagagaatcgctgcacttcagaaagctgattttatttcaagcagtttattaaaatctagatgcaccgtatgttctggtgttacttattccaatttccttttccttcattgaagccctcttaaccacaagtgttttctcaaggggtactggttttccttttcttaagttatagcgttcttcagaaggatctagccctttttaatctgttgcccaatttttggatcctactatccagcatgatgctcacctgaatgatgcgaaagctctcaattttcaaaaatggacttctgagtgtttttggaattcttaggaaaagtggtctttaaaaaccataagatttgaaggcagtctatcagcacgtagcccttagcttcatgtctatggtttgcagagagcttcagaatgttaaaatgagggtttaattttagggtctgctgggcctgaggttaggggtgtgattcttcagcagttctagttaggagaactagttaagtcctagttaagtcaatggggctaaaagctttttaaagatacatcaatatcattataaatcagcaatttgcaagagagttaaaaacactgctatcaaaatccttgtacctctttcctcagcttgcccaagaggaagggatattgtagttatttgttcactctcctcttttgataggctttctacattccattaagtattccctcctgaggatgctcttgggttagaaactgcaggattctgaatgactatgaattccttccttttgcattaggagcttgtcctaatgcttttctcagcatattttgtgaactaaactgttctccactaagctactcaatatttagctttccttggctcttgcttctagttccttaatatattgctcagtgttaaaacctctgccttttgactttttactgccataacgctttgaactggaaaggatagctagattcagatgccagctttggtgtgacctcgggcaagtcccttgctttctattggtcttcattttcttatatgtcatgttggccagtgatctttcatcattaaatgactggttttgttttaacccctggctagagtaaagcttggttgtatgaatgttgtcagccctaaacccccagttcctctttgtcaccaccaacctaaaggatatgaataataggataatcatatttattaatttaattttttttttttgagacggagtctcactctgtcgccaggctggagtgcagttgcacgatctcatctcactgcaacctccaccgcccgcgttcaagcgattctcctgcctcagcagcctcccgccaccatgctcagctaatttttgtatttttagtagagacggggtttcaccatgttggccaggatggtctcgatctcttgacctcatgatccacccgcctcggcctcccagagtgctgagattacaggcgtgagccaccgctcctagcctataatcatatttgtaataattgtactttatttgtgtagcactttacaatggcgaagagttttcagaaataaccatatttaatcctcacacagctatagagtaggtggcatatgacctggattttctatcaatttcagtttcagattttttgtcctgtcatccctttgagtgtccttccagtttttgatttgggaaataatgctaccataccggtggatggggcaacttttcccttctttccatttggacttgagcagactgagactcaagacttgatttgatttatactcactatggtagaagataaggaaccaagtccagaacacacattttacaaactccgagttctctgttctcaaaggaacatccattactcttagcatgatttataaaactgctttatcggcataattaaactggaatccatatgacattctttattccctagctgacaaaattagcacaggagatttactcaaatttgttattaaggctgttataaatgttcttcctttactattcagcttataaaagaaaaaagaaaaataatctgctcttttaactttgattaggatccattgactttccccatttgtaaaatagaaatgtaacttccaaatcaaaatttatggcattttaatggactgttctaaatattataatattttttcttgttcaaataacttgatttaaagcttctaattgaagaacataatagatatttctgaattgcatctctccaagcttatttcagaaggaaactcaaaaagaattgttccttagactttgactggtttacagttttaaaagagctgccaaattgtagtttactgatctaaataagaggaacattaaggttacacctgcagctagaagaaaagtgctggatatgtacaattttatgtagctggatctgcagaagatgatttttgcacacagagtaaaggcatctaaaaacgtgtctgctcttattcagacatttccaatatttcttttttaagcccacaagtctgattacctctgtatgtctcttgggagctgcaattttgctggaaagagattcagaacagtcagagcactcacataaaatagatagtttttaaagtctgtaccctctacggtagtaataaaatgacctaaaaatattctgaaagtctctcttatgacatagtggatgaatcattagcttatttatgaattggtgatattctgtgggaatgtttcaaaatttgctattccacaaagcgttcatcgcttgcataactccaggaaagtcattacaccccctcataaatagaagcttatataacggagacaaatgttgcttatattgatatatttacatacagatttctttaccaagcattaattttggtaagaaagtgattgtttttatattttactttcttggtctgtaaagaggctatcactttaaggccaggcatggtggcacgcacctgtagtcccagcgcttccagaggctgaggcagaaggatcccttgagcccaggaatttgagtccagcctgggcaatatagcaagacgttgtcttagaaaaaaaaaaaaagaagctatcactgaagagcagtgcttctcaaactggtgaagggccaggtttttgttggtggtgggtttttttttttgtttttttgagacagagtcttgctctgttgccaggctggagtgcagtggtgcgattttagctcactgcaaactctgcctcccgggttcaagcgattttcctgcctcagcctcccgagtagctgggattacaggtgtgcaccaccacacccagctaatttttgcatttttagtagagacggggtttcaccatgttggctaggatggtctcgatctcttgacctcatgatctgccagcctccgcctcccaaactgctgggattacaggcgtgaaccactgcacccagccgcggtggtggtttttaacatactacacatcacagatttttaggtggtgctaatgaaactgacaagtatgcattcacaccacatgtaactcaacagtcaagttcaacaacacttgacctcgtctgtaccctgctccatgagatgaattcattgatcatgaatttggatgtcatggcaatgtcaaattgctatagaagttacttaacacactgtccatatctatgcttgtgaaagaccatattttgagtagcactgttctagagcacttaatttttgaaagtataaatgtaaactcaaatcaagtgactcaggtcgggggaggataattaaccaaacaggaacacctgaaaatgttatttatgcggtttaatgttttgccagttgagtcaagttcaggcagaggagggatctattttctttcccacttggtagctctccttagcaattgttttagaagacaaagcatagaaatcattgtgttacaggaaggaaccagagattaagcggcagagccactgctgcctagtttaatgtctctcgcaccccctataattaaatataatgtatataatgtgataagtttaaaatacaggtttgcttttatctagaatataaactgtgatatatgcactctttatggggtgcattcagtgggggaactaattgattatactgtgactttcctattgtcactttatgagtttaggtttggaggcaatgttttgcagcaacaaaattgttcattgactttgaggctggatttaaattctgattctgtcaccagttctctgtggtcaaaaaggaagccactaataattttaaacctcagttatgtgatgtattaaatagttatgatgagacttatcttgtgttgtgaggattagaatgacatatgtaaggtaacagaatgtctgatgtagtaactgctcaaggaattataattgctattagtgatatgcattattattattagttattattatcatataccagtgtctctccttatttaataatctattgggttcctgaattgagataccaagaattcagatagtgagagacacctaggtttaggtcttcacatttgacactcaaggagccactaaatttttctgaagtattttacttcttaaccaaggtgataaagatcacctgatcacaatttatcctaacttttggaaagcatacacgtactttaatttgacatgcaaattaaaataatacattttgtactgtgttgtttgccctcccccaattctaaaataatatatcattcaggataaaaaagactacactttgggaggccgaggcaggtggatcacctgaggtcaggagttcgagaccagcctgggcaacacggtgaaaccccatctctactaaaataaaaatttaaaaaagccagaagtggtggcgtctgcctgtagtaccagatactcgggaagctgaggcaggagaattgcttgaacctgggaggcacgggttgcagtgagccaagatcgcaccactgcacttcagcctgggcaacagagtgagactctgtctcaaaaaagagcataaatatctaataaatgatggtggtactagtctgtggtagtggaggtatcacagaatggctgtagagatgaggagggctaaaactgtgaaaagccttatatggtatgttgaaggttttttatactaaggtttttgatttggaagatgtatcaatcagggtctgcctggtcagaaaacataaaccctctagttatttcaaacaaagggaatttaatgcgggaaattggttactcaagaatggaagtgctgagaagccacacacacagcatgaagtttctgttatacctagggctggagggacaatgacaagaggtggtatcaccagagccccagatgtcatgggcatcaaggcggagttggaacctttggccagctgggaccaatgagggaggggctccgagggagctggagccaggaaggagacacagttagccagacctattgccggaggtagaatgaaaaaggaagtacgcccggcttctcctttccgcctgccctctaggcttctgccagtgactcctattggccaaacttacttggaagccaattggtaagggagcaggaaaatgtactgtaataaacagcagagcagagaaaaggcagagaaagtatcaaaaaccaacaagcaaatgattgaagtacaggagatcccatggacagtaaggcaaccaaccctctatgcagatatttcgggaacaagaaacataaaaaaactaaaaagctttcataggagtttgaggtgacatagataagataccagaaggacatcctgggttcaaaggaaactgatcttaaaggagaggaggtagcaattaaaacaaattatctgcagagaagtccaaacactaaggataagcttccatgcatttgatgaaagtacttgcgacgtttacaggtgtttatgctcatgactctcaagactaaatacagacataccttggagattttgcaggttcagttccagaacacttcagtaaagcaaatatcacaataaagtaagtcacacaagtgttttggttttctagtacatataagttatgtttactctataatgtagtctagtaagtgtgcaacagcattatgtcttaaaaaacaatgtacataccttaatttaaaatactttattgttaaaaaagctaacgatcacctgagccttcagccagtaatgatccttttgctggtggagggtcttgcctcgatgttgatggctgcacagcatggtggttgctgaaggttggggtggctgtggcaatttcttaaaataagacaacaatgaagactgccactcagttgactcttccttttgtgaaagatttctctgtagaatgtgatactatctcatgaaaccacttactttgctcatccataagtagcaactccctatccattaaagtttgatcatgaaattgcagcaattcagccatatcttcacgccccacttgtgatttcaattttcttcctgtttccactacatctgcagttacatcctccactgaagtcttgaacccctgacagtcatccatgagggttggaatcaacgtcttccaaactcctggtaatgttgatattttgacgacctcctatcaatcacaaatgttcttaatggcatcaagaatcacttccagagattttttttttttttttttttgagacacagtcttgctatgttgtccaggctggagtgcagtggcgtgatctaggctcactgcaacctctgccttcctgggttcaagtgattcttctgcctcagcttcccgagtagctgggactacaggcgtgtgccactacgcccggctaatttttgtatttttagtagagacggggtttcaccattttggccaggctggtctcaaactcctgacctcatgatccacctgcctcggcctcccaaagtgctgggattacagccgtgagccaccacacctgacttccagagattttccatttactttgcccagatccatcagaggaatcactgtctatgtcaagctatagccttacaaaatatttctcaactaataagagttgaaagtcacaattttttcttaatccttgggctacagaatggatgttgtgtaagcgggcatgaaaacgtgaatctctttgtacatctccatccaagcttttgggtgacaaggtgcattgtcagtgagcagttatattttgaaaggaaacctattttgaacactaggtcttacagtgagcttgaaatattcagtaaaccatgccgtaaacagatacgctgtcatccaagctttgtttttccatttatacagcacaggcaaagtagatttcacataattccttttttttttttccttccaagacggagtcttgctctgtcacccaggctggagtgcagtggtacgatcttggctcactgcaacctccacctcccgggttcaagcaattctcctgcctcagcctcctgagtagctgggattacaggcgtctgccaccacacctggttaatttttgtatttttagtggagacggggtttcaccatgttggccaggctggtctccaactcctgacctcgtgatctgcccgcctcagcctcccaaagtgctgggattacaggcatgagccactgtgcccggcctgatttcacataattcttaagggccctgtgatttcagaatggtagatgagcattggcttcaacttagtcaccagctgcattaggccctactaagagatacagcctgtccattgaagctttgaaggcagtcattgatttctcctctagagctatgaaagtcctagatagtatcacctttaaatagaaggctgtttcatctatgttgaaaatctgttgttcgttgtagccaccttcatccatgaccttagcttcatctggaaaacttggctgcagcttctgcatcaatgcttgctgcttcatcttgcaccttaatgttatggatatggcttgtttccttaagcttcttgaagcaacctctactagcttccaacttttcttctgcagcttcctcatctcttttagccttcatagaattgaagggagttaaggttttgctctggattaggctttggcttaaagaaatgttgtggctagtttgatcttctattcagagcactcaaactttctccatatcaggaataaggctgttttactttcttatcatttgtgtgctcgcagggtagtacttttaatttccttcattaacttttcctttgcattcacaacttgactgtttggcatgagaggcctagctttcagtctgtctcatctttcaacatgctttcctcactaagctcaatcattaatagcttctgatgtaaagtgacagaggtatggctctttcttcccttgaacacttagaggccattgtagggttattaattaccctgattttaatattgttgtgtctcagaacaggaaggccagaggagagggaaagagatgggggaacagctggtcggtggagcagtcagaacacgtatgacgttgatcaattaagtttgccatcttatgtgggtgtggttagttgcaccccaaaacaatttcagtagtaacatcaacgattactgatcacgattcaccataatagatataaaaataatgacaaatttgaaatattgagggaattttcaaaacgagacacagacccaaagtgagcacatgctgctggaaaaatgtccatagacatgctcaacacaggattgccacaaaccttcagtttgtaaacaatgcaattttcacaaagtgcaatacagcaaagtgcaatttaatgagatgagcctgtaatgagcctctttaaagcaggaactgtcttcctcatctttgtcaccagtgcctggtgcatggtagcctctgaaaaaataattgttcattgaatgaagcacagtagagcaagggagagtgattttgctcgggaggaaaacaaataccactcaagaagatggaaagatacagatgagggttttctaaggcggattattaaactggcaagatggaactctggagagatggagttctttccagaaagtagaagataaagcctcaaagtaattaaaatagggaatatcagttaagttgtagattttattggcaatttgttatcttagcaaaaccaagtgaactgctattctggaattaattttgccctaaaaggaataattaattgataaggagaaataagacccgtaaaaagtgtcactatggattcagaatttatatgacaaagaaaggaaacactgaacacaatttgatgtgctgatggcctcgttcgttcattggtttcctgcttcagtaaacatttaagagcgtgccatgtattttcaaactttagggcaacaggctaaaaatatcaaggagaaaaacgtttactgagggtatagaagtttttatgatcttacttttattgaacattaaaacatggatgttcattctagaaattttagaaggtgaagtgcaaaaacaaaatgaaaatcacctcacatctcagtacccagaaatagccactatttacattttaaaagattgcttccggtcttctttcctatgcatttttatatagttgtttgagataatagaatgtttaaagtgttgtatcctactgtaatcataagtcttctcttattcttagttcctcagagatgttatttttcgctagttgcagtttattggggtaccacttttgtaaaaaaatatttcccaatttttgaaaattgtgacaaagaaaagtcaaattcgtgttgaatttatggaaggaaatctttaagaatctggaggcttattactaacaagcttctgagaagaaagccaagtaaagtgttataataccttctgtccaacaagctacttatgtataagtgatgttacagaataaagtcagtgtggtcaaaaacagacagtcagttatcagaaagttgataagtaacatttatcctatgaaaaatatagctatgaatttaaatcaatagttttctaccacaaatatcttaatggataaaattttctttaccaaatatgtatggtgtcaaggtgacaaggcaagtatccttgtaaactttccgaattacaggaacaactttgcccttcttagcaagcaattttatacagaaactcaactttatgatgggtttctgtaagttttaatttttataataactgatatgtaaatatttagttacctttaacttatctctccaggtagaatggctagcagactgttttatcttctcaaaacatttgtgtgtacagttcccatgttcttttcaaggttcttgcttctaactgtcagttaaggcttttgtagcctcttacttcagttacattttctggccaagacgcaattaaagaatatagagctgataattatttccatagtcgtttccaatttttctactgttccacgtaagactttgaggaacacctttatgcataacacctttctacatttgattcatgtaagtggaatcactgagtcaaatggtgttaatgtttctaagcttcttggaatgcactgcctgaaactttctcaaaaggctgtagccatttacactcataatacttcaaagtgccaatctaaccatgtccttcccagcatggagtattatttttacttttgctattgtaacaaggaaaattaaaccatctcattgttaatatttgtgtattttttatttctagtgaccacaaatgttttcttttaaatatctgctgggtgtttttcttcttttttgagtaatgtgaaaacaaaacgaagttaaccaaacacaactcttccaaacttttctgatataatacacacttttttgtgtgttatgttgaggggctctagttggtaacagcctcctggttacataaatactgtacagtttaattttttttcagctaaataagccttatccctttatccatccttagtggatctattatctacccattaaattaaattttattctctataccaactcctgtttcttcacattttttaaatatatgcagagccctaaattacagtggctgtcctaataaaaggctattcagttattaacagaaaaggaagattgcttcctgcctcttgggtgaggaagactcatgtataccatagatatggtcagtttacatttacagttttctgtgaggcattgatttttttcccccataaatatggagtacttagaatgttcaaaacctttctctgggtaatagaatgcacaaaagtataaggcatgatccctgttcattgcccaagctggcgtgactctggtcatgcagcggacttcatgatgtgatagaattccttgcctatgagagtgaaggagatggtaccaggtctacttgtggccggtggtggaacacttacattattctaagtcctttctgtctgtagaacccaaatgacaaccatattattttatcttctcttattgctagtggtatcgtttattaatgccaacgtatacccattttgcttttcaaggttactttagatgtcttaggttggaatgactgaaggcttatacattcaaatttatatatgacacacacacacacacacacacacacacacacacatatcttattgttgcctgctatctttctacctgttgtataagaaatcctttgaaaaaagcctatgtcagcttcacaaaagatgttactgtgttttgggggaaataaaattgggaagtaataaaacagttaataaatgttacaagaccgtgtacaccaacttaaataagattaaggtcaaacgtatggtaccttatataggtaggaagagcagtattaattagaataattagggagagttgtttggagagtggaaaaaaacattgttctaggaagaaattttgtaatactcaggtaaagtaaaatgtagggccaagatattccagatagtgtagcagcataaacaaaggtatgaaagactggcttgtttgcgagtcagtgaagacattgttctctgagaatctactccagatttttttttttttttttttttttttttttgctttttgagacagggtctcactttgtcgcccaggctggggtgcagtggtgcgaacatggctcactggtgccacaacctcctgggctcaagtgattctcctgcctcagccccccaggcagctgggactacaggcacacaccgccatacctggctaatttttgtatttttggtagagacagggttttgccatgttatccaggctgttctcaactcttgagctcaagccatctgcccatctcggcttcctaaagtgctgggattacaagaatgagccaccgcgcctggccactccagatttttaaaagggaaatctgattcagtgcccctggggtgaactaagtgccttaaattatagagtgagaaatttacattgcatttgattggcaatgggaaaaacattgttaaatcttcagaaaagagaaataatgaagtccgtcttctgtgttttggaataggaatttggtgggtgagtttaaggacagttagagaggggagagattatttcgttttgttttgaggtaattgacatgatgagggtcttaggatagcaatgggggaaggaaaagggaacgtgactccagaggtttttcttaacaaggtagaattgccagaaggtaatcacagattggacaggttttaaagaaaaagggagttatatgtcttcaaaatttgaaggcgtggtgacacagagaatggtgataccattgaggaaaagaggaaattgcaaactgagcggagcaacagggaatagatatgaatttgattgaattacatacttatgggtttatttacaatttctcttcttagaaaaatttatttttggtggctcatataaatgtatgtgctgccataccataagcatatatttctcattaatcctttcaaaaaccctgtaaaagatatttgtatctccattgtgcagatgaggctcagagaaaataggtaattttctcacattgcaaagcagggatttacgtgtacttttaactcctaaaccagcgatttagcccctcagctatactttcttcctgagaggggacagtggcattttgaagaggaaatactctaaagccatttgaaaaggggaaccgaagaaagagtttggtccacagcatgataaaaatattacttgcacttttattatactttataacaagaagtacaggggcagagaaaggttcctaacttttactgagcaagtatatatccaagatacatctcctctttggagcttttgagatacactatctctcttagttttgcaacagccctaggaataggtactattactgttccctttaaaaatgaacaaaaaaaaaatgaagcttaggaaagttaaggttactagaccaagcttattgggagaccatagtgatgaagaggaagggctttagggtcaaatggatttgaattttacttcttaggcctttggtttccttatttataaaatgggattgaaataatgatatcacagttgaaggtaattatatgagaatttatgttatttattgcaaacatagggtaagcacctaataaatgataacctgagaatttatgttatttattgcaaacatagggtaagcacctaataaatgataaccattattactattattttacagcaaagacataaatagagcccattaagttttcttctctacccagtagtttttccattgtacaatagtactctcctgaaggacagcgggtgaagctaagaatttggaagaaatcccagatagagaaatcttgaaaagaagatagatagatttaatactcaatcattaaaaaaagtgcacatgactttaagaaatcaaacattgtaagaggatagtattgaaaagtaagtctccaaccactcttggtatcaatcccctaattttacttcctagagacaattaacagtatagtttttatgtttgcttctgtaaatatttttgcatatacaaacatacacataaaaatatgcccatttttgcacattgagagtataataggcacaatgttctgttctttgatgctattaccttttacataattaacctggagttttttttttcctgtagcgcaatagactgacagatggtgaatgaaaacttgcactatggagagttatgtcagtgttttaataagacaggaacccagaaataaatgtacgaagtttaacatcagcatctcgtggcctttaagtcaaattggacaaccattcaaagcttcataaatgctaactgcttctcatgacttcagaagcaaacaaaaaaatcattattcaaatgggaaattaagctgatcatcagaagtacagagaggatgtcctttcttaaaggcggcacgtctaagggagtgtctgagacctggcttcttcattcaggatggaggctgctgctactctttaaaagaaatgttcacatccttacttcctgacttccttctataacacagtctgcttcacaacactatgactttatatgtcagagcgggttaggaggagctgaatcttaaaaatttaagaagatgccaaggtctagaaaccactcttaacaggggaaaattagaccctgcttgcttttgggaaaatttgttttccagtcagatgtttgtcaaggttaaagaaattcacgggccctctgttcgaattgggagcaattgggagcccttaagctgaatgagtagacttgaagtcccacttagaatgagcctttatatttttgttctgtggcttgctcagggaagggatacacacttggggagaaaaagacttggattctagttgatgtttttctcctagctgactagggaattcagaacaagttactaagagctttctagtccttagttctctcatttggaaaatgaaaattttaaattagagattctatttctaaggcaccatgtatttcattttcttaataaaaagtatatatattcccctaaagaatactcataagaaaaaggtagagttaaaatttcccaaattatttaattcctggttgcccagtaaccattaaatttctcagcagtcaggcaagaaccacattcccaccttgagacaagatttaggcctttccaaacttaccctcgggctctgttccaagtttatttgtaagtcagttgcatacaatttggaatgaaatgtgttataaatggtggttaggtccctaagtcacagaatcttagttaaccctcagagtgcctgatatactgcaccatgtaaatagaaagcagctgtatgtttctatgggagcaaaaaacttttgtaggaaaaatggtagaaactcgtactgcaggtgttgattattcagcaaacttctctagataaggaggactgggaacttcatcattattggtctagttacattcctggtcactccctcatcccattgactggtcagtttccctccctgtggtccttgtgcaagggtttctgcctcaccccataccctctgctccttgcccggtatcatggttcttctgagggtactactgcccattcacccttgtgctaattaggattacactgggtaaggaaagacatttgttctgtagcggagaagcggggaaggccatcagaggctttgagtgtcagaaagatttggtcttgaatgcaggctctgggatgcaaccgtagggaagttaccaaacatttgtgagcctcattttatctttaacaaagctgataatacagaactcagggccttgtaaggactcgatggtatcaggtacacacgacatttgcccttgagtgctcagcgaatgttagtattccttctgccatcggcctgtcacttccgtttttctctttggctctacagggaatacttgcatacaaaaagagctgaagtaagagtcacctacatcttaggaaaaaagggctgctttaggtttatcctcaagtagttttgtccaggattctgaggagaataaaagctgggtcagatccagtgtgttgaaaagaaagctgaggtgagaagtgagagaaacagagaggcagagaaagggggaatgagccctgtctgctatgaagtaggaggcaatccaaaagacaaggaatccgtggtcattgccactgagaggagaaagaaggcaaactcactcctgtgacttcagggccatccatgaggtgggcagaggaactcagagtctgcccgattcttggattgaatcttcaaattggtaaagctttatatcaagcaactcccaaatgcagcatagttttgaggtgataaagaagagtcttttcaaggctgggcacaatagttcacgcctgtaatctcagcactttgggaggccaaggcaggcagatcacttgaggtcgggagttcgagaccagcctggccagcatggtgaaacctcatctctactaaaaatatgaaaattagctgggcgtggtggtgggcacctgtaataccagctacttgggaggctgaggcacaagcatcacttgaacccaggaggcagaggttgcagtgagccgagatcatgccactgcattccagcctgggcgagagaatgagactccgtctaaaaaaaataaaaataaaataaaaagagtattttcccggagtaccggtaatattggttccagattcaaatgtattgtccagatacacagagggtaaacaggaacgcttcaggcatcctttattaaaagcacctcagtctatgtcagagggccaggcagtccattatctaatgaaaatctcctaccattgatttattttatcataactgcagctgctaagtaattttgtttaaggaatgatttacatattagtgtcttcagcaggatctcatcattagcatctagtctccagaaaagttaacacataacagtgaaaagaaaacattctctatcacatgcttctgcatgcatgggcaatttgagtcataccacctgttcccctcttctgttatgctagagtatacaaaaagcagagatacgcatagtttactatgatcctagatgcttaaatatcttgaattgtgttctatcttggactcattattcatgcataaagactcaacagattctcttcttgcacctctcaaacagcaacatcaacaaaacccaaacaatgtatctttcctaatgaggtgaaagcatgcataccagcctaagacagaaatgttgcaaaaatgttttttgcaagaaggtcagtttgcttttcccatggtaactaaggttaatttctactgtggttcattttggcatccattttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactgtcaaaacatatgattagttgaagttaccaaaactatttttttaaataacatttatcttaagagctataaataaagaggaaattttgcactagagatgaagttatgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctcacgtcatttctccaccgcaaggaggattgcgggggtggacgatgctccctatttagtcttctgcattttgttgcttacagttcaattaacatgtcagttagagatgacttttggttgcagttaataaaatatctgaccaattgtatcttaaacacagaggagttgatattttttgtagaacaagaagtctggaggcaggtagttgagagctatggaagagttccgtgatgtcatcagagacctgggccatggtttattctgctgtaccatttttaacgagtgactttggtcctgatggttccaagacgactgctgcttctcaggcaggaagaaagagaaaggacgttcagcctcagagtctctttgtctttccatttgggaagggaaatcctttcttgcagatatcttctcaagcattggccaaaactgtgtccacacagcttcccctggctggatcagggaattgagatcctccagcctttgtagcagagaaagaccaaggagaaagaatttgggaaggggtgttgagtgagccaacatacagttatctgccacaattaaatacagcggattcaccttgcaaataagcattctttttagaccatttattttctttctctctttgtcccaattcctttattccttaggaaagtcttgatatctttgtgaggtgtgtttcaaaaaagaagctccagctcaggttgtaaggagtaagcaaaaataataattccagtgattcagccatagaagtggaaaattatattatttgaagaaaaattagatgtaaaatcaatgtcatcgacagcttaaacctggtaaaagcaaggaagttcctttcagaatctaattttattccaaatacatttattgagcaccatcatttattgccctagatgccaaggataagtgaacacaacatgacctcttcagaagtctgcatttttctcatcttttttccctcaagtataagaatgaaaaataaagctatttctaattagttacatcagtcatttctatcagtattactatagattttatttttattgtatactggatatttaaactaaatttaagcctttgtgggcttagaaattactgtttcatgagtaacatggcttatgtaggaaatttccaatgccattaaccttaaaaatgttcattggaatactgcttatgtcatcttggaaactacctttgcggttgacatataaactgcacgatggtctattttcattatatgtttctgtatgtacataagcatcctcatgataaagattgtctacttgatcaaacttcagccagactcctgaaccttctcctaggcccacctgtgcacttctttgtaaaaatccagctgtagcgagaatcctgctaaatcagtttagcaagaaccaccttcctcttatgtatctgatcaggttcctcatcctccaccatcccccatgtgacgtctgatcaccctggcctgtgtcttcagcaaggttcctgttaagttttttttagctagaatcccccttacccccatgctttctcttagtagttttccatccaccaaaccccaccctgctccttggctatcaattcccacttgtccatgctgtattcagagttgagcccagttctatactgaggtctctttcccactattgcaatattcctgaataaaatctgtttttaccactttaccgtccatctctggtttttctttgacactcacataaccagagttttgtatgtgtgtgttgcttgacacatcacaaatacctgggatacgtgtactgattttttacagggtgaataatctttttgttttccccaatatcttagaaacctgaatctttaacccctgggcttagtacacagttaggcatataataggtgcttaagtaagcgtcaactgatgattttaaatgcagaagtaattgtcacttaatgaaatatagtcaggagactcatggattttggcctgtcttcctacctgttcttgtactgcaacagtaagtgtattaaggcaatatttttggcagcacaatcatttagtttgaatgcattagtaaaaggtggagtccaaagaattaatcgctggaaagttttgggaaaacccagtaacaactgtttccatagagtaatttgagtgacagccaggtaatagctacttattggagggactccacagtcagagccttgacagggacctgaaaaagagtgtaactgaagggtaaatgtaaaagcttttgggagaacaagggagtggtcaggctgaggcaaagatctgaaaagaaatgcctcctggggccaagctggtaatttgaatgactgaaggtgactgggtgggaactggggcaacctgaaaagcttctgttagggtaacagagcctccgttgcagctgactgttctatgagaatgtgagtctctattgtcaggtcttcaggttcttccagagaagcaagacaacgggaaatcaccagatttttaactaatggcgtatcattcaacaatttcaaaaaccattatgtgagcccaaactgaccaacgaatcaaacacacacacacacaaaaaaagagtctgcagactaaattcaaccagttggtgacctctggtctgtggttaccagagaagtaattgaaatggagttttgggagaaagatcatatgttgaaatcttgggagataagggcagagaaataagtaagccgagacggcggtaaggccaaggtagaaaaggtagcctttaggaaaattaagttaagactttttaaaacaggaaggggcaaaagatgaggttaaagcagatgaggaaatttactgttatttattttcatcattaaaatacgctttccacaaatttttcaactgtaagagagagtgataaattcaaaataggtaatgtcaaccatattatgaagagtatgtttttgcaatccaaaaaagctaaggcacaacattaaaaaaaaaaatctgtgaatttggctttgcaaaggtataagaattaagtcacatctgatcatttttagagtcttaccttttataacaaagaggaaaatttaattaaactggctctgccctggcgaatctgggatgtgtgttcacttatgaagagagactgttaagattcgttaattaatgaggttgagaatagagttgaaggagattggggtaaatttataagtttgtgtcattctgagagttctgtaagtagctgagttacccatgttgtgactgagaaaaacaggagagagcagtgactgaaggttctgagccaaaggaggagaatagtattgtttattccagcagccagagtggcctgtgtgactgtaagtcgcctgtcaagagggagactgcaaggaaagtgcattgatttgatttggagtagttgtaactgcagcatgaagaatatgatatatagggatgataattgaggaacaatttaatggctgcataccttgctgaagttgaagttccttctggagataaaggtggcaaaaaagaaagtgcttaggtagaagagctttttaaaatgagttaacagaaaacagcagactaaatatggaattgaggagtaggaaatgaaggaaatgaatttgaagatttactttctttcaggatgcagagctggtatgtaatccctctgtttccagtgccttctcccacttccaaatttcactgctcctcatgcgccctggtgtgtggtgcagcttcgagattaagcctccagccttctgtcaggatgaagcagcaggtggctgagatgctaggctccaagtgggggaggtgtttagggctctaaagactttcaaccagtccttgtattttcagccacatttcagtcttcagaggaacctggagcctttcatttctgagacttcttggctacataaactggcatgcgtcttgttagttcctcccactccctgccccaatctccttgtctccccaacatcattaattgagcttgggatttctctggtctcctaagttggttaccagcaggtcattttctaagccaccaaaatactggagctctgatctgttctcatctcctctcctgttttgttaattttcttttgggtaaatgccattttttattcctcttctatcaacctggtagagtttcagggataaagagagacaaatgagtctgctccatctgctgtgtttaactagaagtcccaacacccaaaatccttcacacgatgtgcagggctctgcagtgggcctccccctgcctacctgtcaggccttatctgtgcccactcttcctccttcctctctgagatttcagcaatattggccttctaaggattcttaaagccccaccttcttctctgcttcagagcttttttttttttttttttttttttttaacatgtgctgacctattacgctgctgtgttcttacctggcacgctcccatcatccttcaagtctttgcttcaatgtcaccttctccaagaagcctctcggacctatgtttccctatgtatacagtctcatcacttcctgtgtgtttccttcaccattttaccacagtacatatgaatatttgtttgttagtttgtttgagacggagttttgctcttgttgcccaggctggagtgcaacggcacaatctcggctcactgcagcctccacctcccaggttcaagcgattctcctgcctcagcctcccaggtagtagctgggattacaggtgcctgccgccgcatccagctaattttttgtatttttagtagagacggggtttcgccatgttggcccaggtggtctcgaacttctgacctcaggtgatctgcctgccttggcctcccaaaggctgggattacaggcgcgagccaccgcacctggcctacatatgaatatttgattattatccatctccttcgctacactgcaaagtcaataaaggcagagatttattttggttaccagtgtattccatgtacttggcatggttcttggcttatagtacatgcacaataaatattgaaaggatagatgaaaggattatggatagatgaatgtcttttaagcagttataaaacagttctgcctaaagagtcttttttaatcagtagtattacttcaaatacatatttaaatacacatatgttataaatatataaaatatgtatttaaatatgtcatttgtactattttaaatgtatttaaaataatatatgttatatattaaaataatactaatgatttttaaaagatcaggcaacactgctttgtagctttttagaagacatttatccttatggatccataattattatggattgtatgttttatatataatgaaggttttgggagttagagccctgatccttccgctcttgaagcttgatttaaaggagcatggcacagtggtgcctatatgagtcagccctccattatctggggcagaattcaggccccagaaatggtacttaagatacacagttctcccccagaaaactttatatcggccatttgttacagaaactgctttctcaacaaaccttttaccagggcagctaacaatgagcaaaactaatttgaatttcaactctgccattattacagtgttgctaagaagtagtgagattctgctgaggaaggccaagcaagaggagggagccagaaatgccttaaacaatccacagccaggattttgtgctatcttttatttcacagttgaacttctcagtattttttggttcataacctttttctcttttcctcaattctgagtcttccacatttgtgccatactaggtactttattgcttctctcccttttttttttttcttgagatggagtctcattctgtcgcccaggctgaagtgcagtggtgcgatctcagctcactacaacctccacctcctgggttcaagcaattatcctgcttcagcctcctgagtagctaggattacaggtgtgcaccaccatgcctggctaatttttttgtgtttttaatagagacggggtttcaccatgttggccaggctgctctcgaactcctgacctcgtgatccgcccgcctcgacctccataagtgctgggattacaggtgtgagccaccacacctggccctctccttcatttcttagaagagttttacaaagtcattggtgataaataagtaataccatttcacatctggaaacataacttgatagtaattataaattcacagactgtactttctgtacttatctaagtatgaatgcataattcctgtttatctgtgtgtaggtttatttttcccccatttaagtaaagctctatgttgatgatgaggtttttacgagttgagattttaagaggcctcaaatatatctaaaaaattatagaccaagtatgatgtgttagtgttcctcttctctcagctaattctttaaagatatgttccagaattcctggtctgttcttgaagatctcccaataattctagacttctgaagcctggatattttggcttaatttgctttcaagacagactggatttaaattactcaatttgtctgaagtctcattaagatccaaggttcttgtctgttctagtgagtttgagctggcaagaataatacttgtcatctgaaaagtccattagaatcctttggaggagtgagactggaaaattggagacatattattatattttaaaatatgccacctttctataataggagtatgtggggagactgccttgttttggcttcttgggaaaatttggaaaattagtaaaataggcaggcagtagtagttcaatgcgtattgtatgccaaacactgaatttagaacaatactcccccaaaagcatatgtgctctaaattttatttttcacttaccacctgggagatttggattaaatttcttctgggaaatagagttggtatgaagaaacaaagaccactataccaatttatctgttggaataatcatttagccgtacagctctttccactcataaagttaatgaggtcattattgttctttctagctaatagataggcatattgaaaccttaggcctttccaaaaagtctccataagccattggaaagatagactaaaacactccttgttttaaattctagacctcagttcagtcagagatagtaggatttttgcagtattattaaaaagacagaaaccagctataaaattgaaatgaagggacttaatgttttttttctgtaatatctttggaatgcttccatggctttaaaatgctgaggtgtttctcactatttttcaaaagcatgtaacatgtagatatgtgacgcaaacttgaccagttgttcctcttttctggtgaattttgacacctgctactattacacagagtaaaagtgaaagtcataaaacagaaatacttaccaaagtcaagaaaaatgcatagactaaacaaaggggcaagagaagcctattacttgtttcatgtttcaaaataaaagatgaatggcctatcacttcagtagttggaaattcaacttgagaaggtaggtggtttgatgtttgcccttgttccttacgtttctagatttctctatttataggctagaaccagccctggataaaataatacaagttatgaagagaaatgtgcagttcagcatttttacccttctgaagtgcgctttctcccagctgccatggaaacatggcgtaactggtttcttggatagtctcactcctcttgagttccggctgtgagagctagtgagctcattacaacttggatcagagtcctggaaagtcagctcccagggaaagtggaggacagtctctcatggggcacgggaatggggggctttagctttattaaactgcatacatactttcactacacagtcatcccaagctttagcccaggacagtgtcacattgttcacagctgtattgcatcttgaggtttctgtgtgcatcctacacactttcctaaggcagagacttatctcttccagctgtaagccggagggagtggtgctgcagactcctagcaacacatgcggactcaaacaacacaggcagttaactctcttgagtagtagacttgtagggcaccagaactccgttgcagttcactgacagttaccagatatacatttgtatggcttccgtagcattgtgatggaagctaaacgtttgccctgctactttcttttttttttttttttatttttttattttttttttattatactttaagttttagggtacatgtgcacattgtgcaggttagttacatatgtatacatgtgccatgctggtgcgctgcacccactaactcgtcatctagcattaggtatatcacccagtgctatcccccccactccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccacaatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccgcattgccaagtcagtcctaagccaaaagaacaaagctggaggcattccctgctactttcttctggtatgcctgaatcactgtttgagaatggattggactttggtgcgtggaaaactggtagcagaaggcttattcactgcagtgggttgggggtaggctgaaaagatgtcagggaggattaactagaggcagaatgtgtcatagttagaagtatttagaagggaagaaagtttgaactctgatactgttccacactaatattcatgccctgaaagaatcagatcattcttgcctctcccacttggatctctagctactggaatttgccaattcttgatatgaacgctaagatttggatggagcttgtgacctcatttagaccatttgttctaaatgctgaatagaaccaggaaaataggaaaagagggtagaattggggtcataagagaggaatcgtcgttctttgaaagaagaaagatgataggaaactaggcacatgagttacgaggcagtggagaaggaggattagaaagggaaaaaaagaagagaaactttatgccaatatcttctacaagatgtttggctggcacaaaactaacactcaatacttttgcataagtaaaggaatgagagaaaatttgggattggatgcttatcccctggaaactgctacaggctggtgttaatgggaaagggatctgtatttgaccaaaagtgcatttccacgtctctacatttctttttataaagagtcaaagggactcaatgatgagtgtgtgtgtaagggaactccacactagcaagtacaggaaaaatttgatggtactggtgaaggatgttgcaccaatctggaggggaggacaggaattggtttctcatggattgatgccgcaagacaattcataccatgagttggctgagaccacttaaaaaagtaagcagtgatgactgggcaaaagagacaaaggaagaaccacatcttttaggggagagagagagaaggacaattaaagggactcaactagatcaagttctgctcactaaaggacagcgtccaggcaaatgttaattatcttcaagaagcaatctgtatatatagcatttcaagatactccgagatgcttttaatttattgaatactttttattggtatttatcataaacaagagactcacaaatatatcccagaggggaggttttggtgtagttgactatagtagttattaaataatctattaataaaagcccacaaaatggaagatagaaagatagaaaaacaaaagacaacacaggatggtgttggtatacagaatttatacttgaagtttaacaacacggaacaagaaactttattaaaatattcatttaaagaacttccatatgaatcaccagaggctcttagtaaaatattgattcggattcacagatctgggtggggcctgagattctgcatttctcataagctccaagcagatactgatgctattcttcctcaaatcacactttgactaacaaggactcacacaggttctctgtaattggtgttggtagtcattcatggttagatgtagttgaggactgccctcttaactacctctcggctgccaggttataaagaaagcaagtctcagtacaagttctgtcacttaggagcatttattagccaatgggtacaaaacaatcttacagcctgtgccagagacacagtgaagtcacagttctgtcttttggggtgcttggtgtgagaggctcacagtctacacaggccacagtcctctattagagtggttctcaaagtgtggtccctggaccagcagcatcagcatcacctggaaacttgctagaaattcagattcccaggcccttcccatacctactgaattagaaaatctggaggtggggcctaggaaatctgcatctttaaactatccactccaggtgattctgatgtttgctcaagtctgaaaaccattgttctagcagcaggattccctcaaccatctaactgaattctggcaactaagaatccggtgaaccacagctggacattttggaattcagcctagggcaccatttctaaagatggagaacctactggattcttcttaaactcaatttaaaggcagggagtgtttctaaatgtttttcaacaatcttcatattttgcaaaccactaatatcactacacaggcccgtctaactattaattaggaaaattaatgaaacccctggtgtaataagagctaaatataactgaatcacttacagtggccgcctgtggcatgaggctttttgattaattgctagccaaccacccttggagttcactcctgattaagacaactgaccacctctacagtgtagcttaagctaacacacacatacatcagagtgtactgttcatgtgagggtttttaaagactcttaaaatttaccttatcagggcataatttaaacactataacatgtttccattttaagtgttcaggttagattttggcaaatgtatacactcgtgtaaccaccatgccaatcaagatataacatttcgatcacctagaaaacacccttgtgttcctttgaggtcagttacctactcccaccacaccccaggctaccatctggcatagtagctaagttttgcctgttctagaagttgatataagtgaaatcaaacagtatgtactgttttgtgcctggcttcttttacccagcttagtgtttttcagatcagttcacattgttgcattatcagtagttagttcctttttattgcactttgcacagtagtatcccactgaatgactttaccacaacttgtttatccattaccttactggttggtttccggtttttgactattatgaataaagctgctatggatattcatgtacacatctttttgtggacatacatttttttttattctgtgcaaatatccaggaaaagaatatttgagtcataatatacatgtgtgtttaatttcataagaaactgcctaactggtttcccaaagttgtcgtacattcccaacaagcagtgtctgagaattccagtcgctccatatcctcaccaacatttggtattccggtcttttaaacaaaattgtatgctgaatagtttaaattacagacattgttttctttcccctagttgaaattcaggcttttatgtttggtctctgcgatggccataaagctgaaaatgttgacccaagtgacttggatatggattgaattattgccctttcctaacacctcatcagaattggtttcgtaggtgtcatttgattatggcagtcatgtatgtcagtgtactttttctttctttcattcttttgtttattgattcagttggtcagtcggtccatgatctgtattaaaacagctttttcagagggcagttgcatattaagttgctaggaaaaatgacagaagtaggtgacagagttcttgtcttcaaggagctttttggagctgagttcctgaaataaatgtagcccagtatctatcaaggcttgtgcagacttgagtaagaacatcatctaaatatagcttcctgctaggtggcgtgagtcagggcttgatagaccggtgactgcagaaaccacagtaacatatattgttgttattctgtgctgaacattagaatgattgtaccttagaatatagagccaaatgtttattttattcctaattatatttttaaatacatatcacacacatagacacatatgttggataaaaaatactcaaaatgttaacagtgcttatttaaaaggtttatataaactttttttgtagagatgggatctcactatgttgcccaagctggtcttaagctcctggcctcaagcagtcctcccaccttggcctctcaaagcgttgggattacaggcatgagccactgaatccagccagttgtgcctatttttgagtttatgggcttgtggatgatttatttgattatatatgtatatgttaaatgtctaagttacccaaagtgagcatgtataacttctacagtcagaaaaaatgttatattgccacttgattgtttaaggtcttatagctatttaaataatgtatttcttgttctctttaatcttgtgcagaaaagattcactacagtagatccagattactttctagaaaaaaataatgcctgtccatctctttcctcttgggaacaggactacatgaatgcccttcaggctataccactttagtcttcacagaacttagccttcctggttgtcaaagggcaaaaggaattattttttcttttccccacgttaacagaattttcacctccgaaagcttggcgtatacacactatatgttttctaggctatttttgtggtggttgtagttattggcaaatcactgggcgtcgggggtgggttgtctgttatttctgatggaataacaaatgctctttgttttccctcttttcagctgacctgaataatgtcagattctcagcttataggactgccatgaaactccgaagactgcagaaggccctttgctgtaagtattggccagtatttgaagatcttgatactatgtctttgcttagaataaaaagtaggttgggtacatttttacttagagaggggagaaacagctgtcacaattcctgttgcaatgtataattcattctttaatgtatccttggcctagagtttgcctagaatgttttgttttatttttagaatcattcctgtcaccattcctcagctactgatgttgaattaagatattgagaatttttattttccaactactggcattggcatcggcatccataattacctttgtgaaacttgcacaatccttgttctacctttgtttttttttctttttacaaaatgtacttagtattagaagactatgactatctgatctaaaccaaacttcatagacatgtgtggtttattagcttgaatgctaacgtgcagatgaatgaagtggtagaggaaaaatgacagaattgctttcctccttttttatcatacatctgtggaaaaatcctgaagtgttacacagctctatcatgtcatcaaatagtttatgtataactctactattgtctgagggtctgtgtgcattgatgatatgcccatgaaacaggcacagtttctttttctttttttctgtttttttttttttttttttttttttgagatggagtcttgctctgttgcccaggctggagtgcagtggagtggcgcaatatgggctcactgcaacctccacctcccaggttcaagtgattctcctgcgtcagcctcccaggtagctgggattacaggcatgccccaccatgcccggctaatttttgttttttgtttgtttgtttgtttgttttgtttttttttgagacagagtctcgctctgtcaccctggctggagtgcagtggcgcgttctaggctcactgcagactccacctcccgggttcacgccattctcctggctcagcctccggagtagctgggactacaggcacccaccaccacgcctggctaattttgtttttgtaattttagtagaggcggggtttcaccgtgttagccaggatggtctcgatctcctgaccttgtgatccgccctcctcggcctcccaaagtgctgggattacaggcatgagccaccacgcccggcctaatttttgtattttttaatagagacggggtttcaccatgttggtcaggctggtctcgaactcctgacctcaggtgattcacccgcctcagcctcccaaagtgctgggattacaggcgtgagccaatgcgcccggcccaacaggcacagtttctgctctgatggaacttacagtctaacaagggataaccaggatgttcatgaaatttgtagacataagcaaatatatgtataatgtattaagaatgtctacagttggttaaaaaaataaagtgatcttgtctctatttccaagaccatttcaatgtcatatatttagttgtgcaacagtgggacaatggggtactatgtgaacagctaactgtgtggaatgagattcaaagaatgtttgtttgaagaggtgatgtctaagctaggtaactctagaagagtaagcagctctctctctaggaagagcgttctagtcagaaagaagagcatgtgctgaagggcccagagaaagcatgacacattcaggaactgaaaatatgtcagtatggctaaagcacagaattccaggggaaagatctattgtgaaataataggctggagagagaagcaggaagcagattgtgcaaggtttttaaaacccaagttaaggaatttagaggtcaggggatttggcctgggggtgacataatcagattgtcgcttagaaagatgattcttgctgtggaacagagtatggattggtgcgatgtgggagtgacaggagaaaaacctgttgcagtaatctaaaccagcaatgtggtggcttgaattagcagagtagtaagggagataagtggagagaatttagaaatatttaggaagtggatttgacaggcctcagtgattcatttgatgtggtgcagggatgtccaatcttttggcttctccgggccacagtggaagaagaattgtcttggaccccacataaaatacactaacgctaacggtagctgatgagctaaaaaaaaaaaaaaaaaaaaaaaaatcgcaaaaaaaaaaaaaaatgttttaggaaagtttacgaattcatttgggcctcattcaaagccatcctgggccacaggttggacaagcttgatgtggtgggtgaaagggagtcaaggaagacacttaggtgcttggcttggaatatcaggtgaatgtgggacttgtctggtaaggttagacacggagctgtggtgctcaggagaaatatacaaacaacgtttagggatcatgagcctgtaggtgctgcttgtaacgggggagaggattggatagctccaggaaagtgtagcgtgagaagggaagttatttaggacacaggataagcaacctacagaagggactgcaaaggaatggccaggaggaaagaaggaaaattccaagaggttatgatgccacatgctccatgggaagaaagaaagaacccgttaccagggtcagatgttgctgggatgtcagcataaagttgcggaaaatgcccattggacttagcaacaggaaggtccctagtaactttggtgagattttagaggcacagtggaagtggtgtggtgagttcaaaagtgaaccaaaagtggagaattagagaaggtatgaatgattcttggagaaatttacttatgaaggggagaagagtggggtggtagctagttggagggggctgaggagttaatggaaatgtatgtacagtcacgtgttgcttaacaatggggatatgttctaagaaatgtgttgttaggcaactttgttgttatgtcaatataggagagtactacacaaacttagatggtatagcctagtacacacctaggctgtatgggatagcctattgctcctaggctatacacctgtacagcacgtgactgttctgaatactgtaggcagttggaacacaatagtaagtattgtgtatcgaaacgtatttaaacatagaaagatacagtaaaaatatataatagtgtaatctcatgggctcgctgtcatataggcagtccattgttgactgaaatgtcattatgtggcacaatatgtgtatataagtgtgtgtgtgtgtgtgtgtgtgtatacattgatccttgaacaacatgggtttgaactgcttgggtcaacttacgtggatttttttcaatcaaatgcaggccaaacatatagtattcgtgggaatgtatttatatgagtatgagaagacagggtgagattacaattattggcccaagaggagatgataaataatgggtgttctcagagaatacgggcaggtaatccagagcccaagggagggaagagatacctctcttccactgtaatgggtggggtagagggaaggatctgggcaggtccaggtaactaagaaaccaggtagcagcaaggtgaaggatgtcttactataaaggcttccattttttgtatggagtggagagtccctgcaacgcagttaacagcaggagatgatgaagttgggcttatctttgtggagaataagagagagggcggagttgaaaaccagctgtgtgaacccagaggcggctgagtgtttcacggtagctccaatctgcaggggtgtggtatttccccaggcacgcttagcacttgggagccagatgcttctgtcctggggtagggagggaacagctgggcaagagaagtgaggatttgggcaaaagattgattaaaatgatactgacaagtccctgttgggtaggagaagctgtgaacgcatatggaaactggtaattaggaggtagagggatgaaaatgctaactcttcagggaggtaggggaagaagtagtaaaggaactgaaggtcaagaagttgtggtcagagagaatcatagatgaacattattttgaaggtggaacagtttcaggtgattagatctaggatatagccatttgagtaggtggcagaggtagagtggatgtgaatttccatggaggtgaaatagcaagttaaggaactgagaggctagaatgatgcatgagtcccccatgccaatgttgaaatcatgcagaattggagcgagaactgggcaaaagagaaggaccgtgaaccctggctgccaggtcttcagaaataaaggggttcaaccagaggatctgcagaggctagcaataagatagtcaaggagtcacttggcatatggttcttacacagagatagagaagaaatgccttagaagtggaattatttggaaagagagactaggccttttcccttcatcttggtatccccaatgcttagtacaaaacctggcacacagcatggttcaatatgttttcatgagatgaatgcatgaatgaaagtaaaccaaggcttccatttccttatagcccgaagttatcatttttcagctatatagttgccaagtttaactggtgtttaaagggctttccaggtcgagggtttccttaggacctgttaatacgtcatagctgggaaaaagtagtttgggatgggatcgagtcagggggctgaatagagaaagttttcttgcctctttttcttcacctgcccctgcccctgcccctgccccatcccagagctactgctttcctttaataaaggagtaattaggcactggttatcatgaagtgctagagaatattcctgtgagatcctaaaagttcagaagctaaccatttgttccagtttatactatggaaaaaaaaaaaaaagaaacccagaaatagaccagatggaaaaaccttataatgactgttcctttctataatgtccattttcaccctggatttaggcattattcgattttcctgctcaaaaaaaattccattcacatatgtgttttattgtctgtcatttcaacttataatttccaataaactttgggaaaatgggggaatttcataatatacaaaattttgtccatttgaggtgataaccttgtaataaaggtaagctccgaatgtagaataatttctttaaattttcacttttaaatcaatttgaaattctctgcatttcctttctgagcatggcttttctaatatgtgaaaaagattcaagtatgccaaaattaaggtgtatgtatctaaattaagtattgaattctcattaatgctaggagggtgccatatatagtaaaactatagaatgaagagttcaccccatccttttattgaacatatgtgtggtcacattacttactttcaatatatgatttaagaattttctcctaattttatatttgcttagatttagcttccaggcttttgtcatttctaagcctgcaaagccatgataaagagctattgtctgcggtacaggcaaataaaacttgccctggctagctttccctaccaaaggccacttctaccaactctaactttaaggaaaattaatgatgttatctcagtgatttcctggtgccagtgaagagtttgaattacagatgccttggaaatatgcacttccacctctattaagcacttgatcttatttttttttcacttccctatcaatgtttccgtattgcagaaagccaaataacccaattgtatccactatagagaattcactatttaagtggagagcatcaccgttggcctataatgtccccagtttgtaatcagttaagtgttgcatgactccttactgcctctcaacacattggaaatgaaaatgaaacttggtagaaaagcaggaacaaagataaaatcttggtaagaaggatttataaactgtttcatatagctgatactccattgaaagttatgaagaaggtaatttaagcattttctttctccctttgtagttctgatgacattctacaggtgtgaggcttctaaaattaaaaagccaacttgtaagagcagaaataaaaacgcacttaacaaagcaagtgtatttagtttattaataatgtgtggtgggttggagagagcccaaaccatagggctaaatatactgcagttgataagtgtgacaaatattctgcaaacagtaagaaatagagaacattttgcctctattcagcaactaaagcacacattatagagatttggtacaggctggagttgtgtgaatagtcacagtttctggactcgccctcaccatgacaaaccaggtgaaaaatgcaccgccttctctgtaaatgcacctcaccttttgatggtgcgctaagggtgacattagataggcttcagttgctaaagaagactctcaggacccacaataacatggcttacaaatccgcgctctattgccagaaaaggctacattacaagagcattactgtcaggatatggatccacagccacaggctgcctccacagcaagggggtctcgagaggccagtgtaattattttgccactgtcctacaaaaatctactttttctatataccatgtattatttttcacataggttagaggccatgtctctgttagttctgagtttaagacgtcttgaggacatggccaaactaattttctcagtttatatggtttgacagatattagtgcccaagagaggtctcataacatgacccatctatctcccaggggaaatactgtaatcttgtttagctgttacccactagggaaagaatggttttctctcagtcagatgctaaagagattaaagaacacctcgtaggttccgttttctagtaattattggttccattctccagctatcaaccttggcagcttgccatccctatccttcctcctggaattggatgcccttgaagtgcgcttcttgcactaggaagtctttctcgtcagtttatcatttctcattcaaagcaaattctacctggccaggtatctctagcccagttcctaattctcctaatagaagtttcttttatttcaagtggattcatgccccttggcccaccagacatgttgccattgagaaatagcagctttaatgggaaatacacatgagacacaaaaatgtgactaggctaaaatcatatgaatagtagtcactcctaaaaggactttggtttgggtatgtcacagaaatttctgtagccatccatatccaatttctagcttttcagtctcaggaaagtaggcccaccaaattcaacttaaatatctgtcactgattcaagctgtcccaattgtccctccacccactaatggctttccacacggagtaatggggcaaatagctatttttttaaacacataatgttatgacagatgaaacatacagcacgtaagccttctatcacatgcccaatacctttgttaaaccttcatcatcacaattgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggttttagcagagtcccccaccccaagaggcatctgagtctaagccaagggagcatattattctcttattttaaacctctccgtaggcagcaacattatattaggttttccctttaaaaaaaaaaaaaagtatcggctgggctcggtggctcacgcctgtaatcccagcacttcgggaggccgaggcaggcagatcacgaggtcaggagttcgaggccatcctggctaacacggtgaaaccccatctctactaaaaatacaaaaaattagccaggcgtgatggcgagcgactgtagtcccagctactcgggagtctgaggcaggagaatggcgtgaacctgggaggcggagcttgcagcgagccgagatcgcgccactgtcctccagcctgggtgacagagcaagactcggtctcaaaaaaaaaaaaaaaaaaaaaagaaaaaagaaataaaaaagtatctttggtggtttccttccccttgcaacaatctcacctttttccttttatcattaattttaagccaaacctcttccccagctacacacacacaccacacaatgcagacagtccccaacttgtgaagtttcaacttaacaattttttgatttcacagtgatgcaaagtgatatgcattcaatagaaactctacttctagatttgaattttgatcttttccaaggctagtaatatgcggtatgatactctctccccttgctgggcagcagcactgaacctcagctcccagtcagccacaagatcatgaggctaaacaactgacactttactgtgtaaggtgttgctagacagttttgcccaactgtaggccgatgtaagtgttgggagcacattgaaggtaggctaggctaagctgtgagtttcagttagttaggtgtattaaatgcatttgtgacttaagatattttcaacctatgatggggttgtgtgatagcttcaattaggcaaggcacaaggaaggagtaatccattccattgatccttgtggaatgcttgtgcttaagtaccaactaatagccatagtatcttattttggaatattaccagcctttgaaactcttaattgtagccccagttcagggactactaggtctggcatcaaaaaagaaacctgtagtgacatagggaatacctgtaagtgccccacttgaattatctttttaattgtaactggtctcacaggtgtagcccatttctcaaaaatgatagttgcttcagctttttggttgggactccacctgcaggccagagagggtgaagcccagtggaaagaaattctgaacttaacattagcttttggatttttttttagcagccttgccatcagtttgcaattgcctcctaatccattttgttagctccttaggttcaagttctctcacttccagattccactagaaagttacaccatcagtaaccaatttcaaagcctgtgttacttttcaaccaagcgtagcttgttgagcaacttcaaaggttctttttcatcccttttatcagaatcttctttttttctttctaaataatgcctcagtcatacttttagctaagaatgagttggaggtgttctaaacaatcttgcttctgacactcactgccctgacagtggaagttaaacagggttcaattgctaaagaggactcacaggaaccaaatgacagtgcttacgaatctagagttccttgcagaaaaaggatgcaatatacccacaacattaaaacaagaataagtgtcacagccacagcctgcctcacagcatagggtccagagaggacaggtgcaagctataattgccctctgtctgcaagagccacaccacgatgcattttctctcttggaacaagagctactgatgtgagcacagaacaccttggaaaccagggagcacaaattggagtttcagccagggtttcttatatcccgtgggtaacctaggcatactgttcctatgtaaccagcctcaaactcagtggcttccgttggtctgactgtgcccgggtaaaaatggtcaatgttactgttagcaataaacaatggtgataacctgcaacccatggctacacttcaacacagtaagtcactttgaaaagcaagtgctttgaccagggctctgcactgtgtagatattttagcaagtcatctcgtgccaactccagcctctctggaattaacccttactgcacagacaactacatcaaagtgcattgactttcttgaagtgcaaagatttgcttgggaggtccctcagccataagtgtaagttgcctgtagagtggcatgcctgggcaagaaaaatcagcaaacatacagcagttcttccaccattactcacctctttctgtttctgtgctaattagatcacagaattatttatacatcaacatagaatatacagattgacctataggatgaacttggggttatatgggcaccatgagactttttttttctccactaaccaactttttggtgcttctgttttatcctactgttgtcattagcatggaatgcagaatggttttcctgttctgtaaagtcagtaaggacaccttctgccacccacttttcccccttacaatatgtacctccatgagaaatcagaaaacctagatatcctgccataacacccagagtgagtctccatatctctggtctcagttgtctcaactgcaaaatgattttaaagcaaccttctggctctaagagtctatcactctgtaaaagacaaaaaaaatctgtcttacataggaaggaatagcaagagttagctactgtggcatacatagaaaggaaaagaatgagcttttgaagctagaaggttgagaagatgattaggcacaaccagagcctcaggaaccattagtgggatccctgtgttgaagtcctgcctgctcgccgccccccaaccgccactgtctgcttttcctgcacagcaaagaggatcctggagagtcagccatttcttttatcctgtccccaccctctctcacccccacagccctcatgcatagggtaccaccacatggtccctgttcttcaatggcttcaaagcctatagcatcctctactgtaaacataatttagaaagtgaagatgtattagaatacttgggtttttatgtagctttaaagatatatctactagtgaatacacacaaacacacacacacacacacacacatacacacacacatatatatatatatatatataatatatttaatggaaattcctagcttaaggaaacaatggtttcacacaactgtatctgctggttgcttattgagggtcctagaaagagctaatcattacatttaatgtttcatcaaaaagtctaggtgtgttctctaagatgctcattttgaaaagcatatgcatggcaattaaattgtccctattgatattctcacctccttttcgggtccatagcatggattgtgtatacctaaatggaaattttttcaaaatagctccatgaaagttgaattctgtttgacatgtttgtttagggaaatgtgctcttcagtcttctgtgatggattgttcttgtgtttaaccacatccagttttagcagagcacactgcacagtatttctctcctaactgtgtcatcttctgctcctgtaatttcagagcaattgctttgctcccctctggagctatttctactcaacatttgctgttctatgtgttacccattcacctgtacagagataagagcaggccccataaaatgaaatgcatgcagtttttctctgttcatttccatcacacggctaaataagactcttaatacaaaagtgattcgaaaaattttcactagttacttcttaaatgcctggatcagaggcaaaatatttatgatgactaaagcagagtaacaaaaaagaaaataattgaaaaacttcaaaccacccatagcttccttcagtatataaggaaacatgttgggaatattggtgtttggaagaaatccattcctctcttccagtaatggagctggcataccgtgtttctaagtgttcctactacgtgcacttgagtatgtgccctctgaggaaaacaagcacacagaagagagagagaagaaaagtttgagtcttttgtctctggacctcgctccagcctcccacgcagtcttctttcagccattccctcctcacgtcctcccgtcctcctgcctccttgcattgctttttaaaattctttattatttttctcacttgattcttcagataagtctcccaagttatcttccttcctcccactttaaagaaagtctcagcttccatgaaaagggtcatttctctatctttagagtatttcagagcaaaaacagaggggccttcccttccaagggaggagtgcagactcctgcttccaccaccatgtctgtttcatgcttctggggaaactccaggattttctgttttcctttttttaaaagagaaaaatgtgtgcgcaatataggtggaaaagtatttttgcacaaacctacataggtattaaccactatttttgtttttttcttaatatttaattagaactggccatgaataacttgtaaaatatactaaagccttaagtttgcatttctttattactgggaaaggtgtttactgagcgggatttacctctatttatgtgaactacatttataattgaattgccccttccccctagatgcatgagagatttacttaattagcattgattccttgcctcaaaggactgagaattccaaccagagcttaggtgtataaggtagtataaaagcaatgttgttgtgtttctagtttggctaataaattggctttagagaaatgcatcttttcatgacacttgggaataaagcttgtgatttgctgatgttggacaaggttgaagtttcacttttgttaaatttttgtccccagcataagattaaacacctcctcagatcaagggaattttcctccctcagccttataaagttgttagaggacttagaaagaatattatgaaatacaatttgaaggtgaaaggagaaataagcgagcctcaggtctgaaaactggatagattatgcaattactttagtttgcctatagaaaattttagtggagagtatttttttcacctaatattagggtagcagagagatgctgaggtgactgatatttcaaggagaaaagcgcttaatgattataaatgcatagctagaaatagagtttacacaaccttagccatacagattaatctaacagatcttctctaatgctaatacaagaaagtatcatcggatctctttaaaaatttctgctaaaacattttttttttcttattcaggtgacaattgactctgtttatgtagaacaggctaggtccccttaactctcagatattccccagtaatccaaggatgggaattatatctttgcccatatcttcacccaatgccagtgagatttaagaacaacttcagatcctgaatactgatcaaactcatcaacttagagtcgaggcataaaaataaaacacctttcaaagagagtgtggttcacgtttggtgtttattaaagggtatgagagagtcctagctaggattctcagaggaaaaaggacactgaaaggaaggttttactctttgagtcatttgtgattttatttgttttttgcagtggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgtacgtatggcatgtttttatttcccgggctctgtcacaggaggcttagcgtacagaatggtgaagtgtaattagcattacaacagggccctggaagctgtggacctaatgctcttcctgtgataaatcatttttgcatttatgacttgaaaaatattttgataagctaggagttaagagccagaatgtagattgctctcagattagaaaacaaacaaaaccctgagacactcattttgcaaatagtggaatgagtcgacatatagcctttggttctttccctttctcgcccatggattttggaattcttccatgcacttcaggggtggcttcctctcactggcggccatggctgtgctcctggagatactggcacacctgtctccagatcagaatggtcttagctgatacttaggacacttttgcagaagattatgaattgataggccaaacaaaatgaaaacaagcccttaatacagcaaacttagcttctcaaactgagaacatttttcgttttcttttgttttttaataagattttatgaagtttcagtttggcgcctccattcatcactctctcttagagaacaattgtttgttttggattgcacacaagggagatatccccagttctgatttttttttttcttgagcttaatgaagacaattgaagaagggagcagaaggaattggtcttaattttgcctaaattcttcttagatctcaaaattattacatgcctcatttcaccaatcaagaacatactcccatttggaaatctgggaaggttttctgaaaagagttgcaaaacaactgttttgccttttacctttgttgtagacttctactaccttttgaactaaaatttatacctttttttctttcttattttgataaggtattgctttttaaaatttcaggaccacctgactattacattcatcatagtcatctaccaagtccttgaacatgtcggatttcaattgtgaactacgttcacattagttttgataagagtttgtattcaggtttcccctcaaatatattttggcactgttttctttgcagatgacatgtgaatgcattctgaatgtataacttccttctacctgactgaaaagtatttggtgacaattttaactccttgaagacctgagttgctgtataaagtggatttgttaaattttgatctaccttttcttaagagggagaaagataagaaaattttccagtgataggaatttgtttagtccattagtgcccaggatttctttttgactgagggatttaataaattttagtagctggaagttgagcatattgttcaccgaaaataaccgccattgggacctatcctttgtgattttgaagtgctaataggcgaattattctgaaatattttctcctttttctttttaccaatatctaagggccagtagctttccgtaataaaataagaagccaaaaaactattgaaagacactttttaactttaattttaggtttcggggtattatgtgaaggtctgttacataggtaaactcacgtcacgggggtttgttgtacagattatttcatcactcaggtattaacccatttatgcctagtgttccattattggaacactaagcttgtgggaattattcctatcctactgctcaaggtcatcgccaaggtctgattttcacaaaaagtaatatgcagcctccagcataaatgggttaagcgcagtacccaacagttgtcttttctgctcctctccctccttccaccctccaccctcaagaccccagtatctgttgttcccttgtgttcgtgagctctcatcatttagcttccacttagaagtgagaacatgcagtatttacttttctgtttctgcattagtttgctaaggataatagtctccagctaatccgtgttcaaaagacatgatctcattcttttttatagctgcatggtattccatagtgtatatgtaccatatttctcattgatgggcattcatattgattccatgtcttgaaagacattttctacaaaatggaaaacttttcattcttatttttcctttttttcccccatggataaaattagcttattaataaatttgttatgtgaaatgctttatttcagttttctatatgcaaatatagaaaatgctatgcaaataaaagcaatctatattaaaacactgatatagcaacaggttatttataaatttattttttagatcatatatttgaatgttgtttaatagagtatgatatttttcttacggagataaacatttatattctatattatgtgttatgtggcctgaagtaattaattttctttcaataaggggcaatctgatgaagatctgagcatttaagagggctgagcagttagttgctggtaatttttttggcttccatgaccaaagtaggtaatttgctttagtaaccaaagtagattggtgaagattagtaattcttctgcttaccaacttaaaccaaggtggctttccataggtgaatagaatttttttttcttaatttatgtagaacttttgcagttcaaataagggtttttaggaattgaaacttggtaaacattcagtggtcaagttggttgaatttccattgcattgtaggtcatcagtcaaagagataatgaatttggaaaagttcaaaacaatcttaataaaacagtggtcaatagagttcacacatcattgagcactttactcctttatttttccttttcaaggctttattcttaactagaagtgtttaccctctaggaaagggtcagtaattgttttctgctttgattcttcataataggggacgaacagggaggatccgtgtcctgtcttttaaaactggcatcatttccctgtgtaaagcacatttggaagacaagtacagatgtaagtcgtgtatattaatgctgtattcttttattaatgttggctaattaccctagttctagatgggaaatgacagactgttcttatttgacagcagattcctcatgtaagatgtagaactgcttttagagtgtcataaaatttggtttgtgccattccttgtcaaacattaaattgcaggcatttaagtagagaatgaggattagcttttccagtccaggtattattttacattacattgactgtgtctgaataaaacacatgttcctaggggataaagtctgattttctaacctctttctgtaagtcggaaaaataagtgtgaagatttaatctctgcacttgtctagtctttgggttcttatttaaagaataccatgtgacattcatgttcaagaaacattgtttattttataatcatcttactgcaagttgtactgacacatccaattccgtgacgtgactaacattttattatttgagagacagatagcttgctgtttcttaaaggatagatacgtaccaccctacagaatttccttttgattacgcattgggttcttctgcttaaaaactgtaaaaccaaattaaaagccaatgctagaggagtgatggttcagatgaccaagtgaccatccattcatattgtgaaaggctgcagttggttttccccttgaaatgcttataagcaatcttttcagtaggaatattaaacaaattcagcctagcttgtcttttctctcttcccctgaggcctagccacacatgtgaggagatgtgctaagcttcaggacaggcaggagataaaagccactctgtctcctactgatcatttctccttcaggagtaagccacaaaatacacaaaccattttggccctcacttttatgtagtttccacttgagttttctcatcctcagaacgagagaaaaataactgaacagcttttgttaaccattttaaaatgtatttcggatgagatgggatacctgtgtgcttttctcctttaaatattgtagttacttagtataggttaggttctaatctaccgtatatatggtatagtgacagcacattgtaaatataatattaaattgaataattgaggaagctttgagttggtgtttcgaataactactaagagggaacatgtttttaggttggtgaaacaaaaatattaaatgcaaaatgagatgtttgaaagtaactcataactttgaaaataaacacctaggtatgtatatcggagagcagataaaaagctgtgcgtacaatctcaatttttagtgccatcttaggtatcctgttaaaacatttaatttcctagagtttaaagtgtgcttatgggtacagaaagctttcttggatttactttttttgaggggcaacttctaggtgaatataaggtatgattaaaattttatatctgagaacaaaacataacattgcaagcattcagtatgttcattcattctgttacatatattgggcacctactatccaccgggtactgccattctactgtagatacttctggcacacaactgaccaagatatggttccttccctcaaggggatataagtctcctgccaaaaacgatagacacatattgaatcaatgccagcataacatgatgtgagctattaattagaaatacgcagccaggcgcagtagctcacacctgtaatcccagcacttagggaggccgaggtaggaggatcacttgaggtcaggagttcaagaccagcctggccatcatggtgaaacacgtctccagtaaaaatacaaaaattagctgggtgtgatggcatgtgcctgtaatcgcagctactcaggcggctgaggcaggagaatggcttgaacccgggaggcagaggttgcggtgagcagagatcgcaccactgcactgcagcctgggcgacagagcaagactccgtctcaaaaaacaacaacaacaacaacaaactatgcacagtatcctgtgggaacacatacatgatggactagaagctcagtgatcttatgactccataaagaagtcccaactgtggtacatttttgaatctctggtgtccaaggagggtggtgctttgggccagttatatgtctcttaatgctaaaacacttattttttgatgtagttacatcctatatacaataattcccaaggattatgttctggcttagaagaaatttaagtgtcgagggtacgtgtaagcttgcgcttcttgcagtgacacagtttatgtaaaagttatcacacttcatatatatacagtgatcattaacttgattcataaaaataataaatatccagattagcacaaattagaagtaaccccactctgtggaaatactggctactcttgagaattgctactggaattgagttggatgtcaggttctgctggcatccatgggtgctgtgttttgactgttgcaattttcttcttcctttgtagaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgtaagttattcaccttctaggtaacatatttattctttcatattttagaaattaattaaaaaacccacagagcttcgttttctcatattagctcttcagtaggcagtaggtatgggatttgggatatttggaacctctgtaagtaagcagcttctggaactctaggttttgggaaagaagacagtgctgaggaaggaaaagaaatctccatctgcagcagggaccccacagttattgaggtgctagaggggaagaagttcagcaagggaggaaataagtctctagccacagaaatcctatgtatataagaaaatggcctttgtaggcgagtctcttagtctctgagtcctttctctaattctatcattatagcctcctttcaatggctgttggtaaattgttagcacagctgtccttttttttaaaactgtcctttgtagctttgacattcccctattattccaaagtctagaggtgtatactctctgctaatgtccatcactgactgaacacactcttgtccgttctctttcctatcctgtcccattgctttttctctgtcgtagtcagtgccccagaaacaccctcttcttcccaaatgcctgagcactccactggtagacattcatcttgttctaatttttttttctctttccttttttttttttttttcttttttgagttgcagtctcgctctgtcacccaggctggagtgcagtggtgagatctctgctcactgcaacctccacctcccgggttcaagtgattctgctacctcagcctcccgagtagctgggattacaggcgcccaccgccaccccaagctaatttttgtatttttagtagagacagggtttcaccaggttggccaggctggtctcaaactcctgacctcaggtgatccacctgcctcgaactcccaaagtgctcggattacaggcgtaagccaccgtgcctggcctctaatttttattaggtagatagtgctacaatgaacatccttatcgtttagcttttgtctttgaagctttctttataggatcaattctcaggcgtgtgattgccagacaaaataatataaacattttttgtggcctttcttcaaaagttgttctaattgtaacgctatcagtattgaaggagtaagatgctttcggtatcacattattcacagtgttcttatgtttttgtttttggttttttcaagtgctaagagctgtttttcttatgtagggtttctcaatccattctaattctattaacaatggctgagatttacaaaatggaactagctgtagaactaactgggttatatctgaagtctttgaccacagactaggatgaaactatagaaggtttcctgggcagatcactgtgaatatttaggtgtttaaagcagtttgagtatttatttaatagttagttggatagatttaccggatgcacacataataagttcatttatgtaaagtgggatatactgtttgaattattttgccaaaattatggcaaattagttgtaaatgtaaaatgcatgtggagaaataaatatcttttcctcctcatacccaaaccttccaaaatgcagatagatgatcaatccaatcaatcatcaaaatgtagacacaagtaacttccatacaatgaatattaatggccacaggcaatctaggttcattttgattttttaaaatccaattataaaacaacttgccataaacgcgagttatttcctaatcttttggttgtgtgttttttttgttttgttttgttttgagatggagtctccctctgtcgcccaggctggagtgcaatggcgcgatctcggctcactgcaacctccgcctccctggttcaagcaattgtcatgcctcagcctcccgagtagctgggattacagggtgcctgccaccatgcctggctaattttttgtggagacagggtttcaccatgttggccaggctgagctcaaactcctgatctcaagcaatccacctgcctcggcctcccaaagtgctgggattacaggtcctaatcatttttcccctttagtcaagtctcagttactctttgagttctagtgaaacacacacacgtgttcatatatagggatatataaacatatgtgtgtgcattgtgacttgggttaaaggtaaggctcagtgatggtccctgctgcaaagtaaactaggctgtattcagggccagctggattctttgttttctcgcccgagtactgactcatcaggaagccaccaccatcctcactgcagcctctggccctcttggatttggttgtcaggataagcggtggccatacagaagctctgctttccctgggctgccccccttatcaggagaccaacctattccatttctgcctgctacatccttttgctggataacctcctactcccctaagcccatgtctctggtttggttacatttctgtctctgtaataacaactctgtattctcagtctcaaagctttgaattcagtccatccttgcatatttgttgaatgcctcctggttggccagccagtctccaagctctttgaaatgtgaaatgtgttttgttttgttttcagaaggggtctaacttcgtcacccaggctggagtgcagtggcacgatcacagctcattgcagcctcgacctctgggctcaagtgatcctcccacctcagcctcctgagtagctgggactacaggcatggaccgccacgcctggcatttttttggtgtatgtgtgtgtgtgtgcgtgtgtgtgtgtgtgtgtgtgtgtgtgtgtgtgtgtgtgtacagggtctctcgccatgttgcctaggctggtctcgagctcttgggctcaagctgtccacccacctcagcctcccaaaatgttgggagtacaggcgtgagccacggcatccagccttgaaatgttttctatgagactggggggaaatcagtcaagatatgaatggtggtaacaggtggcttttgattttctctgtactatttttattttctgagttttcttctttgaacatttataattagaaaaaaaattagtaaagtgctgcctctttttttagggaaagaaacatgttttgtttgattgctttccattgccattcttacattgtttccaggccttctcatcattgcactggcttcctagcaagcctccacttcacactccagtccttttcattggtcttattgccctcatactagttttagagaaaagcatttcccatatgatgccgtccttgaaaatgtcagtatctttctgttgtctagtgaacaaatcctaattcctctatttaactctcagacctttcctactctggtttcataaccacccatagtttgctttcactatcatgaaacagcttctccttaccatttgtacctattatgcttataaataatattgttaccattgctactaacaaaactttgttcacatgaattctctcatttaatcctcaccaagtctttgaggggaacagaatagtcaggctttggagattttgcttttattattgtttaagtggatgaataatttatttgcgcccttaaagtccctcagctggtggaagggtttgattcctagtccagtatgcccaccgccacatttactacctcattcccaaatatgtagtttctgatacttctgctctccagcttcccaaggccaaacaacagctacttttcctgagtcctggatagaataagaaaaggtataacaagacaggggacccttgagggggaagaggaattagtttgaagtgctggcaaatgtagtatttctaatcagatgctagtaaattccatatgtatggcgaggctttcattacttagatttggggagcctctcagcgttttagcaatttgcaatcaggttgaatggatccattgtaaatacttaggaatacttaggaatccacgtcctggccctggcatgcttttcctcggccaggtgcactggcggtcaccttgcctttcattgtgccacgtgcataaaaatacaatgtttgctgtagggaaagataacaggagtgaaaatgtcctctgccctttgtttgaagtataggaccttcagaatgaggctgggctggttccttcagcaagcttgtgctcaaaggctgctatttctaccagcctgaggtaaacggtaataaagtacttgtttatcctacaagtgcattccttgcattgcagatttgatttcctttgatttcttgtcaccacctggaaaccttactttgtttcaggttggtacagttagaaaggtactgaatcttctgattcagacaagggcccagtagtggcaagaagagaggtacgtgtttgtgtgccacactctctggattatctattaaaggttttctcatatccctccccactaaccacttagaaaaggaaatcacctatcaggtctaaatgtaaaattttgcttatttaaaaatcactataggtcttccaaggaattatccattaagccaggaaatgaagtcacatccatggatatgaaaaaggaatagtcactgtaaatttatggctttgacagtggtatcttcgtagatactaaatgaggcaacaggatatgtttccacattaatagcatattgcagtcaacacatttactgggaaattgactcattttggtagtgatagaagtaaagttttgcaacgagtttaagagatacagctgtaattaatatattgccagcttgttcctttctcatattccatggaaacagccctgttgagagattagattgatttttacgaccttagtaaggccaagcctgccctggcagtgagtcacatagactgcctgaaggaaccttgaggattttctgcacctctcctttttcagatgagaaaacaggcccacagtggcacaatgaatctagtctacatcgtgcaatttacatcatgttatggcttcaaccagttcggagactagattgaaatgacagagtgttaatgtgtcaatgtgatcccctatatgaattttagattgtaatagaatgagatagataaataaacacccctcccccaaaacacatacatgcacacacacccatctttattgaaaatactctaatcccaacatagctgtttagtctatcttcagataaaaccaagtatcacttttaggtgggaaaactatacagtcatgtgctgaagaatgacgttttggtcaatgacaggccatatatactatggtggtcccataagatcaacgtaagaagagattataatggaactgaaaaattcgcattactttgtgacactgtagccattgtaacatcatagcacgaagaattatttcacaaacctgcactgccagtcatttaacaggtaaaaaagtatgttttaaaatatttttaattattatggacacataatagtactcatttatgggttacatgtgatattttgatacaagcatacaatgtgtagggtaacacaatcagagtaattggggtgtccatcatctcaaacattcatcatttctctggtaggaacattcccatttcactcttttagttattttgaaatatacaataaattattgttgccatgcatggtagcacgcacctgtaggaccagcgtttcaggaggctgaggtgggaggatcacttgcgcccaggaattcaaggctgtaatgcacaacaattgcacctgtgaatagtcactacactccaacatggacagcatagtgagaccctatctgtaaaaagatttaaaaatatattgattactatagtggccttattgtgctaccaaacactagatcatatttcttcttactgtatttttgtacccattaaccatcccttttttatcccccgatcttcactacatttcccagactctggtagtcatgattttactctatctccatgagttcaatttttttttttttttttttttttagctcccacacatgagtgagaacatgggatacttgtctttctgtgtgtggctgatctcaacataacgtcttccggttccgtacatgttgctgcaaataatgggatttcattttttatggctgaataatattccattatgtgtttatagtacattttctttatgcattcatccactgatgggcgcttaggttgattctatatcttggctattgtgaacaatgctgcagtcaacatgggagtgcagatatctttttgtggtttcgattttgtagtatcttcttcagtaaacattttaaggactttattgtttagataacgtcaagtataccaactttatattcaatatgcttcacctatgagagctggagtgtcaaaatctgtttattttacatctgttttctgcctcctgttgtacttagtattccaaatgagtaagttgcttttccatctatcttctgaatttctctatttgtatgacaaaaatgaataccatctatgcacagttgttgtaataatgtagaatgatatgaaaatgagaataaattacagtctcaactgttgagaacaagtatttctctgtgttagaaacattcccaattctactcttttagttattttgaaatatacaatgtattattgttgccatgcatggtggcatgcccctgtagtcccagctactcaggagactgaggtgggaggatcagtaacacataaatgagaaagcattccagaatatctggagaagtgactggcagagtggttaagtgcataggctttgaaaccgaactgtgcctgagtccaaatctgagctctgctatttgctggctgtgtgactgtggacacatttcttaaccttcctggcccctgaactcctggaggtgattgtgaggattaaatgaaccaatagaagcaaagcacttaagagctgtagtggatacatagaaggtgcccagtgaatgttagctatgattatctaaagtgtgttgtggcatgaaaatatcctgccaatgttaacagttgcttttatctataacaaaacatcatctgtggattgcattttagagattctggagattctgtttctctgcaaatgttaaaatgccatatcaggagacttttggctggttagacagcattccccgggtcaactgattacttttttttttttttttttttttttttttttttttttttttttttttttgagacagagtctcgctctgttgccaggctggagtccagtggtgccatctcggcacactgcaacctccacctcccaggttcaagtgattctcctgcctcagcctcccaagtagctgggactacaggcacgtgccaccacgcccagctaatttttgtatttttaatagagaaggtttcaccatgttggccaggatggtctcaatctcttgaccttgtgatccgcccacctcagcctcccaaagtgctgggattacaggcatgagccatcacacctggccgattccattttattaatagattttccatcctgaaagtaactcctaaaaaccctccttcacttaggtttcctttggctttttgtgtattaatcagactgtgggccctttggttccatagacattccttttacaccccttttggacggatgaatactcactagtaactaagtaattagtaagagttactacaatttggtatttataaagaggtggcctttcccagaattgaaggtagaccctaatagtccaatcagccttccatagagatagctggctgccatgaaaagctgagagatatcaccgacctcttactgggcctgctcatgaacagttagttaaaattcctgcaattttcagaaaagacccttatcagagtattatcagtattgtcttaagtttaatattggtttccagttgttatttttaaaaattttaagctaccgtgggttaagctttatgatgatctgtttaagtggtttgtttgattaacttctctattggagtaatggatgttttcttcaccagaattttgaagataggtttgtgttgtagttgaaacctgttttgtttatacacttactgctaaggaaaagcacatgtcattttgttttccatcttcatccttctaaagtagcacttcattgttatgaccaaatctttctttcttccttccttcctctcaccctgtcttttccttccttccttcctgccctccctcccgcctctcttcctttcctctcctctcctttcctttctttctttcttttctcttttctttcgttctctctctctccctccctccctctctctgtccccttctccttccctccttccttcctttcttccttccatttctatcacccctaaaattccatcatgctgtatcatctcactaagtcccaatctctggaaaccacagctctgttttctgttcctgtaattttgccttttcctgaactggattttaaaggattgtaggaggcagtagtggaagagctaactttatatcttgttcttttacataatgcgccctgatccacacttgggaaagtatattccatggtacctatagacagatatatgtgctttaccatgtatatgtgaaacttttctaatttaactttcctgttaaattagaactcggtagcataaattaatactgttgagtatacttagggatttgcatagatttaaaattgtgcatatgttccctagggccatggcgttaattggtttattagtcaggtggagtgcagagcctgaggtcaggacagttgtccttgaacatggaaatgaagagtggataatcaccatgtgttattgtttgggctgattttatctttaatgggtgattcagagtcctgattaatatttagagcagtgactgctggcctcctacctgctcattatcttcagaactttaaataaaatacttgatttctacccaagatggtagttatgggaagccttttacttcttcttgtctcacaaagacaactcttgacctctcaatccttaaacaaaaagttctgcttctgcgcatgtggggactcttaaactcattttcatgcctggagattcacatttagggatctaggaaaagcacatctaggcagagtcgatgaggagatgctttaagaaccgtgacaaggacaggaaggaaatcaattttgcgttaggtttgtatttttagagaaaacgaatcctggggaacttttcacactcattactattgacattaataccattgtcctgtccctttcacagttactaaaatcactcttgcccaccctcctgccttgcccacaacctattcccatgaaggggtgacttgggagaaataacggtttccaaccaacgttttattttggaaacatttcaagcacaaagagtagttgaaaggatagtctaaagaacactcatctgtgtcatacatctgttcaatccatggttgcttttcgctctacttacctcctccaccctctcagctctgtttatgtatgtgtctgtctgtgtacatacacacacaaacacattttcccctatgccatttaaaagtaaaggagcatcacaacataaacccctaaacacttcaccatacaccattttcttaaaggatgacattctctaacataactgcaatgctatcgttacacacaaatttaacagcaatccagcaataccctctgatatgcagtccacactgaactttccccagtgccccagaattgttccttatagccactgttttcttccagcatctagtcaaggtttttgtctgtcatgtctctgtaccttcatttagttttgaacagtctcccagcattttgttttcctttcatgacattgacttttttggtagggggacagagtctcgctctgtcacccaggctggagtgcagtggcgcaatctcggctcactgcaacctctgcttcccgagttcatgtgactctccacctcagcctcaggagtagctgggattacaggcatgcaccaccacacccggctgatttttgtatttttagtagagacagggtttcaccacgttggccaggctggtcttgaactcctgacctcaggtgatccacctgcctcggcctcccaaagtactggaattacaggtatcagccaccacgccgggctgacgttgacatttttgaagagttcagaccagttctcttgaagaatgtcccatactctgggcttttctgatggtttccttgtgattagattaatgttaacattttttggccaaaagacgataagatgatgctctgtacctaccactgtatcacaatctggaggaacaaaataacattttgttcctattggtatcactaagaatgttaaggtggtgtctacaagatactttccttgtaaaatatccttttccctttgtaatgagaaagtaattttttgatattttgacatattataatatccattccttaaccttttaccctatggttttagcatttatggatgatccttgtctaattcagttataatattggtggttgcataatggtggctttctaattctaccatactttctgcatgtattagaccattttcttatgtaaagaagagcttctacctctcccccgtctattcatgaatatcactgtggacatccaaggtggttctgagtgtacaaagaatgatatctctctttactgaactgccattggatactatttttgtcttggaattgtttaaaatggcagtgtatggaattgaaagtcctttctccagagagccacataaacagatgtctaataaatacatttccatattaaccaatccttttatgggaacaacacattgacataattaaaacacgtaacatgaaaactgtgctgaattgagaagctcatagagttttgtttcttttttttcctttttgccacttcaatatatatggacccgcacctgtcagtccaggtagctcatacatgccgtagcatctaatggtacgagggacatgtaatgctgaaaagaagggggaaaggagttgatcagatgagatataagtatgcatttatcagtgttgtggggtattcacttgcaccttccattggctctcgcagccatgttatcggcatataattcagttgaagatttatattcacctggaaattgtcctaagtgggccttgcttacttagctatcagactctagtactttcaaacaaattaaagattcaaaagattttggggatcgccttgctttttcccataggaaatcacttttgtcctgtctttttaagactattttaagcatatatttcagtattaaaatcgtagataatcttaagctgtttccttaacctctttgggccttttcttatctgtaacataaagttaaaacaggttatctcaaaagttacttatccctaagtgtctttgattctatgctaaatgttataaaggccgaaagggaaatggattattgtacttatttcaaagcttggccatgatcagcaaagtcttacctgatcttccgggtaacaactcttgtatcagagctataagatatagaaaacagtcttgtacatagagtgtggcatttcacatgagaccaagtgttctctgaatggaaacacacactaagagcaagatgtgaaaaaccattgtgtacaacctcatgtaaatgatcccttgcgtccgtacactatagtttcctcagtaactcaaaggtaaaacccaagtatcttgtgtctaagaggatcaaaatgtcaccttccttctgttttatttgttacatgcaggttttgtatagttttatagagtctttttatcactcatttgattttcataaaaattgggattgtttggaagaagagtcattaatattctttacagcttgttcttgttcctccttttatgttctctgctggtgcagacttctctcttatgtaaaatattccactgatgcccttggtagatttagaggttgttaaagaaattgtaataacagatcagggaacagtcagggactgcctgtcctatactgtctgaccctgactaaccgttctccttgtagttttaaatctttgtgtacagactgtaattcaaaaaacagtttttataaatttaaattcagcaaatctttccaaatgctaaggctttttataacgagggctagaaaagttgagttgtcagctattaatgccaatacctattaacaatggcaatgacattgaaatgattttttggatttatgaagggaacatgttactaatgaaaatagcaaatgaaaatggccactgtattagtccgttttcacgctgctgataaagacatacctgagatggggcaatttacaaaagagagagggtcattggacttaacagttccacgtggctggggaggcctcacaatcatggcagaaggcaaggaggagcaagtcacaacttacctggatggcagcaggcaaaaaaagagcttgtgcagagaaactcccgtttttaaaaccatcagatagtgtgagactcattcactatcacgagaacggcgcaggaaagaccaacccccataagtcaatcacctcccaccaggctcctcccacgacatgtgggaattgtgggagttataattcaagatgagatttgggtggggacacagccaaaccatatcagccacaaaggagagattaccctttttaaaaatctgtggtttgcccacaatgttttccataaatttacctttttctgtcaataaaaatgtttaggaattctatttatggatatgtatgtatttaatatttgcatatttagttcttattttttctctaaatggttatgacctgtactaagtaaaatcaaaacacacacacacacacacacacatacacattgtactagcagacctgctttaccttgcttgggataattatctgccatgattaaataaataaatttctgcaactgtttatcctggaatacactgcatagagttgtcagtttgagaagcaacttgatttcaaatctgagtctacaattttagcgtgtttccttgtgacttctagtttggggcttttaatttcccttttgctctctctaccctcagtttatgaacgagtgtggcatttcggcagttgaataggcctatggtagcctcccagtttctgtgttgtagaggatagttgccggcttattaaatgcccttgcaggactctcagggaagtctgttgtttagtgaatagtgatgaatcaatgtggatttcttagttttgacaagtgaaccatatggttatgtaagatgttaacattggggcagggtttctcaaccttggtgctactgatgctttggcccgaatcattctagttctttgttgtgggaagctgccctgtgtgctgctggatgttttgcagaatcctggcctctatctactaaatgctagtagcaccccctccccgccctccccctcccccccccccccccccccccgcccagttgtgacaaccaaaaatgtctcccgtaaaagataccaggatgaaatcactttttgtcagtcccaaactaactagagccagggcagcatgaaaggaggagggttcatggttacatgcctgagataaagactgtctcaaggactttctaaaatcgccccacaagaaattcctctgttaggactgcagcagtgcacgtaatatgctctcaaaagaacatctgcccagtaatggcatccccactaataaactgacaccagttctggcgttgagcatctgaaacgaactatgtttccaagcagcttatgtaaacttctgtttttaccaataaaagtttccctctacagtctcctcttcagatgcatcttgggttgtaatcctcatttctaattccaaaataaatttaacatatttggcgatgtttttctctgatgttttttggtcgacactccaaacattgttatatttcctctggggtacggcatcatttccggttgagaaccaccgacctagagaaaagctatctgcctgtgcagttcctttcaagggccccaagtgtgaattttgtgtatacctatattttaagccagatcattctgtacataccttctaagtccagatgaagtctgttagccttttatgtgtgataccatcacatagaaaccaacacaaggacatttactgtaatcgataaaggaaattttggacagtttgagaaagtaacttattttgtcttctgctctttataaaatctttacaagtgtatgtttttgctcttcaggatgactaggcagctttttaaaattctgacttcatacagattttataatcttccttttatttcttgcgatcatattgcagttgaattcccacccactgttcaattcagcagattttaacagagactccagaagtatagttcctgtctttaattaatctgcaatttaggaaagaaattaaggaggtatcgttctgtattgtttccaggatggtggtttcttgttatctgagaattactgggcacagtctcttgcccaatgtttacttctctatatagagttgacccttgaaaaacatagatttgaactgtgtgggtccacttataagtggatcgttttcaaccaaatgcgtatcgaaaatgcagtactcaagagatgtgaaacctgcggatatgcgttcagctgggcctactgtgggacttgcgtatgcgtggattttgctgtatctcaacagcaaaatccccgtgggagtggggctgcggcgggccaggaagcaacccctagcatatactgagggatgactgtactaattattgtagtttattaagtgttcacatggttttcacaaacctcacaattgaaatgccaattgccttctcctaaaaaatacaatgtacgtgttcatggtagctgggatgcagggcttgctgagaaatacttaattgcatttcttctgtagccatgaattgattttattaccttgagagaaaaatgagtattcaggtggacctcctggcaggcggttggcccttcagtgtccaaggatttatagaaagcacaacatcaaagaaatccaaaagttcttcggaaccccagcaactctcctacctccaaacttgccatgtaatgcccttttaaacttattatattgataggtaaatcggtttgctagaaattccagatattgagaattctttgtctgtgtaccttgttatatttgtataaaggtgatatttgtatgaagccaccctccagtgtgctgtaacagagcaatagtaatgacaactgattccttcccctagcttttctgttatggatagttgctggcaggtgaggaccaacagaaaaagaggagaaacccaacataattccaaactgtgaccatcataatggaaggagctgtgatagctttgctttctgtgtgtgcatgacatagaaggggaaaatggagttattgccaaaacaacagcaaaagcaaaacaaagccaacaaacaaaacaaaacccagggctaaatgacctttccaagagattttgcttgcatggcttgaaactggtgtttagagatgaggacaaggtcacccttgatactgagaggggattatatctgagacttatatgtatctcaacaaataatggtacttacaaagattatctcagtccagtgaatgccatcatacttatcttttgaccttaataacttcctgctattccaatctatccctatatatttttttctggaatgatcgaaatgtaattttagctgggtttaattctagttctgttaggtctttacagaagcttgcctggcttttaattctttccttcttcattgccagacaaaaggagagggaatataccactaggatacagagtagtttgtcataaaaatgaaagattgaaacagaatgagaacgtgaatccccgtaccttgtcttcagtctgtcagttggcgtaggtgagcagttttaaaagagccaacatgatggatcttgcatcttaggggctagaaatttgagaatgttcaacctttaagcatagaagaatctatagttttttgaaagagtagaacattctacagcctcccttggtaattcacactaatgctttaacaactttcagcatcaggaaattcttccatatgagctacagcctaaattcttcatgctgcttaagtctgtttcttcttgttctgtcctcagtggagagatcgaacagctggtcacaggcccctatgcgagagccattcacataattgaaaactgttattaaatcgccccttcagaagtcactcttgcttgttctctctctctctctctctctctctctctctctctctctctctctctctctctctctctctctctctctctgagaatctgggaagattccagagctgattaacatgttgctttactgatgaccttctcagcttttaatatgttaacgtgctctaagaattttaagaggcagatataatgtgcactgtttctttcattaatttgaccttctcgtgaagcattttgctggacgattgatctgctggacatactgggaaacactgactcagagattttagttgagtaggaaccgtgtgtgagcctacggtacagaacaaaagaaagtaatccagttacactgtctggagaaatagaggtacattctccgcaatcatatttgaagaatagttttctaaatgacaatggcaaactaagccgtgtcatatgaagaagaagtaaaaagaataggaatgaagaggcatggacagataagacagctctggtaaaatatttaaagggctgttcaaagaccaagaacttctgggttgctggtcagatggataataataatgacaataacaatagcaaacatgattcttgctatgtgtcagacacggttccaattgcctttcatttgctgactcacgtaatcataaaataactctatgaggtaggcactattaatatttccagtttgtagcagagaaaaagtaagacacagagagataaagttattttcctaaggtcacacagccagtgagtggtgaactccagtggtttaactctggaacttctatatgctgtgctgatggatttcagctcaatgtgatgcagcacttttgacaggggtatctggacacaggtgttcaggatcaccttctaaggatgtttcccagctctctcacatgggtggtgtagtggctgtaagcacacactggcatgggtaagagtttggactcgatgaatgctgagtttggactcagtgaatcctgaaagtcttacagctctgtggtgccatgccaaaaggatgaatggacttgcatgatctttttcatttttagattgcataattctttataaacttttttttccacaaagtacctctgtgatggaactctacacagagaaaagtgctcagcaacagctttttaaaatttaacttgtaagttcaggggtacctgtctaggtttcttatgaggtaaacttgtgtcatgggggtttgttgtacagattattttgtcacccaagtattaagcctaatacccattagttattttcctgatcttctccctcctcccaccctccatcctctgataagccacagtgtgtgtttttcccctctatctgcccatgtgttctcatcatttaactcccacttataagtgaaaacatgcaatacttggttttctgttcctgcattagtttgctaaggataatggcctccagctccatccatgttcctgcaaagaacatgatctcattcttttttctggctccggagtattccagggtgtatatgtaccacgttttctttattcagtcttccattggtgggcatttagattgattctaggtctttggtaaacagtagcatttgatcggaagtttgaactgataccattttgcagctaggaaatccaaagttaaacagtttattatagtgttgctaaatttagaattaggggtaatgactggagtgctgttgaggtgatcagtgttataagccaaatgacctgtcagtctaaaccctcctgcctttctatctgaaatgtggatatgtcctttattaggaaaccacattacaagagaagcaacttggctttgcagctcaaatacccatgacttgtgtgatactaagtattcccatgtcatatattcaactgaaattggctgtggaataagtaatgcttcttggttcttggcaaaagcaaaggagaatcatctctggagaaagcacttttattctaggctcaagcttttatttatctctagaaaatattggtaaggtcagtttagtacgtggtaaaaaaaaaaaacaaaaaacatattaagcacacaagaaatcaaggtggaaaaagaaagaaatcaaggtgaatgagaaccagaagaaatagcaaaccatagaagcagacctacgataacatcatattccagaattattagacagattattttcttaattgtgtttatgcagttagaaaaataaaaaacaacattgaaaaatatctacagggaaccacaaacctgagaagttaccttaaaaatgaccaagtagtatttctagatgtcaaaagtacaataatcaaaatttaaaactgtatgggtttacagcagaccggcaagagaaatggatacccagacagtaaggcagaaggaattaataagaatgaagcacagaaggatgttttaaaaagatgtggggcagagaggggggaactagggaagtcctgttcagagaaatatagattgaagaagagtaacatttatgtaacagagttctgaaagtagaatggagagggaatggagaagaggcactatttgttgagagaatgacggagaagattccacagctgattaaagactctaaatcacaggtttaagaagtccagtgaatcctaagcagtctaaatcaaatcctagaaacagcacaagatagaaaacagatagattatctttattttttttattttatttttattatactttaagttttagggtacatgtgcacaatgtgcaggttagttacatatgtatacatgtgccatgctggtgtgctgcacccactaactcgtcatctagcattaggtatatctcctaatgctatccctcccccctccccccaccccacaacagtccccagagtgtgatgttccccttcctatgtccatgtgttctcattgttccattcccacctatgagtgagaacatgcggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcaaaggagcaacagtcatctttactattgacttctcagcagcaacagagatagacgaaagtggagtaatatttcagtattcaaaaacaaaataaaaacaagaccccaaaacctttcaatcaaaaattttatacttgggccaggcgcagtggctcacgcctgttatcccagcactttgggaggccgaggcgggtggatcattttaagtcaggagttcgagacctgcctagtcaacatggtgaaaccccatctctactaaaaatacaaaaagtagccgggtggggtggcgtgtgcccatggtcccagctacttgggaggctgaggcatgagaatcacttgaacccaggaggcggagattgcaggagccgagatcacgccactgcactccagcctgggcaatagagatagagtcagtctcaaaaaaaaaaaaaattgtatttaatgaagataactatcaggaatatggattttttttttaaaaaaaggaggtattttcagacaaacagagcttgagaaatgcaccaccaacagctaaaggaaattctaagggacatatttcaggcagaactaatcccagatggaagatttgagatgaaagaaagcaatgaagagcaaaaaagtagtcaatatataggtcaatctatctaataatataaaaaattaaaacaatcctatagggttgaaaaaaacaaggtataattaaaattcatgaatatagtaacatataaatcaaatggtggtattttgagattgttgagatcattgtcctgtctgggatgaattgtatttcttacatttagactttgaaagagagagaaatagagaggcagacagaatcaacagggcatcatgaaaacagcgctaagccaggaggtttggattctattatcagctctgctgctagctgtatggcctttgaaaagctccttttctggtctacaaaatcagtttgcttgtctgttagatgaggctttggaaccagatgaattttaaagcccctcattatgattctatgagaaacagattctctagaaaaaaaaatcagttgtccccctcctttgaaattttatcagtaaacacctgcatttcacttctggctaacttttatgtatcagttcaaaaattaaagctaaataaagtctcgctcaggtgtgtagtttgcttacctttctcgtttgttggttttgttttcttttcttgtcatctagtagccaaaaagagtaatggcagtttaccaaagccttaggagtgggtagctctttggatatcagggagcatttgcagaaacaagctgtgaaaagccagcctagctttgcaaccattgttctttctatcttttctgtttaacttattaatcgaactgatatacacctcctttgccatcttgccttctttcctttcatccttttgccctccttctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtattaggaaccaaaaaaaaaatgtcatttttttctcatcatttttcacctttttatgacttgatcttttatctcctgtgccagttgctgttagttcgtaccgtctccaaagtgggagagaaggtgattgggctggaacatcgatcattcctgtcaccctcctgatcgctaggttattttggtggatctcacttattaggctggtgtcccttaccaccttcactcttcagctcttcggagccacatttttggttgagcaggccaaagtgcgtgtcttcacggaggtattacagatgaactgtacctcctccttcctggaaccaaaacatttttaccatctttcctttttcacggtctttcctgtttatagaaacttcccaagaatcagttataaaactgagagatgattctattctgggaggaaccataatagtagctcagtctctcattcactttgcaccatttttttttctcccttaagtaacaagaattgttttcagcatcttagaacttgcttctttatctgtgaatctgattacattctttgtatagtatcccagtgaacttctaaaggaataaaaagtaggcaagtaaatggaagattcacaaagcagctaaaaaacaaccagtccttatacatttagaagtgaaagagataggaaacgtagcaggttattctgatagtcttaaaatatcatggaaaacaaggccaaataaatctttagccctgctgacctgtttggggagacaggatttttttttaaatgaattaatctcacttaacattaatcctaaatcctaattctgaaactgcgatgtccttaaatgtgtgaatcaacatcaaggtttctatagtgatgaataagccacaaagttgtaaactagctctatggtctatgcctgtgcagaatccacttagcagcaaagtaaacactcttttccagttacgtgtgaactggttttgttactttattttctaataactaccttgtactgttgcgtgctttttattcatagtgcttttttacttttggtgtttattgttccatagtcatgctgtttacaaagaggttttacaaaaacttttagaggtttctgaagcctagatagacaacagtgagtaggtactgcttgcaaaggtcaccttctttccttcccggtttcttggcaggtaaaaatgataccatgggggtggggagtggggaagggaagccacagtgactgcattagatttctaagctaccttttctctgcttccttagctagtgggctttgtatacaagggaaatttttataaaataaagaagaagaatgccttggaggatctgaaagagcactttcaccttcaattcttttgcccttatcatattatattattttaggacccagcacttctcattcctcctgtccccctcttgaaagatggctggaatctaaaaaagatagctttccttcccacttccccatatgtgacataagaaatatgtttatttgaattggctaaggttcttatctgagaaagcaaaaggcaggagagtatgaaacaaagaatatcgcattctgataatggaggaaatgtaccaactagtatttacagattataaattcttccatctaatccaaatttcatgttctcttggggcttcagttatcatttgtaggtaatggggtgagagatttctgaagagatagagataaaagagttcattcgagtaactgtttgaagatgaatcgtatcagtcaattagaaaacattattaaagcgagacttgttttaattgaaagttcttgttcacatttcttttgtcttgtgaaattgctttatcttgacaatgttttgaaaataattgcttcagaaaacttttgtcccatgatgggtaaggggcatgcacagcgtaagtctgtcgctcctggaagttcttttaaatttgagtatttggttttcaaaagactggaaattttccagtaccttcctacttaatctcaaagagttcctagtggagtttaaataaaagctgagtttttcttccctccttccatatgtttataggataatctttctgccaaaatgttttggtactgtaggagaggcaccggaaaaatctggaggcagaaagttaatcacttaccttgtgggactaatgaacattgctttctgtttctcaaattagaacgtggtagaaggtttattaaagagtgttctttgggaatttgattcgaagaaatacatacgtgtttgtttttgctctttatcaggtacaggagtctaaagcactttaattatgacatctgccaaagctgctttttttctggtcgagttgcaaaaggccataaaatgcactatcccatggtggaatattgcactccggtaagtttgacgccagcctgacgtgagagttagttcacctgggataaatttcagttttgtacaatactgcagatcatgtataatgctgtgatttgtcacttccccagatgttccccagctaaagtggctctcaactgtaggcttcaggatttaccctatccctggtgcctaggggagtgcctggcacatatggaacatgatagaccctcaataaatattgttggatgaataaatagggttttcattctgtgtgcatggttgtattgaagacgttttcacgtttattttgcacagccttagaggttgtgtggggcgatcttatggccatgaggcatgttgagtatgggggatggttctaggttcccccaaattcataaactaccacttttaatcaatgttgctcacctattatctgtcctgtatactagtgacattttaaaaatccattttatatgctaacacttactaaatgctaggcatttaccttttaaactaccctgtgtaaaataagtactatgatttttatcccctctatacagatgaggaccctgaggtcctgaggttaaataatttactcaaggttctataagtaagagttgaagccatctcctaagatgttattttaggaaaatgttaagtggccaatagaactgtgaaaaatcactagggaaatggcaaggatgtagacttggtggccagacagacctgagtacaaatctgcctaagaattaaagacaggctcctctcaggtttgttttttctaaaataaacctgtccctgttgactgtagagccacccttcgtgtttctcttctctttctttaattcttacagtctcctcttctctaaactttgcatgcttgctattcaagatacggtctgttgactaatcatcatatgtctattggcattaccttggtctttattagaaatgtgaaaccacaggccccaactcctgatgctctaaatcaaaacccacattttagcgagatctgcagctggttcccatacacaacaaagtatgagaagctctgctttagagcatctctctcttccatcatcagagtgatcctcccagatatttgcctgtctcacttttattcctcttatagagatggtcagtgattgagaatgtaccatgctatgaatagaccgaaatttagtgggtgaagcatgctatcattttgtactaagtagtttttaaaataccataaagtgtggtaaaatttaatgtcacctttttgaccttaagacctataaactaccatttattgagtagcctagtaagcttgtatgtttcttttatttatcataacaacgtgttgaggtgttgttgctcccattttactgatgatcagagcctctgagaagtaaataactcagccaaattagtacatgccaggcctggtttcagagccccatttgtctgattccaaagcctttgctcacaaccacaacactctccttaattacaaaacaagtgtcatggggcagaagactggagtggtcattagttttgaaatcatcctgtcctaaatctgatctcaccatgatctcccttttagactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttcatacttaattggctggattttatttattttgacctttcagtaaatttttttgcggctgagtttgcgtgtgtctccttcaccacctcattttttgttttgcagtcccgttactctgatcaacttctggccagtagattctgcgtgagtactttttttgctgaagggtgctgctaccaccaacacattcgctcgcttggttctcttttgttctgtttatttgtttgttttcttttgttttgttttgttttatggacatattaattccccttccttcatttcagtttttttttttcttttcttgatgagactttgaaagtaccatctacacagatcaggagaatcagagtgggttttttggttcctccaccaggtgaaattcaaaccagcagaaatcctggcttgaattcaaattataatcaaagaagttattggagttttagctgtattcctgggagacatgtttatatatttcttcatataaaagcaaggaagaagcttctgattacataataacattctttagccatatttcttgagattcgatgctttttagaatctttagggtctgttataagtggactattaaaaatcagcagaattcgttttaaagtatgatgctgagtttggttgaataattttaatgaggtgtgcggactgtttatcaggttatgccatgctatttgactaatcattatatacaagggtttctaaattttgaactaaactcactttgctctcctctccaagctaaatattcagctcataaacaattatacatttgctctaggaggaaagtatttctttgttattactattggtgtgtattaataatactgagcttagataccagcagatgatttatctcagagtttataatgctagaaaactcttttttggggcctgtgatttctatattagcaaacaaagtgcctattttaaaactacattatgtagggttgttataacaaacttttggtatttcaaagtatgctttattaaaatatttattgaaaatcagacagctctgttatggataaaggggaaatgaccaattcggaagataagcttgtgtaagaattcaatttctttttattaaatcttttttattgttccaccatataatttaatctaaactagatccttttttaaaaaccctgtcgtgataaatgcatattattaattgaggtttattttcagtctttaataggcctaaaggaagtggaaggctatgctttcctttttaaaacttcgttattgcgccccttaattttgagatatggtagctataagtagtatattatctgatttatttaatcatcatgcttaaagaacttagggagttatttaggttcagttatgtcctctgcctcttggaaattgtgtttcctaacccaggtagtctgttatagaagttacaaccgttcataaataagaaacttttaaagagttgatacactacagtttcagcttgattggatcctgataagggaatggatttactctatgtggaaataagtttaaccgagtaagaaatccaaacgacaaatatgctaaagaacagttgttacaaatacatagataaaagtagcaccaaataataaacaaagagtaattaatagtccttgaaaggcaaaaaggagctacacgtaagctaatgagaaaaacattatgacaatcagattaacttattttaagtagaagattttgtctgtcttaaacgttgaaagactttaaaattaataacatcttttatttaaaaatattttctaacaactaaaacacacctcccaatttgcctttttatgaagagttggttagattattcagaaatagtgggaagttttaattttgaggaagaaaacaaatctagcagactgaagtctgtgttttctttaatagcagtaattgtatttaaagtatttattcataggattataaatactgtataaaatatattacaaagccatcctattcaggcataagagccaggtcctaacgtgtttcattttgcaagacttgtatctaatgttaacaaatcctatgatgattacaatatttgatccatttgatatggatcacagaatttgaaagtttccagagatacagaccgtttggttttccttagactaaactcttatttgcttgtgtttgtcatattactttaaaactaaagctaacataggcctttacgttgtctgtccataagtgagccagtcaaacgatattctttgagcgattctgcattgaaacctaaatgaatgtcagcttttaattaatagagttttcataaaagagaaggtggtggtgggtgggatggaattgaccaagtaggtcattaactcttatagtaagtaatccttctgggtatatggttttgtgtttaggaagtgggaagcggggaacagtattattaccttcttttggaagtgttttagaaggctttgcacttagttttgtttgtggactaagtggctttgtattttcactaattcttggtttttaaatgattcatctctgaccagtactcccttttggctcattttctggtttaataaatgtctcttttagtgtatattttttaagatttctggttattgtaagttcttgtgcttatgcatgctgtgataggcgccactgatattaataagaaaaataacatggaattatccttgaggcaaagaattaaagctctgtataagattttctgtataaaatggtattaaagtattttggatttatatgcctacttttcttggtgtacttatgctccaaggtcttaggctttcattcttgtacacacttccaggatagcaactattacaagggaaaacactactaatgtattttccctgatggtaggctttttgcttattaaaaaaatatgtaattgaaagactggtctgttccaaaagatagttcttataatacaaataatccaagtattaatttatcttgatctgcagtgaagatttcaaaacagaccttagcatttttctaataatgggctatgccagggttctagaagattaacagattaactctccaaaactatagtgaagtttcacatggaaatctttggatctgcttattaaattgagtagtcatcgttttgtttcctcttgacaatttaaacgtctttataactcatttcaatttgattatgattacacttgacctagatgacattggtttcataaataagacctttctctctcagggaagaattccatttccctagttatttgctatagtgtgtcgtaattatcttactgtagtatattaagaaatatgaatttctggcacattttctaatgcaagcttagctactggtaactgcatctttttcttttttaatgtaagaagaaacaaacacattctccttagtgtttcaaccaagtccttcaacgctacttggacactgggctaaaccagggtcctctctgaattacattatcgttgacttttggatttatgcctttacctaagggctttctgtgtcagcagagaaatggaagagaccttttgtgctattccaattaaaagaaaaagtccaagcctaaactggttttcagaacagatggttttttttcctaaggttaatccaaaagatactataaaaacttcaaggataattaatagatcagatatgaaaggatgaaaaaatgttaaccctaccagaattctagcctatggagataagaaaagataggtgtttatatacaaaaagcatatagactattcctgctaatgatctcctcttattttctcacctatgttttagcacacagtatctctaagaaatatttcagatatcatgacgttctatgaaatttagtcattcttttttaaaacctcacaatataatccagggtcattctattttgtgctagaaattagtggtatagtcttgctgctgaattggaagatacatttcttctttacaaaattgcatagatcaagacatcttgatacatggagttttaagaagtcttgtactagagtagcctctttgaagctaaaataattgtaagtatctaggcagatatacagctttgatccaataagaagatagcctataaatggcgcaggtgtaaactatttaaaattttaaaccacatagggctaacacaatttcggaattataggatgtgagaaattacaaagtaggaggacaaaatgcttcctagaaactgtctcccccaaccttttctacgatgggaattttccagagaagattttggcctctcttcatggcttttaataaaagcagaagtatgagaaatcatctctcaatcctggattttaaaatacttgataatatttaagatataggagcaactaaatgtatacattatccatagaattagaataaaagcattctaggccatgtgtataacataactgtgtggtgggttttttctccattaatggatggtatctgtgactaatcacattttctgccttataggcctgcctcgtcccctcagctttcacacgatgatactcattcacgcattgaacattatgctagcaggtatgagactagttgtatgccaggcaaatattgattgaaataactaaccaaggaaagctaacctatgatattttaaacaaatcttttctttttttccccaaacttgtctgattcctactaatcaacttgccctctaacgtgcatgccgttccactgcatgttgtttttggtcaccaacaagagcattagtccagaataatcttccctaaccctggcttttaaacatttccggtagccttgctatgtttttttatactgagcacatttactaaattggcttacaaatagtttaacctccttagaaaactgctagaccagacattcatatatgaaaaaatgatactatattatatggagaatatgaaagcatcagctttccgtttgtgtatttattttacatgatatgctgtaaagaagagaataattaattttcctaatccttggacttttctgtctcaccttctttgtgtttgagatgatttttatacctaaaaactgaattactaattttaaaatattttatgcttgttaaatccgtaagagtttggttaacttttttagttgtaaaaaaacaaacaaacaaacaaacaaaaaaccccctgtataattgcctgaggtgaagaagattttaaaggtaaaaattggtggcagaatgtttagagagcttactgtgcatccatcctttgtcaatattctaactgctggacatgtttaccaatcgtgaaaagcattagctagctgtgtaagtctgtcatcagtggaaagtagtaattgtcctaaaagacaaggggtagtgtaaggtagggagtgcacttattgttagggaagcttttcttctgaaaacaaagacctgttctcagtgaaagcaagactgatctgtagggggaaaacagtgaaatataactttccttagaatttctatcataaatgtagtgctactaactagctgtggtctaccacacactgcctcaaatggttaagccaacacacacatcctttaatttgaaggattcctttctcttcttgccatgatttatcctttagttttcaggaatgttcgattaggtcttgaatagattctaagacgtcacataagttttaatgagcttttacgttttttatcaggctagcagaaatggaaaacagcaatggatcttatctaaatgatagcatctctcctaatgagagcatgtaagtatcccatctctttttacaaaatgttcctgacaatgaaattgctttgagggatttagaggtaggatagcacaggatataggaattagcatcatattcatttgatcttttaaggagccattcatttacttttttcctttaattcttaatgccctggcatggaatgagctcatccaaattctggcattattagtattcagagtagcaaaaatagtttgccttactcttatttgaacttatttcataccatatgattacaaattgcagagtcccaagtatttatagtaatgcttaatctttgaccaaacctgccagatatttaaagggataggatattaattttaaagtcatggctaagtactattttctccactcatggggagtggaaacgtgatcttggtatagcatggctattcacatatggtaggttagttgggcattttccttcagaaatccaaagaagtagatttttgtgatttagcatcttcacaagataaataaagtgaggcaatcttatgaagagtttccagaggagaagtaccaattcaggttgcaggttgttagcaggatgataagccaaccctgttaaactttaaggacggagatagagcggtgctaagagcagcagggaacacagctatggcagggaaacaggcttcattatagagtgagggcagtgttcacaatacagagcacaaaggaacattgccatgaaccaagtaaatgctgaccggggcttgaggtagagagagcagacattgaagcaaatatgaaggaaaaaataaggatttgccaagtgaataaataacataaagagaagaaatctagtcaaagtattacgatgcctttttagtttgataaagtaaggatatctcacccatcttggagaatatagacaaagggaagaatggtaaatttatcatatgtagttggtgtggcaacacaaagtcatgctcagatgagaaaagaaccttcataaggattaggccaaaagaaatagtatcaaagtggcatatatataactagttattgaagacatgagaataaataatctcatctggtacataaacgatcaagctaataataaagaatcaagtcaaccctcagtcatttgtatatgacttacttccttcaaacaaacaaacaaaaaagcctttccccaaccataactgtgatgccttatctttcttagctatgggaaaaagtattaatggtactaatatataagatacttcaacagtaaaatgtgtggccaaagaatcagccaaatgtaaatagcttgtgcttctttggctcactgattttggtattagaagctctagcacattcagattaattcgagttgtatctacgtaacagtggctgtcattcattgactgcctaagagaacaggaagaaaagtgtagttacaactctaggttataattaaacatgggaagttctagcagtacaacttcagaatttggaatgagtgtgataaattaggtggtaaaactgcttttgttttattttaaaataagctttagcttattctgaggacataaaatccattttgactcaatgttggatggcaaaaactcatggcattttaggggcaggtttggggaagtggtttggtggattggttgacttcacttaaatgtgtgtttttaatacccaataattatttttagtcagcttttcacatctaaaccaggtaactggcttgataaacaaaaataattcaaatgagaaggactttttcctaaatttctgatatttttcaacttaagtgggtatggagaggagaatattagcgtatcatcttaatgatatctaaccagaaacaatgagctttagcctgtcattacggacagaagaaaattcttataacttggaggtaaacaggcctttccggagcttggagcaatgcattcagaaaaaagtttgtcctgtgtattagagagttcctagtttccaggaaagattgtagctgcctccccaaatagaagcctttttgcctccttttcccgcaagattagtccttaaaaccattatgtataaatttaaaaataaataaaacttgtatttaaaaaaactctgccccgaggaatgagatgttcagtcttcttttaatcagtcaccttaatgtcttttttccccttaattttcgttcttctgtctaaacaataactgaatgaaacaatcatgtatctccagtttaattgttgttgtcattctgcctcaatgacttatataagttaaaactgacttactgaagcaatactttttggttacattgccttccacttaataaaatatttcctctgttacttttagagctgcaaggtattttttcctactcagtacaacaatagcgtgggttagtgaacagattatcttgacaggcttggtggccaaagcattatacagccattattatatcttttaatattttttagctattgactaacatcaacgtagagtcccagtatttctgtaattctgcctttcatttatccgtgtaaataggccaatcaatttcatttgaaaatctgagcaagaaaacactttgaattggtaccagtagaatggtagatcacaacctcagcagtatcaaaaggtctttagaagcaggaaaaaaggtctaattaattgttaagagcaaataaatgtttctattttcaaatacactcctgagtccctaacccccaaagcaaaataagggggggaaaaaaccaaaacctttgattttattttccagagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggtgagttttctttctagctttgtcattggtatgcagagtgcatacacttgcacacatagaaaagtgccaggaatcttcacttagagtcattttatgtctaattgttttctaaaataatctgtttagctccatttgcagattctctctctcttttttttttttgttatctgaaagaagacaatggatgcaatagtatgatgaagaactcatattttaggtgtgaaggagttaatgctgatggtggtatttgacttgttgcatgtgtctccaaggctttgattttatatttcagaatagaatttaagaaaaaagtaggttatttaattttatgattatatgattttttttacatgtgtttggccatattatctacctcaaacatttaagaaagtagggttattggcttggtcatattgggaaaccaattgtttcatcttatttttcatcatcaaatgcagaaattattatttatgctcaccatcatagcaggttagtgagacaattccaattgtcagccatcacctgtaaaagacagtcatgtaaaaatagcagaaattgtagaagagaaaaaggctaaagaactctcataatgactgcagggaggacaaagatgtaaacatctggggtactgtattgtgtcaggataatgcaaatcattggactttcagttctgtattacatttattatgtcacaggtcccttggtttaaaaagtcttctcacatgatcacttctaactcacaatgtgccttcttcagacagatgccaccaagcaaggatttaaagtagatgttgctcagatttgtgggtcttaagtactttcatctctttggttgagcccaaggcaccaaaagctcttaacgtaggcaacgcagtgtgtctgagatcagtgccctcgggagtatgccacttcaggatgaaaaaacaaactgccactcttccattgcttcctgctgccactgcgagccttctagctcttaacaccttttacctatggccatagctccttatctggttggcttccctttagtctctttcccacccttgcaataaatcctccatactgactctacttgtacatcttgccagaaccaagacccatcatggcattcccctttcactggatttctgcatgtagaaaaaaatcaagcttcttagtggggcgttcaaacccttccacaatattctcttgacttgctttttctatgccatcttcttttgttctccctgtgttctggctatgctgttgtagctagtatttctgaatacatcctgctctcatctacctttggggtcaagctcaagcttgagtctcagcctaactgctaacctctaacccaccactgccgtatctgacaaaggaatcccacctatcctccatcacactgctcaaaataactttccccatggagccctgctagatccctgcagttggaagaaatctgtcttttgcctctattcccagagcactttggacctttctcagaaaattccttgacagttttcctttttatcagttattaccagtgcctctctttaatgagctagtgtgtgtctttggggcatggactgtatcttaatcatcttcatatcctccagagtacttagcatggtttgaatatttaatggctactcaggaaatgtttgctaaaaacctgaaaatacagcaagaacatcacatgagtaccatccacgagataatattgaactttttttgttgttttaatgatagctttatttttggccgtacttttgagatcatttgtcagtgaagaccatggtagagaaaacatttctactttattgagaataatcagtaatatccatttatgttaaatctgtaattattgtaggggtcaaagtcaaatcggaataaaaagttggaactgacactgtaaatagaatttgatgttaccaaggagtaaatatatttttgaagtatatgatcgtgtaatatatcttttgagctcattggtcaagagccctgcctcgtttgtggttagcatagtctttctccgtaccattgcacccgggtcaaagaatgtttgtaaagagtactgataactatcatttatttatcattttatcattttgagtgcacttttacatattttagatcatttaatcttcttacaaacgctatggagaagagactgtcgcctttctgtgaatgagacacaggttcttagaggttcacacagcttgccccagatttcccagtcagccagtggtagaactgaattgaaatccagatttttctgactctaaataggcaactctgccttcaaccagataataaagaagagtaagtctctgtgaatgtcatttacatagaattgcggcatattccccagaatgtgccttaacttgagggactatctatgaggactgagtgtcccggaataaacctgttcatctacttgtggcacagcgataaccgctttaccctggaagatatccaagaccattctccaagaatgggatggtttgttctctaaaagaacaaaaaacataacaccaggcctacttagagctccaaaatgaggactctggggttgatgcaaatctttgtgtaagttaccttgaccttcacgaaatgatcaggatgagcttccttcattgtcccttcattttgtcctatttgaccttctaccaaattccaaagaaatgtctccacagagttcccttcctgaaaacagcccgtgtgttttctttgatctgccctgtcctgtcttcttgcagttctgcgcaaggagcttcagagccctagatttgccttcgctacccttgaattcagtgttgcttaaggagcctttaatttgccatttcctgttgagaaaacccaggaattctttagatgccctctctgtgcatgtctagctggctatgtcctaagtcagcattgggctacgcaatctgacaaatacgagcatacttttagagaaaataagaaagtatatttaaaattgagattgccccaagtcctttggatgtgtacttattgatctgttaatatatatattttatgttcctttagctgtgatttatctccaaataacagcaaaagagagaggcctggagagccccattcctgactagatatttattaaattccattaattgttcttattcatgacacctccctacaaccccctagaaaaacagaggatggctgtttgagaagtgtctcagaggtatcttatctctgcctttagaattccatttctcctggttgttgcacatagtattcaataaatatttgttgaatgcattaatgaataaatgaattgaagctgaatttattttaattgtagcatacatgcatgcacttttgactaaagttcttttacaaacctaatttcgtagagaaaagcctttcaaagactttgttttctgcttgcttttcaaaattctcccctttttcaaactgccttgattagcaccaggcatggctttgtcataaatttagaatgttaagaacccgttttccaaatcacaggcactgtatgtatcccacattggtgttctctgattcttggttgatgccacagagataaggctaaagctctgagtaaaagctaaatctgactgagtttttcccatagtgcctcccataagtttggatgactaatggtgttagtgagatatctaatctttaatatttcgcttctgcatcatatttctccctcattaccacatataattcagatacatctttatttggcaaagagccactggatcttgggtttttgccccattgtgtgtccttagcattgcagactcaaggtttacttttttttcttgcgttgattaaagccttcagtctcctgacttaagcctgtagtgttcaaatacagagatgtatttgtctctgcactgtctaaataaaccaagacttgctctgaaattcaaggtatgatcctagcaatgaaaaggtagcctttctgagagacaaagacattgtcgttctactacctgcagagcaaattgattagattgttctcaagtcaacaaggtggctaaatattaacctaattcaccataaagtctaaagttaaagttgttagtagatgttatataacacgagggaactctgtagattcttaatacctactcaggacctttcatatgtcttgttgggcagtaagaccttatgaagccaaaatttgagttttctctttttcctttaaattcctccagtgattgtgcaagattattattgttacagtcaaagaagttctagatcagttactgataccactgaattaaagtagctggaaatcatgatcccgttgctttactttgtaattgacttgatgactttggacctagtctagtagctatcaatcttcatagctacgggaaatctttattcaatgttctttcattaggtctttgtgcaagtctccaatgatggtgaaaagatggccaaaatgaagggaatctgaagaggttaggaatgggcattcctatggaatataaacaaaggtgtcagggtgaggaatggcagagtttgtttgagggaaactgcagttgtattaccttttttaagaaggcaaagaatgagaggagatgaggctgaccaggtcagcaagggcaggtcgggaagggtgtggtacccactgcagagttgctgcctccgtgcctagtctagggagcaactcaagggtgtgatccaggagtcaggccatgatattgacatgaatatacgccacacaggcagctgtgcggagggtaactttgaaaagagcgatgctggaacgaggaaatcaagctggggggagtcacatgggagcccaggaaagagatgattagagccttaagtaaggtgatagaaatgaagtagacaggctgatctgagtgatatttcgggggaggatagagctgtttgattcggtagttctgtgggactagggtatgaaggaatgattcccagggctggtaactacaaaacaagatgatagtagttatttgcagctgggactgataattcaggaggagttgcagcaggtccatcctttaatgcagcagtgtttattagaggtccttcctgaagggctgagtagctggaaggtgataaatgaggtatggaagaggtcgagttgaggtcctggtgacatctccatgtgtaaatgtctgacagtctgagagatagaactctgatgcttgtagaaaggatataagcctgagatattaggactgtgagtcgccagctcacaggtggtagttgaaaccgtgagaatgaatttatatatcccgggagcatgtagcagaaggagaacactggatttggtagaactccggaagatgtgaacattaaagtgtgtatttaattacttttatttttagtagagaatacatgtatattattatacaaaatccaaagggttcaaaaagacatatagagaaaagtgaatccttctccaaccttctcccctggctgtggtgtttccagctctggaggctgccatctttcttggtttcttgtgtttccttccaaacatgctctctacatatgcaaatatttgcaaacatatttatggttgttggggttacttcacacagtgtcgtgcagtgttcactctggttttctctttttacttaaaaatctctaattttcacatgctggagaaatgtgccagaagaagaggagggcagagcttgggaatgatgggagcattttcccacaggaggcaggagagagaagggttagggaactaaagtatgggaggaggcgtgaccttgaatgagaggaaggactgcctctgaagacaaagtggtaggtaaggaatttagggtaaggaagggaggaaagaagcataatggaatgaatgttaaaatgtccagtagacatcactggaaataattcaagactgattcctacggctgttcccacatgtttttaaagttggagtggagaggaaagcgtggtatatgatacatttaacgaaactaggcattcaagttacttggtgtattagtccattttcatacggggcaatttacaaagaaaaagaggtttaatggactcacagttccgtgtggctgggaaggcctcacaatcatggcagaaggtgaaggaggaggaaaggcatgtcttacacggtggcaggcaagagagcatgtgcaggagaactgccctttttaaaaccatcagatctcatgagagttactatcacaaaaacagcatgggaaaaccccacccccatgattcagttacctcccactgggttcctcccatgatatgtgcggattatgagagctataattcaagatcagatttgggtggagatccagccaaactatatcatttggtgacatgggccccaaaacaaagggctacagagcccttcttgagacaaagggagctagtttgatcacagaaatcagaaagccaagaccttttatggcaaggatgaataagagctgaagggcatacatgccacatttaagaagctgtgtaagaatggggtcaaccatctcagctctactcaggcagggaggacaggaacatggtagaagtggaatcaccattattcacagactcagtttctaactagcagggccagtgtaactaaatttccttcagtttatccaaagttaattgaagtctgaggggactgattcatagtatgcagttcatggcagtgaatggataacccagaatgaaagtttatttctccctttatcctaattatctctctttttaactgccttgtattaaaatgttatcaaggttgccttaaagcttttttaggaggagacagcatctggtttaagtgcaaatactagatctattaaaatgaggaatatattcattttttcggcacacagcatcctgtgtcttagaatccagtgtcttaggaatcacaataaaaatcaaattgtgttctggtgagcctagaatcttggcatctaaaattggatgtttgtgaggactgcttcatactacaaaaaaattgaagcacccctctggcgattagaatattcacatcttacaagtacagctgccatctccctagaacatgctggataagagtttatgttcttacaatccaatttcccttttttttttttttttttttttagatttttcatgaagaccctcatcctcctgttggccttcatttgccaattgtccctctacagtagaattgattatggtcatgagtttctttagctactttccaggcctgaggatgtaattctgttcaattctgcagatagttactgagtgcttaatgtaattttaaaattatgagactacaaagatgaataagccttggttcttaccctcatggagctcaaaatttattttaaaaaagttaaaatagaaacaactacttatatcctactgttacaagtgctctgggggcacagaggtgaatgatttattctatcagagggagtagagaggcctttacaaagagagtttaagagttgaagactgaatgggagttttccagtctgagagatgggggaaggatgagttttccagactggtggaccagtgagtaatgtgtggcttggaatgaggagaataagagggcagtgggatggtaggtggggactactgtttaaaggactttgtgcatcatactaaggagtttgggttttatcctataagcaggtgaacagtgatggctttttgacgggggggaggattgagaaaaataactgacctggcagaaagctaaagccatgaagattggtagaagcacagtggaatagtccattaaaagatgccaggttcttaactaaggatgtcttaggcaagtgaagaaggggatggagaaattagaaggtcactgaatgaatgagaccaagggaaaatggagagggggaggcatctggtgttacggaaagttttaatttgggaactgggaaatgatcattgaaaaacaaacaaaagcaacctagtgcacccaggaaaaactcctgatttgcaaagggttagtgcatggagagaaagagctacgtatcagacatactgaattctatttgcccaaggacatttcaagtggaaatttcctatgttgattttacgtattcagttttcagaaaggattctttaaaaagtcatagcaatacaattcctgcaatataaataatagatcaatgaacatcatagggattagcatagttgatttgactaagcttcagattcagtttgagcttccctgtagccagggagataataggaaacaaagatttgtctgtctcttaatattgaattaaagaagcacgcagcatcctaaagaaacatcattgttttcctggctctacgtaataataataataacaaaaatagctgtcctttgagtgattgctatggacaggaactgttctgagtacatatgaactcctatttaatccttaaaacaaccctatgaaagagaggctgtttccagaggattacgtggcacagagtattaaggacacttcatatggccagcaagtaataggacctgtattcaaacttgggtggtggtcctgaactcttaagcagcgttacacttgaagtgattattggctagtgtccttatcaacatttttataacaaatcccaagggaaattatatgtggctgtttctcatggcctttgataattgtggaaagcttaacattaaaacaccaaagatagggtgacagttctccaaggataaaggtcactgttgcctaaaatgtattctgcagaataccactgagatactctgagaaaaaaaggattccaaggacagtaaaactttgaaagcactcatactggaaagtcatcattacgttagcatttgcactgaggagtttggaagtgaagaaacctgattagctttgtctaacctcatgttgctcccacttacttgacctcgagcccaactgcaatgttatatggaacacactttggtaaagaaattcaagtctgaagtaaactttgaaaaccagtctaggagatagcatagttgactctctactgtagttgttgagaagcctatccgttgtgtctctgggaacatcagaagataaagctataacaggtgcccacgtaggaagcctggatttttcgcacaaaagtaacttttcatatgctctagtggtgaagcagttaccctgtagacccagaagccagaatgatttagtctgaaaaatctaaagataggtattaaattaactctcatgatcatagaaaattctttgcaccatttttgtagaatatcccaccgaataacttggcttttcacccaaaccaccaagaaaaattgccaccagtgacttgatgcaattaacttgctatcgggagttctttcttgtgaaatgattgaactttgaaagatgtttaccaaagacagcacctttagcttcatcacaattactgtggaatctttctttgtaagtagttagatgcaaaggccagttgttgcttgaggcctctcctggattgtgattttaaagtgtatcatcaacacatgggaagatatttctccctctttatcttatgacagaaatgcaggtatagctttcatctcaaagtaagattaaggtataagttacaaagatgtgtagctactatatggtcctgtgtaatgctacttgaggaaggctgttcctttcctggcactgaaattttagagcttgcataatcagtatatcaacctcgtgtggcttggtgcttagcaagtttcagcttctagagcccatggctaatggagccatccaggagaatgttggagagataggtctgaagccttagaagagaagtcttgattaaggagtaatgagttgcgggaaggggtcatggttgtggcggagatggaagcctggggagaggacagagacctcctaggaagagagtttgtgtaagaagaagaccaaggacctcctgatgtacttgattgtaattgggcatgagcagcccagttagaaatggtttcctgttggtattacatatgtacatggatggcttctgcagatggctaaactcacccattttatttttttactatcttaatagttaaaatatgaccttttcttgtgtctccaaattctgagttaccttatggtgctagtctgtctgttgtaactacaagtcataagtaaatccatatgattcttttcctgtaatttcctggtaaatcaaggcgataatttcaaagataaaaatctgtatttttagctttagcagtgagcatgattcccagtctttttgccttcgagtaaggtttgtttccatggtggaagtaaacaatatcccacactctagaatgtgagctcttcaagggtaagggacagtgtcctacatatatctttatctccacagcactgggtacataaatgtgtcataaaaatgaatgggtaaatatcctttggagtttttctgttacttgatgggtttttggggttgattttcaggtatctcccttgtttttctcatttcttacattattttctttcccaaaatcccttaatatacctgtttagtttgtgatgtcattttccattagactgaaaccatccaagttgtttaggctaacccagacttaagcattttctgggcttatttttggactctttttaaaactcatcatctgaaaatatttaatgtccacacggataattctgaagacatgtgcataccatttttcttttatgtacatgggttaaaccttgatttttccatagtaggagaaagcattataagattttattgttttcactggggtaatatcttttgtgctataagaaataaaattttgaatctagaacttagttttttataagacctttattgagatataattctcgtaccataggagttacccatttacagtgtattagtcactgattattagttaataggttaaccagtattagtaatcactggttattaattacagagttgtgcaaccatcagcgcacaattttagaacatttttatcaccccccaaaagaaatcccatccccattttcaagtcactcctcgtttctcctgcaactactcttttcagccctagcagtagacaatccctgatctactttctgtctctatggatttgcttattctggactgttaatgtaaatgaaataatacaatataaagtcttttgtgactggcttctttcacatagcgtaatcttttaaaatggtatctatattatagcccgtattagtatttcattctttctttaatgctgagtaacatttcattgtatggatataccacattttttaatctattcattacttgatggacatttgggctatttctacttattgtctgttatggataatgcagctatgaacattcatgtacaagtaccggtaattattttaaagaagttattctgggctgggcatggtggctcacacctgtaaacccaacactttggcaggctgaggtgggaggatcacttgagaccaagaatttgagaccagcctgggcaacatggggagataccgtctctacaatttttttttttaattagccaggcatggtggctcatgcctgtagtcccaactactcaagaggctggggctggaggatcacttgagcccaggaattcaaggttacagtgagctatgattacaccactgcactccagcctgggtgacagagcaaggccctgtctcaaaaaaagaaaaaaaaaaaaaagattctatagtttctgtcattgtaatagaggaggccataggatcatatatggcaagagtatatagcagtgcatgccagggagtgaaaaataggccatcaaattgaagttactgggagaacttaagactaagtctaactacgcatgagggattgaagccgggacacacaaagcttaaaattatgattcttctagagactgttacggctttttgctgaccacagacaatgaaagtttgatattttgctgtatttgtctgaaaatggaaacacacttttcccaatggcagtattcctgaggactagagttcttcacctctaaaacctctccaatcctagtttttccttttggctgatgatgaccagccactgccatttttgtcttaggttttgttagtctgtcttatttccagttataagtggttaaaatttcttatgaattcttcttgtgttgaacttttgattaatacatttagtctatagacagtaatgaattagcatctgatcaggaatttgtgaaaaacatctcagtcattaaagattaagaaactgaagccaattaatattgtcatgttctgtctcttggaacttgagcaagatacagatctacgtgtcaatgacatatccagaaaatagactccacctagatacattaaccctgtacccttggtccacatattttatttcagcaatgatccatggacatattataatttgacagtttcatcacatacctagcgtattgggtcaaatcaaggaaatctcatcctagtgatcttaactcagtgatttcattttgcccagatgttcagctgtgataaactttactaaggcacagatgatggatgatacacaataattccaaaatttgggggtggctacaatgtggctaggggctagaactcaggtatctacaggacaaatactgagtgattagtcactttctaagcgctagatatgcatatgttctgccaagctcagtaggtctaagtagattgcttccatttcagataattaagtgctttctttttataggaagtttttagcacatctgaggttctaaatccaaaaagtaaataatatatagagaaagaagtaataacaataataatagtaaccaacatttattgaacacagtatgggctgggcatggttcaaagaaagtttgacatatagaatgtcgaccatactggcttaataatcctcataactgaattagtgcttaagtcagttgcccagcctcagcaagcagcagaggcaagtaagtcataaatcaagatcttctgaatccaagaccatctctcaagccttgttctaattctctcctcagccatggatggtgaaaggcaccacaaaggcagcgtgtcaaaaagtggcattgttcaacctttcccctgatggggcaaagcttttatttttttcctttacgttctttgacatctgttttaaaatgcagatatcactagaagaaatgacaactttattataaaatcccagtaaaatgtaaatgtcttatataaaacctttatactgagcaaatttcagtaggaaagggcttggaagtaaggctctgaatgttttaaagggggacagtgctaagaaatgattagaaacaagagcctggaggggtcctgccatttttactgttttgcttaaggctgacctaaaatatgcatagtcttacttctcaccctgtgagcttatccttattaatgtctttttccacctagtttaggggtatttttgaatttgtgtttgataaagatgtctaaagctgtactgtaaaattttattgtcacttttttttttaaatggagtctccctctgttacccagcttggagtgcagtggcatgatcatggctcactgcagcctcaacctcccagactcaagcggtcctcccaccccagcctcctcctcctgagtagctgagactacaggcatgtgtcacgacatatggctaatttttttcaatttttttgtaaagatggtgggggtgtctccctatgttgcccaggctggtcttgaactcctgagctcaagtgatcctcccacctcaacctcccaaagtgctgggattacaggtgtgagccattgcactgagctttattgtaatttcaagggctcaatgcaatttccagtttttaaagttcatcttgcttgcagaatttgtctttcatttaaaaaaaaactgctgattggctacatttatagctgctgtaatagttctgtatgatttactacatttgcctgaatttagattggtggatatgatttagctgcttttaatattatatgagggtaaagccagatttctttggatctattccttttagatggcaatctttgtagttgttctactttacaaaataatccctgtgtgtgctcatgctttggtatacagttaaatgtatgatactgttaagaaaacattgatcactggaaagtgaccttcatttctttatttcataaatatcattatacaactatataactacacgtagtagggaagctccatttaaagagtagatgacttacactgaaatcatttgacctttgtaaattagtttaaattacacagagattgttgtaatgttctttatcatacataatagttacgattgctagagaggcactcataaatcattgctaaaagggccagctgctttcatgttttcagcaggttgagttaagggaacaagccttgccaatttgattaatctcttatgtccattagttggttgggaagtttttttgagtgtaaatttgtatgtagacaacagagtttatattctttatgacataaaattaatcagatatatctacatatttgtagaatggggggattcttagctctatagagaataagaaatactggatggaagactttttttaggatgactggctacaggaagaaattgtagtgacagaagccatgtgtattgaatttgaattaatgttccttagggagctaccagagaaatataatttacaagataatcaagaacgtaaatagattctctgtggagtcgttgtctgatcactgacatatattcatctgtattgaaatgacttcatgactacattctaacaattagagaatcattaggggtgagatgtacgtgtataccttcaagaaaagcaaaatatgtattggtaataattgacagctgttaaaacgagtgcattgtgtacttgttaaacattagaggctgggcatgttggctcacacctgtaatcccagcactttgggaggccgaggcaggcggatcacgaggtcaggagatggagaccatcctggctaacacggtgaaaccctgtctctactaaaaatacaaaaaaaaaaagccgggcgtggtggcgggcacctgtagtcccagtgactctggaggctgaggcaggagaatgtgaacccaggaggcagagcttgcagtgagctgagatcgcaccactgcactccagcatgggcgacagagcgagattccgtctcaaaaaataaaaaataaaaaaataaaaaaaaaacattagaataacttaccttggaacagtaactctgagggaaccttgatcatttatgagaatgatctcccctacgttaatactgcatcaaaactaacattatggtatacctcaaaaagtattggcatagatgtttttaaatataagaaaattcaaatgcgtaattgataagggctaaatggctcaatttcccaacccctaacaaaaatatgccctaacacagctctgtgactatgactgcatttattagaaaacatttagtaaaaatcatctctagttcaaaccctccagcatcagttcttcttgataattctcatgaacatttagaaataccttaaaagagaattcagactcaaatcaaaaaaccttatttcatttggttgcaggccaagatacctcttttaaccatttctggcttttagaatccttatcatgacagcttgtcctatctcagagcttcaggaggaaaaactagtccctcaaaatcaagtttgctattgagcttaataagaggtttctgtatgtcatatgtttgtttagaagaaaagcacttgttcgactcatttaatcctggcctgatgaattaaggcttgaattaatactgagggaaccttgactatacatctacaaaatcaatgtgtcctggtaggcttctgattaagataacattagctcttgcttgaaggcatctttctctgctcctaccatttatccagtggtagataatatatggagtgaaaaatgaaaaagacatagctgggctttaaagcaagatgaacatctctgtgaaccagaaatgtgaaagaaaaaaaaaaaagtaagtggggctaaattagtgggctttcagctcgtgctgtagtaacagggattaaaattctccttacaaggtagtggcccaaagccaggattactatttgaaatcagagccccacaaaaacacacctagagagagacacatacacacttacacttaaaagcaacatgaaaagaaacagtttgctgcaagggtctacagcttatatgcagctatggccctaatgcatagagccgagggaagaggcaaagattcgcagttgggaaagagagcatcacagccttgaaaccaggacctgaaccaatctacctactgcctggcaatgaaatgagtgatatctctgtatcactcagtgtaggagctgcaaactaccaacagatgtggctctaaactctaagcccctgggtatggctgggagaagccataaaaccacctgagagagagataatgagtttaaaaagagaggaaaatattaaagtacacacacatgagaataatagaaaacatacacatgcatatgtatgcacatgcaaaacatcccttgcaaaatttgtctccaaatcacgatccaaaatacatgaagaaatgggatagcaccccccacccaagttaaacatcaaaaagtgaattaggctgggaacagtggctcacacctgtaatcctatcactttgggaggccaaggtgggaggactgcttgtgcccaggtgtttgagactagccagggcaatgtagtgaggtgccatctttacaaaaaataatttaaaatatattagccaggagtggtggtacatgcctgtagtcccaactactcaggaggctgagataggaggatcgcttgagcccaggaggatgaggctgcattgagccataattgtgccactgcactccatcctgggcaacagagtgagaccctatctcaaaaaaaaaaaaagatgaattaattctagaagaaagcaaaataatacactagtacaacaaagatttttacttacatttaagatgctcagaccaggtgcagtggctcacgcctgtaatcccagcactctgggaggctgagatgggtggatcacctgaggtcaggagttcaagaacagcctgcccaacatggtgaaaccctgcctctactaaaaatacaaaaattagctgggcatggtggcaggcacctgtaatcccagctactcaggaggctgaggcaggagagtcgcttgaacccaggaggtggtggttgcagtgagcggagatcgtgccactgcaccccagcctccatctcaaaaaaaaaaaaaaagatgcttaaaggcataaataaggggtaccactcgctaaaataacaagaaactaagaaacagagatggatgaaatgtaactaggtctgaaaacaaagatatctttgccaaaaaaactagtcattgaagttactaaactcaatatacaggataaattctagactttgtcctgtcagagaaggcaagggaattagaagatgatgctgagaatgttactgtgtacaacactcacagaaaaagataagaaatataaatgagcaattaggagaaatggagaattgaccacaggctctacaatataccttactagaatttagaggtttgtttaggagtgtatttgagaggtttcagaagaaaatggaggaaatggtagagaagtaatatttgaagctgtcatagctgagaatcttccagaattgaagaaggatgtgagtcttgaaggaaatgtgctcccaagagaaatttcaaacatctgggaaggaaagaaaggcctgcattgagcaattgatattctttacagctcagctttggctgattaaaatgagccttttctgttttcactggaaaccaccaaaacagaaatgtaatgtgttgtatataccaaaccatgcctcttgaacaagggtccttataaataaatcataaaagaagagccctgtggacaactaaacccacaggatcaagataccaaggaagatctctctagaaaaggcagtctcctgtcagcacctttgtgaaaaataggtgggaagacagtaatggcttgttgtaccatcttgaggtccatgtctaaaaactgttttcaaaaggaacaccatggctgccccaatctggtagaaagaaaaatttgaataggattctacataaaaagtgttgccagttagaacattttgttgaagttttcttttaatgaagagggaaaaatagaaagtaattcctatggaatgagaccttgtgaacattggatactgcttcaagttcacagaaacattgaactgattgccagttaagttctcagaaattagatttaattaatgtggacagttacatacatcggtgcacacccagaagacccgtgtgcagaatctgactgaaggtgtacttacttcgatgaatctcttctcatcactgctttgtcaaagcagattgctatgaaataaactatacaaacaactacccttgaaggctgatagcaataggatttcaatcagtacagataggagattctatttctgtagatgaaaaagatcatacattgattttctgtgtgactttaaataaattcctggaaaccttgtaatgttaggtactaggtagaatgaaaaaaatgaagcaaaacaaaacaaagaaaaaaaccagagtagattgggttttctttctgcttccatgtggagatctagccttttgaaactgagcattttggaagacatgccgtcccctgtggaatgttcattccgagtatgggacaacagaaaatatttagcagacctggtgatgagatgatcttgctttctcaaactggacaatgggaaaactcttcttggctactcactacttacatttcatctcttttctcattgatatagatctcccacatttgtggataggaatttctctcacctgatgaaatatcatctgtgaacaacagaaatctgtcatcttattttggtatttatcacaagtagaagaaagatgtcaagagttctaatcagtcactggatatcaaatatcagaaatgtcctcaattggaattgtattctcagtaaatcctaaagcatttgggaccttcacatgtgctaatactgtttatatttatttggaaattaaccaaatataaccaaaagacagtggaataaccatagaaacctttaaatggaataaaatttatggcaatcaacattattaggaagaaaaagtatactacctagaaacagtgcaagaacaacgaggatcttctgtgcatctaactatataggtctagaaatatataaagtgaattatgatagaattaaaaggagaaactaacaaatccataattatatctcaacactcatctaacaaaaattgatagctacaaataatcaaaaattaataaagatatggacaattttaacaacaaaatcagcacactatgtatttagagactccatctttccaatggaaaaatacacattatttcaagtactcaatgaacatttttagaaagtgactgtgaactaggtcacaaaaagaagtattgctaaatttcaaaggatcagtatcatacaggggttctctgattgaaacgcaattaaattagaaatgcactaagaagtgaaaatggaaatataaccactgtgctcctaaatgactatgggttaagttaaaagaaatcacagtaagaattacaaaacataaggcactgaattgaatcaggtgatgtatataaaaacttttggtatataattaaagtggtaccaaggaggaaatgtataaccctaaatgtgttcattaaaaataaaaaatcaatgacttattcaacctgtaaagcaagaggaaaaaaaagagtaacaagtaaaacattattaatggacataaaatgagaccatagtaagtaaggagcttcactgcattcttggatgtgaagactcaattattatgaacttagttcttcccagtttaacctatgaattcaatgtaattcaaactcaaaatttcaacaagcattttcataaaatcagaaaaccaaacactaaaatcatggagaagatcaaaggggtcagaatagtcaagacaattttgaggaaaaacaaagtgggctgagaaggcctatcagacatcaattgatttaaagctggagtgtgggatctaccagggatatgcagatagaaccacagactagaatacagagctcagaagcacacctgtatatttatggacacttgatgttttgcggaagcatcgttagagatcagtgggaaatagatggaccatacaatgaatgaggctggcttcatagtttatccatgggggaaaagtaaaattagatcgcatgttcacggcaagcacaaaaatagattctgggtaaattcaagtcctaaatgtgaaaaaccaaattttaaactttaaaatgtaggtgtaagaaaagattttcgtgaacaaaacataaaaagcagagaacatacagggatatgttaaaatttacatcttttataccataggatgccataagcaaagttaaagataagctacactaagataagggtagaagatcatatttgccatgcacataactaacaatggattagcatctagaacatatccaaaggtttaaaaagaaaaagacaatccagcaggaaaatgggtaaaggaagcatgaaaagccagttaacatggaagaagtctaaccttgccagtaatccgggatgtatgtgcaaattaaaatgcacccatcaggttaactaaaacttgaatgtctgataacaccaagtatttggtgaggaggtgggccaaatggaaaacctcattcactactgaagcgagagtaaattggtaaaagcaccgatttgtcacccagagcgattcggtgacatgtagcaatgttgaagatgttgctaagatccaacaattccacatcaaactatattctgtaaagaatctcttcaacaggtatccaaggagataggtataaaaaagaatttcattgtatcattgtttataatagtgaaaagttggaaacaacctaaatgtccatggacaggaaaatgttggcatattcaagcaacagaataataataccttatggcagttaaaatagcaaactattatgtatcgacctggagaaatctccaaaatggtgttgaaggcaaaaagcaactcttagaatggtatgtatattcttaaatgtgaagttcttaaatttaaagtttaaaaacatgcaaaataatgttattagattgaatcacataaaatgggtgtttttgtaggtgaaagaaaaatacaggcaaacatcagcatcttttttaagctcaacctagtatttgttgatacattcatggtaacactgggcatgaaattcagtgtggcattatctccttgagggcagcggggaggagagaatggtatggtgttgaggcgggcatgtgagggagcttctgctttggctgttaacttttctttcttcaaaaaacttttgaagaaaatatggcaaatgataaacttatcaaggggaggtgataggaacatgggtatacttactccattcttatacatttctgttgaaaatatttgctaatgtttagagcaaaccaaagtgttgatagaggtataaaatttttaatctcatgacattataaagaaatatttacaaagtgattaaatcctttgctgcttacttatctgaacataccagtcgcgaggcttttagtgtaacataaaaaattgaaaagcatggctcccttcacacaccaggcaaaagcttcaaattttgttttgttcttttagcactggtaagattgtcatcattaaaaccattcattagtgcctcttttgcttgctgttcttcggtggcagtcagatgcatctatctaccatggtatataaaatttggtgatgatattcaaattactttttttcttctttttctttttctttctttttttttcttttttacttttttgatgccaataggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaagtgaggagagagatgggatttttacaaacattcatttttccctcttaaacaaaactaaacctcagagagcactttttataggtgcaacaagcatcaattcttaagtgcttggtatgtgcctgcaaagtgatagtatcaaaggatagaagtagaggagatagaaaaactagtgtgtcttttttgtatttgtccaatattgtttcctaccaaaatggttttttcttgaccaatttgaaatacatcttggggaaaaaaacgcctaaaggtttccactagttctctaaaagtgaatatttcacttcttgaaatggaactatttcatttacaattagttatattttctggtatacctttgtgttttttttctcctaatccctaacacatagttctttaagcctccatcgaaaacctagcaagatactgcattgtaagaggacctacctggacatagttctggctttctgggaattttaaatttttcaattatgttctctctatcttgttacttaatacttcacaaagatatgaatcttccattacagttttgagatctcacatagtctcatcattcacacatgaccttctaaatcttccagttatttaatgtaatgatgtatagtctcattccagtgtagctctgatttttttctcaaatttataagggagcacaattcagatacaaagacagtttctatggattatatcaacagtgaaatatcccaaattaaacaatctttgggagggcttctaaagtaggaagggtcaaaatttatgagtcctgagtgtgtatcatattttgaaatttatacatttgtatgtttattatgaaaagtaattctgttttcttttggatgacttagccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggcgaaaaaagtctaaaaagaaaattctaaaaaggtgtattctggcagctctatctggcccacagaaaacttgtataggtgagaagaccagttaggaggcaattgccaaggccaagattggtgagttctgagggcctgcacttgagagatgtgggaggagaggactgtgagactattctataaaaatagacttgccagggggctgggcgtggaggctcacgcctgtaatcccagcactttgggagggtgaggtgggcggatcacaaggttaggagttgaagaccagcccggccaatatggtgaaaccctgtctctactaaaaatagaaaaattagccaggcatggtggtgggcgcctatagtcccagctactcgggaggatgaggcaggagaatcgcttgagcccaggaggcggaggttgcagtgagccaagatggcaccattgcactccagcctgggcgacagagcaagactgtgtctcaaaaaaaaaaaaaaaaaatagagttcccagggtctggggactgagtgcaaattgtaagaagaggaatgaagggagaggatttggttggaagaagatagtgaaacttctgattgtggacataatgtgtttgagaaattgacaggtcttctaagtcatgtcccaaaagaaattaagatacagatctatacttgaagtaagtgggcaaactggagagatttgagaatgagtttcatagaattgattgctgaagggtgtgagatgagaaatctataaaatctataacacaggtgcttcgatccagtgccttggaaaagacctccatttgggtaatgggatagtaaaggatggataagtagggaggttcaaggaagatgtgacaaaaaggtgaaatgctaaagagagctcaatggaaattaaaataaatcacagtccattgggtcactataaatgcattgggtaattttgagaaaccattttaggccaagagaagggaaggtggaaaacttctgtttcaatgaaatgaaagactaggtaatcttaaaatgaatgaggattaaggaaagtgaagacaattttgaaacattaccaagtaagaaggaagccttaggcaaaagttggatgaatttgttgaggaaatggtccacatgttctgttctcattcttagcaatgttctctgcctaggactaggttctaagaaaggtggagctgatgaggcataaatgatcaaaggtcaaaacaagagtagggcattttacagtggtaatgaatggctaggacaggggttcctagccagctgctcattggtttttcctgctgtgtctggctagacaatagagggttttatgaaggccacaaatacttggtcccccttcctcatttctctttctctgtaaaggcccagtaggagtcagctccatcctctctccttacttttccctgggacctaaactggttatatacttggtcctctcaaatcttacctcacagaatagaaaagacctgtgactccttgattccatacacttacagctctattgcctgatatgatgatgtgttcaggaattcatttcatacttgagctcttccatgagggtagaataaagggaggcaaagtgccttaaccaaaatggataggacagaaaggaaaagtcaggggtgtgggtgagttttatggcgaaaaatttggagatcacagtcgggaaaattcaaaagttggatatcatggaagtaaaatactttcaagcaatttctacatctaacatggtgcctcccagcgagctgctgaagattttacttggagatcactgaggggtagggagtacagttcatggagttgatgagaccaacgttgctgagcttatcagcagaggggtgaggtccagatcctgacgacagtggtagatcaggatggaaaagatgttgaagaagatggacgagggctctgaggagatgaacatttctgaggaaagagacagggtagttgaaataaatgtgatgaagttcaagaacctggagcagtgggaagaggcacatcctcctctggagaagccaaatcttgtaggaaagccaggttttgatttttttgagaaggaaaaggatatgtttgaggttattttcctgaatttactacacctccatgatttaaggcaatctctgtgtcagattatctccctccacctgagatctgaatatagctaataaactgttgggattgtaaatgacaacacactacatgaaaaacaactgtatgcatttgcaaagtctgtaaattctgaaaacaactgagctttagtacctcttatttttttctacttcaggattttcccccttttttaagtaagtaaagcatatgaaactaagttacatattttagtggtcagattcagagccctgggtgcttagaagcattaataattatttaggtcgttgacaatggcgaataggcagcatactcgttaaagcactcaaattaaagtgcacattaggatgtggtcctgatgatctgtggagctaaaaagatcatggtagaactgaataccaggacaaaagtgctatattccaatggctaagctaagagataacttgctggcataaaatggataagctgtgttaaatttgtcctctgaaagaaaagactgaattcaagggtactttttcttgaactgtgtattaatctgttttcacactgctataaagaactacctgagactgggtaatttatgaagaaagaggtttattgactcagttccacaaggctggggaggcctcaggaaacttacaatcatgggggaaggtgaaggggaagcaaggcatgtgctacatagcggcaggagagagaaagcgaggggagaactgccacacttttaaaccatcagatcttatgcgaactcactatcatgagaacagcatgggggaaaccgccgccatgatccagtcacctcccaccggacccctcccgcagcacatggggattacaattcaacatgagatttggatggggacacagaaccaaaccatatcgaactgcataagctaacttcatttaaaaaggaaaaaagccttaccgtcttcttgaaggatgcacacaggtgtttaaataaatgcagtgtatatacttgggctttgaaggtttgagatacaaggctgggatctgctgaaccacattctggatagagctgcattctttaaatatgcaaccccgatgactgattttcttttaagtgaaacatgagacaagtcatattaggtgatgtgtctaaagagtcaacatatttcctcaagccatgaaatacttatcactgagtctctatgtaccatttgtattctgtacagttcttactgagacaatgtgctaatgaaacgtacattctattggaggaagcaaatacagaacaaaatagcaattaacaatgtttatcccctattggctctcatgggctccatatacaaatctgtgatgtccagacaactccttatctctgatgactcctaactttccaccagattactgttttttgaagcattttatattttattgatttaaaaattaaactgttcctttgctttttaaaaaatttatcatgtacatttgaggtttatgacataatggctccctagctttttatttagaacaatttcaaacttatggcaaaactgcaattaattcaacagtttgccacatttgctttatagctatttatttatgtacttttacattcatgtgttgttaaatggattgcatatatttagattaacatgtatatctgtatgttaacatatttttatatactgtatatgtttatattttatgtgcatatttaatcatattcatgcgtgtatatagtttgtggatttttttttcactgatccactcaatggttaggtttcatacataacacttcacccctaaacacttgaacacgtgccttctaaaatgaaagatattcttgcataagcacaattatcatgctcaaaaagaacaatactgttatataatgtagaatttaaattcaaatacctccaattctgccaattaatattcttcatagcgatattttacattcaggatcagtgatgtccctgtagtctcctttaatctgaagcactttcccagcctctttaaatctttcatgacattgatatattagaagaggtcgggctagatgttttgtagaatgtcccccaatttgaatttgtctgcttgtatccaagtgattgggttcgggttaaatgttttatgccagattaccatataggtaaggtatcctcagtacatcacatcaaggttttcctcaagattctccatccccttcaccgttcttcactctccctgggcgctccttccatactttggcttctgctatgctgacaactcttaagtcaagatttccagcccagacctcccacctgagcatcttctggataaaattataaataaaaatatagcctaatctgaaatcatgatcaacctttggagcatctcttccaatttcccaatctatacaaagtcattttctaccccttcttcctttacctgccttccttagctatgttccaccaccatcaatccagtcaccaaggtcagtgtgttttgctacttatgaaaaagagcaaaattcttcaattcagctacttctgcccaaatttagccctcatcatgtgttacctgaacagacaatatgaatactttcctaattggttcctctgcctttggtctctctccctttctaagctatcttccagaaacttcagttcctcttctaccattcaaattatatcatattattcccctctttaagcattttatgccttctgtttgacaacagaataaatgtgctctttggccttgagtacattatgttcttaacctgaaatatagcatcctttcttttcactcagtgagttttcttttggaacttaatcatgcattatatcattctggttttgttgttgttgttgttgttgttgttgttgttgtttcttttgtgtgagacggagtctcgctttattgcccaggctggagtgcagtggtgcgatctcagctcattgcaacctccacctcctgggttcaagcgattctcctgcctcaccctcctgagtagctgggattacaggctcgccaccatgcctggctactttttcttgtatttttagtagagacagggtttcaccatgttggccaggctgttcttgaactcccaacctcaagcaatccacccgcctcagcctcccaaagtgctgggattaaaggcatgagccaccacacccagccatgttttcagccagttactagtacttctttcttctgcctacaactccctagaacttaagctccttaaggacaggatgtaagtcttgctcattgtcgttactgtatgaggatactctgtgcaacaaacaatcagtaaagtgcttgttgagttaatattttagaaatcaagcataatacattcttgtgtacacatggaacagcccacacgtttaggaaatttagctactagtttcagtatctttcaccaccattcacaactgatcagctaataatcagcaacaacattgtacaccataatatgttaaaggtgttacacacagaatttatgtgtgaaattgaaagcatcggtcctatatcatatggaaaaaaattaattgtagccaaatgttgggtattggatacatcagtgtgctttttcttctaaaaaatactggagaaaggcaggaaatacacaagtactaagataataacacatcaagtcggaaactggttaaaatccaaagaaaaatgttggtgggcgtatttgttcatacacagccccctttatgagaaaaaataatttcttgtacacagctcctttttaaaaaaaagagaaaataatttgtttagattcagacaaaaacacaggagtaattcttgtgtctattctgcataggctgcgtaggttctggctaaaatcactttttaagcagatagaaccattatcagcgtttgaatcaaagggaagtgagtcagatgggatatcttcccttcaagaaagggatctgaaaccatcgttatatttcagaagactgaagaatatcttgccatggcaaagcattccttttcttttttctcggattaaattgagtcatcccacttcttttttcttcacttcagcagtgattaaaggagactatcatattttgctatatcacggtactatttaactttgactatgtctttccttattttaaaaaatgtttcagtgatttatttggaccacaatcagacaagccaggaagaccaaatagctaataatccaaaaaacattatttttctctttttattatttcagtagttttcagggaacccaggtggtgtttggttacatgaataagttcttcggtggtgatttctgacatttgggtgcatccatcacctgagcagtgtacactgtacccaacgtgtagtcttttatccttcacccccctcccacccttccccccaagtccccagagtccatggtatcattctcatgcctttgcatccgcatagcttagctcccacttataagtgagaaagtacaatgtttggttgtctattcctgagttactttacttagagtaatggtctccaactccatccaggttgctgtgaatgccattatttcattcctttcatgactaatattccatggcgtgtgtgtgtgtgtgtgtgtgtgtgtgtgtgtgtatataaacaccacgtacatactgcattttctttatccactcgttggttgatgggcatttaagctagttccgtatttctgcaattatgaattgcgctgctataatcttggtatgcaagtatatttttcacataatgacttcctttcctttgggtagatatccagtagtgggactgctggatcaaatggtagttctacattttagttctttaaggagcctccatagtgttttccatagtggttgtcctagtttacattcccaccagcagtgtaaaagtgttctgttttcaccacatccacactgacatctattatttatgcatgtttgtggaaatcaccttggagtagagtcaagtttaagtgttaaagcattgccatcaactaagtttaaaatcccccaaagactagcaatatgctatttgagcaggcaatgaatctgtgaagtagggataagggctgtgcaggtctctagtgtgcaactggaactcagtattttcttgttgaataagtgaaaaaagtgaaaaggtgtttttgtttttggtgatgaggggcttgtgatgacaggtattattgttagagtcagaaatattttgaggttgcctattaatatggtttggctctgtgttcccacctaaatctcatctcaaattgtaatccccacgtgtcaggggagggacctgatgggaggtgactggatcatgaagaagttttcccccatgctgttctcgtgatagtgagtgagttctcaggagagctgatggtttttaaagtgtgtggcacttcccccttctctctctctctctctctctctctctctctctctctctctctctctctctctctctctctctcctgctgccatgtaagaggtgccttgcttcccctttgccttccaccatgattctaaacttataatcatgaggcctcctgaggcctcctcacgcatctggaactgtgagtcaattaaacctctttcctttataaattacccagtctcaggtagtatctctatagcagtgtgaaaatggattaatacacctattatgttgtagctacatagtgtatgattagacaagccataaatattatatctggcttgtttcatgcccataatagtgtatcagtcagctgttgctgcataacaaataaccacaaaattctcaagttgcatatttctcattcacgcatctgttgtttggctgaacttttgctggcaatcagctggacttgacaccaagttgtggtttgggttcaggtctgttcaacatgtctctcatccttcttgggctagcaagctacctgggccatatgcttcttgtgcacataaacacaagcgggcaaccccaaccagtcaaagacattctaagcctctacttttgtcatgcccgcttacattccattttccaaagcaggttatgtggccaaatccgaatccccaggccagggaagtactgttttcccagctcttgttcactctgctttatctacattagacttcttgctgtgcttgaggaagccagtcacactctcctctcagagtctttgcatttgccaatccttctgtctggagcacttttccctcaaatacttgtgcaactcataccctccagttcttaaagcttttgctcaactgcatctcatcaatgaggacttccaagactccactttctgatgactctcattgtcccttgctagccctctcctcagagtgttcatcaccactcaagatacctatatagtttacttatttacttgttaagcctgtgtgcctccttatgaatgcgagtttcacagagagagtgtgtgggtggggtttgtttgcttattgctatatcttcagtgaacaatatgccaggcactgttcaaccatttgaacagtgcctggcatatatagttggattttaataaatatttgaataaataaatgaatcttactgtttttaaacttttgtggtttttaaaaggcattttaaaaatctgggttagtatcaaatattacaatggtattactttaacttcaggtttcatttagctgttttaacttttacaatatattctgacacagaaaatattaggcattaagcatttttcaatgagttgattcacttctactcatgcacatatgtgatgtctgatttcgattcttaaaaagagatgagcctgggcgtggtggctcacgcctgtaatcccagcactttgggaggccgaggcaggtggatcacgaggtcaggagattgagactattctggctaacacggtgaaaccctgtctctactaaaaaatataaaaaattagccaggcgtggtggcacgcgcctgtagtcccagctactcaggaggctgaggcaggagaatcacttgaacccggaaggcagaggttgcagctagccgagattccaccactgcactccagcctgggtgacagagcaagactccatctcaaaaaaaaagaaaaagagaaaaaaagcaatgcattaaaaccatcttgagaaatcatgaaaatatggagaaaagaagaaaacaagattatactctacttgtttttatactacctagaatgtaataggcactcaaaaaaatgtctgaatggatacaattatcactgccttaaaagttttccattaaagcaaagaagccaattttacatttgtattatacttggacactcatattaaagactcacagagagtttatctggaaaaataaacttggctgacatcattaggtttatactttataatttgatctttgaaataattcaggaacaggaatgccagtcacttcattgaactgtacctgaattttaacacagtacaattgagttcctagagctccaatatgatgtaattaaactgtcagaaatattaacatcgatgttcatgagcgtcgttcatgatgttctcttggttctgatttattcagtgaggcatactgtcactgaagtggacttactgccattaaaaatgcctcatgtttcccagttccgcaaaaatttgcatcagtaatgaaacagagagatgtaatcagccctgcagttgtcaggatcttgatcctcttggtagtatttcattcatttcatcttcaccagataatggtagtttaaaaccgcaagaaaaatgaaactaaaaatagtgaatttcacttctttttctaaaggcataaacttaagcaaatagtgcatgtgtgtgaggggggaggaagagagagagaaagaggagagagagagtttgtaactattccttttctgctttgtgaccttaattcttcagcacccatttcctgtacttaatattgcaaagaggtttcctgtggtatgttaccaggagactcatgtagtctgaggctttttatctaccttacgttcttatccctccattctaataaaaatatgaagcctcacatccacctagaatatgattttgtcttaatggttagcattggcaatgattcttttagcttctgctgttaaaaaaaaaaaaaggaataaatgcaggattctaatcaaacatgaaaatccaagtggcatagaccaaagggaatgagaagcatatttaagtcatttagtcactggcttccgaagcagttccaagtcagatgtaaacctgaggttgtccctaattaagttcattatggttgacttgctaaagcaaggtcttgttttagatggaagtgacaatgtgcaaaacaaacagagcttgaatagaagttattttcactattggaagattgtatattatgaaaagttagtttcaaaggacctttaaagtttaattttgtttgcacctaagaaatttccctttaacttgcaaatgctgtttgaagtgtatttctttaacacatgaacaaacaatacagacacagattcacaaaatctacaaggagatttccattcccagtgaatatcatccatccataggtttctttgcttccagatcatcattctctcctcacataaacagtcaaaatgtttgtaatgtcttctttataaaacccaaaacataattatgataaagtagtcccaagtaacagaggaaaggaccataactctccaatatatgccatatctacagtttttagaatattcatatttcattacctatataggatatatactatttttatttctattacattggagtttaaaggtacttgagtttcgtttgtatttttggttaaatgtcaaaacaaagagtgaaaaaaagacctcagtgtctcaactcccttcttaccttcatgaagtgactgcaaagtgttcaattcttactcttttgtgttgaggagacagcactgcaagtgtgcagtaatacttattttattacatagaacaaagtttcacatttgtgaatggggcacaaaagagagcttgtcagttttacctttttcaattgactttttcttttattctttttaacttttaaatttattttttgtttttttgtttttttgtttttaaatagagacagggtctcactatgttgcccaagctgctctcaaattcctggcagcaaacaatcctcccacctcggcttcccaaagggctgggattacaggcatgagcgaccgcacccagcctgttttttactgtagtataatatttgtacatatttatggagtgcatttgatattttgttgcatacacagaatgtgttaatgatcaagtcagggtatttagagtattcattatctcatgtatttatcatttctatgtgcggggcacatttcaagtaactagtcaacttttaaaaagatacgcagtaggctgggcgtgttggctcacgcctgtaatcccagcactttgggaggctgaggtgggcagatcatgaggtcaggagttcgagaccagcctggccaatatggtgaaaccctgtctctactaaaaatacaaaaattagctggacgtgttggcgcatgcctgtagtcccagctactcgggaggctgaggcagaagaatcgtttgaacctgggaggcggaggttgcagtgagccaagatcgtgccactgcactccagcctgggtgacagagcaagactccatctcaaaaaaaaaaaaaaaaaaagatatacagtttttttttctccaagggtaatgatatagataaactactgtatggatttcttcttccctttaaagaattacttcctcattattaagcttgagggttttctttgttatttatgagcaagtgaaatgaatttataatggtgttaaaaatgtaatcatggccctttaatatctgttttctataaatgtaattttccattatttgtttttgcttttattaaggtgaggaagatcttctcagtcctccccaggacacaagcacagggttagaggaggtgatggagcaactcaacaactccttccctagttcaagaggtaagctccaatacctagaagggactcagatttgctgggatcaggccactcgcttccctacccaactggtgtgtgtattttccatatggaagccaacacgcagtatcagaatggcaatttgggtccatggtgaaaagatttgatttttaagtgtgaatttgtggtttagagtactctgaattcaaatacccgtgagggcaacatgtttccaaaaataagaataccaccctctatttgtcaagtattttacttgcttcacacattagtctgaagagttaattatgaggtgccctttactgaagagcaattattatgtgacttttacagatgaggaaattaatgccctgatagtgcctttgccagggacatatggctactacgtgctacagcaaggcctagaacaatgcctactgattggtagtggtagagattctgacttgccatctgatgccctttatatttaaaaattgtatcttactccatcatttaaatatagggacaattaaatcttcatagagtagttggttattttttacttcgatagaggaaatacaggcttagcaaagaaagacattaatatttttctttttcttcatcactttggccttgcgtattttacccccatacaaaaacagcattttaccctgcagaattttcccactggcttgcatgagcttcagatgtcttgcttcatccaagatgatgttttgctgctactgttcgtttctgggggcatttatttggtttattgccctcacataaaacaaagtcactctctcgccttccttcaacgaataaaaaggatggtggcagtcacctgtgatcaaatagaagaaaagcctagagaaacaaaagggagaaaacacaaggctttgtggccagtgattggcacctctaatgggtagcctgggagggacgggcagcaggaaatctgggctgtttgttcctctccataagggcaatgaggagggtgtattgagtagtgtgtttttcctatctttttgttcagtgtcagttaacaatggccatttcctagctatttgatgtgcaagtaaacgttgtgcagtgcacattaaaagcaataatgttctggtagagcgttgctaaggaaccgtcaggggaagctaattttaaatgtctgcaccagccatcttttcactgctgagcgccactgaagtgatgattttaacagataaaaatcttatctgtcttccacccacctccacatcccccaccgccacccgcatccccattctgactatcttaggtatctccttcttctagatgtcataattcataatgagaagatcatacacaggcttgacagaatcaggtgctttcacgtgtctcctcattactttgtcctgcttgcttttactagcacctactacgtaccagtggaggtagtagggatggaaagaagaaatgacaaattccttgccttcaaggtacttatggtcaattgcagatacagaactccaaagaaattcaaatcacagtacaatcattgattactgtatgatcctggccccttgaactggcagcttgcttacctgctctggaaagttgctggctgccctgttggcaccctgggcatttcttccacatctaaacaagaggttagtagagaagaagctacagcaaggctcatgactctgcttcttcataggcagccttgacttcctagactcctttttgtacctgagtttctggtccaccctaattagctgtaaggtgaaatcctttgcaccatctccctgtgtcccgcttttagagtccttaaagctagataccacatgggtgtagaagcttcctggaagacaagaaatatacctcctctgatatggtatttagcagtcagtatctctgatgttgatttacttacttgtatggaaacttgggaaactcaattcaggccacctggatagtgtttactaaattagtgcttacggaagaatttcaggccttaagggctgatttaagttctcaaatgtgggagaaggaagccttgtccgataccaattccattaacttaagttccggcttactcagtggtacccttgtggcctgagaaaataaattcacattcttaaaaaacaaaacaattaaatacacaaaaaacacaagagagtagctaaggtattggaaaatctggcctatcattctgtaataccatgatcttggcatttcctcacgttttgctactttcagctaactcaggctttcttacaggcctttttctccccaaattcaagtggataaaaagtttcattattgtaaaaattaggctaattattgatgcactcaaaaaagtggtttttggatgctttctttccaactaaaagcacttttgttttttaattttgaaaaatggcatatgtgtgtgtacacacacatataccgtcaagtttggcgggaacatcttaccagttggtagatgtgttcagctgatattaagcagaaattcttgagaatcttaacatcttgggattacaaagtctttcaaatggaagagccttgaaaggtcattttaacacttttgacatccaggacagtgatttctgactctgttttgatggttatccatatcagaggaacattttacatcacaaactggggtaaagatataaaataaattgtacatgtgtttatgtacacacatgtatatatacacccaccatatgtacacacacacatttacagtgtcatatgcatacaaagatcagaaacaaaagtttcatcaagtgatgccttccatactacatacagtgcatgctgtttttctattttatttatttaaaaacaaaatgctggttgcaacccactaaatggattttctgaaccagtggtttaaaaatactaatctatgtgatctcagtttttcttgcctggttgaattatctttcaaaaaaatttaaattttgagatttttgccgtggaagtttctgccaagacgttgctaatgtctcagagacctttatagttttattctaacactaccatccatgttctcattgttgtgttacaaaaaacaaagttcatgattgctacagctgttttggacagctgtttgagtaactcaaaacagatgtgagagccagaggtctgacatttagtggaaatgtgctattaaataccaccgcgtggtttacttaaccctgctagataattgcccacagaggaaaagccgtttttaaaaaacttatgctcttcataaacataaagtatatagataggtaagctattatgtacctcaaatttacaacttttctgttgccccttgccacagagttggtcctgaaggtgtcagctaacctttctttatcttttattttcacaaagagtacctggaagccaagaaaagtcaagtgccttatttatggccattcagcaggttaagttaggcttctaatcttatcttaatggctttgctaaactgttatcaaaattaataaatgagtggcatgcttctccatttagtgataaaccgatggccaacactatcctgcataataggcaatataagcaggagcatattcaagatatgaatgtgtaaacattcagctttgtgattatatctttctggttggtctctagatatacttagttgttcacaaacacttgggagatttgagtggctcagtgtatatttgaacactgaatattagccaatttctatctaatctgtctatctctaatctcttcctttgtaagtatatgtgtagaaattgaattatagtgtaataagtcattatctactttactataaggtactctctaaagctctgccattctataggaaaactacatgggtacaataaacaaacgtaatttaaaaaataaccccattaagtgatttgtccataagtctctgatcatttagcagactaacaaagatatttttatatgtatgtgcattgatgaaagaaacgctctcctagtcagtagtatggtattaggctctctaaaatgtggtaccactttatatagatgaatgaataataggagccaagataagctcttaatgcagtaaaacaatccagaaagcagttagcagtgctactatttctgctacctgtacaatctcttgcctactgacctgtgccacattatctccaccagcccatgccatcctctttttttcataccatcccctctcaaataagcccgcgtacattctatcaaatacccctaaattaccaacccaacagctttgtaaaacctaccgtcttttaaaattaaaatcttattctgtggttcttttatggaagagcaacataaagaacaaaggcagatagaaatatggtgtgccctttttcaggcaccattctgtttcctgtatgctcccacaaaggatttgagcggttatccctttaatccaggactagcaaactacatacagcccaaatgccaaatctggcccaatacctgtttttataaagctttattggaacacagccatacccattcatttacatgttgcctatagttgctttctcattaccagggcagagtagttgcagcagtgctgaatagctggtccagagaccgtgggcttgcaaagcctgaaatatttactatctggccctttatggggaaaatttgccaatccctgctttacgctattatttcgttgtccattctgactcattacatgtatagagtcacaggcttctgtgctgatcaactttcagctgaacaagattattgagctgaaattgaattgatttatagatttatattcatattcaccaaagagcctgcaagtgtggccatttgaatttttttgacttataaaataacagaaatcctaaaaagggacttattcttccttaagtattttaaatagtcagtgaattaatataaaagaggctaaaagcacccagaaacagtactgtcctgcaattccaactctaaaataatgaattacaatcaataatgtcaattttatagtgcccgaggaaattagacttctcgggacctgaccaagccctttatttagactcaggactgccccagcacacttcccttttgtcttgattcatttcctgacaacacatcacattgccagatggacactgtaactgaaggtctacagaaactcatttccaaaaaaaaataaatgtttagaaaatgaaacatatctgaaactttatttatcggtcaagaacttttaaaaatgttgtaatcaagtagcctctgttttgtcagcgtagaactagtccttttacagtagaaaatatcatttgtttttaactttttctaaagtgaaaaaaaggaccttccttttgtaatgtgttaatgagtacgtggggacccaagtgatgagggaggattttagaagagattagagttagcttggctctgggaggtccattttcataaaatatggtttctgaagaaggatctggaacataacacaagtcatttgctgctacatattaagaaataatcaattgataactgagttctgaatatggcttagtgtagaattactaaagatatgtatcattaagcattcaaagaatcatcgttacattctgaagtacataaccataattacattctaaatcacatggctttctaacaacactgtccttcctaaagatctcaagttttcaaaactagaccaaagttacatgccgaaacaagttacccacctttggcatccaaactaaagtgtgccagtgaagggcaagttacttataacacagaaggactcctcttggtcatgacccaactactactttaccaattcacttcagccagtatttatcaaataccaaaagtgtgtatatacggtacagggcattgggcatagagaggtggatgagcaacatgtggaccccgtcctcaagaggcttatagtcttacaggggaagggaattaattctgccaccagacagtattatgaaacataaagatacttttttaaaaaaaccttgctaaaggaatcaaaaagaaggggtgagtgattcatactgggatttcagccatcaaggaaagaatgatgttctcctccccaaatgatgggaacatcatttggtatggatctcccactagtgacacccacagctgaggagctagtacccatttttctccctcttttccctggcttgaggagcatcttaaatacctggcccttacgtggtcaagctgaaaatctgatactcctaagaaatcgctgagtcatgtaggaaattcagaaggaagagaggaagggagagaaggagaaagggagggaagaaagagaaggagagagggaagaaaaacttagaaactatccttaaatgtatactagaagttttgaaccctaaccttgagtgagttttgaaaggtttctattggtgtcgtagctccatacctcttcattccagactagtagttctcaaattgtttcagggagtttttagtcttcttggagccactgagaatgatgggtggaggggaaagggagatgctgtacaggatctctcacagctctgctttgaactgctcaaaatattggaattccatataagattgttttaggagatgtcccattgctatagttaaaacagtttgaaaaccaagattttaaaggaaattgcatgcccaagacaggctattgacatgtatggacagaagtccctacttttctgtccaattatgacttatcatagaacactttctcatcagagtctacttttgaaatacaaataaatgcatacagatgtaggaatctatgaatcaaggccagtgggtctttagccattgcctcgtaaggctcctgatatttgctgaattggggaggaagtggaaagctcattcctggatctggctctgtggcttgcccattactgggacttacctcttcccctcatctgttctttctgttttctcaaatgcctccaatttcatcatggaaatgctcagcttctatcagatagaacaaattctcccaagaggatggagtccagcctctatgtcgggttctaccttgcatttgatgtgcagactttgggcacacagagtcaactactgtttatgtttcaatgtgctgattgtcaagagtgaagagattctgagactttttttaacattaagtttgagttgtccttgaaaacaatgcccaatttgtcagatttctattctgtgccagttttcatccagtttaatgcgtgaactctatggattttacaaatgacgtcttctggatcatgttatctgtttacactgatcttaagtgtatgtaaaggttatttgactagatgtgtcttttgggttttttgtttctgtttttttttttttttttttttccagcagagaataaatggtcatctcaacatttgtttggtaaaagaagcaaattggtatgaaattgtatatttatgcatgttttttttccctttctgatatctctgcctcttcctctctctattattaaaggaagaaatacccctggaaagccaatgagagaggttagtgagattcaggctcacggccatggcttctgtctgtctcatcctgctttttatgtttggcgtttgtgtaagaattgtgtgtgtgcacgcgcatgtgtgtattacacattgtgtcatcatgtaaggatggtagtcacctctccacttgcagctcatgaggaacattcctcaaatgttcattgccgttgtcatcaccatgacgacaagactggggttgggagcaagaatctctttaaaatggcaatcctttgtagtccctaggttggaatcctgccgttcatcatctgttgccatttgcaacactaacaaaatcttcaaaataaatttagccttgaacataactgatgagtcataaagctttcttccacttccaggaccttagcattttctgccagcgcccttagtttttattcttctgggatgacttcattttgcttttgtttccttttttcttggttcctacgctctttctctcccattttagcgaacattttttgagcacttactgtgtgccaagcattgttctcagcacttgccatctttttcatcatgtcatcttcatgacaaacctgtgaggtaggtactcttattaaccccgttttacagataaggagactgagtcaatgagagagtaagcagtgtgtcccaggtgacagagccaaggatttggatccaggcagtctggctccagacccacactcttaactctcatttgaaaggcttacatcatctcaacgtacccttcagaagatgatcttttttatttggtatttgaagccacacagaacaataaccaattcgattaaaaaattaaatattggagttttgagaggtttttaaaatgcctatttatgggttgaaagggatagggtgcagtcttatcactgaatgtggtttcaggttttacggtgaaagatgcttcttactcctattccaccaggaatattgtctgaatatcgaattacctaattaagtgactgttggatgacaaagtgttaactgacagcccaagtaaaatcaaggttgtctttaccaagaatttaatctgaaggaggagagaaggaaagctctcccatgggatgacagtgttctgggagacaggctggatgggtggagagtccttcttaaatgagaagattctggattccttagcaacaggatggactggagagaccactgattcatttaaacacaggagtcgtaatgaaaactctgccaacatcatgccatacaagtctaatcaatttaatgattcttcagtgtgtctgtgccagtgcctccttccaaggctttgggcagtggggccagggagggaatggtaggctgggaggagaaattgaggaaacctgacttggtgaagcattgaatgcccctgacggtttgcctggttcatgtacttcgtatgtgagacttcttgggttcattcttatggtaagtgccccttaaaatttattcattttaactttttgtagaaaaatgcaccataattttgaccaccttaaacatgtttcactcacaaatgaatttcagaaaaggctagcacatgtaattgaagttatataggcatttgcagacttgactacctgaggtgtatggtgttcagacaagtttccagaagccaaagaatcaaaacaataatgaccttttttaatgctatgaaaatatcccaaatgtacgtaaagcagatttttttcagagattaaattatagagaagaaaagataagcaaatttccctgtagtattccggctttcctttggacaactgaatgctaacaatttatttgggaattgtatttttaaaaaatagagcaccagattgctattgaggtcttggatctttgccagaaagtctcaattccaatcgctgtggaaaacaattccctcaggcagtggtgacgtgtgagactaaatgtgttgcagttagcgccaacttgaaaaacatacaactgccctaatgttcaaggcatagtgcctttgtgttcaataatccttaagaatggattaaatcaatactttctatagacatagttttctgtcaccttgtgcctgaaggtgattgcaaatgcctgaatcctggctgcttttcagtacctctcatacttcatagtatgagattgtaattttgactttagaaaaatctgtcaggtaacattaatgacctcccgaatgctctgccttacacacatggataatagaactaggatacaaatctactttctatagtcatgtcacagtgcagtcttacccctccaacggattaaagtatgattctttagggcagtagtttgtaaaaagagattgacttcttttttctggatctaatgaaaaactccatggaaagaaattagaattatttattctggtaaagcaggtatttagtgaagtaaccaaaggcataatatagatgatgaggtgactctaaaagttctttatttttatagcacaaagatggccacaaggtcatttgtgaaaatgcagcagtgtaaaccggttaaaggccacccaactttttgtcggagtgtgcatggcacattaagaataatgaacctgttttccctggcaaatctttaaatagcagatacccctagaacttatgcttcttgagagactcaagaattttccttccagttagtaactgaacaccatttcaaggaagagaagcaccacttggctatataatccataaatgcatttatttgttttattatattttgaactgccatctacatcccctagcacacagcctaaaaagaaagacactttgtgattatcgataagctgacaggaaaaaaaatgagttttctccccttttcgttgatgttttgtaatatgttttctagctactaggtggactacatactatagtcacatgtgggccatgagaaatacttcgaattacattcaggcaccatgttgtaaaggtcctggactttgtttttactgattttgttaaccgtaaagatcgctagtaattaaaaattggcagttagtccatctatcttcaatttatgcatgaataattatgcagatttcccagggttgctggacagccaaaaatagatacaggggaagccctccaacttgatagcagcagttatatatttgtactctgagctctaaggagcagcaaaggccccactgtgtcgtcttcctgtggtttttatggcacagaaagccaaaaatgatttcagttcttcactgagggctgccaaactattggcccactttatgaatagttgcatatgctttgttaaaaaatttttatacttgcagtctcagccaaaatccaaagtgattttctaaaatataattaatactccatgaaattctttgcactaataaagcacaaaaagatagatatacaaacttggtcaccttaatagaaatgcctgaatgacattaaacttttaataagtaagtcttcagttgatctggtgccatcactgtttaagtgcctgcccgtgaatccgcttcattttgtagagaagctatatctcttgaaataaatattaaaacaaaatactctccctagtctatagctttaatttttattgggatatctttaatttttattggtatttttaacaattattatgggaatctgtaaagttgatacatggcaaggtagtaatagcctagtaaagcatttcagttccaaagacaatacttgaatagtggaaggatttaccaatgtgcaataattaaaattagccatgtaaaactatgggacatagacgaaaaggcaagccataaagtaagtctcagattatcttactctaaatctgaattttgctacgaagtacccagggacattgtgctgttctttttctccgtgctgggagattcgtgctaggtcgtgctgcattattagtaaaaggctattgtgatagttaaccctcatttaggaggagctctaagatggattcacaaaatacccaaatgcatacaatacatgtgggtcaccttataattagggtctagagtaatttggaatgtaaagcaatttttattctgaggtttcctaattcaaatgttaatagtgcaccaaaaggtcaattcaagagtttattattattatttttcaacccaagtaaaagcagagagaaaatagccacctccaccatagcctcagaagcaagccaacagcctgaaacagctttgaaatgaaaagttggtgtggcggtgatggtggcagtgataatggtgacgatggttgggtgctggtgatggtagtggtagttgtgaaggtggtgatggtggtttgattgatagtaaaaaaaatgttcgttaatacaagtagagagtaagtaatcaatcaatcactcatagccaaggtggaaaagatgtatcccatcatggaatattcctgttctgatagaaatcttgtgcttatctatggaattcttttgatatatatttacattgggaacctgaatgtagcttgacatttttccatgtaaacaccagtagcctgatccaacattaagctgatactaacaaacaacgtgtaatggcttcattaataaggctttgcttcttcctggaaactggtgaaaaatcaaaccttgttgtgtacaccctcgatgcagcttctgtgttgtcttcacccagaaatggggaatgatttcccaaatggcaaagaaacagagtgatgctatctatctgcaccttttgtaaagtctgtctttctttctctttgttttccaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcat

SEQ ID NO: 4470 - DNA, 215772 bp, human
gcttttgatgacgtcggtgaatccgtcctcagcggcattttctggggtctcctgcagacccctcagctgtgccataaccaaacgccacgtgcctcagcttcctcacgccccaaactttggaaggcaggtgggtccgcgtgcggtccgtttgatgctctccacagcaggtctcgctgaggatctagtgtgtctgaggatggattttccctcctccctaggccctcagccacggagatggggatgcggggggcgcggggcggctggggggagcttgaaaacgcagaaacacagacaccttagcgtgggttggttgaaagagggcgccgtcaaaatgcccaccccatccttagagacgaaaaacaggtgctgttcccagctcctggctctaaaatagagtgggcgaggcctggaaggtgaaagctgaggagggacctggtggtcaatacacccacaagcaagttgacgactcgcttttccacgctgcgcagaatcgatgcaaaaacaggagcaattagggagccgcttgccaaaagcagcacatgaggtcatgaatgatttagcattgccacttagaagatgactacactgacaagaagggtcactggttttagctatctgggtcacttacacgtgtgtaccccacttttgtatcctgacttgagtgcactgaccagacatgggtaatatatgccaaggactatccattttcttaggagatttcaccaaagctacccactcttctctcagtgcatatgttcactctgactgcctcctccattccttcctcccaccactgaggctagaattagattggactataaacagctcgtatgactttattttctaaaaatttcagaagtgactttcatttggttagtatccttactccctcccccacctccccacacacataactcatcctgcatttcttcctgcagtagcccaataactttaaatcctatccatcatctactgaagaaaaattaactttgcaagaggaacttggcaagggacctagcaatagctaaggattttcttttcttgttttcgtctgcattttcattcaaagtagatgcttatccttttctaaaacactggctctcgactatgactagacattggaatcatctgtggagttttaccaaaaaactgtttcctggtttccacacccagagatgccgattaattgttctggtgattccaatgtgcaaccaagttttaaaaacattgataaaatggcctgtacacagtcaatttggcgccttctttaagacaattttgccagcgactctgttccattcctattataatacctttaataaaaacctaatatgtttgccgtcctgtttttcattgccaagttgacccttttcatggcagtggatactttattttgacaaaaacttagtggttagtcttgactacagaattttcttagattcaacctgcgctgactctcaggatggattgtcaactgggtacctttcaattagatcttgatcttgagaatttatgcctattggaaatctttgttgacagaagacctcttaggtttcccaagtgcccattttttttagactcgtcagttctatttttagcaatttcaagtgggaaatatttagaattatagcacagctcctattaaagagaggtataaaagtatgaaaattatccagaatttaaaaaaaaaaagggttgtgacatagtacattttatatcatcaagccactactattagaagaatatggtattggaacaggaagagacaaaatggaaaaacaaagtagtactcagaaatagatccagccaaagggaatgtactaaatatgacattttaattcattcattaaaaaactgaatatataatgattatcttttcataaagttagactttcctaacttaaactaaaaaaattctagatagattacagattcaactatacaaaaatgaaaccaaataagtgatgaatctatagcagtttgagttatggggcattcttaacccaaacactaattccagatgactttaaggagaaaaatgggcctggggcagttgctcacacctgtaatgccagcactttgggaggtcaaggctggcagatcacttgaggccaggagttcaagaccagcctggccaaagtggcaaaaccacatctctactaaaaatacaaaaattagccaggcgtgttggcgccagcctgtaatcccaactactctggaggctgaggcaggagaatcacttgaacccaggaggcagaggttgcagtgagctgagattgggccatcacgcttcagcctgggccactccatctcaaaaaaaaaaaagaaagaaagaaaaatgacacttgctactacataaaaaataaatatttctataaagccaaagatgttacaatagagcaaaaagacaataaactgagaaaatacacttagaatatctatcacaaagacttaatatctctattttaatacaagtctacaaattgatttgaagacagaaatacaatttaaaaaatatataatctgaacagaaaaaccacaaaagaggacaggcaaataaccaatacaattatgaggaagtagtcaatattctcatagtcaaaaaggcaaaatgaaataacatttcctgcccatgagctggacgagaaaacaaacagatggaataacattcagtgctggaatgggtgtgagaaaagaagctcttaataatctctactggtgaagtattgatacaatattttaagaaagtaacctgagaacagctatggaaaagtccacaatcttttgcccatcaatccctccttaagaatctatcaaaaataaaatcactagtatgtaaggatatatgtaagattgtttactgaagccgtgtctaaaagaatacattcattgaaatcactctaaatgtctttcaactcagaactcactgaagcaatctgattataccaaataatggggtatttagtacctgctaaaagtatgttatgtaccttatacaaattattatcggactaaatacagtgctatattcgaagaacaatatatcacaacaaaactgggtgtatttgggcaaggaaacgtcattttttttctttttcatttcagaattttgttttaatttttaatttttgtgggtacagagtaggtatatctatttataggttatatgagatatttcaatacaggcacacaatacataataatcacatcagggtaaatgttggatctatcacctcaagcatttatcctttctttgtgttacagacaatccaattatactctttaagttattttacagtgtacaacaaattattgtttactgtagtcaccctgttttgcaaacaaatacagatcttattcattctatctaactatacttttgtacctattaaccatccccactctccatcccattacccttcccatcctctggtaaccatcattctactttctatcttgatgagtttaattgttttaatttttagctcccacaaataagcaagaacatgcaaagtttgtcttgctgtgcctggcttatttcacttaacataatgacctccggttcgatccatgttgttgcaaatgacagggtatcattctttttatggctggatagttctccattttgtataagcacgacattttctttatccattcatctgttgatggacacttacgttgcttccaaatcttggctattgtgactagtgctgcaataaacaagagagtgcagttatctcttttatatactgatttcctttcttttggatgtatacctagcaatgagattgctgaattatatagcaggtctattttcagttttctgaggaacttccaaagtgttctacatagtggtggttctaatttacatttccatcaacagtataagagggttcccttttctccacattctcaccagcatttgttatcacctgtcttttggataaaagccattttaactgggatgagatgttatctcattgtaacacttgaaaaccaattgatgtgacccatcacattaaaaatatgaaggatgaaaacaaatataaaaaaagtattggaaaaaattaattccctcacatgaacacgtgcactctcgcgtgcacacacacacaaacacacacacacccttcctgggaaactggaagtagaagagatgtaacttgatctgataaaaagtatctataagtaatctacaacaatgtatttaattaatatactacttaatataataagtcaggaaaatgaaattaaaggtatacagttagagcgaaaaaagcttttattatttacagactaaacatgcatagaaaattcgaagaaccatcagataaaatattagaattaataagtggatttaatgaggtttctggataccatgtgaatatccaaaagttaattgtaattttcaagagtaaacagttagaaagtggtatttttttaaaataatgccatcaataaatcaaaaataaataaatgtataaaatatgtttgagatacctaagcagaaacatatattatgaatgagaggatttaaagaaaacgtatctaaatggaaaactatgtcatgctcatgggttggcagaatcaacattataaagatgtaaactctcaaaaattgatctgtagagtcactgaaatcctaatcaaccccatcaggagtgtgcgtgtgtgtgtgtgcgcacattataaaaatttatgtggacatgcaaaggtccaacatagccacgacaatcttaaaaagaacaaagtgggaaattttatactaacagatattaccaattattatgaaacaattgaaattcaaacagtgtgtttttggtgtgaatacagataactagaacaatggaacataagagagagtctaaaaacaggctcacacatatatagttacctgatttacagcaaaggtgacactgaagttcagtagggaatgaatcgtcttttctataaattatgtgggatcaactggagattagattttagacttaaatgtgaaagctgtgaaagaaataattctagaagataacataagagaatagtttcatgaccttggtggggacattttttaaacaagatataaaatcaccagcttaaaaatattggcatattggcttcattaaagcaagaaattttactcatcagaaggcttcactaggagatcacagagtgggaaataatatgttaatgaaatgttatattaagcaagcaaattatactttaatatttatagtatctcattgaaaaaataaaactctatatgagtgtgtgttttgtttaaataagcaactacagaaaacatacatatgaacacacaaaagagacactatgagattataaaagtgaaggaatagtttatgagcctctgagctgcttaagcttctaaaggctgatagagtaggtaactagaaatgttgcttattatttcattctttaaaaacattttcaaaagttagtttgaagtctgcctggaaactgtctggtgaagatgatcaaggcaatgaaaaggaaactattaaaatctttaaaatcttccttattccaaatccacactgttgtattgtcatattggcttcattaaaacaagaaattttattcatcagaagacctcactaagagacagagagactgaaaaaggaaatcagagaatgggaaatgatatttgtgtatacgtttaaaaaaaaaaagctagtatccagaatatattttaaaaactcataacaatcaataaaaatctatttttaacaaaataagtgaaagattttaaaatatgttgcaccaaaaagatatcagaatgaccaataaaaatatgaaagaaccagatacagagcacttgcctgtagtcccatctactcaggaggctgacacaagagagtcacttgagcccaggagtttgtgtccagccaggataacctaggggagactttgtctcttaaaaaaaaaaatgaaaggatgtttaacattgtaaaagcatcaagtaattaatattaaaaccacaaagcaaaacaactacatacccattgtaatggccataatcaaaattaaaaaaaaaaaaaacagaactgaaaatactaagtattgttgtaagtgtgatgtgattggaaaacccttccacactgtttatggaagtgaaaattgaccctcctgctttgacaaactattggtagaatatactaaaacaaaaatgttgcattctgcatgacatataaattccacctttaagatagattaatcaaaagataggaacagtaaggttcagtgcagtgtttgtcataatagccacaattagaaacaacccttatatgccgcaacattaaaattaataaagatacatggctctattcaaataaatgaatgctatacagaaatagaaatgaatggactactgatacatgcaataccatgcgtggacttcacagacataatttgagtgaaagaaaccaaacatagaaggtgtgtattatgtaattatatttatgcaagggttaaaagtagagaaaacccaacctatgctaatagaaaaccaggtagaaccaatttatggtgttacacgataaaagtggttacctttagagggaagcaatgttcgggaccaggtaacaaaaatgcttgtgagattattaaaatgcctatatcttgatctgggtgatcgatatactcaatgttaattgtgtaaaaagtaatgaagctctgcatttatgattcatgtatttttatgtatgtatctttctgtgtcatattccgttttttaaaataagcatagattaaagttacatgtaaatatttttagatatatttgtggaatgctgtatgaaacaagcaaattatagtttgatatttatagtatttcagggaaaaaataaaaccctgtattatgtgagtgtatatattgtttaagcaactgtataaaaatgtgtatgaacacacaaaggggaaactatgacattataaaagtgaaggaagattttgtgagcttctgagcttcttaagcttctaaaggctgatagagtaggtagctagaaaggttgctcattattttattctattgaaaacattttcaaaagttagtttgaagtctgcctggaaactgtctgtgaagatgatcaagcaataatcatcttatagtcttccatattccaattctaaactgttgtatttatttcaacaaatataaaaatagatttcctaacattttcttattcaaaaatgttggggttagagaggttagaatacctctctttagatgagccatttacatctagatgactgcttaactggctcatacaaatttcagatattgttcccttaggatattgtccagagtaaaagaattccatggactcctgcagaatgttcagttactctacaccacagaatgcatttgcacctaaggagatatgagacattcaaataatatcatgtcaaagagtttttttcagattacctgctaaagccatttattattattttttaaattatactttaagttctgggatacatgtgcagaacgtgtaggtttgttacataggtatacatgtgccatggtggtttgctgcacccatcaacctgtcgtctacattaggtatttctcctaatgctatccctcccctagctcccccaccctctgacaggccctggtgtgtgatgttcccctccctgtgtccatgtgttctcattgttcaactcccacttatgagtgagaacatgcaatgtttggttttctcttcctgtgttagtttgctaagaataatggtttccagcttcatccatgtccctgcaaaggacatgaattcatccttttttatggctgcatagtattccatggtttatatgtgaagccgtttattttatgaactgtccaactagaatatgaacaatatagtataattaaccaaaactccgccaatttaattgtgaatggattattatatcttagaagttctcaaatatggcacatatgtattacactaaaaataagccttccacgaagtttcatgtagtttcctttagcagagaatgctgaactctattatagatgtatgttttatgtactgtcatcactttatatagaaatatccatcgattgcatgagagaactttcatgaatcaacatggctattagttttctcttaacagagatattttagaaaacacagttagaaatatgtgtattttagggatgcagagaaagcatttttccctaggagactggaaatttagtttatatttttagattcctgtcatgggttctgcaaatgtttctaagaaacattttctacacaatcaaggataatttgaatcacaacattttcttattcttccaaatgtatattttttagggatctctttgaaatttttgactactagaatgatctaaatttaagcatgcacttgccttctggtgtgtcctcagactgggtgagttctgggagaagagggaatgttgcctcagtaatgatgatctactaatgctagagctaaaacctatgtgttagacttttctgttaactatctaaaatgatcaatatcccttgcttctcaagatcagtttcgtagattgaatcttgtaaagaggttaatttttctcatcctcactgatcatcatgctaagtcccagaggtaaggaatggtaaagaaattatacctcttgatcgggtagtaccgaagttctggaagaatgtgtggaattgaagatgttcctgtcataatttttagaaatgcaatttgtcacatggtaaagaaaaaaatgatgctctgtatggttaagagaagatttgggcaacaacccagttgtatttggcaaaatgaatctgtgtgtagaagttgtttatttttacttttggcttctgtctgcgataaaaatgaatgatcagcatttctttctagacttggtccatatcaaatttatttcctatttatatagatcatcttaaagagaccactactgtctgcaattctaatttttggatttttatcttggcctgaaattttcactcagaaactagtatgcttcctccttctgttactcactaagctggcctttgacttgacattatggacttctggaaacagctgtgctataactgtatctcaaaaatgtttactcctcatcagttatttaatcaggaatggctatgcatttgataatttttggcaaatactgggtctccaaacgataatagttttagaactgctgatggtagtagctacttagtagtttattccagacttttaaaaaagaaaatgaaattcagaatgctctctaggtcacacagaaaattagtaacagatccataactggaagtagattctgagacaagaaattgaaggaacgtaatttatttgggaggcaatacctggtaatactttgctgcataacaagccacctcaaaatgcagtggcttaaaacaatgacagcctttattttgtttacaagtttgtaaatttaggcagcatttgacataaacagctgatctctgccccagatggtatcatagggagaggctcaaaggctgaggactagaattttctaaaaacgtattccctcctcactcatgtatttgtggttgatactagctgctagttgagacctttgctgggtttgtgatcagaacatttatacatggcctttctgcgttactgcttggcttcttcatagtaaagaggctggcgtccaagttgatagttagaaaatagaaagccaggaagaatctataacatcttttatgacctaactttgtaagtcatccaacgtcacttcagccacattaaaatcaggaagcccatcaccaaggcttcatacttgaagtcccatgtctctgcgctcatttcctactacccccttctctttctcagtttgctccagctatacccatgcctcataaaatattctatcctcaaagattatgtgtcttgtcttgcaaaaacctaaaccattcagaaacagacataaatgatttaccttactgaaataggggctaattttttccagtatctcattccaacctgatcgctttatgtgtatttgggcatatgtgtgcaatataaggatatttattcagcatctggtatatcctaggtgctggaaatacagcggtaagtagacagtctcgttctatggaacttccagtatttttggggaggtaggaaaacattgctcaaataatcacagagatataacctttcagatgtgtcaaggaaatatacatgttgctttagtgcctataatagcaacaattggcttctttggaagagggtagagagggcttatttgaggaagagatgattcatttgagatctataaataagacctaactcactgaaagattttttttgaagtcctgttagggtcaatggcctactcatgatcttcttgtaaatataaaatatatatatatttcaaacttaatatgttgaaaacatggctcaatctctcctacccatctccaccagatatggtcttccaaatgctgtcttcatcactgtgaatagcagcaccaatattccagttttgcaggacacaagacttaattattcttaacatcattcttaatatcattccttaatattcactttatttttcataccttaccttcaaatatatccagaacctgactatatcttcctacctccatagctgcttccctgattcaaaccatcatcatcactctgctgatatgttgcatacccttctatatgtttttcactggtttgtaacccattagtgagccataaaattaattaatttatgccttgtaaatagcagtaaaacaatgccttgcaatataatagaaaatattgaattgcataatgcatagatcaattttttgtaaaacgtatttcagttttatttataaatatataaacatgtagacatatatgtctagatgtatatgtacacatgtgtgtgtccatatatcctgaatctcaatataaaatactcttactgtgtatgaatttaaaatttttgaaaggtatttggattcttcctgcttcaacttgtagcctcactcgggagtactctgaaaacagtaatcagagggatttcctctacaggcaatacattttaattaattaattaaatatataaggcagataaagatacatctctattcaaaatacttaatggactcccatttcgttaaaaataaaagcctattgtaagtcattacaatggcctgtgagtcacatattcagcccataccttctccctttctctctaacctcatctcctgctaatctcacacttgctcatcaaacccagtcaaactggtcttctcgctgtttgtaaaacactccgagcacataccgacttcagaacttttgcacttactattttacctgcctaaagttacttccctttatgtaagttcatgtcgtcctccctcgcctctttcacgtttcttaccttctcattgagtcatccatagcctgcctattttaaatttctgtcatctatcttcaatgccctacagtccccatcatccttgcctattttatatttctccataacgcttgtaatctctgatgtaccatgcattttacttatctgattattttctgtttcccttgacccacattagactgtgagcttcatatggtaattagttttgtctatactgtaatctgcacaattcccaatgactagtacactcactattatgtagaaggtaatcaataagttgttgaatggatggagggaaggagaaaaggagggaggctggatcaatggatggattaaaaaaaacaaatgaaagaaatagaatttcaaggatcgggaatgagacgtaaaacagctctctaaggctgggtgcggtggctcatgccggtaatcccagaacattgggaggctgaggcgggcagatcacctgaggtcaggagttccagaccagtctggccaacatggggaaaccccatctctactaaaaatagaaaaactagtcaggcgtggtggtgcacccctgtaatcccagctacttgggagactgaggcaggagaatcgctggaaccagggaggcagaggttgcagtgagccaagattgcgccgctgcactccagcctgggtgacaagagcaagactccagctcaaaacaaaaacaaaaacaaaacaaacgaacaaaacactctctagctggagagtcaacagaggatggaggatgctttggtccatggccatgagaaagactgaaaagaggccagtgtagctggagaggaaggaatgaagtaaggattgggatggaggaatatatggctagagaggtattcaggagtaaaccaaaaagcaccaaaacacaaaactaagggaattactctatatcctaaaaatactgggaagcctttgaaggcttttaaatttgggaaagcggtggagggatcaagaacaatgggtgatgtcattatcttatttacattttaagtgatagggaaaaacgataattcataaacatggtttaggcctagtgagagaaactatatctctcatcagtttaatctgagttcataacattctctagatcctaaatggtcctagtcacatttctgagtcagttctttgcttagatgtataattcattgactcttttattattttattttatttttatttttatttttccattagttattggggtacaggtggtatttgattacatgagtaacttctttagtggtgatttatgagattttgatgcacccatcacccaagcagtatacactgcatgatatttatagtattttatccctcgccccctcctactctttcacccatgttcccaaagtccactgcatcatgcctttgcatccccatagcttagctcccacatatcagtgagaacatatgatgtttggttttctattcctgagttatttcacttagaatagtagtctccagtctcatccaggtcactgcaaatgccgttacttcattctttttatggctgcgtagtattccatcagatatataaatgcattatatcatatatatttaattcagattacataatatataatgtattataatatatatacaatgcagatgacatcacacacacacacatagatatatattaaatgcagatatatatatcacagtttctttatccactcattgattgatgggcaattgggttggttccacaattttgcaattgtgaattgtgttgctataaacatgcgtgtgcaagtatctttttcgaataatgacttcttttcctctgggtagatactcagtagtgggattgatggatcaaatggtagttctagttttagttctttaaggaatctccacactgttttctatagtgactgtacaagtttacattcaacccagcagtgtagaagtgttccctgttcacagcatccacaccgacatctactgttttttgattttttgattatggccattcttgcaggagtaaggtggtatcacattgtgcttttgatttgtatttccctgatcattagtgatattgagcgttttttcatctgtttatttgccatttgtctatcttcttttgagaactgtctattcatgtctttagcctactttttgatgggattgtttgttttttacttactgatttgcttgagttcgctgtagattctggatattcctcctttttcagatgtatagattgtgaagatcttctcccacactgtgggttttctgtttactctgctgactgttccttttgccattcaaaagctctttagtttagttaagtcccagctatttatctttgcctaagccaatatctagaagggttttttccaatgagttcttatgtgttaagtgagtatcctgaaggcagcagatagttccttggtgagttcttatccattctgcagttctgtatctcttaagtggagcacctaggccatttacattcagtgttagtatttaaatgtgaggtacctttgcgttcattgtgctctttgttgcctgtggactttgtgttgtttttttgttttgtttcttgcttttgctttttagcttatatttttgttttataggtcctgtgtaatttatgctttaaagaggttctgttttcatggtttccaggattcctttcaagatttagagatccttttagcagttcttgtagtggtggcttggtaatggtgaattctctcagcacttgtttgtctgaaaacgactgtatctttccttcatatatgatacttagtttctctggatacaaaattcttggctgataattgttttgtttgaggaggctgaagatagggccccaatccctcctagcttttagggtttctgctgagaaatttgctgttaatctgataggttttcctttatagtttacctggtgcttctgtctcacagctctcaagattctttcctttgtcttaactttggataacctgatgacaacgtgcctagatctttttgtgatgaatttctcagatgttctttgtgctgcttgtatttggatgtctaggtctccagctaggctggggaattttcctcaattattcccccaaatatgttttccaagcttttagaattctcttcttcctcaggaacactggttattcttaggtttggttgtttaatgtaatcccagacttcttggaggctttgttcatattttctttttcttttttctttgtctttattggattgggttaattcgaagaccttgtctttgagctctgaatttttctcttctacttgttcatttttattgctgagactttctggagcattttacatttctaaaagtgtatccaaagtttcctgaattttttattgtgttttctttaagctatctgttacattgaatatttctcccttcacttcttgtatcattttttggatttccttgcattgggcttcacctttctctggtccctccctaattagcttaataagtaacctcctgaattctttttcaggtaaatcagggatttcttcttggtttggatccattgctggtgtactagtgtgattttttttggggggggggagggtgttgaagagtcttgttttgtcatattaccaggttttctggttccttctcatttgggtaggctctgtcagagggaaggtctaaggccgaaggctgttgttcagattcttttgtccagtggggtgttgccttgatgtagtactctcctccttttcctatggatgtggcttcctgtgagccaaacggcagtgattgttgtctctcttctggttctaaccacccagcaagtctacccggctccagactggtactggcggttgtgacactctgttcgcatcagagttctgtgatgtgaaccgtctatgggtctctcagctgtggataccagtgcctgttccggtggaggtggcgaagagttcggtggattccctgagggtccttagctttggtggtttaatgttctactcttgtactggttggcctcctgccaggaggtggcgctttctagaaagcatcagctgtagtagtgtggagagggactggtagtgggcggggccctagaactcccaagattctataccttttgtcttccgctgccgcgtggatagggaaggaccatcaggttggggcagggcgaggcgtgtctgagctcagactttacttgggcgggtcttgctgcagctgctgtggagaatgggggtaagattcctaggtcactggaattgtgtacctaagatgattatggctacctctgctgagtcatgcaggttgtcagggaagtgggggaaagccagcagttacaggcctcagccagctcccacacaaaccgaagggcctgtctcacttctaacatgtccacggctccccaacagccctgagtatgtttacaggtggagggcgagaggggcttgaaacttgcctgaggctctccgcctcccagctgccaaagaaagggctttagttccctgccccccacccccgccccttccgccgcctgtgaagggacccaccgagctcccagggcctttctgctgcttcctctacccctgtattttgctcggctctgtaacttgactcagcttcaggtaaagtcagaaacttctgcaaacagaccttcaacttctcctgtaggggtatgtgttcgggagaggagggtctccctttcccacttttgtagctggggcactcacagtatttagggtgtttcccaggtcctgcagtagtccgcttccttcagagggtctgtgagtcctctcaggattgctgatttgttcttttagttgatctggcgctaaaattcacagtgcaagtctccagatgctgttctatctggagctgcaatgtagtcctgcctcccatccgccataatcccctccatctcctaattccttgacatgtgagaaacccttcaaatttatgcttctggaaaccctgagaatataaagatcatggcattattccaagaagagatgtcggtttatttaatgtactttattaagcaagatgcaagtcagatgttatgattttcagttacaagtttttcctatatctataatttgaagattatagtatactgaaagcattagctttgggctcaattataaatgtattatccaaagaacttgctgtattatccaaatttaaatataaaatagtctttcaataacgattgagttctaaaagtaaaaataaaaggaaagaaataattatactttagacaaaaaaccgtactcaatttaacacataccagacacacacacacacacacacacagacacacacacactccacacacacaattagcctggtgggctataagtagagtgaatgaaaaataagctacattgttttatttttattgtgttaatgcagtaatgaagttaaaataaatgcgatgtcttcttttgaaaggtatctgttcatgtaatttgccctctttttaatgaggttgtctttttcttgtgaatttgcttaagttccttatagattctggatattagacctttgtcagatgcataatttgcaaaagttttctcccattctgtaggttgtctgctcactctcttgatagtttcctttgctatgcagaagctcagtttaattagatcccatttgtcaatttgtggttttgttgcagttgcctttggtgtcttcttcatgaaatatttgcctatgcctatgtcctgaaagatattgcctaggttgtcttccaggcttctatagttttgggttttacatttaagtctttaatctatcttgagttaatttttgtatatggtgtaaaaaggggtccagtttcaatcttgtgtatatggctagccagtaccattaattgaaagggaatcctttccccattgcttgtttttgtcaggtttgtcggagatcgtatatgtgtaagtgtgtggccttatttctgagttctctatcctgttccattggtctatgtgtctgtttttgtattagtactatgctgttttggttactgtagccctacagtatagtttgcagtcaggtagcatgatgctcaacaccagtgatcattagagaaatgcaaatcaaaaccacaatgagatgccattgtacaccagtcagaatggctattattaaaaggtcaaaaaataacagattctggcaaggttgtggagaaaaaggaatgcttatacactgttggtgggagtgtaaattaatttaaccattgtggaagacagtgtagcagttcctcaaagacctaaaaatagatataccattcgatccagctatcccattatgggatatatatacctaaaagattacaaattattctattataaagacacatgtatgtatatgttcattgcagaattattcacaataacaaagacatgaaatcaacctaaatgcccatcaatgttagactagaaaaagaaaatgcggtacatgtacaacacggaataccatgcagctgtaaaaaagaatgagatactgtcctttgcagggacatggatgaagttggaggccattgtcctcaccaaactaacacagaaacaaaaaaaaacaaacattgcatgttctcacttataagtaggagctaaatgataagaacacatgggcacacaaagggcaacaacacactctggggcctttctcagggtggagggtgggaagagggagaggatcagggaaaacaactaatgggtactgggcttaataccagggtgatgaaataatctgtatgacaaactcccatgtcacaagtttaactatataacaaaccttcacatgtacccctgaacttaaaagttaaaaaaataataaaaaattaaaattaaaatgaatgggataatattgtaattcagaaaattgctactaatcaaaatgggaaatcaatgaatgattgatatgttttttcataaaggactaattataatactatgctttgggattttgcaagatactataatgaactcatagataccttcaagtgtttctgactatcacctaccataggaaatacattttatttgtacttacacatacaacacacaaacttacacacatatgtgaaaaatgaattaaagtctcctgaagcaatgatcacccttttctttgttgggcatgctagtatttcctcttctattatgtcttatcttattctatctcatttttataaatactgactatatactactaaattgattttatcatcaactaatgcgttataacacataatttgtaaaaacaacttatatacagtaatggttgctttctgcagaggagtagtagaaaaatttttattaacttcttcacacatcaaatattgagataaaaataagaaaacacctagttgattgatttttccaatgtgcaaatattcaggcagttatttatattatttatattgatatcatttatgcaacttgtaaatctgtgcttaactgttgttcaaatagcctcatggtaagggtcattcacattgtgctgcaaggaaattttgaaggactttattttcaaattgttatttggatatatgtgaatcaagatgtaataactatcttggctccagaagttctttaaatttttatccccatgtgaaaatgtgtatttatcgctctattagggacaattaatcagggaaatctcaaatattaattccaaacatgcaccatcagtgggctgaataactgtgcatatgaataatgtatatgtccttctgtgtatctatggttactgcaatttcctcttacgttgtaatttgtaaaagttatacaagaggagtttaaaaatagtagagtgtaaatgtgactggcgagaggagttggtaacaatagacaacaacccagaagaatattaactaatctacctcaataggacctactgtaccttacttgtgaatacctgaatccatccccagtaggtctaggtggatcaaagggaccatagagaacaaaaccaacaattgcaaaagatctcacataaacggactactaaaatcacttgtcttaaaccatgggtgttaaaaaaaatctatattttctgattcattaaaagcacattttagaccacatatgtaacctaaaccctattattttttagataacagcaaagagttaatatctctactttccagcatgtgaaattctgctgtaaagctttatggtattcttttcttaaacctttttcagtagaagataaaaaaactgccatttcaaagctgcaacaagtttttccagtcacaagaattgaagcctcattgttctattgttttgggaaataaaatgaacatttgaaaaaatcttttaatttcataaatgtgagatccacaccctcctcagaaatagggagatttcagatgctgtggtttttccaaggttgtataggcagggatcatgtttccttttgagaaatgattattggctctatatggatttaaagtttgctttatgtgaaatggtggttatactcatggcattcttttttttttttttttttttttttgagaaggaatcttgctccgtcgcccaggcgggatggagtgcagtggcgcgaacttggctcattgcaagctctgcctcccaggttcacgccattctcctgcctcagcctcctgagtagctgggactacaggtgcccgccaccacactggctaatttttttttttttttttgtatttttagtagagacagggtttcaccatgtcagcaggatggtcttgatcttctgacctcgtgatccgcccacctcggcctcccaaagtgctggcgtgattacaggtgtgagccactgcgcctggccactcatggcattctatgtagctttatctgatctatttatttggggaagacaaggagatgagaagggatttgattgcagttttggttactgtagccttgtagtatagtttgaattcaggtaatgtgatgcttccagctttgttctttatgcttaggattgccttggctattcaggctcttttttcggttgcatatgaaatttcaaatagtatttttaataatttggtgaagaatgtcattggtagttttataagaatagcattaaatctgtacattgctttgggtggtatggacattttaacaatattgattcttcctatctatgaccatgtaatgtttctccatttgtttgtgtcacttccgatttctttgagcagtgttttgtgattctctgtgtggagattttcacctccatgattagctgtatttctaggtattttattcttttgtggctattgtgaatgggattgcattcttgatttggctttcaggttgggtgttcttgatgtataggaatgctactgatttttgtacattgattttatatcatgaaaatttctaaagttgtttatcagatcaagcagcttgtgggcagagactatggtgttttctacatatagaatcatgtcatctacagagatattttgacttctcatcctcctatgtgaataccttttatttttttctcttgcctaattgctctggctaggacttccaagagagagggcatccttgtgagggatggcatctttgtcttctgctggttttcaaggggaatacttgcagcttttgaccattcaatgtgatattggctgtggatttttcatagattgatcttgttactttgaggtatgttccttcagtgcctagtttgttgaaggtttttaacatgaaaagatgttgaattttttcaaaagccttttctgtgtttattgagatgatcatacagggtttttgtttgtttgtttgctttttagttcactttatatggtttgtcacatttattgatttgcatatgctgaaccttcattgcatcccagggataaagcttacttgtacttcgtggattagctttttaatatgctgctggattcgctttgccagtattttgttgaggatttttgcatcgatgttcatcaaggatattggcctgaagtttctttctttgttgtgcctctgccaggttttggaatcaggatgatgctagcctcacagaaagatttggggaggactccctcttatttttcggaatagtgtcagtaggaatggtaccagctttaccttatacatctcgtagaatttgacgacaaatttttctggttctgggccttttctggttggtaggctttttatgactgattctttttaagaaatcatagttgatctgttctgggattcaatctcttcctggttcattcttgggagtttgcgtatttccagaggtttatcagtttcttctaggttttctagcttgtgtgcatagagatgtttgcagtagtctctaaggctttcttatatttctgttgggttggtgttaatgttcgctttgtcatttctgattttgtttatttggatcttctctctatttttctttattaggctagctaatggtctattttattagttctttcaagtaaccagctactgaattcatttatcttttatatggttttttactagttcagttctgattttggttatttcttgtcttatgctagccttgggattgttttgctcttgtttctgtagtttttctaattgtgcttttaaattgttgatttgagatctttctaagttttagatgtgggtgtttagtgctataaacttccctcttaacactgctttggctgtgtcccagagattctggtatgttgtatcttttttctcattagtttcaaataatttctggatttctgccttaatttaattatttatcgggaagtcataaatattgggagcaaattgtctaatttccatgtcattatatggttttgagtgattttcttagcattaatttctatttttattgcattgtggtctgagagcattgttggtatgattttggatttttcacatttgctgaggatcattttatgcctgattggttgattttagagtatatgtcatgtgcagataacaatgtatattctgtttttttataggtggagagttctgtacatgtctattaggtccatttgttcaagtgctgagttaaggcttcaaacatctttgctagttttctgtgtcagtgatctgtctaatattgtcagtggggtattaaaatctcccacttatattgtttggttatctaagcctcttcacagatctctaagaacttgctttatgaatctgtgttctcctatgttgggtgcctatatatttagtatagttatgttgtcatgttgaattcaaccctttaccattatgtagtacccttctttgtcttttttgatctttgttgatttaaagtctgtttttttgtgtgtgaaattagaatagcaacccctgcctttttatgtatttggtttgtttggtagatttttcttcatccccttactttgagactatgagtgtcattgcatgtgtgatggatctcttaacgacagcataccattggttttgcttctttattcaacttaccactctgtgtcttttaattggggcatttaacccatttacattcaaggttaatatggatatttgcaaatttgatcctgtcatgttgttaactggttacttgttattaacaaacagaattgtttgtttggctgctttatattatcactgatctatgtacttaagtgtgttttatggtggctgataatgatctttccatatttagcactccctatagttcttaactccagtcaccctagtctgctataacatgaggatgcatgtatcatgttgacatactgatttccttttctttggagagacagccagtagtgggattgctggatcatgcagtaattcttttttttttcttctagaaatctgtatactgttttccacagtagacatattcatttacattcccatcaacagtgcacaagagttcccttttgtactcatcatatccagcatcatttttttttcttcttttaaaacttgtttctcaggttcaagagtacatttgcaagtttgttaaataggtaattgcatgccacaggggtttggtttatagattattttgtctgtcaggtattaagcatagtaccagtggtagtttttttatcctgaccctctcccaccctccatcctcaagtaggccctggtgtctgttgttgccttttttgtgttcatatgtactcaatgtttgtttgtttatgatttaggatctcactgtcagccaggctggagtgcagtagagcaatcacagtttactgcagcctcgacttcttcaggctcaggtgatcctcccacctcagcctcctggatagctgggactacagatatgcataaccatgcctggctaatttttcagtatttttttttgcagagacagagttttgctatgttgcccagactggtctcatctcctgggctcaaccaatccaacttgcttagcctgatcctctccctccctcctcccaccctccaccctctgaaaggccccagagtatgttgttcccctctatgtgtccatgtgttctcatcagttaatttctatttataagtgagaagatgcagtatttggttttctgttcctgcattagtttgctgagagtaatggcctccagctccattcatgtccctgcaaagaacatcatctcattctatttttatggcttcacagaattccatcatgtatatgtaccacatttcctttatctagtctatcattgatggccatttgggttgatgccatgtctttgctattgtgaatagtgctgcaatgaacatgtgtgtatgtgtctttttaacagaaggatttatattcctttgggtatatacccagcaatgggaatgctgggtcaaatagtatttctgtgtttaggtctttgaggaatcaccacactgctttctacaatgactgacttaatttatactcctaccaacagtgtatatgcattcctttttctacacaacctcatcagcatctcttattttttgactatttaataatagccattctgactggggttaaatggtatctcattgtgattttggtttgcattttttttttagtgataagtgatgttgagcttttttcatgtttgttggctgcatgtatgtcttctttgataagtgtctttttacgtcatttgtccactttttattgcagttgttgttttgtaaatttgttccttataaatgttggatattagacctttgtcagatgcatagtttgcaaaaattttctcctattctgtggattgtttactttgttgatactttcttttgctgtgcagaagcttagtttagttttattccatttgtcaatttttacttttgttgcaattgcttttggcgtcttcatcatgaaatctttacctgtgcctatgtcctgaatggtattgcctagattgccttctaggatttttatagtgttgggttttacatttaagtatttaatccatcttgagttaaattttgtacgtggtataaggaaggggttcagtttcaatcttgtgcatatggctagcctgttatcccagcaccatgtattgaatagggaatcctttcctcattgcttgtttttgttaggtttgctgaagatcagatagttgaaggtgtgtggtcttatttctatgttctctattctgttccattggtcagtgtatcttttcttgtaacagtaccatgctattttggttactgcagacctgtagtattgtttgaagttgggtactgtgatgcctccagctttgttctttttgtgtaggattttttggctacatggactctgttttggttccatatgtattttagagtagtttttttctagttctgtgaagaaagtcacctgtagtttaatgagaacactattgaatctataaattcttttgggcagtatggccattttaacgatattgattctttccacttatgagcatggaattattttccatttgtttgtgtcatctctgatttctttgagtactagtttgtagttctccttgtagagatctttcacctccctagttatctgtattcctaggtattttattctttttgtggcaattgcgaatgagagtttgcttatggtttggctctccgcttgactgttgttggcatatagaagtgtgagtaatttttacacattgagtttgtatcctgagatttttctgaagttgtttatcagcttaagaagcttttgggctgagatgatggggtattctagatatagggtcatgtcatctgcaaacagggatagtttgatttattctcttcctatttggataccctttatttctttctcttgcctgattgccctggccaaaacttctaatactttattgaatagacatgatgagataggctatccttctcttgtgctgcttttcaaggggaatgcttccaggttttgcccattcattatgatgttggctatgggtttgtcatatatggctcttattatttggaagtatgttccttcaatacctagtatattgagcatttttaaaatgaaggaatgtttaattttatcaaacaccttttctacatttattgaaataatcatgtggtttttgtctttagttccatttatgtgatgaatcacatttattgatttgcgtatgttgaaccaaccttgcataccagggatgaagcctatttgatcatggcaaatacactttttgttgtgctgctggattcagtttaccatcattttattgaggatttttgctttgatgttcatgaaggatattgacctgaagtttttgttgttgttgttgcatctctgccaggttttggtatcataataatgctggcttcatagaatgatatagggaggagtccttcctcctcagtttttttttttttttttaatagtttcagtagaaatggtaccagttcttcttttacatctggtagaattcagctgtgaatccatctggtcctgggctttttttggttgataggctatttattgccgcttcaatttcagaactctttattggtctgtcagggattcagtttctttctggttcagccatgggagggtgtatgtgtctcagaattcatctatttctgctagattttctagtttaatatatcatattttcttcattattctcatgatgaacatttagggtgatttcatgtctttgctattgtgagtgctgctgcaatgaacaaaagcatgcatgtgtctttatggtagagttatttatatttctttggatatacccaataatgggatttctgggtcaaatggtaattctgtttttaaattctttgagaaatctccaaagagccttccacaggggcttaactaatttacattcccaccagcagtgtgcagacatttctttttttctgcaaccttcctagcatctggtattttttgactttttaataatagctattacgactggtgtgtgatagtatcggattttggttttaatttgcatttatttaatgattagtgatgttgaagcatttttttcatatgcttgttggccacgtttatgtcttcttttgagaagtgtctattcatgtctttgcccattttttaatggcagtgttttttgcttgttgatttgtttatgttccttagagattctggatattaaacctttgccagatgcatactttttaaatattttctcccattctgtaggttgcctgattactgtgttgatagatggttttgatgtgcagaaggtctttagtttaattaggtctaatttgttcctttttattctattgcagttgcttttggcatcatcatcatgaaatctttcccaaggcctatgtccagaatggcattttctaggttatcttctagggatttttatagttttaagttttacatgtaagtctttaatccatttttagttgatttttgtatatggcataagcaaagagtccggttaaaatcttctgcatataactaaccagttatcccagcaccatttattaaatagaaagtcctttctgtattgcttgtttttgtagattttgttgaagagcggcttcttgtgggtgtccagcattattttttggcactctattctcttccattggataggaagaatcagtatgttaaaatggccatattgcaaaaacctatttgcatattcaatgctatcagtctaccaataatattcttcacacaattagaaaaaatgactatattaaaataaatatggaacccaaaaagaggccaaatctccaaggcaaaaagagcaaaactgatatgcagaaaattgaaagtgaatccatttcttacactttatacaaaaactaactcaagctgaaaaaaaaacttaagtgcaaaacccaaaactataaaaaccctagaagaaaatctaggcattaccattcaggacataggcatgggcaaagatttcatgacaaaaacatcaaaagcaattacaacaaaagcaaaaattgacaaacagaatctaattaaactaaagagcttctgcacagtaaaagaaactgtcatcagagtgaacacagagccaacagaatgggagaaaatttttgcaacctatccatctgacaaatgtctaatatccagagcctacaaggaacttaaacaaatttgcaagaaaaaaaaaaaaaccctaaaaagtgagcaaagaacatgaacaggaacttatcaaaagaagacatttatgttgccaacaaacatatgatcattagagaaatgcaaattaaaaccacaatgagataccatctcatgccagtcagaatggcgattattaaaaagtcaagaaacaacagatattggtgaggctgcagagagataggaatgcttttacactgctattgggaatgtaaattagttcaaccattgtggaagacagtgtggtgattcctcaaagacctagaaccagaaattccatttgacccagcaattccattaaagggtatatacccaaaggaatataaataattctattataaagatacatgcacatgtatgttctttgcagcactgttcacaatagcaaagacatggaatcaacccaaatggccatcaatgacagactggataaagaaaatgtggtacaaatccaccatggaatactacacagccataaaaaggaatgagatcctgtcctttgcagggacatagatggagctggaagctattatccttagcaaactaacacaggagcagaaaaccaaacaccacatgttgtcgctcataagtgggagctgaacaatgagaacacatggacacaaggaggagaacaacacatgcgggcctgttggaggggtgtggcaggggaggaagagcatcaggaaaaatagctaatgtatgctgggcttaatacttaggtgatgggttgataggtgcagcagactaccatggcacaggtttatctatgtaacaagcctgcacatgtaccttggaacataaaataaagaataaatactcagaaaaaaattcaaagctgaaggtatcacattacctgacttcaaactataccacaagactacagtaaccaaaacatcatcgtgttgatattctttgtagtagccattttagcttgggtaagatgatacctgcatgtggttttgatattcatttcccttatgattagtgataatgagcatttttttttttgatacggagtctcgctctgttgcccaggctggagtgcagtggcacaatctcggctccctgcaacctctgcctcttgggttcaagcaattcttctgcctcagcctcctgagtagctgtggctacaggtgcacgccaccacacccagctaatttttgtatttttagtagagacagggtttcaccatattgaccaagctggttgtgtactcctgacctcgtgatccacccgcctcggcctcccaaagtgctgggattacaggcgtgagccaccgcgcccagccgagcatttttaaatatataattgttggccatctgtatgtcttctttgccaattgctttttcatgtcttctgcccactttttattttttttattattattttctgagatgaagtctcactctgtggcctaggctggagtgcagtggcatgatcttggctcactgcaacccctatctcctgggttcaagatattctcctgcctcagcctcccaagtacctgggattacaggtgcacaccaccatgttcagctaatttttttttcttttttttttttgtagagacagggtttcactatgttggccaggctgggcttgaactgctgacctcaggtgatccacctgccttggccacccaaagtgctgggattacaggtgtgagccaccactcccggccctgcgcaccctttaatggaatgattggtttatttatttgttgagttgtttgagttccttgtatattccagatattagtgtcttaatagtttgatgaatagtttgcaaatatttcttccattctgtcttaatagtttggatgaatagtttgcaaatattttcttccattctgtaggttgtttcttcactctctgcattgttttctttgctgtgctgaagtgttttactttagtataatactatttgtctattaaggtcttagccagcaaatctttgcctagaccaatgtcctgaagtattttatgtatgtttccttctggtaatttaatagttttggttcttaagtttaataatttatcttgagttgatttttgtttataatgtcagagagttccagtttcattcttctgcatatggatatctaattttcccagcatcatttattgaggagcgtattctttccccagtgggaaaggaaatctttggcacctttgtctaaaatcagctggctgtaagttggtggatttgtttctgggttctgtattcactttcattgttctatgtgtctatttttataccaataccgtgatgttttggttactataggcttgtaatctatttttacatcaggtagtgtgatgcctccagcttatgttctttttgctgaagattgctttgcctacacagacattttttttagtttcttatgaattttagggcttaaaaattgtttaaatgatgacatttttaataggaattgtattaaatctgtatgttgctttgggcagtataattattgtaatgaaattaatttttccgatctatgagcgagatgagtctttacatttatttttgtccttgtcaatttctttcatcagcatttttcagttttgcttttagagagctttctccttcttagttaaatttattcctaggtgttttattctgtgtgtcactattataaagggaactgtcatcttgatttcttttttggctatttattattacattatagaaacacttgtgatttttgtatgttgattttgtattctacaactctactgaatttgcttatcagctcagagatttttggtgcagtcttttgatttttccaaatatataagatcatgtcatctacaaagatgaacaatttgcattcctcatttacaatttgggtctcttttatttttcttgcttgtttgcactggatgggacctctactaccatgccaaataggagcagttaaagttggcatccttctgtagctccagttcttaaagaaaagactttcacatttttcctattcagtgtgttgttgactgtgtgtttgtcacatatggacaaatgaattgaagatataatccttttatgcttagtgtgttgagagtttttgtcaacaagggatattgaattttcccaaaggctttttctgtgtcgattgaaatgatcatatagtttttgtccttcattctcttgatattatgtattatgttccttgatgtgtagatgttaaaccatctttacatccctgatataaatactacttgatcatagtgtattatgtttttgaagtgctgtttaattcagtttgctagaattttgttgaggatttttgcatcggtgttcatcatggatattgccctgtagttttctactttgtgtgtgtccgtatctggttttagtatcggggtaatgctggcctcataaaatgagatagggagagtttctccctctttcattttttggaataattttaggaagattcatattaattttcatgcatttgatagaaatcagcagtggagccacccactcctgggctttttttttttttttttaatggaaggctttttattactgcttcaatctcattactaattgttggtctattaaggttttctatttcttccgtattcaattctgataggttgtatgtttttaggaatttatctgtttcctctgggttttccagtttgttaatatatagttgtccctaatagtctctggtaatcttttttgtggtattagtggtaaaatgtctcatttttcagttcagattttggttatttagatcttttcttgtctttgttagtctagttagtgatttattttctttattttttgaaaaattaactttccctttcattcattctttttttgtttttagtctctattttgtccagtcctgttctgatatttattatttcttttcttctcgtaaattgggatttggtttgttcttgcttttctagttcctggagatgtattattagattatttatttcaaatctttttactttctgatgtaggtttttattattataaactttgctctaagtactttttttcctgtaatccacaggttttagtatgttgtttttccattttcatttgtttcaagaactatttttatttttgtcttaattttttctttgacctattggtcattcaggagcatgctgtttaatttgtatgtatttgtatttaatttgtattgtatgtatttgtatgtaaattgtatacaaatttgtatgtaaattgtacacaaatttgtaattgtatttgtacacaaatttgtaattgtatacaatttgtacacaattgtatacaaattatacacaaatttgtaattgtatacaaatttgtatgtaaattgtatacaaatttgtaaaacattcctctgcttttttgtttctacttttatttcttcgttatctgagaaggtactgaattggaaacatttttgagtctttatttgtggcctaacatagagtttatcctggagaatgttgcatgggctgtagaagaaagtgtattctatagtcattgggtttaatgttctgtaagtgctttgtaggtccgtttggtctaaagcctagttcaaatctcatttttcttgttgattttctgtgtagattatctgtctcctgccaagattgtggtgttgaagtcccccacaattattgcattgaaatctatctctcgctaaagatgtaatatttgaattatgaatctgggtgccctattattgggtaatgtatcctgttgcaggattaatactttttgtgggtagatgctatgtatgtatatatagtattggggtatctgggatattttcatacaggcaatactgcataataatcacatcctagtaaaaggggcatccatcacttcaattatttatcccttctttctgttacaaacaatccaataatactcttttagttactttaaattgtacaataaatgattggcaactgtagttactctgttgtgcaatcaaatactagttcttattcattctgtcaaactatatttttttaatacatgaacaatctctacttccctctactcacattaccctgcccaaactcataaccatcattttacctgtatctccatgggttcaattgttttaattttaactcctataaatgagtgaaaacatgttttgtttgcctttttgagcctggcttatttcatgtaacataatgtcctccagttgcatacatgttgttgcaaatgacaggttctcaatcgttttttatggctgaatagtactccattgtgtatatgtacacatatgttctttattcattaatctgttgatggtctcaggttgctttcaaatcctgcctatagtgaatagtgctacaataactagtgctgcaataaatgtgggagtgcagatatgtctttatatactgatttcctttcttttgaatatatacctagcagtgggattgctggatcatatggtggttctgttttaagtttttgagaaacctccaaactggtccataatggttgtactaatttacattcttaccaacagagtacaagggttcccttttctccacatactcaccagcatttgttattgcctgtcttttggatataagccattttaactaaagtgagataatatcccattgtagttttgatttgcattatctgatgaccagtgatgttatcacctgttctgatacctgtttaccatctgaacgtcatgttttgaaaaatatctattcatatcttttgcccattttaaaatcacattattagatattttctatacaattgttcatgctccttgtatattctggttattaatctcttctcagatgaattgtttgcaaatattttctcccattctgtgcgttgtctcttcactttgttaattgcttcctttgctgtgcagaagccttttaagttgatgtgatcttatttatatatttttgctttggttgcctgtggtttttgggtattactcaatgaatctttccccagaccaatttcatggagactttatccaacattttctttagtagtttcataatttgaggccttagatttaagtttttaatcaatttttatttgatttttatatagagagaaagatagtgggctagttctgttcttctgcatatgggtatccagttttccaagtaccatttattgaagactgtcctttccccaatatatgtcttaccacctttgtcgaaaatgagttcactatgtatgtatgtttttatttatgggatctaaattttgttccattggtctatgtgtctgtttttgtggctgtaccatgctattttgtttactatgcctctatagtataatttaaatcaggtaatgtgatttttctagttttgttctttttttctctggatagctttggctattctgggtcttttgtggtttcatgtaagttttaaaattgtttctttggccaggcacggtggcttatgcctgtaatcccagcactttgggaggctgaggcgggcggatcacaaggtcaagagattgagaccatcctgaccaacatggtgaaaccccgtctctactaaaaatacaaatattagctgggcgtagtcgcacacctgtagtcccagatacttgggaggctgaggcaggagaatcacttgaacccaggaggcagaggttgcagtgagctgagatcgtgccactgcactccagcctgggcaacagagtgagcctccgtctcgccgtctcaaaaaaaaaaaaaaaatagattttttttttttctatttttgtgaagaacatcgctggtattttttttttctttctttctttggagatggaatctcactctgtcaccaggctggagtgcagtggcgcactcttggctcactgcaacctccatccctcaggtttaagcattctcctgcctcagcctcctgtgtagctggaattacaggcacctgccaccatacctggctaatttttgtatttttaatagagacggagttttgccacgttggccagactggtctcaaactcctgacctcaggtgatccacctgcctcagcctcccaaagtgctgagattacaggtgtgtggcaccacacccggtattttgatagggattgcattgaatctgtacattgctttgggtagtatgtacattttaacgatactgtattttctaatttgtgaaaatggaatatctttatatttctttgtgtcttctttgatttcttgaatcagtgttttatagttttcattatagaagtatttctttcctttcattaagtttattcctagatattttattttatttgtagctattgtaaatgggattactttttatttcttcttcagatcatttgctgttgtcatatagtactgtctttttaaaaaaatgtttttggcttaaagtctatttcttctgacataattatagctacttctgctcacatttggtttctatttgcatggaagatctttttccatccctttactttcggtctatatatgcctttacgtgtaaagtgtatttttttatgcgtactatgtagttggttgatgtttttgtgttttttaatacatttttggaactaatcaacaaggctatttgttttaagtagatactttaatccatttacagccaagtttattatgataggtgaagttttgttcctgtaacaatgttaattgttttctgattattttatctattttttgttcctttctttctctcttattgatattgttgtagtttggtggttttatgtactggtactgactgagtccttctcttccttatgtatgtttgatttactaatcagttttatattttcatgtgttctcattatagtaaatgtcttcctttcctttccatgtttaggactccctttagcatttcttgtaggtccaccctagtggtgatcaactccctcaacttttcttgtctgggaaagattttatttctctttcatttataaaggataattttgctggatttaatatccttggctaacaattgttttctttcagtgctttgaatatatcatctaattctttcttggctataaggtttctgctgagaaatctgctgttagtctgatgaggggtacatatataggtacagatgtctagatgccttactcttcatgtttttagaatattgtctttgtctttgacttcagtttgactgtaatgtgctatgcagaatacctttttgcgttgtatgtttgagaatctcagatgctcctgtatctggatttctaaatctctcactaaccttgggatgttttcatctgttattttgttaaacatttattttaactcttttgctctctctttgcctcataggccaccaataatttgtatatttgatcacttaatggtatcctttatgatatgaaggcttcgcttattttttttattattttacattaatttttatctaactggattatttcagaacatctctgtaagttataagattcttctgctttatttagtctattgttgaagctgtgtaatatagtttatttttcattcaatgaattcttcagttctagaatatctgtttggttctttttttttttttagaaagctacctctttggtaagctattcatatctccttcatatcctatattatttttatgattctttgtgttgtctctcagaattctcttgcatctcattgagcctatttagaatcaataattgaattattttccagaatttcataaatttctttttgattggtaaatgttactaaataataattgttttcctttggaagtgttattttatttgctttttcatgtttcatatattcttaggttgatgtctgtgcatctggtgtaacagtccctttttctaattttttatatttgcttttgtagggagaaacattctcctgaagatatatctattatgttggctgggtaaggcaatttggttttgattctgagtatatgtaatagcatgtattttctttatgatttcttcagctgtgaacagtatcagtggtatctgttatttccttggtggcttagagtacagttattcatggaggctgtggataagcttccctggggctgtgacaccaggtaagccagtctttgggccatttggggcccaaggtgccatacactggcaccattgctagcagatccaggtggatcagcctctaggtggcttacttggatgctgatactggcagtaatgacctaggtaggtgtgaagattctcaggcccctgtgcagctggcatgacatggaaaatggcagtggcagttgtggagtgatcctctgggtgccaaacagtgtgtgctcatgttagcagttgttgcagtgggttgggtggactactgcccagacctgcaggtagtacatgcaggtagctgccagttaaggtgttaatagctgggtaggtaagtcttatcttaggcccccagaggagtgtttcagtgtcaatggtggtaggctgggatgggcagtcctctggcccctggattctgtgccctgaccaagagtagggatgaagctgggtcagccaggcttgtcctcatgcccctcatcaggggtgtgtgcgggcaccagccatgataggcagggtcagggcaatgccactgatggaattctcatgtggggggcagcagtagccacatttctgccctgctgctgggcaaggcgatgctgccagaaggtagaaagcatgtgccgctcacagctcagccctggccctgctcatgccttacactttgctgcagtacattgcctgttttgtgcctcagccccaagtgcagtagcccacacctcaatcacacctcagcacttgttgtggtatcctatacttcacttcacacctcagccctgggagcaccagcccacacttctcttgtgcctcagccccagtgcctctgggctcctggatagcgtgcaatatgttggggatggggctctaaaatcgagcctttctgtacctgtttatgactcagggaatgcgtgggacccagcattagctctatctctggaacagtaccatcgcacgatcttctggcaactccctatgttagtttcagggcccacgagggtcgaggggctctcttagggttaggattgtaggcagccagaagagaatgtaggctactgatagtctctcacttcccctttccctgttttgaggagtctctcttcacttctagccagtcccaacagagtagactgcctcactacttcttccttccttgctttaggtatttcttgtcacctctctgttgaattctagagttctgtcttgaatgagctatgcaaaatgtgattatctgctcactatttcatttattcttagtggaggaggtgagtacaaaatgcctctagtcagctatcttgatgtactctctcagattagatattaaatgtcctctcgaaggtgataccaacagtggaaatttatcattagtacatttttccaaaaaacttaacatactttaacatcatgaagtatttattaaactgctgtatatacatggcacagtgctctgaaatgttttgccctggggattttgacactagagattattatttccacgtaaagatgacaagatttagcaaaaaagtaaagtgagttgaagattcccaattcagtggcaaagctgaaactagaagctacctcacatttatatattatttacatattttaattatgggtttatattttaataattgtgagactgtattttacataaagttatcaatattctaagcttttatgtataatattcacaatatgtaaatcataataatataacagtatttacactcaatatttagagtatttaaaatgataatatacaactatttattaaaactaattttactagggaaaatattcatgtggtcagaagtaagttttgatgaattattatcatatacagattaaaattaaaattagtttattttgttttttatgatactctgacttcttactaacatttgagtgggaatgtgattggcaaatcttaccactgacctctcacctatataagagttcctcacagctaaatgttcaagaatgatggttttgataatgatggttgtgctaataaatacaacggcaaagttttaaaatgtactaccttattaaaagcaaccccataatttctaatatagcacttctctggtaatctgcatgagaatgtatttcttggacttagaaacgttagtaaggcttcctgccatttaacactcccccagaccactccatacccctaacatggcccaggtcagtttattggttaaggatataggacagattggcacacagaaaatgtaaagttcaggagatagttcagaaagttcagaactcagtggcaaattatttaacttttgtacatttctgaccacctagttttatctacttttaataagcctaatctcttgaagcatcaagtgacaaagactgctcctaatctaagtcaatttacagaagccatctgtaatggtttttaaacatgaccacaaattatttagtaccaattttagtgagaaattggatgtatgcataccctcatgttaaatctaggttgatttgcaaagcttcatccgtgtagtatttaaaaagtgatgctatattacttctgaagctagcttgtaaaaggccatacagctttgttcttatttactggagcactttctctaggagcctggagccaccatatgggaagtctgaatacccagacattgtcttgctgggtaggccatatctatgtgttccagctgacagaattgagaatccactgagcccagctttctagtcatctgtgtcaaggcaatagatacatgaatgaagccatttcagtagaccagtttttctatcagctaaatactatttagagacttgtgtagacaccattggttctgtttgaatttctgacacactaacttatgagattaaaaaatgattgttttaatacaccaagttttggtgtggtttgttatgttacaatagataatttaaacaccatgacttcaggaaaataagctttgcctctcccatcattcattaagttttatattcatgtatatatacgacagatatttatgaatgtcttcaatgtgctatatctgtttggggccgtaagaatataatggtaaataaaacactaaccttcctattttcatagaatttatattctacacagtaaaagccaataaaaatgttataaaatatgtgcaatgtatcaattggtgattattgaaaagataaagcaaaaataaaacaggataacaacatattggagagtaccagaggtgagttactattttatatagcatggccataagtggcttatttgacgttatttaatcagagtccataataaaatgagaatgtaagttatatgagtatctgaggaaagaacattacaagtaaaatgagacctaaagagaagcaaatttttggtatgtctgaggaagaccacaactaggtcagaatggtgtgaatacagtgaaagaagcagagagtatcttcaggtaggttaacaagatgttcaaccatgtcgaaggttgctttttttttgagacggagtcttgctctgtcgcccaggccggagtgcagtggcgcgatctcggctcactgcaagctccgcctcccggattcacgccattcttctgcctcagcctcctgagtagctgggactacaggcgcccgccaccatgcccggctgattttttgtatttttagtagagacgggttttcaccatgttagccaggatggtcttgatctcctgacctcgtgatccaccggcctcagcctcccaaagtgctgggattacaggcgtgagccaccgcgcccgacctgaaccatgtagaagcttttaagatggtaaaaggcttttaattttattcacaatgagaagataaatcattgtagaattttaaatagagaagtaccatgtcatgatttaacttttaaaagacgctctctgggtgatggagagagaaaagagtgtaggagggtagggccataaaaagagagacaacttctaatttctgcagtagtccaggtcagtgaagatgatgatgtagcctaatgtggctcttgtgtaggtgattaatatagtaaaatgtctgtttaggatatatctcaaaatggagttgatatggataatatccatgcagcaggtagaaaggttgtgcacctgtgatgaatatgacatttaactcatttaaatatttaccagattagagaaagaaaggtctgctggacttacacagatgctaaacatacagactttctacactgccttttgctcaagaccatccccctatgatttcaattgttttctgtttctcaaatctcaccctcctccaaacaaccctcccagttgggactaaagtattggctaccatcctatttactgttaacctcatcagcatgtgaattttttaattgtaatatgaatataatgccaggctgtagccatggtgaccaggaactaaacatacatagtttaatcttctttgagaaaatttacttgtccagattcttcccatgtccttggcttatctttggacataattgagtcttctttatctcattttgtctttcaaccatatacattctttctagttatattgatgaccaagacaatattggcacacacttaaaattttccaagtacttatgtccatgtaatctctgtcttctttacatgacttctaaatcaaacttattggagtttacacatgttctttatactaattttgttcccataccattatatttatttcttcaatttatcagatcctataaacctttcctctagtaagacatgacccactcaagacctcaaacactgaggaatctgtttaatatcgtggttttgatacatgtttaattgtgtggataagtgggtgattactagacaatagaacatggttagaagttttctttatggattattagtgaaacataactaaaggagaattatgatctatttgtcctgatacctttgatcataggtactaaaagtgatatttccatgtcctagtaattaattcatacattattattaaaaacagggactagagcacaaattaggaatcccagaagatataagattagaatgagaatgaatttgggatgtttatatttagtctctatttttcatacacgtgttcatacatacatctacaaagtgctaagctctttgttactaattttcacatcatggtaataagttagcaagaaagacagaatatatactattggctagtttgatagagccaaaataatatagagaagcaaatcaaatctgtgggtaaatagatactgtgttagagaaaatggtatgtttgcaccaaattgtatttgtttcatcttcttgataagactgtatttcccaacctctttcacagctcagttaaggtcaagtgtcactctcaagtatggccataaaactgcccatacaatttatctatattctttttttccctgtactgtggcaatcttggaggtcatgtgttttaaactgtttagtcaccttataaaaggaacatggtttcataaatcaccacattgagtaccaataccacccagattaacaacccaacccatattggcatgtgccatgaggaaaaattaaatttatgtttattacaccactgagatatcagtgtttattacttattgcagccaaacatagcctattctcagttatgcatggatggaaaggaagggaagggaaaagggaagggaggagggagggagagaggaaggaggggagtagaggggaaaggagaggaggggaggagaggagaggggaggggaggggaggagaggagaggcgaggggaggagggaaaaaaagaaatatcaaattcagcacaagggggagagaagaagcaggggagataagtttcttgtccaaaagagtagatatgttagacatatgccatttttcattctaatcaaaagtccccaagcacacagaaaccattgaccagaatgtaaccatttgtacatgccaagataaaaattataggtgtttgttagtttcacactgatttcttcaaattaagcaattcaattatgaattaccacaatgtagctttatttgtccatagctttttattttttaatgtattttccagcaaattttttcttagtcaaagacatacttcagtgaatctcagaagcatcttctcttccagaaaactcatacctgttcatttcaagtcattatacactggcagctgaggaagacagctgttatctaaattccataaatactctgtggaggctaaactttagaacctcagtgattccaaactagctgtgttctgaactcttgcattttgatgagcctctccttttattgccttcctgtataagaaaatgttaacaaatcagagatctagattcaataccagactaaggtggttgtataaatgatacataattactggtgaaatgcccatattcttaccattaaaaatagtggagtggacacatttactatccctagatgtcccagaatacttatcttgaccataatgagtttttttatgatccttcatcatatagaaaatttaccacctttaaatgaacacattgttgatgccccccccccaacacacacacttaactttgcagtcgtgtatgtatttctcagtttaattccttaggatgtatgatagcatctaaggaatgtctgttatcttctcataggagaagaataagaaataactatctttacctactttatcgtgttaatgtgtttagcatttttattctatagcacactaatgacttttatgtacaggtttttggactgagtgcttctggcccagccacttatatcattgagtatggttgattttctgtgaacctacacattgcactaatctttctaatacaatgctggagaatcaagctcagagtacaaaacgttgatgttatatttcaaaaggcagatgggattgcgcattatattatatattagaaaaatagggaaggggtactaagtctcccttgtttttctcttcaattggcctgcctacggctcatcaatactggaaataaacagctccagaggctaaatgtggcaaatgcagcaaattcagcaaatccaagtcccttagcattatataatgttgactgcatccattctacagaattttaatttgatatcactctcatgttaatccatttatacattttagtgggcaataaaagaagttatgggcaatcacaaaaagtacatagtagagctatgtgtgacactgatgtcagaaatttatatttttgtggaaaattttaaaaggggatcccatggtggtagatttttaaaattctaataacaattttttaaatttctaataaattaattagaaaaataacttaaatgcacccaagagtggtgaattttaaaaaatcacaaggtaggtaaagctttaagtgaagtgattaaaactgaaagtaagggcatttgagacatgaaaagtgatctaggtcttaagaattacaaactgtgtgtaatgcattttaccaacaataaagtaacatgttctttatccttgcgattaatcattatagtagtccttgggcacccaaactaaagtgagacataaatcaaattgacccaatcaacactcagtaactttaatgacataaacaagcagccagcctttaccaacatcttactacatttaacagtcccgtattactacccaatgtgtggagacagcacagtaggccacaaagagtaccagcttatggaattttggttttacagccgtcactagctttatgaaattgggtaaacaataaattttgtggcccttcagtttcctctaaataatgaaaacaggagtatccattctttcttactatgcaggtagctgcaattgtcaagttaatttctgtaaacctatattgaatattatagcactcaagacaattgtgaaatattagattcgcttccaaataaatttgtttagatgcatggtggtgtttgtttttctggaagaaaattactgagcatcaatggtaatctcatatatatagacctcaggtaaatataggccagattttaattattagaaaaagagctaaactgaatcacttaggctaaacagaaaatgataattgaatttaattattaacataggtgcccatctgtaaccctcactggacattaatcagaccttcattaagacacagttttgtactgatttccatgttttatagataatttatagaaaccgatagaaactgagcagagttcatatcatgaaaaaggggagaaaatacaattatttaaagaaaatgagttagagaattgaacaatatggaaggtcaaaagtttagtgtcagttttcaagcactagataattattgagattcctgcctgttcttcttaatcattttcattttaaccaaccatatatactgatacagttatgttcataacactgcactgtgccagatttaacaaaaataacaccaactaaaaaattaaatatagtccttcccaaggaagccgtgtaggattttgcagtcaattttggggggaaatgggccagcatagataaagcatttaaaaaacaatgctttctttacatctatcataaaggtccagtatgactttataaatgggccagcatagataaagcatttaaaaaacaattctttctttacatctatcataaaggtccagtatgactttataaaaaattagtcaaggagattatttggaaaagaaactcccattaatgttttggactttgaatcctttatgatatttaatactggacggatgagtacctgccttagttaagtcctggaatatgagatgtattttctaggtttagacatgctattatctttctactttaattcttttaaaagttttaaaagagaaattaaatgtaagtttttgaaaagacaatagttaatttatttgtataaggaaaaagtcatctctagtgagtgattgcaattaaaagttaaaaactagcagatgtatactttccctcttatgcacataaaaaccaaatccatactatttcctcttcagttgtttctccgtatatcttctctattactatttatggcaggattattctcccagatatgcccactctgaaacctacttaacttttccttccatttcctttactcctacatccaaatgattggttaaatgccattgaatcgaccactgtactatctttccttaattctaccaattaattttttcttaattccacctctcttaatttcaccaattacatttaaatttaaatttcagcttgtagtattaaaccccattatttatattgcatgttgtggccatacttacctctctaaaattttctcttattgtcaaagtgctactttaaaattttcagtgaattaagtttgtctaaagcatgacatctcaaaatgccatcccagagtcagcaacattaaaatcaccttggagcttcttagaaatacagtgtgtgaagtcttacccggaaacaactgattcagaaattctgaggacgaagcctagtaatctgtatttgaacaagccctccagttttacattttgttgtgttgagactttatttttagagcagttttaggtttatagacaaaatgaacagaaagtacagagagttattatatactccaactcccccacacatacattatttttctatttttagcatctggcgttagtgtggtacattttttagagtagatgaaccaattagaacatattgcatttttttcaaaattcattttactgtggtaagtacacaacatgagatctatcctgttaaatttttaagcacaaaatagttttgttaactattggtacaatgttgcttagctgacttttagaatttattcattttgtatgactttctgtatgtttattaacaactcccaactctccatttctcctactccctgctcctggcaaccactattcattccactctgattctatgagtttgactattttaaatatctcctataagtgaaatcatgcagaatctgttttcatattcccggcttgttttccttaacatcatgttcacagaatttatacatgttgtcacatattacaaaattttctagttttgaaggctgaataatattccatgcatgtgtgtatgtgtacacacacatacacatacatatatatgtcttacattttctcaaccatccatggacatttggattgttactgcatctggaccatcatgattagtgctgcagtgaacatgggagtactaacgcctcttcaacattctgatttcagttcttttagagaattaactaaaaattagtttgctaaatcatatcgcacgtatattttcattttctttttgaggaatgaccataatgtgttccatagcagctgcaccatttggcattcctagcaatggtgtagaagggtggcaacatccccacatcttcaccagtattttttgtctttttgaagatagctatcctgacaggttgaggcagtatcattgtggttttgatttgcatttctctgatgattagtgactttgagcatcttgtcataaacctgttcgtcatttgtatgtcttatttggataaacgtctgttaaaagtctttaacccattttaaaaattgggtgattagcttttttttgctgttgagttgtaggagttccttatatgttttggaaattaaacccttatcagatatattgtttgcaaatttttttttcctattctttaggttgccttttcaatctgttgataatttcctctgcaatgcagaagcttttagtttaatgatatcccaattgtttattttgctttttttgcctacgcttttggtttcatgtgcataaaatcattgctaagattaatgtcatgatgctttttcactgttttcttcttgtagatttctaatttgaggttttacacttaagtctttaattcatttttagttgatttttttgtgtgtggtgtaagttaagggtccaatttcattcttttgcgtgtgtatatccagttttcccaacaacatttattaaagagactattctctcccaattgtgtatcctatactgttttaattaacatagccgtgtaatatatattgctaatcaggaagtgtgatgcctccagtttcattattttttctctcgagtggtttggctttctggtgttttattgtggctccatataaactttgggtttttttttttctatttctgtgaagaatgtcattaagattttgatagagattgcatagaatctttagatagctttgggtagtatggttgttttaacaacattaagtctgccaatccatgaatgtagaatatctctttacttgtttgtgtctctttcaatttctttcatcaatgttttatagatttcaacgtaccagtcttccacctacttactttactcataattattttgttctttttgatgctattgtaaatgtggttcttttcctgatttccatttcagataattcattgttagtgtatagaaatgcaactaatttttactcattgattttatatcctggaactttactgaatttgtttattagttttactaggtttttatggagtttttggagttttctatatagaaggtagaagattatgccatttgtaaacagggagaatttcacttcttcctttctcatctggatgatttttacttcttgatcttgcctgatttctctggttagaacttccagtactatgttgacaaatggtgagattgggcatcctgcctatttcctgttcttagaggaaaagacttaagattttcctattgagtatgatgttagctgtgggcttgttatatatgaacttttctgttaaagtcatttatttctattcttagttcattgagaggtttttgtcttctggttgtaaaaagatgtcacattttgtttaaagatttttatgtatctattgaaatgatcttgtggcttttattctttactctgttaatgtggtatatcccattattttatttttatatagtgaatcatccttgcattccaaagttaaatctcacttggctatggtgtatgatccttttaatgtgctgttgggtttagtttgctagtataatattggaggattttggaatccatatttatcattaattttggactgtaattttcttttcttccgatgcctttgactagcttttttatcaggataatactcacctcaaaaaatgaatttggaagtgttcattccacttcaggtttttggaagattttgataatatttgatgttaattctcatctacgtgtatattagaattcaccagtaaagtcaccaggttctggaagtttccttgttgggaggtttggattactaattcaatctccttgctgtttataggtctgttgaaaatttatatttcttttcatggtttgatcttagtaggttgggtgtttctaggaatgtatccattgatttttttttttctaggctatccaatttgctggcatataatcattcatagtagtctgttattatcatttttatgtctatgggttcagttttgtcttcttttcatttctgaatttatttatttgaatttcctctcatttttttagtttagcaaaaatattgtcaattttatttcttttcagaaaactacctcttaattttgttgatttttttttcaattgtttttctatgctctatttcatttatttattctctaatatttattatttccttctttctgctaattttgggttgaatttattcttttactagtttcatgaggtatagagtttggttgttgatttgagatctgttttatttttaaacgtaggcatttactgctataatcttcccttttactactgcttttgctgaatcctataagttagggtatcatgtatttttgttttcatttgtctcaacattttttaaattttttttatttcttctttgacccatggttgatcaaatgagttgtttaatttccacatatttgtgaagtttctagttttccttctgctatggatttctagttctgttccttttgtggtcacaaaagatatttggtatggtttcaatcttattttttatgtcttgttttgcgacctaacatgtgatttatcttgcagagtgtaccatgtctgcttaagaagaatgtatattctgttacttttttgtggaatgatctgtataggtctgtcacatccatttgaactatagtgttattcatagccactattcctttgttgattttctgtctggttgttctgttcattatttgaaagcttttattaatactattgttgtattactggctacttatcccttccatgctgtaaatgtttgctttatatatttaaatgctttaacgttagccacatatatatttataatcattatgtattccttgtgtatttacacttttgtcattacatattagtaatgtccttctttgtctcttgtgacaactttttacataaaatctatttttcctgatacaagtattgccacctttgcttttttgggtattatttgcctgtaatattttttctttattcttccgctttcagcttatatgaatcattaagtataaagcgagtttcttatacacagaatatagtcatatcttgtttttttgtttcattcattcactctatgtatgctgcaaaatccactgatggttttatggggatttccttgtacactttcctatcattgtattttaagtgtatgttgtatattctggatataagtactttgtcagatatgtaactcataaacattttaacctggtctatgattgtcttttcatgcttttaacagtctctttcacaaagtacttttttatagttttaatgaaatccaacttatcaattatatcaacatatctaaaaacttatcaccaaaccccaaatgtaagattttcttacatttacctttgaagaggttaaagctttgtgctttatatttaggtctatgatccattttgagtcaattccttaatgtgtaaggcctgtgtcacattcagtattttgtatgtggatatgcatttgtttcaggatcatatgttgaaaaatctttcctcagtttaaggatagttgtctgtttagaattgcatttattcctttgttaaagataaatttactatatttgtctgggtctgtttttgtactctccattctgttttgttgatttatttgtctgttgtttgctaataccatactctcttggttatcatgctcttatagtaattactgaagttgggtagtattaacccttcaacttagtgcctcttcttcaatattgttttggctattctgttttttttttatgtttttgcctttcaatataaattttagaatgaatttatcaattgatttatcaattggatacaaagtaacttggtgagattttattgagattgcattcaatctatagattaatttggaaagaactgacaatttaacaatatttagtcttcttatctgtaaacatgagatagctgtccaattatttagatcttcaattgtttcatcagtgttttgtggttttacttatatagaacttgtgcatctttatacacacacacacacacacacacacacacacacacacacacacacacaaggtcttgctctatcactctggacagtggttggaaaggagtggcatgatcatgactcactgcagtctcaacctcctgggctcaagcaatccccttgccttagcctcctgagtgggactacaagagacttttgtatattatccttctattctgcaaccttgccatgattgtttattagttctaagaggtgttttgtttgtttgttttggtttgtttgctttggagtgttttttatgattgcttagtatttttcatgtaggaagttatgtcatctgttaacaaaggcagtttaatttagttattccaagtctgtataccttttatttacatttcctgttttctgtttcatcagctgggacttctagtataatattgaataggagtggtgatagtggacatccttgccttattcctgatcataagaaaaaataatctagtttctcaccgttaactgtgatgttagctgtaagtttcttgcagatgttctttatcaaatagagaaagttctctttctagtttgctgaatgatttttatcacgactaagtgttgcatctttctcaaatactttgtctgcatctgttcgtatgatcatatggtttttcttctttagcctattgatgaaattatgttaatttatttctgagtgttgcaccagtcttgcatacctgagataactgccacttggtaatagtgtatatttctttttttatagtgatatatttaatttagtaatatttttgaggacttttacattcatgttcatgagagatattggtctgtgcttttcttttacttgcaatgtgtttgtttgggtgagagtaatgttagcctcatagaaagagttctattttctgcttctatcttctggaagaggttgaagataattggtctaatttcttcctcaaaagactggtagaattcatcagtgaagccatctggacctgttgctttttgttttataaagttactaattattggtttaatttcatatatatatatatatattcattaagattatttatttctccttgtatgactttagatagattgtgtctttagaggaattggtccattttatctaaattataaaacttgtgaatatagagttgttcatagtgtccctttattattcttttaatatttataggatttgtagtgatggctctcctttcatttgtaatattagtgatttgtagtaatttatgtcttcactcttattatttttttggtgagccttactagaggttaatccattttcaaagaatcagttttcagtgagatgtgtctttgggctgtgcctttcacaggtgcttctcagctttcctctcttcactccttaggtaatacaggaaggctatagagaactagagtttggtatttaccttctaccagatgggttagcctgtagtcaaaatctagttcaggttaggctctggtaaaatacttttccttgaggccaggcctttgttaagaagtatccaacactctggacaaatttcaagtgtttattttttcccttcccctgctgaaagcttgagggaattttcctctgaaatgtcaaactctttacattttggactagaaactagaaaacctctaggagcttttgatgcacacttgattttgagaagtactggcctataggatacattctaaactctttaccatgaattctaggtttgaattaatctgtctccaccaagtttctaatgttattttctgtattctgctctctctatattttctattattttaaaaatatttttatattcattcctatattttatccttcccactttttccttctatccctttgccatttgactataatgctcttttctttctctctttctctacctctcctatcttttttttgtctctttctccgtgtgtatatatacacacacatatatatacacacatatatgtatatataaaatctctaatgtgtatatatgtgtgtgtataatctctagtctataaagatatcaataattctttttcttcaacacatattttaagcgtttattaagtagcagtagaggatagaaggaaaaagaaaatatttttgccgctttccaggaatttattaaccaccacgggagataaaaacatctatacaattccatgccttacatttcacagaagtaaaagtttagacaccagtatagtgtttgtttttatacatacctgtagggaaaaaaaacaaatgcctaaatcattttctaagacctattttgttattcttgaagtgcaacccaaccagtgtcattgaaaatcataagctacataaacatcatattttatattttacatatgaactatctcatttacagaaaataactgcctctagtgaaacgactcaactcttttcatttaaccttctcattaattatttttaaatatttttcaaaattatttggaatgtgctaatttgtaagcctatacattgtaggaaagcagtttttaatcacaaaacagaggtatctaaataaagttgcagaagatagcttctctggtaatgatcaagcagaaatttgatttgtcactgcattctactaaagtaccttgaaggagaaaaggcacccgtaagtatttccacaaagcagccaagttgcctcaagattgtggcttagagcattacatggtatcccgctgaaatgtggcatcaattgttttcaattccaaatgattgcggttttaactctgctcgtagttggagacacagaaactatagaaaagtcagaagaccctctttagatttatcaccttgcataatgatggtgtacttgtaatttactcactcattcaaaaatactgtagtgctaatgtgatggttaacactgagtgtcaacttgactggattgagggatgcaaagtattaatcctgggtgtgtctgtgtggatgtttccaaaagagattaacatttgagtcagtgggctggggaaggcagatccacccttaatctggtgggcacaatctaatcagcttccagcgaatatgaagcaggtggaaaaacctgaaaaggagagacagacctagcctcccagtctgcatctttattccattctggatgtgtcctgccctcgaccatcagactccaagttcttcagttttggtactcggactggctctccttgctcctcagcttgcatacagtcattgtgggaccttgtgatggtgtaagttaatacttaataaacttccctttatatacacgtatatatatatcctattagttctatccctctaagaggaccctgactaatacaaatttctagacaaatagtttctgttgtcatgtggaaagcaaagaaataccttcaatgggaagtagaaaacttccagtgaagcttttgatgttaattacacctgaagcatccactaacacagtacttcccatactttattgtacataggtatgacttgagaccttgttaaaatgcacattatgatgcactttgggcatggccgaagattcctcatttctataaggttcctagttaatgctgctgcttaattaactgtgactagcaagactctagtatatggtaagctttctaaaagaagaggctgtatcttacttgtgtttgcccttaagcctagagatattttgcttacttttatttatcacatctatctatctctctaacttctaaaagttattcaacgctgttcatagagaaatatcagatattttaaaataagttaaattaaaagaaacacggaaatcagggcaaaaggaaaaagtaagattaaggaatttgttaaatttagttttctactagaagcgaacctacgttgtggctccgaacattgatgcccttatgtcctgggcacagtcttggtttatgcccattgcatcaatgtaattattgataaaaacatttactagtctaggttaaacggaacaagcggataccctactgttagccctggtaaataactcttaacctggaaaaacaatgccttacattgattaatgagcagtgtaatgtatggatggaaagagtctttaagcaaatgcccagatattggaaagaaaagatcaggattctatgatattcttaaaacagttattaattttaccactgtgaatattgatggcacattagaccttaaaactatagttattttacatatataggcaatgaatgtttttaaaaatattatatatcaataaaatatcttgatttttttaaactataaattattttataatatacattatgatatttatatataagttcttatctttaggattcttgagaattaacattttagaaagaaaatatctagatgcaaatctagatatataggatgactattaatcttacattccctaaagggacccacaaaaataatgaggggctttctcttagatggatgacttttcattttgcaattaaaaagggtgagaaggcccttcatcaaacttttatttagggcaaaataggtgtcatgaaagaacttaaggccattactaattaataatataaagtaacaaagcagaaaaaaataacctttcatagatttcctgtaggttttaagcagcttcattgattagatcttgatagtagtaagaattctaagaaatacataagataatttagagtatgttcagatatttatacttattatttttatatgcataattgtatttgaaattatatataatttaatttcttattttagaaataagactcttttcaacaaaaaacttaaaatttgcaattattaaatctctgctgatggcactgcccataaaaaagttgtgtttgctaacctaagagaaatttacctaataaaataatttaattgcagagattgtccttgttctaaaataaataacatcttcctaaacatcttactaaaagatctctttcaaatctgctggactgtgttggatgcatctatagtggacttccttcaagcctgtctttcttttaattttaaatacattttcaatttaaataaaatgaccatattctatttaaattacttgtttaactgtgtaacttcctcaccagactattcattctatgagaatagcagatgtgtctttcttgtctttttgatatccagcccctagcatggtactctgcatataatagaggctcagtaaataactgtatataaagcaaaagttgataaagttttagacattttgtatagtaaaaacataatccaaactatagttaaattattgtgatacagaaagtggtagatgacagcaaagttatttaccatctaatctgaatttacaaaatattaaaataatgattaatttgtacaaaaatgtgattgcaagtgtaatattgctttagtctatgtaactatatgctcctttgttccttgcaatttttcaacattttctattgcttcctttcattgttcatcctctttcttcaagtctcaatttaaaggtcatgtcttcagggcaaccattcctgactacagtatttttgtgtgtttcaatactgtatttatttcctttatggctgttatcacaaaatccagttttcttctttattggtttattatctattttccttctattaaattccatgtgagcagtgacattgccagtttttaccattgtattcttaactcctaggagattgcccaacaatttaatgacagaattaatggatggatggatggatggatggatggatgaatggatggatatacaaattcagagatgtgacagtaagttcagcaaaacacatgttcatgaaaacatagaaaaagtaaataagataaagctattctgtttcccacaaaataattcctgatgtatttttatgcttggatacacaagctactgcttgagtctaaaatttatcaaattcatatattagtaatctaggatcatacatcgttgttaagctatgtgtttcttaagatctacctctaatttgaccataggcaatgaggttttggtgctttaaaagcctactcttgctataaaagggaatttatcattttaaattttactttgttagaaatcacttaaaataattaaacacagttttttagtcagtttcaagatataggacatattatttgtacatatgtaagaatttttaatttggcataataacttaagacttattctttaaagtgaatattacatatgcatgggaggagcttgaacctagagatatggtaaaaatatatcagagcaattatatagcttatcttaagatgacagtgatttcaaggttaattcttagcccaacgtatccagacgattattacattctgttcctccttgtgtaggtcagtctggctgttgaaaatgctttcttacttgatgaatcttatcaagttcacattgtggcattttctccagcttttaaataattttttctctaatgtgataaaatgagagtaataagaataatgcacagttgaccatcttgaacaaaaagtgtgggaatacagcgtttacataatggaaaaagaagcagagaagataggctcaaatctccatgtcagggaaaatctgagtagaaaagaaatgacctcatttttgtcaagagtttccttccttcattccttccttccttccttccttccttccttccttccttccttccttgtctttctctctttccttctttctttttcttttcctttcctttcatttccttcccttccctttcccttcccttccctttcccttcctttccttcctttcctttctttccttcttcccttccctttcccttcccttcccttccttccttttctttctttctctcctatctctctctctctccctttctttcctcctcctttgtctttttcttccttcctttcttcctcttacctcttcctcctctgcctcttccttctcttactcctttcttctgtcttcctaaaaagaatagtttttgacacaacactctgaatttctctagggaaatacagtacattcatgttttaaatgtataccttattggatcattgatgccaagggacaagtcaagtctacatcataaaattggtaatcttgtagagatcagattaattgaagttgctttttataaaacttctttttttttatttcaacttttattttagattgagggggtacatgtgcaggttgtgctacatgggtatattttgcaatgctgaggtttggggtatggattccatcatgcaggtagtgagcatagtacccgataagtagttttatcacacatgccccactcccatcctcccccctctagtagtccaggttgtcaattgtttccatgtttatgtccatgtatgctcaatgtttagctcccacttagaagtgagaacccacagtacttggttaactgatcctctgttaatttgattaggattatagcctccagcttcatccatgttgctgcaaaggacagaattttgtcatttttttctggttgcataatactccatggcatgtatgtaccacattttctttatccagtccaccattgataggtacctaggttgattccatgtctttgctattgtgactggtgctgcaatcaacctataagtgcacatgtctttttggtagaatgatttgttttctgtttggtatatatccagtaatgagattgctaggtcatgtggtagttctgttttaggttctttgagaaatctccaaactgctttccacagtggctgaactaatttacattcacattcccaccaacggtgtataagtgttcccttttctccacagcctcaccagcatctgttgtttttttgactttttaataatcaccagtctgactggtgtgagacggtatctcactgtggttcagatttgcatttctctaatgatagtgatagtgagcattttttcatgtttttttcatatgtttgttggcttcttatgtgtcttttgacaagtgtctgttcatttcgtctgcccattttttaatggtggtatttgctccttgcttgtcaatttaagttccttatagattccagatgcaagacttttgtcacgtgcatagtttgtgaactttttcttccattctgtaggttgtgtttactctgttgatagtttcttttgctatgcaaatgttctttagttaattagatcccacttgtcaaattttgtttttcttccaattgcttttagggatttagccaaaaatgatttgccaaggccagtaccagtaagggtatttcctacggtttcttctaggattcttagagtttgaagtcttacatttaaatccatcttgagtttatttttgtacatgttgaaagataagtgtccactttcatttttctgagtgaggccagccagttatcccagggccatttactgaataggagttagttttcctattgcaccacttatttaatagggggtcctttttctattgcttggccttgtcggagatcagatggttgtaggtgtgtggctttatttccgagatttctgttctgttccattggtctatgtgtccatttttgtaccaggaccatactgttgtgattactgtagccttatagtataatttgaagttgaatagtttaatgtctccagttttgttcctttttcttaggattgctttggctattgggcctctttttttggttccatgtgaattttagaatagtttttctaattctttgaagaagatattggtagtttgataggaatactgttgaatctctaaattgctttggggagtacagctattgtttttgagaaattgctgatatatctaagatttaggaaacatgggactaaaactcaaaaattatttcattgcttaaaacttgaatgtacaataagaaatagtttttttttaaatttttgtcaggctttagttctcttatttttaaacagatattttgaagtataatgtgacattcagcctcaaaaacgtcatgctaagtgaaagaatccagatccaaaagactacatattgtatgattctgtttgtacggcatttctagaaaaggtaaatttatagagatggcaagcagatcaatgtttgccctgcagctggggatgggaatgtggaatgatcacaaatgggcacaagagagcattttgaggtgattcaaatgatctaaagctgggttaccatgatgattgcacatctaaaaatcattgaattgtacatttacgaggggtgaagtttatggcatgtaaagtatgaccattttaacaatattgatttttccagttcataagtatgggaataatttttcatttatttttatcatctctgatttccttcagcagttttttgtagttcttcttatagagatctttcacctccttggttagctgtattgccaggtatttcattttctttgtggccacttaaaatgggcttttgttcttaacttgcctcttagcctgggcattattggtgtatagaaatgctactgactttcatacaatggctttttatcctgaaactttactaaaattactagttctagaagccctttggcaaagtcttcagggttttctaggtgtaagattacatcatcagcaaagagagatagtttgatttcttcctttcttacactatcagtggggtgttgaagtgtccaactgttatatatggctgtctaagtcttttcataggccgtgaataacacgttttgtaaaactacttacttcaattttgggtgtatatatatgatacttcagtctttttgttggattataccctttatcattatgtaatgcccttccttttccttcttatttttattggtttgacccttttcccacttagaaaaagaaaaagtgcagcttgctgccagtgctcatttaattttatataaagacactcttagaggctgaagcaaatctgactgattttcaatatgaaaataaaatataaaaactgttcttggagttatttctaaacagaactaatatcacaatcgtctgaataatcagaattgtctattttggaaaaatcaaattcatgaaatgaatctttggccaacaactctttgagaacaatgttaacatcatgcgtagaaatgctgtgttttctaggatttcacattttcagtgattgataattactatattttgtaaatagaaataccactactaaaaacagaatgctataaatagaattctgtcttttgtttctaaagtcaatatgccagagtgacgtgaaaataataaaagtaagatattttgtggaaaaattactactctctctccctactgaaatgtaaactccattgaggcaaagctttctctcatgtttgttcattgctgtatttgagcaactataacattgtcagatgttcaatacacatttattgaatgactgaattaatattaggggacttatgtcatatacaggttctttgttttacatcttgggggcttctgttttctaataatttaaatcctgatcagtatatcatgctgcttctaccacccataaatatacctgcttacttgcttctttctcaagtaaaataaaactcacaagttttattaaagttaactaagatgtctatattttaataaagcatagttattaagcataccagaaaagtgatattataaagttagaatatttatgcagagatatattttaaaataagaatctttagaaactgaaacttagagtataataaatcaattcatttgcttgcaatagcaaatagttgtcacatagaactatattaaagaaatttaatacatgtgaacattaccagtagtttcatgtatggtgcagtttagtaaaattctatcataaagtattttataattatacaaataatttaaaagttatttagtttactacacatcctttttttggttttgttttttacttatcatctttttccatgacagatggttctcataaagctatgaattacaataaactgccttttggttaccgggatagccacattacccaggcttaaccaactatgttcatcaatattactgccgagagagaaagttccaattatacagtttcagattgttgaatataccaatctggctttgcacagttctatgtactaataaactaccttctttgtaaaaattagccttcattgattttctttttttaatttttaatttttgtgggtcatagtaggtgtatatatttatggggtacataagctgttttaatacaggtatgcaatgcatagtaattacatcattgaaaatgggatatccaaacccttaggcatttttctttgtgttatgaaaaatccaatttcactattttagatatgtttaaatgtacaataaaatcataattaaccattgtcaccctattgtgctatctaatattaggtcttattaattctttttaaatacttttttttactcattaacaattgccacctctctcaccctgacacccattacccatcccagcctctagtaacgtaacccgccttctactctctatctccatgagctcaaaggttttgaattttagatcacacaaaactatgcttatcctaagtaaaaagagtaaataatcaaccaatgaaaaataatgaccataacaacttttcatggcatagttcaataggatataaacagaaacaataaaaagttaagaagcagagagacaaagttaagacagagtttttactcggtttatttttgcttttttgtttgtttatgcaaataacataaagttgttatcaggttaaatattacccactccactgccctttccagccttgaaaactatccttctactctatctccatgaaattaattgtgttgatttttagatctcacatgtgaatgaaaacatgtaaagtttgtctttatgtgcctagcttattttacttaatgttctgtagttccatccctgttgttgcaaatgacagtactacattgtgtatatgtaccacattttctttttgcatttgtctgttgatagacacttaggttgatttcaaatcttggatattgcaaataatgctgcaacaagcatagaagtgcagatatctcttggatgtactgatctcctttcttttgggtatgtacccagcagtgggattgctggatcatatggtagctcaatatttagttttttgaggaacatgcaaatgattcttcatactggctgtactaatttacattcccaccaacagtgtgcgaaggttcccttttctctgcatcctcgccaacatttgtttttctagggtaagatgatatctcattatagtttttatttgcatttttctgatgatcaatgatgttgagcaccttttcatatggccatttgccttttgtatgtcttcttttgagaaatgtctattcaaatattttactcattttaaaaatcagattattagattgttttctacaaagttttttgagctctttatatattctggttattaatttcttgtcagataggtagtttgcaaattttctctttaattatctgtgctgtctcttcactttgttgtttagatcaggggttcccaacccccgggccatggactggtactggtccatggcctgttaggaactggaccacacagcaggaggtgagcagcacgagagtgagcattaccacctgacctttacctcctgtcaggtaagcattggcgttagattctcataggagcacaaaccctactgtgaactgcaaatttgagggatctaggttgcgtgctccttaagagaatctaatgcctgatatgaggtggaacaatttcatccccaaaccaactcccctcctgtcccagggaaaaactggcttccacgaaactggtccttggtgccaaaaaggttgaggaccactggtttagctcctttgttttacagaagctttttctctttatgtgatctcatttgtttatttttgctttgattgctagtgcttgtggggtattgctcaagaaatttttgcccagaacaatgtcctggagattttccccaatgttttcttgtagtagttccacagtttgagatcttagatttaagtctttaatacattttgattttatatttttgtatagcaatatgggatctagtttccttcttttgcatgtaactatccagttttcccagcaccgtttattgaagagacggtcatttccccagtgtattttcttggtacctttttcaaaaataagttcactgtaggtgtgtggatttgtttctgggttctctattctatgccgttgatctacgtgtctgtttttattgcagtaatatactattttggttactatatctgtaatatgattgaagtcaggtaatgtaattcctccttttttttttttttttttttgttaagataggctcggctgctctgggacttctgtggttccatataaattttagaattgttgctttttctttttttgtgaagaatgtaattgctattttgatagagattacattgagtctgtagcttgcttttggtaatatggacattttaacaattttgattcttctaatccataaacgtggaatatccttccattgtttggtgtcctcttcaattatttcttttatcagtgttttctagttttcattatagcaattttcacttctttggttaagctcattcctaggtatttaattttatgtgtggctattgtaaatgggattacttttttattttcttttcacattgttcactgttggcatatgaaaatgctactgatattgtatgttaatattttatcctgcaactttactgaatttgtctatcagttctaatagttttcctttgaagtcttgaggtttttccaaatgtaagattatatcatctgcaaacagaataatttgatctcttcctttccaatttggatgttggttatatctttcttttgtcttattcctctagcaaggatttccagtactgtactgaataacagtggtgacagttagcacccctgttgtgttccatatcttagaagaaaggctttcacttttttcccattcaatgttatacgagctgtgggtctgtcatatacgacttttcttgggttgacatatgttccttttatgtccagttcgtttagcgtttttaatgtgaatacatgttgaattttttcattttttcaacatccattaaaatggtcatatgtttttatccttagttcgttccattgatatggtgtatcacatacattgatttgcacatgttgaaacattccttcatcccagggataaatcccacttgatcatgatgaataatctttctaatgtattgttgaattctgtttgccagtattttgttgaagatttttgcatcaatattcatgagatatattgtcctgtaattttctttcttttttttttttttgatgtttggagggtaatgctggccttgttttgtaagtttggaagtaatctcactgcctacatttttcggaagagcgtgagtaggattggtagtatttcttctttaaatattagttataattcagcagtaaagccaacaggctccaggctttcctttatttggagaatttttattatgacatcaatctcgttacttgttattgatctgttcaggttttggatttcttcctggttcaacgttggtaggttatatgtatttaggtatttgtccatttcttctaggttttccaatttattgatatatagttgctcatagtagccactaatgatcctttgaatttctgtagtttcagttgtaatatctcctttttcatatctgattttatttatttggaacttctttttttcttagtctggctaaaggttggtcaatttttttaacttttcagaagaaaaaccacaactatttgttgtattgatcttttctattgttttattcatttcaattttatttctttctgctctgatctttatttcttttcttctactactataattttgattttggtttgaccttggattttaagttcattaagatgcatcattagattgttcttaaaaagtttttcctctttttaaatgtaggtccctatagataaaagcttccctcttagtacagttttttttttttgtatccaataggttttggtatgctgttattttattatcatttgtttaaggaaatttttctctgttttttctcaatttcttcatcgacccactggtcattcaggagcatactgtttaattttcatatatttgtatagttttcaaaatccctcttgttattaatttcttgttttattttattatggtcagagaagatatttgatataattttatttttttgaatgttttaagacttgttttgtgaattaatatttgctctgttattgagaatgatccatgtgctgaggaaaggaatatatattctgcagcttttggatgaaatgctctgtaaatatttattaggtccatttaatctatagcgtagattaagtttgatatttctttattgattttctgtctagaagatctgtccaatgctgaaggtagcgtgtgggtctccagctattattgttctgtgttttctcattctcttttgctctcatagtatttgctttatatatctggatgctccagtattgggttcatatatatttaaaattgttaggccaggcacagtggctcacacctgtaatcccagcactttgggaggctgaggcaggtggatcacgagatcaggagatcgagaccatcctgaataacacggtgaaaccccgtctctactaaaaatacaaaaaaatagccaggcatggtggcgggcacctgtagtcccagctactcgggaggctgaggcaggagaatggcgtgaacccgggaggcggagcttgcagtgagccgagatcgcgccactgcactccagcctgggcaacagagcgagactccgtctcaaaaaagaaaaaaaattgttatgttctcccgctgaattaacccattttctttacatagtcgccttctgtgtctcttatagtttttgccttgaaatctattttgtctgatgtaagtgtagcgacttctgctcttttttggtttccattggcatggaatatctttttccatccctttattttcagtctaagtgtgtctttatgagtgaagtgtgtttctttttggcaacagttcagtgagacctttttttttcatccattcaactagtctatcccttgtcattggagagtttatttcatttatattcaatgccattgttgataagcaaggacttactcctgccatattgttgttttctagttgttctatggtcttctcttcctcttttcatttctttccaccttcctctagtgataataattatctctggtaatatggtattgttttttggttttttttttgtatttactatatgctttgtttatttgaggttatcatgaggcttgcacatattatcttgtaacctattatttaacctgataaaaaccttatgttattttcataaacaaacaaaaagtcaaaaagaaaactagtaaaaactctatgtcctaactttgtccctctgcttcttaactttttattgtttctgtttatatcctattgtactatgtcatgaaaagttgttgtggtcattatttttcattggtcgattatttagtctttctacttagggtaagagtagtttactcatcacaggtacaatgttaataatatcctatgttttcctgtgtacttacttttatcagtgagttttataccttcaggtgattgtttattgctcattaatgtcttttactttctgattgatggacttcctctagcatttcttgtaggataggtttggtgttgatgaaatccctccgcatttgtattaatacccttaattttacagaagataaaatttacttgagagaagttaagaaaattatcccttgctagtctactagttagtgaatgttccaaaaatcaccaaatatcctaatattcagtcttcttattttaaatatgtctttaaaacttttttgatgctttttcttctgcctctgctgtttcttctttctttgtgaaaacatctactttttatactgttatgaaaaggaatattgatacaactgggtccttttacttaagtacaacttctatcagttctgcaacttcatgaatacttagtggatttggtaacatcaattgtctccaaccatctgtttgtagcttattacagaaatgtgattattttgccttaggggatccataatgagctccagaaaatcctagatgtcatctccattttgagctttttaaccaattctcgcttctcatatattttctttttcttatttagtagaccagaaatgtagagaaaccccatggccatcaccagccattactttgtcattcttctaattccctacttctaagtttctactttatttaaatgttaacattttttaaaatctataaattattttttgtgaggtgtaatagagatttcccttgatcagtaaaatacatttcatcttcatagtatacaactataagtgagtagcagctggccaggaaaagttcatatttgcatgcacccatatagttatgaacatatgattagttttcatcaatggaatgtaggtgaacatagtgagtgccacttttggatcaagactttgaaaatataaatgtgccaccttttttcctgtttctcttcattgatttgctgtatatttaaaatgataaggcctatgagctgtactgttttatatggtggccattagccacatgtgactatttcaatctaaaataattaaaatttaatacaatttaaaattaagtttctcatttacactagccacatttcaaaaatataaaggttatattgtcattattgcaaaatctgttattgaagggcactgacttagataatggtagagataagatgcagagagccttgttcattgcatcttagtgaggagagccaatcagctattcacctctgatgagtgcatgaaataaacttctagtttagtccagtgtacatctatatatttggcggtctttatttcttagtattttagattgtcctagttgacatagaagctaagtggtaattttaaaaatattttaacatctttttagacatttggaagatttcctacctccttttatttttttatttgtttttttctacatttaaaatcaaaacaatatagaatatgtttttttaaagtagaatgttttaagatgtagtgtattcaagaaaaaagtccaatagaaacttctcatggtaatgcatccacagtgaaaaagccatgatgaaacttcaggtttctttttccaccttcttaccttataagataatatccttaaaagtacaagcccaggaagggcatggtctttgggctcagattctttgggtttgagtcatgattctaacacttcatatttacaacctttgtagttttatggccatctataaataacaataatcgaaaaagtcaccagagttctgcacatagaaaacaatatatcagtttaattgctgataaaacctgggctggagaatatgaattagatatgtggcaataatgagcttcatgatactcctgaccccaccaatttagatattggcacagtctactgcaggcaaagcttgagtcttcaggaaagacttgcacagaattgttgcctttcactgcaggagggggttgagaaggagagtagagtgcaaattttcaaagtttaggaatttcaatacattaacatcaccaaattcatagatttggaccaaggtatatctgacaattcaattagccactgttgagaggcaaagaagtgtagcagaagaccagaataatataaggaaaatttattgtcaagaaaaccagagaaataatagagaaggctttagcattgtgagtttgtttctttacagtaaatggagatggtaatagtgcttaggattgctatgaccattaaatgctataattttagtaaaacatataatgctttatgaatggtaaacttttactaattctattagtaataataatgtcattttttattgttgttgcctgaacatttatagttgtagattaattatttggtaaacttactggaggggtgatgaagcaaagttgattaatgggtacaaatatatagttagatagaaaatataagatctttagtttgatagatcagtaggtgattataattaacattaatctattgtacatttcaaaatagaagaaaataattcaaatgtttctggaatacaaatatataaatgtttaaggtcatggatatacaaattacacccacttgatcatatggatatatcaaattttcacgtgtacctcaaacacatgtacatctattatgtataagtacaattttatttaaaaagtaaacattttagtttttatgaagtagaatttttttaatgaagctagaaagaatgaatacttgggaattcctaagggatgacaataactaatgaaagttttatggaaagtaggaaagttgctgttttattttctctgtaaatttgactggctctggatcaggcctgaaacaattgctggcaaacaatatgggaggtaagttttgtatcttaatcaaaaaattagaaattaagtattcattctttgaaatagaaaatataatgagcacatattattataattagcatttgcaactggaaaaatattggggaccattaaaatttaacaggaatggaatcattcttccatctattaatttttactaatctattggataattctttagtgtcatagtacatcacattgcactgtgggcctgttggggatgcaaattagctcaacattcattctgtcttcaaaaacttgtagactaatatatggaatttagttctaaatattataatccttataatcctataataaaaagtaaaaattagagctttgggagtttagagaaaaatattttcaattgtagaatttagaggaagtattattttcagctgtggtgtggtttgggggaggaaagcttcaagggaagtttgaaggaggagatagcatatgaactcagttacatttggacaaaagtcatggtggtagggttttccatgccaatgaaacaagaggtaaaaaaattatttccatctgggtaaattaaagatacacaaataaaacagaagcaattaacaaatgtaatataaattatttgccaaataattttatagttttacttagtataagaaaaatgttgaacttatgttaatagatctagataatctaaaagctaaaatgtttaagattgacttaatttagaaagttttgaattggtttaaaaggaatgaatgaaaataaacgaatgacttagatgtaatttctgaggaagttttatatgttaatagtgagctattctaaatcttgctaccttcttatagacacattggaataagaatcagttgtacagatatgtactaaagatgatggaatcttgaagtgaatgtacaacataaataagaaatgtatatcattctctttaacatgagcacgtagtatttttaaaactaacttgaaatatagtaaattgtcaaatttaaaatacaggtttggagtattgcattcaatttcaattataaatctcaaaaaatatgagtaatttcagaaactttacaagtaataaaacaaatcttcaattgttattattttattgggtagataaaataaataatataggcaggcacatgtacacatacacacacccatgcatacatagattcacagagatgcacataaacagcatagcacatgcaagttatttatgcatgaaaatttttaaagttatactattataacaggtatagtgccatttgtttaatctctttaaatgaaagatatttacatttaaaaatattccagtaagattcactatgcctattatattttaactttttataatttctattatgtttagtgttatctgtgatattgggccatgcataaaagctaacaataaagaaatttccatgtttccacactgggctgaatatatcctgaaattgaatactgaacaatgaattatattatgcaaaacagaagacatacaagcagaaaaggctgaagtattttaatggcacttcaaacgcttcacataatgggaacatagatggaggcacactttttttctttgatggctcaacccctctatttcagtttcatgaaccttttgttcatgtcctctctaaaagaattttaaagaacattttagatgttgcacatttatgatgtcatatatttttattatctaagttttattatctagaagtggcaaaagatagaatttttggcatattgcatacattgtcattttaaataaaacagttacatttgcttaaaatatctcagatcatccaaattccataatgatctgatacaaccaaactgttacacaatataatgaataaacaaactcttatttcaaaatctgaaattacgtattatttgttttcccccttgtaattatataaacagtgcacttctttcacataaacttaatataatacattttgtatttgaaaattcttattgatcaaagcaacttaagtttcttcagcaaaataatatgtatctaaattgaaattatattttgtaaattttcagttaccataaatctctaaatgctaaattttcttctgtttggttgccaattgtaattcttagtagtaaacaataggtcaaaacaacatgcatctttcatcaattttgggaaataaccaaagtataaaaattattataattatttctaaatgagatggatgagttacgcttttgttttttcaattgacttattatgtatctgtagatagatattacttattgctacagtgagtcaaaacacaatattctgttttttttctcatttaatagggataagtgctgagtaaacctcttcataaacaaatagatgataatacagttatgatgttacagcaatgtttctcaagtctttgtacttttttttttttttttttttgagacggagtctcgctctgtcgcccaggctggagtgcagtggcatgaactcggctcactgcaaggtctgcctcccaggttcacgccattctcctgccttagcctcctgagtagctgggactacaggcgcctgccatcacgccaagctaattttttttttgtattttttagtagagatggggtttcaccatgttagccaggatggtctcgatctcctgacctcatgatccgcccgtctcggcctccgaaagtgctgggattacaggcgtgagccactgcgcccggccactttttgtaactaaatgaggccttcttcaattttgttgtaagcaaataattggaaatccctcaaattgcaaaatgctttgatacctagtcactggtggaattaatttccttaacataagcagtaattttgcaaactgttgaattgttaaacctataggtattaaaccactggacaactctaatataattagtcaaagggaaggctttcttttataaaataggaaaatagtgaaggtgaagaggaagtgggaaccaagatgatgccttcaccctgtgaaaggtgtatgctcacttttactcatacaaatccattttgggacagacaacacatggtatttcaggatacggtaattgctttgctttaaaattatctatacccttatatctttttgagtgtcttcaggtagccaagaggttgcaggcagtggaattggctgttgtttttcatccctgtgagcagggttattctgtcatgagttgctgtaatggcctgaggtagctggcctccaaccaggaggtggtgctttcaagagagcaccagccacaatggtagcagaaggatctaagcttgccctaagttggccagggaaagtattctggtttctcaggtggtgggtggggtcataaagttcccaggagtttatgtcttttgtgtttggctaccagggcgggtagagaaataccatcggctgggggcaggtttaggtgggtctgggctcagactctccttgggaagggcttgctatggccactgtgaaggatggggatgtggttctcaggccaatggggttatgctctggagattattatggctgcctctgctgtgttatataatttgccagagaagtccaggatggctggtagcaaaaaacttcactcagcttccacgcggttggcaaggtggtcttgttcccacagtgccctgctcagatcttgccccaagctatcagcttccctgttgagaaagcaagcttgcctttcaggcctccccctatctcatctacccgcagtatttgctgtgtctccctgtactcgtatctgcatcagttctcatttgccccctggattctgctcaagaaaatttatgcccagttgaaattattacgaatttagttcgaagcgtctttcacactgtgacccctccctaatcctgctggctgccttccccaagggcctctgtgagatatagtctgggatggcttccctgggaacgagctggagactggaagtgcctacaagtctcttcttgcttctgtttctacttttgtattttgtgcaactccctaaatctgtttcagctataggtaaggttaaatccttttcccatgatctggattttcagattccctagtggggatatgtgtttgaaggtaggctttctccctttcacactttgggaactcacagtttttcacttgtctcatggaatttgcaatagtgtgccacttctttaaaaggacctgtaaattatttcagttttctggtacatttctgtgatggttcttggagcaaaagttcatggtgtgagtctctacacactgttctgtctatctaagtggtagctgcatgttagccctgtcttctatctgccatctttgctagattcacctgtattatctttttgatttgttgttggcttcacgttagtggtattttgttggatatttttgcatctatgtttatcagggttattagcctatagtttttggtttcttgcatccttacttggcttttatatcaaagaaattatggcctggtacaatggattaagaacattttccacctattcagtttcttgaaacactttgagaaaaaaaaaatggttttcgttcttttttatgagtttggtagaattcagctgtaaatctgtctgtccctaggcttttcattgtttggagcttttttattactgattcagtcttattagtcactattggtttgctcaggttttctaattattcacagttcagtcatggtagactatatgtttctgggaatgtatatattttctctggattttatctaactttaaacatagtcatttataatttttaaattttttaaatgtaggatctgttaaaatatctcctttatatatgtaattttatttatttggacgttttcttttttctttttttatggttaagctatctagtattctagcaattttgtgaatcatttcaaaaaaacaaagttttgttccattgatcttttgtattgttctttgtccctattttgtttagttttgctctgacctttattattgaattcctactaattttgattttggtttgttcttacttttctattttcttgagttttatttgtaatatttctacttttatgatgtaggcatttatataaacttttctcttgccactgcttttgctctatttcataggttttggtatattatatttccattattatttatttcaagaaatttaaaaattttcttcttaatttctttatgaatacaatggtcatttaagatctggttatttaatttcatgcaggttccaatgtacctcttatttttgatttctagttttattcttttgtggtctaaggtacatgacatgatttcaattaaaaaaaaatcctgagacttattttgtgttctaccatgtgatctatcctaaagaatgttccatgtgctgatgagaagaatgtgtaccttgcagctgttgtataaaatgttctgtaaatatttgttgagttcatatactccaaaatgcaatttaatgttttttggtcatttatttttgtctagatctagatgatatgtcatatgctgagattgggatgttgaagtgtccctctattttcatattggagtttcctctcacatttgatctaataaaagttgctttatatatttgggtgttctggtgttcagtgaatatatatttacaatcattatatactcttgctgaagtgatccctttatcgttatatagtaaccacctttgtctctgtttatcattttttactttaaatctgttttattttatgttagtgtggctactcttgcacacattggatttctgtttgtgagggctgtctttttccaatcttttacgtttattctgtgtctttacagatgaagtggcttgcttgtagacatcatatacttcagtcatgtttttgtaatctattcagccaatgtgtgtcttttaggtgggaaatttaatccatttacattcactattattattgataggtaagaatttataattatcattgtgttgattgttttctggttgttttgaatgtcctttatttctttctctattcaataaggaataatcgtttctctattattgtttatagttatgtttgttggctttctgtaatggtaacttttcaattctttcttgttttcatttgtgcatctgctttaccagtgagttttatattttcatgtgttttcattatggtggatattgcccttttacttccaggtttagggctcttaaagcatattttagcaccagtctagtggtgatgagcttcctcattttttgctagtctgggagagactatacatatccttccattttaaggacatctttgctaggtatattatacttggctgacactttttctttcagcactttaaatatattacacattctctcctggcctgtaagacttctgctgagaaatctgctcatggtctaatatggattcccttatatgtgacttgtttcttatgtcttgtagcttttagaatcctctcattgtctttgaattttggcattttgattttaatttgctttggagaaaactttactgagatgaatctatttagagattttgagcttcctgtggagagttgcaatgtttttgctattctcttgatgaaataattttctatgcctttgcccatctttttccctggaatttctaaaactaatatttggttgctttatgtttttttatatgtctcataggctttttttatctttttaatttattattctttcttctttttctgactgttatttcaaaatacctatctttaatttcagaaatcctttatactgctagatgtattctattactgaagtactcaattacgttttttttattgttaattcttgtgtgtacatagtatgtgtatgtatttatgaggtccattagatgttttgatacaggcatgcaacataatcacattgtaaagaatggagtatccatccactcaagcatgtattctttgtgttacaaacaatccaataacattctattattttaaaatgtacaattaagttattttaaatgtacaatgaagttattatttactgtagtcaccctgctgggctagcaaacagtaagtcttatccattttttctactttttgtatcaattaactttccccacctccccctcaaccccccagtaccctttcctgcctcttataatcatccttcgattctctatgtccagagttcaattgttttgatttttagattccacaaataagtgagaacattcaatgtttctctttatgtgcctggcttatttcacttaacataatgatctccacttcaatccatgttgttgcaaatgacaggatatcattctttttatcattgaatagtactccattgtgtatatgtaccatattttctttatccactcgtctgttgatggatatttaggttgattccaaatattagatattgtgaacagtgctgcagtaaacaagggagggcaaatatctctgtaatatagtgattttctttcttttgggtatatacccagcagtgggactgcttaatcatactggtatctcaatttttggtttttggaggaacctccaaactgttctccatagtgattttacttatgtacattcctgtcaacagtagacaggggctcccttttctccacatcctcactatcatttgttactgcctttctttggatataagccattttaactggggtgagatgatatctcattatagttttgatttgcatttctctgatgatttatgatgttgagcaccttttcatatgcccatttgtcatttgtatgtcttcgagaagtatctattcaaatattttgcccatattttgatcagattatttgatttttttcaatagagttgtttgagcttattacatattctggttaataatcccttgtcagacagtaaatttgcaaacattctctctcattctctggaatgtctcttcactttgttgattttttatttgtttacagaagctttttaacttgatgtgatcccatttgtcgtttctactttccttgcccttacttgtaggttattgctaaaaaaaaattgaccagaccaatgtcctggagattttcctcaaagcttccttctagtagtttcatagtttgagatcttagatttaaatctctaatcccttttcgtatgattttatatatggcaaagggggtctagtttcattcctttgctcatggatttctaatttccaagcaccattaattgaatagactgtgtttttcccagtgtatgctcttggaacctttgtcagaaatgagttcactgtaggtgtgtggatttgtttctgggttttctattttgctgtattggtctgtgtgtttttatgagagtaacaccctgttttggttgctataactctatagtacaatttgaagtaaggtaatgtgatttttcagttttctgctttttgtttaggatagctttggctattgtgtgtcttttgtgctttcatgtaaattttaggattttttttctttttctgtgaagaatatccttagtattttgatagggattgcatttagtctgtagatggcttttggtagtatggacattttaacagtattaattcttgaaatcaatgaacatgaaatatcttcatttttatgtgtcctcttcaaggtatttcatcagtgttttacagtttttattatagaggtctttgacttccttggttaagttaattgttaggtatttaattttatttaattttatgtgtagctatcgtaaatgagattaccttttaatgtctttttcagattgttcactcttgacatatagaaatgctactgatttttgtatgttgattttgtatcttgtaactttactgaatttatcagttctaatagtatttttgtgtagtctttagtttttttcaaatataagatcatatcgtctgcaaacaaggatactttgactttttccttttcaatttggatgccctttatttctttttttttgtctgattacactagccaggacttctagctatgttgaataacagtggtgaaagtgggcatccttgatatgttcccaattgtagagaaaaaatttttatattttccctatttagtataatactagtagtgagtctgttgtatttagcttttattaagttgacatatgttcattctataagcagttttttgagaagttttattctgaagggacattgaatttgttttgtacttttagataatttctccctgctcattaacatccttttttctgattgaaatactaccgttagcatttcttgtaggataggtctggtattgatgaaattccttagctgttgtttgtatgggaaagtctttatttctccttcatgtttgaacaatgttatcagcagatataccatttgaaactaagtactttttttctttaacactttaaatatatcatgccactctctcctgacctgtaaagtttccattaaaaagtctgctgccagatgtattagagcttcattgtatgatatttatatattttatcttgctacatttaggatactttctttatccttgaccttttggagtttgatttttttttttttttaagactgagttttgctcttgttgcccaggctggagtgcaatggcgcaatctcagctcaatgcaacctccgcctcccgggttcaagcaattctcctgcctcagtctcccgagtagttcggattacaggcatgtgccaccacgcctggctaattttgtatttttagtagagacggggtttctccatgttggtcaggctggtctcgaactcccgacctcaggtgatctgcccactttggcctcccaaagtgctgggattacaggcacgagccaccacacccagccgggaggttgattattaaaggccttgaggtagtcttctttgggttaaatctgcttggtgttctataacctttttgtacttaaatatttatatcttctgtgcagcacaccaacatggcacatgtatatatatgtaacaagcctgcacgctgtgcacatgtaccctaaaacttaaagtataataataataataataaaaataaagcttctgcttcagtgcagctaaaaaaaatatttatatctttctttaggtttgttctcttttattatccctttgaatgaagtttctactgctgtctttttctctactctctctttaaggccaataacttttagatttaccatttcaatgctattttctagatcctataggtgtgcttcattgttttttattccttttccttttgtctcctctgagtgtattttcaattagcccatcttctagctcactaatactttcttctgcttgatctatactgctcttaaaggactctgatgcattcttcggtatgccagttgcatactgtatgccatttttcagctccagagtttctgcttatttttaattactccaatctctttgttaaatttttctgatagaattcttaattccttctctctgttatcttaagtgtctttgagtttcctcaacacagctattttgaattctctttctgaaaggtctcatatctctgtttctccattactggtccctggtgtcttattttgttcattttgtgaagtcatgtattcctggatgatgttgatgatagtagatgttcttctgtgtctaggcattgaagggttaagtatttgttgtagtttttactttctgggcttatttgtagccattattcttaggaagtctttttagatatttaaaatgacttgggtgttgtgatctaagctgtatctgctttagggagtaccctatgtccagtaccagtgtggttcttgcagacttgtaaaggtactgcctttatggtcttggacaagatccaggagaattctctggtttacctggcagagacatgtattctcttcccttactttttccaaaacaaatggagtttctctctctctgagctgaactacctaaagctggatgaagtgatacaagcacccctgtggccaccagcactatggctgcactggatcagacctgaagccagcacagtgcttggtctcacccaacgcctgctgtaaccatttcctggctactgccaatgttcactcaagactctggggctttataatcagcaggtatgaaagccagccagggctatatccatttcttcagagtggcaaattccctgaggtcccaggttggtccagtggtgctgttcggtagtcaaggactagagtcaaatccttagaaatctacttcatgttctattatactccagctaagctggcactgaaactacaaggcacagtcctttccactctcttcacgtttttccaaatgcagaggagcctcgctccgtagtcactgccaccacaggcaacagggagtactgccagactagcaccaatgtatttttaaagcccaaggacttgtaagtcagtttctggtgaatgctgcctggcctgttagtcacttttcagggcagtgagctcccatctggccctggacaggtccataaatgccatttatgccccctgttctgggattggggaccccgagagctcacttgttgctctaccatcctgcagctgagctggtacctaaggttcaagaccaagtgccctttacttttccttctgtttttctcaagaagaaggaattttgccccatagccaccatagctggtagtgcactgagtctcacctgaagccattatgtcttagaggctcattcaaggccctcaacatggtacgtgggtatcactgctggttattcagggcccaagagctctttagttaacaagtgatgtatactgctaggaatgggttcttcccttcaagtcagtggattcccttgtatctcagatgttatctagaaatttcttccagtagctagtgcctggaacaggggcttcatttctcttactggtgccctattatactgtggctgaactggtatccaaaatgcaagacaaagtccatcccagtcttttctctcctctcaaatagagggaaggggtgtcttttgtagctgtgagctgtgcttcctggggttaggggaggagtcatgccagcacttccttagccaccccagctggagtctcagtaggttacaggccacccccaaccccgtcaccaaccaagttcactgtctcttggcccagttcatcactaggacttgcctcagcgtcgcagtccttgtggcctctcctgtctttgaggtttacttttagacccagagcactttagccctcagtggtgagcaaggtatgtaagaactcaaattttcaccattgggatggcaagtccccttcagctagaaatgctccttccatgggcaagagtcagctgagtttggtctggttttcctttctgctctaacagcacagctctgagttcaatgcctcacaattactatactctctctcccccagtaccctgagatgctctccacaccatgccaatcctgctgggggataggaaagtagtcatgtcaatgattcaaaactactttttctgtctcctcactgcctatcccagtgatatgaagttaaaaccagtactctgaggactcacctgatttttgtttcttatgaagttatatatttttttcttttctgtataaatagttgtaaaattggtgtcctcacatgggggactatcaattgagcattctattctgccactttgcttcctctctctctcatatattttcttgtttgtatttttttattacattcattaattttttagttctagagttcccatgtgtttcttttttaagatgtctatttctttgttgaatttctcatttatatcctgaattgtttttctcgtttctttgtattatttttccatattgtctttatcttactgagcttttttgataacattatttctatttttttaggcatttctttcttgtttttcttttttggagtcggagtcttgctctgtcacccaggctggagtgcagtggtgcaatctcagctcactgcaacttccacctcccgggttcaagctattctcctgcctcaccctcccgagtagctgggattacaggtgtgtgccaccatgcctggctaattttttgcattttagtagagatggggtttcaccgtgttgtccaggcattagcagtagcagtagcagtggtaggtcaaccgttgggcctctgagcagagcacacgagcaccagtagtggcagcagcaggctggacagactattccaaggccatgaggtggtgcctaaaggagagtgccagagactgcaccagtggcggtaggctgggtagactggtcacttggcccctgggatgtgcatacagtcactggatgtggcttgaatgggcctatttttaggtccccagaaggtgtagatgggtaccagtggtggttgctgggctgcattaatccccaggaacccagataacgtttgtgggtggtggtcatgttgagtgggacatacctgtcctcaagcccttgagaatgtgcaagagcaccagcgtccagtggcagggtggatttatctctaggcctcagataacatttgtgggcactggggggtggtgatggtgggtggaacacatctttcctcatgtccctggatcatgtgtacaggtgcctgatgtggcaggcagggcaggttgatccctaagcctccagatggtttactgggtctctggtggcagtagtggtcatcagtggtacagatttattcttaggccactgatcagcatgtgtggtctttagtagtgacggatggattagattgattcccagttcccctggcggcatttgcaggtgcctggtagtcctgccactggtaggggaaggattgctatcaatggcagtggtcccaggcaaacaactctcaggatctggggagcatacacattggttccctttgtcctggaggcagccttccagatggactgaaccatccattacccagagtgtaagacactgtgtgagctagagtgctggggaccctcctgcaccactggatccagttggtggtgtgatactgcagccctctgagtgtatgtggagagatgtcagtggggtttcagaaatgaggaaatgcagggattattggaccctagggcaggatgcagtctggggtgctggactctcaaaatggcactgtgctgcagatgcttgggtctcaggggctgtgtgggactcagtgtgagctttctctctggaacaacaccatcacgtggattccacgcacctctgcgtactaaccttagggcctggaagtgctctcctgtggctacaattctaagaatccaaggtgcgaatgttgacggctggagatatcttgcttaccttttcccagcaatagggagttcctgctggctacaagccaattccagtggggctggttgctttgcttccctcttgttctgtgcctcagagtttccctgtcacttcactttggaattccagtgttctctcttagaagctctatttaatgtgtggttagctcactgttaagttgttcttttttggagaaggcaagtcccggtcacctctatttagacattgtgaatccccctcctatactgtgttttatctatttaaaggaaacaacaataaactgttaaattaactgcagcttttcttatcaatttattcttgcttataaatctacaatcatttttaattaaaaaatcttttaaggctttcatatgaatagctttaaatttataattcaatcaaaagataatagacaagaaaaaacagaatgtagtgtgatctttttacattttttatactaagtatgccatatgtatttgagaagtacatagcaaatatcttactaatagagctgttaagattatggtttgtgggttctgttagccaaagttgaaaccccacttgggtattcactgattatatgaacttactcaaattacttcttaatgaatatttctttctccatctgtaaaatagtacctgtctcataaggtttttgtaaataaggcagtccatgtaatttgttataatacttggtatgtaattgatgttcagtaaatattatttgttgtaatttttaaacatatcatccttaggataaactccaaaattgtaaggccttgagtattctgatctctacctatcatttaatatatgggagttttatgtattagaaaaagatctagatttacattgcagagatgagaaaattcaaaccatgtagtgacttaaaaatattttttctaaattataaaatataagttcaaagggaccaaaatctgtgagaaaagagtttgaataaattttggtttagtttcctgactaaaacattagacaaaaccacaaattatggaagaaatccccttgaaagttacatttaggagagaaaattttctgaacctagattcatttcaatgttaagggacttgtttcttgtttctaatattaccttgagtgacatttctatctaaaattgacacttataatatctaattttatttgcttctaggtgagttcttggatgaagtgcatccttatagcttctggggactaatctcaagtcatctgaatttattaacaaatccatgatctgagataaatgactctctagattcatgctatagttatttgataagtgttgactatcattaacccaaaaagccacattttggaggagcacaaacttcttgtagaattaatatgatattaacataaaatgcttcattttatggggtctggttcagaaatgcattgctctcccatctccgtgatcaaattggaccataagttacatgctgggctgctttttgttgctttgggatgctggtacgctattatctcactgctaatggtagccttagtggcttcccccggtgttccttccaaagtttccaggccattgttttaaaaatatgttttggtcttttatagcaagtggttgttaacatgttgtttgtataatagagaggaagtggaacttcacagtctttactggtggagagccattttcagttgccgctttgcttattaacaagaaaagatcttaatagtttctgagaaaattcagtcccttttactcaacttacaatctctgtggggtttatagagaatcttttacagagaatgaaaatctgtgtttaaaagaatgtaaagaggttatgtgtgggattataaatggtatttaagtacatattaggcatgctttcacatttatgtttatacagaattcaaaaaaatagtgcattcagtttgctgtatcccattcaaatatttatcccttcgtgattaattacagttacagaaatgactacatagtttaaaaggttaaaaatgaagaaagattgtcctacggatttttggtactagttctttgcatgtctggtagaatttggctgtgacttcatcatgcccatagctcttttctggatggtagggtttttttattagtgtttcaattttagaacttgttattggttggttcagtggttcagttactttctggctcaataatgggaggttgggtgtttccaggagtttacccatttcttttagtttttgcagtttgtgtgcttataagagttgataattgtttgaggatttttttttttttttgctatggggttaattataatgtagctttgttgtttctgatgtgcttatttggatcttcttttttttcctttgttattcaagctagtagtctattcttatttattctttcagaaaacaaattttggttttattgattttttgtattttaatgtttcaattttcagttcttctcgaattttggttatttattttcttctgctagattttggtttactcttgtttttctagttcctctgggtgtgacattaggttcttaatttgagatccttctatcttcttgatgtaggtgtttagtgcttgatatggtttggctgtgtcctcatccaaatctcatcttgaattgtaaatcccgggtgttgagggagagatgtggtgggaagtgatttgattatgggggcagtttcccctatgctgttcttgtgatagtgagcaaatattcagatatgatggttttataaatggtagtatttttccgcactcacacacacttgttctctctcgcctgccaccatgtaagacgtgcctcttccccttctgccatgactgtaagtttggcctccccaaccatgtggaagtgtgagtcaattaaacctctcttctttataaattacccagcttcaggtatgtcttgatagcagtgtgaaaatggactaatacggtactgtaagcttttctcttaatactgatttcgctgtttctcaaggattctgttatatcacgtctttttaattaatttcaaataattttttgatttctgccttaattttgttctttacgcaaaagtcattgaagaaaaagttgtttcacttccatgtaattgtatgattttgagagatcctcttggaattgctttctatttttttattgcactgtggtgtgagagtgtgcttattgtgattttattttattttttgaaatttgttgagacttgctttatagccaagcatgtggttggtcttagaataggtgccatgagtagataagaagagtgtatattctgtgtttgttgggtgtagtatcctaaagatatctactgggtccgattggtcaagtgttgagtttaagttcagaaatatatttgctagttttctgccttgacgatctaatgccagcacctgttattttttgactttataataatgaccattcagactggtgtgagacggtatcacattgtggctttgatgtgcatttctctaatgatcagtgatgtagagctttttttcatatgattgttggtcacctatatgtcttcttttgaaaagtgtctattcatatcctttgcccactttttaaagaggttgttaggtgttttttaataaatctgtttaagttccttatagattctggattttagaactttgtctaaatgttttttcccattttgtaggttgtctgtgctgttgatagtgttgtttgctgtgcataagcacttttgtttaattagattccatttctcaattttttcttttattctaattgcttttggcatctttgtcatgaaacatttgcctgtgactatttcctgaatgatattgctaggtttacttccaaggtttttatagttttgggttttatatttacgtctttaatctatcttgagttattttttgtatcttgtgtaaggaaggggtccagtttaaatcttgtccatatggctagccagttatcttagcactatttattgaaaagggaatcatttctccattgcttgtttttgtcaggtttgtcaaagatcagatagttgtaggtatgtagtcttatttctgagttctctatcctgttccattggtctctgtgtctgtttttgtaccagtgccatgttgttttggttactgtagccctatagtatagattgaagtcaggtgggatgatgcctccaggtttgttccttttgcttaggattgccttggctattttggctctttgttggttccatatgaattttaaaatagtttttctggttctatacattgctttgaaaagtgtggccatttaaacaatattgattctttttatgaatgagcatggaatattttttcatttgtttgtgtcatctctgatttcctttagcactggtctgtagttgtccttatagagatctttcaccttccttgttagctgtattcctaagtattctattcattttgtgtccattgcgaatggtcgtacattcttgattgggctcttagcttgactgtttttggtgtataaaaatgctagtgatgtttgcacattgatttttatatcttaagactttgctgaagttgtttgttagcttaagaaactttttgactgagactatggggttttcttgatataggatcattttgcctgcaaacagggatagtttgacttcttctcttcctatttggatgccccctaatttcttgctcttgtctgattgccctggtgagcacttccaatgctatgttgaatacgagtagtgagagagggaatctttgtcttgtgctggttttcaagggaagttcttccagctttttcccattcactttatgttggttgtgggtttgtcaaagatggctttttgaattttcagcattcttgtgctgattctttctcatctttgtgggcttatctaccttcaatctttgagatcgctgacctttggatgggtttttcttttattttctcctatttgattatcttgagtgcgtgattgtggcataaggttgattcagccaactggctttgtttctgggagatgttagaaggcaaacactcagttcccaactcctgggctgtgtgctctaactctgggggacttgtatcgagccccgactttgttctctggctccttgaggtttggagtccactgcgctggcagtcctaaggtgcagcagcttcagcagagtgttagtggatgtaggggtggctgcgtcactgcaggcattaaccacagtggcacaagcaaggcagctgaggggggcaaggggcgccttctggatactgtgcgctcttgaactggaggtgatgttgccttggggctgggtgctggccagtacaggtctgggtgccttctctgtgcctcacaaacaggagtgatccctcagggtgtgagaggatcctctgttctcttcaaagtgttagcacgagggctggatgctggtggaggtagggctggatgctggtggaggtagggcttgctggttctgtgcctgccaagactccaactgcagtggtggtcctgggggacagagggaggagactacactcatgtgtgctgatgggacaggtgaaaaaaaacccactcttgcagacacgcaccagctgcagtatggggagggtacatctggggtggtgcacagccctaggggccgccttgctggagctctacgctggtaaggcatagcctgccagcatggaagctatggtgtgggccactagggcactcaagactgacctgtaagcaggtgtggccaggctggggccctgggaagaccaatagaccaagaagtgctcaggtcggaccaggcccgttggatgagcaagaccgctctgcagagattgggtctgacagttcccctagggctaaagtctcctatgggagcaagtcaagcctatagggatggctatcgctggccatgctcaactacagacactcctgcaccaaaccctctacatcagtggccttgctgttccaccagttctctaagtagttctccctaccacctcaagtgtccatggtggacgatgggtctccttcgcaggcttccagaggcctgtgatgagagtgggttgctccttgccagttcaactcaccctttctcctgaggtggttgtggttcaaaaatgaatcccagtgtgtggcagcccatgcagggtttccaactttctcccccttaatcccagctcctgtgtctttcctctgtccactttcagtgccttccctctgaagatctgttgaaaggacaccagttgcctcagtctctccatgggaggtcttccacttgtctgtgtctagctgaccatctttccttcccccctactttcttgaggcacagagttaagttgtttatctgaaatccttcttctttttcaatggttgtagttactgctgttagtgtccctcatagtactgcttttgctgcattccataacttttggtatgttttatttatttttgttttcattagtctcaagatgttttctaattatttttgtgatttcattttgtacatttgttgttcaaaagtgtgttgattaatttctatatatatgtgaattttccaagtttcaactattgatttctagtttcatttcactgtgtttggaaaaggtacttgttacgatttcggtcttcttaatttgttaagatttgctttgtgacctaccatgtgatctatcctggaagatgtttcatttgctattgagatgaatgtgtattctgttgctgctcagtgtaatatgtcttttgacctattaatatttttcaatcctttatttcctcattaaactgtttttttatttccattatttaatttttggtttgaaatactctattattgttttactatttcttcatttaattatgttaatgtttatatatttgggttctcttatgttaagtgcatatataattgttatatattctcagataaatggcccttttatcgttatattcttgtaagagttttcacttaaagtactttttgtctaataagtatggcaacctgtactctcttttgatgctatttgcatgcaacaactttttcccttttactttcagtctatgtgtgtccttcaatctaaagtgagtatcttatagacagcatatagtttgatattgttttattcttttcctatcaatcaaccactctacctcttttgattggagagtttaatacatttacatgtaaaggaattactgatagggaaggacttgctgcattcattttggtactgtttactttcttgacatagctattttcttctcctcttattctcttgctgccttcctttgtgttttgttgatattttgtagtgatatctttccagtattttctcattttctgttctatgccatctgtgagtattttctttgaggtttccaggaacttataaaaaacattttatacttatgacaatttgttttcagctgataactatgtaactacatcagtgtacagaaactctgccattttacgtctcccccactttgtgttattaacatcacaaattacatatttttactttttgtattcaataacatagttttatagttataataattttatacttcataagtttgatgacagaaataaaactgatttgcacacatatatttatgacatacaacatgttgtttcaatatacatatacggtgtgaaatgattatcaaaatcaatcaaattaatgcagtaatcacctcacagttacctttttttcttttttgtagtgaggacacttgagatctactctcttagcaaatttcaagtgtacaatacattattgttaaatattgttaccatgctgtacattagatctccaaaacttataatagaaaatacatataatttaacaacgtctaccagtttacccaccccctgacacttggcaagcacccctctactctgtttatatgagattgactttatttatttatttattgttttgagacagagtctcgctccatagcccaggcttgagtgcagtggcatgatcttagctcgctgcaacctctgcctcccaggttcaagtgattctactgcctcagcctcactagtagctgggattataggcctgtgccaccacacccagctaattttttgtatttttagtagagatggggtttcaccacgttggccaggctgctctctaactcctgacctcaagtgatctgcccacctcggcctcccaaatttctgggattacaggcatgaaccaccatgcccagcaaagtttgactttattaggttccatgtatcagtgagatcatgcattgtttgtctttctgtagtggcttatttcacttaacataaaataccccagtttcattcatattgtcgcaaatggcatggttttcttatttttatggctgaataacaatgactaattatatatatatatatataaacatatataaacattctatttatttatctgtagaaagatgcttaggttgttttcatatcttagctattttgaatgacatggtttggatgttttgtctctccaaatttcatgttcacatatgacctccaatgttggaggtgggcttagtgggaagtgtttgggtcttggcagtagatcccttatgaatgtcttggcaccatcctcatggttatgagtgagttctcctcctggtagctcatgtgagagctggttgtttaaaatgagtgtggcgctttcccccctcactcttgctcccctctctcttttgctcccactttcaccatttgatgtacctgcttccccttcaccttcttcctccatgagtgaaagtttcctgaggcctcactaagagaaaatgctggtgccatgctttctgtacagcctagagaatgacaagccaaaacaaaaactttaatttttacctacatttattgagtctcttcggtctggtagaacataactgaacctagtcatttctgtagaactgttaactcagtaattttttttttttttgaggtggagtttcactcttgtcacccaggctggagtgcaatggtgcgatctctgctccctgcaacctcgccgcctaggttcaagcgattctcctacctcagcttcctgagtaactgggattgcaggcacccgccaccacgcccagctaatttttatatttttagtagaggtggggtttcaccatgttgaccacgctggtctcaaactcttgacttcaggtgatccacctgcctcggcctcccaaagtgctgggattacagacatgagccactgcgcccggcaactccgtaatttttaaattcaatccataattttctacattaggaaaggttttacattccctctccttttttttctaaggtggtatttaactacaggtgtagatgacaggctcatttagaatcaaagatgtattcagagaggaattatctgattctagattgtcatgtgtccatctcatgtatcctttgcaataaatatcgttctgtattgctctcagctgtaatcatttttcatcctgatattacctaagatagtcatgctatctctgaaatcgtagttgtaagattaatgctgttttctactacaacatgacattatttcaacaatgagatccttagaatctaccacctaacttccttgcttgtttcaaatccttttttttttctttgcttacttttatgcctttcctgggagcagagaaaaatcttgcttctctcttctgtcacgctgcagccacaaaaagcttcacaaactgtctcagagcaaactgatctttctagtaaaacttgacctctttgcctaatttgtctgctgttacacgatgctgaagtgtagtaaaggctggagtcttgaagatctctaagtcatatgataaacaaagcacagatttctactctttgtaaattgtattctatttggaagttctattcccctcaccttcctcaaaacttgaatgtgctttaagtgaggcataattcaagatccttttaagaaacactctccagcatctaatatgtatgtttcttttcttactcagcctctgccccctcttgccaagccaagcagttttagtgaaatgtctgccgtggcctcccttccattggacagtggcagccaaagactagcttgagtagtgaccaacaatttgggagacaaagttattgcaggtagatgtgcacagacacatgcacacataggtaaatatttcaaaaaataactttgtcacagctaaccctattctaatattgctatggaacatacaatatgataaacacatagtacatattcagtatgtttgtgaatttaaaaatgtattggttctgctctcttcaagacagagatattacatttgaattcatgtaagttcatttttttgcattgatttactatgaattaaaagtaaaacaaataaggaatgtataccagagaaatcgtcaacaccttgggagatactaagatggatttacatgtaaaatctgccctcaatgagtttatatgctaataggaagagacatatttgttcataaataactctaacacaaagcagattgtgtgccataataataagacatattaatagctacaatttattagactttaatatctgccaagctccatgcttggtacttcatatacattaacttatttattgcacataacaactagtgatgttgttgttatcatttcagtagaaataaaaaatcagagaaagataagattaacatgagtggggtgggattaagaccttcctcattaatgaagcaacatttaaactaggtctttattaaaatgggtgggaaacttagaggtgtatttggagaatacaatgttattggcatcaaaataacaagagatttgtgaggggttaatatgattaggaatgtactttgaagagatttctgatagaagtttgaagatcagagagtaaaaataactctctcatcaagaagaataaaattaaatgttaaatgcatctttaatgaataattggcacattaactgaaaattgcagattttaataactctataaattcttataacttaagcaagtctacaaatccatagtccagttatgcatcagtgctcaaggtacagtgaaattagaagccaatgacatgtatgtccccttttaaaaagccggatatttaaatgtcttttgctatcaaacacataaaaatcttcaaaaatgccattatttgataattacattatatctattaagtaatgagtatttgatgactatatttcaatccttgaaaaaagaaagaaactatagttatctaataatgtgattgattcacctaatccaagggacctctcttttgaatgaatcctataattatttatggtctttaatcgagcttacatagacaccaatttttgtcacctcaactttatgttataaatgtgttaatagataagaatctggagcaaaataaaaagatcaaagattttacaagtctaggcgataaaatttgatctgaactaaaaatcaaatttaaaaggcactcttttaagcaatgtttctgtccattatagctgagatttaataattaattactgatgtctccataattttctgataagattatggggctaataaaagcaaaattacatatttttgtaattgtataagtcgattagctttccacagataaacacaccatcttttctcagtgctattgatgaaaattatgctcaacaaaccactgatttcattagatattgataggaattatgttagaaagagattctctggacaacttagtttgagaaagtactaacttcaaaattactgcgaattacttcaaaataccaacttcagattttcattttgttttgtttttattataaactttctcttcacgtttaaaatgcccatatgcactgcaaatttctaagaaaataatatagtatgtagtatttcttaaaattatatcacagaatcctttattatgtaaactttttacccaaatattaagctataaaatatatttgaatattccgctgtatgccatacaataaaaattcttgtaatatgtgttttttaaaaatttttattataagttccagggtacatgtgcaggatgtgcaggtttgttacataggtaaacgtgtgccatggtggtttgctgcacctatcaacccatcacctaagtattaagcccagcatgcattagctatttttctcgatgctctccctccctcaacctcacctaccaacaggcccaagtgtgtgttgttaccctccctgagtccatgtgttctcattgttcagctctcaggtataagtgagaagatgcagtgtttggttttctgttcccgtgttagtttgctgaggataatgacttccagctccatcaatgtccctgcaaagcacatgatcttatttctttttatggctgcatagtattctttggtgtatctgtaccatatgttctttatccagtctatcactgatggacatttgggttgattccatgtctttgctgttgtgagtaatgctgcaaagaacatatgtgtgcacatatctttataatataatgatttatattcctttggatatatacacaataataggattgctgggttaaatgatatttcttgttctagatcttagaggaatcatcacaccatcttccacagtggttaagttgattcacattcccaccaacagtgtaaaagcattcctatttctctgcaaccttgccagcctctgttatttcttgactttttaataatcaccattctaactggcataagatgatatctcatttttgttttgatttgcatttctctaatgatcagtgatgttgagctttttttcatatgtttgttgaccacatgaatgtcttcttttaagtagtgtctgttcatgtcctttgcttactttttaataggcttgttttttttcttgtaaatttgtgtaagttccttgtagattctggatattagacctttgtccaatggatagactgcaaagattttctccattctgtaggttacctgtttgccctgatgacagtttcttttgctgtgcagaagttctttaattagatcccatttgtcaatttttgcttttgttgcaattgcttttggtgatttcatcatgaaatatttgcccgtgcctatgtcctgaattgcctagattttcttctaaggtttttatagttttgggtcttacatttaagtctttaatccatcttgagttaattttcatataaggtgtcaggaaggggtccagtttcaattttctgcatatggttagccacttctcctagcaccatttattaaatagggaatcctttccccattgcttgtttttgtcagtttcgtcaaagatcagatgattgtcgatgtgcagttttatttgtagtttctctattctattccattggtctacattcctgtttttgtaccagtaccatgatgttttgtttattgaagccttggagtgtggtttgaagtttggtagtgtgatgcctccagctttcttctttttgcttaagattgtcggggctatatgagctcttttttggttccataggaatattaaaatagtttcttctagttctgtgaagaatgtcaatggtagtttaatgggaatagccttgaatctataaattactttgggcagtatggccattttcacaatattgattcttcctatccatgagcatggaatgtttttccattcgtttgtgccctctctgattttcttgagcagttatttgtaattctccttgaagaggtccgttacttcccttgttagctgtattcctaggtagtttattctctttgtagcaattgtgaatgggagttcattcattatttggctctctgcttgcctgttgttggtgcataggaatgcttgtgacttttgcacattgattttgtatcctgagactgctgaggttgcttatcagcttaagaaccttttgggctgagatggtggggttttctagatataggatcatgtcatctgcaaacaaagacaatttgacttcctcttttcctatttgaataccctttagttctgtctcttgccttatttctctggccagcactttcaatactgtgttgaataggagtgttgagagagggcatccttgtcttgtgctggttttcaaagggaacgcttcctgcttttccccattcagtatgatattggctgtgggtttgtcataaatggctcttattattttgaggtatgtttcttcaatacctagtttattgagagtttttaacataaagggatgttgaattttattgaaggtctttcctgtgtctattgagataatcatgtggtttttgtcttttgttctgtttatatgatggattatgtttattgatttttgcatatgttcaaccagccttgcatcccacagatgaagccaacttgatcgtggtggatacgctttttgatgtgctgctgtattcagtttgtccatattttattgataatttttacattgatattcatcagagatattggcctaaagtttcctttttgttcttgttgtatctctgccaggttttggtgtcagggtgatgctggcctcatagaatgagttagagagaagtccctccttttcaattgtttggaatagtttcagaaggaagggtataaggctcctctttgtatgactggtagaattcaggtgtaaatccatctggtcctgggctttctttggattggtaagctatttattactgccttaatttcagaaattgttactggtctattcagggatctaacgtcttcctggtttagtcttgggagggtgtatgtgtccaggaatttatccacttcttctagattttctagtttatttgcatagaggtgtttatagtaatctctgatggttgtttgtatttctgtggggtcagtgctgatatcccctttatcattttttattgttgtgtctatttgattcttcccttttttccttatcattagtctagctagtggtctatttattaatattttccaaaaaccagcttctggattcattgatttttttggaagggttttttgtgtctctgtctccttcagttccgctctgacgttggttatttcctttcttctgctagctttggagtttcattgctcttggttctctagttcttgcagttgtgatgttaaggggtcaatttgaggttttctaggtttttatatgggcatttagtgctataaatttccctcttgacactgctttagctgcatcccagagattttggtatgttgtcacttcattctcattggtttcaaagaacttcttgatttctgcctcaatttcattatttatccaggagtcatgcaggaacaggttgttcagtttccatgttatggtatggttttgagtgagtttcttaatcttgagttctaatttgattgtgctgtggtctgagagactgttatgacttcagttcttttgcatttgctgaggaatgatttacttccaactatgtgatcaattttagagtaagtgccatgtagtgtcgagaagaatgtatattctgttgggtggacaattctgtagaaatctatcaggtccacttgatccagagctgagttaaagtcttgaatatctttattaattttcagtctcaatgatgtaatattgacagtggggtgttaaagtctcccactattattgtgtgggagtctaagtctctttgtagatctctaagaatttgttttatgaatctgggtactcctgtattggattcatatatatttaggatagttagatcttctcgttgaatttaacccctttatcattatgtaatgataatttatctttgttggtttaatgtctgtttcatcagaaactaggtttgcaacccctgcttttttctgcttttcatttcttggtaaatttttctacttccttttattttgagtctatgtgtgtctttgcttgtgagatgggtctcttgaatacagcatgcctatggatcttgatgctttatccagctttccattctgtgtcttttaatttggacatttagcccatttacctttaaggttaatattgttatatgtgaatttgatcctgtcatcgtgatgctagctggttattttacagacctctttatgtaggtgcttcatagtgtaactggtctgtatacttcagtgtgtttctgtagtggctggttactttttttttaaacatatttagtgcttccttcaggagcttgtgcaaggcaggcctggtgttgatgaattccctcaacatttggttgtctgaaaaagattttatctctcctttgcttctgaagtttagtttggccagatatgaaattctagacttaaatttttttcctttaaaaacgttaaatatagccaccaccccccccatttcttatgacttgtagggtttctgctgagaggtctgctgttggtctgatgggcttctatttatgggtgacctgggctttctctctagctgtccttaacattttttgcattcattttgaccttggataatctgatgattatgtgtattggggttgatattctcatggagtatcttaccggagttctctggatttcctgaatttgaatgttggcttcttgtgctaggttggggaaattctctggaataatatcctgaagtgtgttttccaacttggttccattcttcacatctctttcaagtacccctatcagtcgtaggtttggtcttttaacataatcccatagttcttggaggttttgtttgttcttttatattatcctttttctctaattttgtgtgcctgccttatttcagcaaaatagtcttcaagctctgatatcctttcttccacctggtctattgagctattaacagaagttacatagttatactagtgtttgcattgtgaaggtctcatgttgtgtttttctgctccatcaggtcattcatgttcctctctaaactggttattctggttaatagctcctgtatgttctagttaatagcttctgtaatgtcttatcgtggttcttagcttcttgcaatgagttataacatactcctttagttcagtgaagtttgttattacccatcttctgaatcctacttctttcaatgtatccatctcagcctcagcccagttctgtgcccttgctggaaatgtgttgagatcacttggagaagaggcactctggctttttgagtttttagcatttttgctttgatttttttctcatcttcatgggtttatctacctttaatctttgaggctgccgacctttggatagggtttttgtggggtcttttttgttgatttcatggttattgttgttgttttctgtttgtttttcttttagcagtcaggcccctcttccatagggctgctgcagtttgctgggggtccactccagaccctattcacctgggtccctcctgcaactggaagtatcaccagtggaggctgcagaccatcaaagatggcagcctgatccctcctctgtcccagaggggcaccgacctgatgccagccagaatgaacctgtatgaggtgtctggagactcccattgggaggtctcacccagtcaggaggagcaggatcagggacccacctaaataagcagtccggctgcccctcggcagagcaggtgtgctgctctggggggattccccctcgtccaacctgttctgactctcaaaaaccagcaggcagaaaagattaagacgattgatccacgataccatagccatccctcctcctaggtgctcctctcagggatatcagagttctgtccataaacccctggctggggatgctgaaattcctgtagggaggccccgcccagtgagaaagagtggattggggtcccacctaaagaaatattctggccactacctgcttcagatactgtgctatgctgtggggaattgctcctggtccatactggccagtctcgctggcaccagcagtaggggaaaaaggccaactggagccgcagtgattgcgactgtctctctcccccaggaactaagtcttcttaggcaatctccagcctgctgtgctggccagttgggattccaagccagtgagttttaccttgtggggctccatgggagtgaggctgcttggcttcctggcttcagcccccttcccactggagtggatggatctcttgccttactagagttcccagagccagagtatgcaaatactcctgtgtctcagtgcctgctcgagtttctgcccacttgcgcagcctctgtgagtctgcacagcagtgttcttgggatccaaggccctggtggcgtgggctcacgtggggacctcctgatcctcaggttgcaaggatccgtgggaaaagcatgatcttcagggaggctagcacaatccctcaccacctcccttagctggaggagggagctccctttgcgctgtgtagctctcgggtgggccctcactccaccctgctttttattgctctctgtgggtcacgccaaccacctagtcagtcccaatgagagaaccttggtacctcaattgaagatgcagaattcactcgcagttttcatccttcttggtgggaggtgcagagcagagctgtttctatttggccatcttggctgctcccctccatatgtgttgtttttatgttcagattcaaataatcctaatacatggggaaaaattaatgatttctttctctatgtgtatctggttggctactttattcaaataatacttagatggatgctgattggacacatttcataagccaatggctatttgctgcatggtgacagtttagtttctgtttccctgaagtcggagatttaaacgcaaagaatttacttgggtgggacagggaacaccagcagaggcattgatgtgtaagacagggaaggcaaggcagctgataatgagtatgttcttaagccagttaccacaatggacaaccaaatattaatcttgcaagcaaatcctgtaaaacttttcaaaaatgcatgctttcacattatcccagctatgggatgctggaactgtgatgttcatacctgcacaccaaccagtcatttgttaagggccgtccttgggagttaggagtgggttggggaggtgataagggagattgttttctaggcacttctgggcaaaatggtctctggcagtactactcaagacattatctgttaacagaacatgtttaccaattatgggaatagctttccaaattgccagtgcatatgaagtggtgaatagattgcaaggaatcatctaataatagattaatggggcttgagaacaagatggtgaattgggcatgcatttcttacctcctattgcattgaattttcaagacatggggaaaaagagccttgcaagggaaaaagtcattaaagcagtggaaaataagaaatggtaccaccagtagtctagaaatgttgagagacttctaacaagaggaaagtaggtagaatggcattggcaaagaaaattagatcccaaaatatgcagagaggcttcttataggtaagaatggttctgtggaagctctaagcatggggtcacttcatgaagaaatggaagagagtcttgaagtgtatatcagggtgattaattagaaaactttggagcagcaaagttttttttttttttcctctccacttcttttatttgtgttgaatacttggcagaaggccatgagtattagtcctgaggctgagaatgaacagcagagctcatattgcctttagacacccagaagaggcggggaatctctgacagtcagaggacaactgtatcaggaacatgttccctttcccttcactctgccagagcagaccgtggtaaacagattaggcaggagatggagacagaagtgctcaaaacaattctgagcacaccaacatgaactatcaaatatctgagggaaataaatatcatagaaagcaaaatgctaaaattaagcaacaggagatttaacactcccctccttcaccagatgagggggaggggagacacttaatatggtgtggttgaagagtagaatgttctctgataattggtgaattaccaagtaatattgaaccaaataattctttaccaaagcaagtgaaatgggtacatgctggaacataagagggaaaaccgaaccttggtgaaaagagatccagatatactattgttattctaggtagatttccagagagagaggttaaaataaatgtaaagaggaaaagtaactaaatcatggaagaaaatttcccagacttactgctgaccaccggcaagttggatggcaaaaaggataaatgttaactatccacacgtagacacatagtgatgaaatgttagaacagtgacgataaagataaaaacctttaaatggtttcacacagaaaaatgaaacaaaaacaaagcaaaaacatgcagagtctccacaaaagagaatgagtcatatcactgtcacacttattatctacaacatcaggtaaaaaacgtggagcaggaatacttgatattaaataatagcatcaagaaaggctcatcaacattaaatacaactgatttgttaggaaagagaagtaaaattcatcaaatgcctaacggattaaaacttttgtaatatgattttatctcacctagaggtagataaggcatagagatactaattactcaaagcaagacagaagttatgagtagatgtatgatacaaactcatgtcttttagatgctatgagctcttgtcctatccattgctatattctttgtatttctttttattattattcaaaaaatatttgtgggtacatagtaggtgtatatatttatgaggtacatgacatgttttggtacaggcatgcaatgtgaaatatgcacatcatggaaaatggggtatccatcccctcaagcatttctcctttctgttaaaagcaatctaattacattctttgttatttaaaattatacaattaagttattattgacttattgctaccctattgtgctgtcaaatagtaggccttattcattctttctatttttttgtttttgtatccatgaaccaaacctacccccatctcccacccagcctccactacccttcccagcctctggtaaccatccttctactctctgtgtccatgagttcaattgatttgatatttagatcccacaaataagtgagaacatgaggtgtttgtttttctatgcctgacttatttcacttaatgtaatgatctccagttctatccatattgtagcaaaagactggatctcattctttttatgactgaatagtactccacatttttctttatgcattcatctgttgatagacacttaggttgctttggaattttagctattgtaaatagtgcagcaacaagcataggagtgcagatatctcttcaatatactgattttctttttcgggggtatatacccagcagtgggattgctggattttatggtagctcaatttttagtttttggaggaacctccaaactgttctccatagtgattgtactaatttacattcccactaacggtgtaccagggttcccttttctccacattctcaccagcatttgttattgcttgtcttttggaagccattttaactagggtgagatgatatctcattgcagttttgatttgcatttccctaatgatcagtgatgctgagcaccttttcctatgcttgtttgccatttgtatgtcttcttttgagaaaggtttattcaaatcttttgcccatttttaatcagattagtagattttttttcctatagagttgtttgagctccctatatatattggctattaatcctttggcagagaggtagtttgaaaatattttctcccattctgtgaattgtcttttcacttttttgattgtatcctttgctgtgaagaagctttttaacttgatgtgatcccatttgtccatgtttgctttggttgcctgtgcttatggggtattgctcaagaagtctttgcctagaccaatgtcctggagattttacccaaagttttcttgtaatagtttcatagtttgaggtcttaaaattaagtctttaatccattttggtttcatttttgtatatgtcaagaggtaggggtctagtttcactcttttgcatatggatatccagttttcctagcaccatttattgaagagactgtcttttccctagtgtatgttgttagcagctttgtcaaaaatgagttcagccaggggcggtggctcatgcctgtaatcccagcgctttgggaggccgaggcaggcagatcacgaggtcgggagttcgagaccagcctggccaacgtggtgaaacctcgtctctaataaaaatacaaaaaattagccgggcgtggtggcagatgcctgtaatcctagctactggggaggctgaggcaggagaatcacttgaacccgggaggcagaagttacagtgagccgagaccatgccactgcattccagcctggacaacagagcaaggctctgtccccaaaaaaaaaaaaaaaaaaaaaaaaaaagagttccctgtaggtgggtgaatttgtttctgagttctctattctgctccatgggtctatgtgtatgtttttatgtcagtacaatgctattttggttactacagctctgttatataatttggagtcatgtaatgtgatttcttcaattttattctttttgcttaggataactttggctattctgggtcttctatgattccatataaattgtaggattgtttttctttatttatgtgaagaatgtcattggtatattgatagacattgcattgaatctgtggattaccttgtacagtatggacattttaactatattcactcttgcgatccatgaacatgaaatatctttccatatttttggtttcctcttcaattttctacatcagtgttttatagttttaatatagaaatctttcatttctttggctaattcctagatatttatgtgtggctattgtaaatgggactactttttaaatttctttttcacattgttcagtgttggcatatataaatgatactgatttttgtatattggttttgtatcctgcaactttactgaattagtttgtcagatctaataattttcttgtggagcctttaggtttttccaaatataagatcatatcactagcaaatagagataatttcaattcttcccttataatttgaatgccccttatttatttctcttgtctgattgctttagctaggatttacagtagtatgttgaataacagctgtgacagtgggcatccttgttgtgttccagatcacgaagaaaggctttcattttttctctattgagtatgacactagctgtgagtctgttttatatggattttattatgtgggtgttcgttctttctagtcccaatttttttgtgggtttttatcgtgaagggatgttggattttatcaaatgctttttcagcatcccttgaaataatcatatggtttttatctttcattctgttaatatgatgtatcacactgtttgatttgcatatgttgacatatacttgcatcacagggataaatcccagttggtgatgatgaatgatctttccaatatagttttgaatttggtttgctagtattttgttgaggattttgcattaatattcatgaaaagtattggcctgtaatttttttctcctcctctgtttttttggaataatttgagtagaattgatattaggagttctttaaatgtttggtagaatgaatcattgaagccatcaggtcctgaccttttctttactgggaaactttgtattacagcttcaatttccttacttgttattggtctgttcaggttttggatttcttcctaattaaatattggtaggttgtatgtatctaggaatttgtcaatccattctatattttccaatttatttgcatatacttgctcataggggccactaatgatcctctgaatttctgcagtatcagttgtaatgtctcctttttcatatctgattttatttggattttctttgttttttcttagtctggctaaagttttaccaattttgtttagcttttcagaaaaccaatttttttcattgatattttgtattttttaaaatttcactttcatttatttctgctctgagcttcattattttatttttcttttactaatttggggtttggtttgctcttgcttttctaattctttaagatttttagttagactgtttatttgtattttttcctcctttttgatgtagacacttaaagctataaacttacctcttagtacttcttttgctgtatcccataggttttggagtgttgtgtttccgttataatttgtttcaagaaaatttgcaatttccttattaatttcttcactgacccactggtcattcaagagcatattttttaatttcagtgtttttgtatagtttccaaaattcctcttgttcttaatttctagttttcttccattgtggttagagaagatgcttaatattatttcaatgtttctgaatgtttttaagacttgttttgtgacctaacatatggtcgatccttgagaatgatccatgtgcttaggaaaagattttgtattctgcagctcttggatgaaatatcctgtaaatatcaattagattaatttcgtctgtagcgcagatgaagtctgattttttttattgattttctgtctggaagatctgtccaatgctgaaagtgatatgttgaagtctccaactattattgtgtcagggtctatctctctctctttagctctaataatatttcctttgcatagcaatcaagcaagacccccatctcaaaaaaaaaaaaaaagaaagaaaaagaaaagaaaagaaaaaaaagcaacagcagccatgaggatatttggaagaaaatttgacacatgagtgctgttggtaataactttgtaaaaattacacaagccatggagcatgttgttatgacaattccagactgaaatatgagcgtaagacaacatagttatatcaactgtgacaagcttccaatttgctgttattacattgaatttcacgtgcttgcattaacatcagaaatacagtataatatatattagatacacacatacacagatagttttaccacccccctcctaaaaaaaaggagaaatggaaaggcatttctatataaacaataaaataacaaaagcaacataataaaccaaagtacttgtaaagccacaacataagcaaggattgatgtcccccaatacacaggactgatatggttctgtaaagttgcagctgatgctaatagcatggcttggaagcagtcataatccagaatgcatacaaaggcataagaaattctcattctgaaagtgagtgcttaacccagaaacatagattacccaaggaagcacaatgccattggtagaaacactccagtaagtgttaacactcatactggcacactaggaatactagagtactctatactgacttaaatacatttaataccctcaataaacaaagggatcaagttcattgtattggttattagttagaaattacgaaaaaaaaatgaaccagggaacaataagtagacatttatgaagaataactattgtggtattttgaaaaaaaatgtgttgaaatacagtaaaaatattaacacaagttttttgctgaataaacacagccaaaaaataagttagtaggcagaaaggtcaggtgtagcagtattctgaaacagattttaaaatatatataaaaaagggaagccatgaaagagaagactggaaaaatatatagatcaccttaattttttaactaagatttctgaatgaaagggttgaaaactgatgggtccaaaataattgaaaaaatcataaataaaaattttccagaattgaaagtacgtatggatcctgatattggaataactcttttggtatatagcagggcaaatgaaaaaatgaaacttgtccagaatcttgtagtttcaattttgagtcacagataagaagaaatttctagaagttaaccacagtacactttcaaattcccctagagagtggttaaaaattctcaacaaatgtgtcaatattttccaagtatgaaattttgggcgattaatatacatgatggctggtgttggtgctcttacttttttctgtttctttcagagtagaaagtaatgtttaactacattaatcctatttaagatttcttttcaatcattatttaaaactgctatagcaattaaaggatgttttactgtttggtattatgtcatagatttgaaaattattgctgtaaaatatcatcagtgttttaatgaatggagagcatcgtctatgtgtattctgaattcttagtcttgctgcccacatgtattaaattgtatgagctattgagaagagaagaatctcataagtaaacaggaaaaccaggataatattcctataagcactctgatactatttttctccttgctacaaaatgtctttttctactttttaaagtgattcatatttattttttatgaaattatctatctttgaatctatatagtctatcaatatatttgaatatacaaaatcatctctgtggctactgttttatataatatccctcattttaattcatatattttaagttacctatgatttaaaacaactaatattggcattgaatttcaaaatctacagattttagtgtcagtttaatggaatatgcaagcagaggtcaacggcatgatctttttataaatatatatttaaataaactattatgtacgcttattttacataagattatattctctgaagttcatgtgacagctttcaaatgtagctaacatggattgtctttagatgaaattacatcttctttgtaagctatctgttccctttaccacgtatttaactactaagcatggagtaaaggggaaaagatacgagtcagtgtctaagtcaaggatataaaataaaatacctcctatctctgaaaagcttagactgcaaaatttgttgagcaaatatgcatagtgatttaacagtttaacttttcttccctcatatcagaacattcagctaatgtatttactatgagaatttctactgtttttatgagtggaagattgaggttaggttgaggtacaaaataaactacctaacaaaaaaatccgcaagcaaacaaagaattgtacttatctactgctcaaaatttgggaggaaaagagatgttatgtaccacagttaaaaatatatttctgtatatagccatgcccaagggcagtaacgatgtcttatttaaattattacccctgatgcctacaacatataattttgctacacagttgagtaagctgcctatataaactaaggtttaaaggaaagttcacagatacttaatagaattgatagttaaagtacaaataagactttatatgcctggttattttgtaatgtatctactctagagtattggaataaaaaacatgaaggacattggcctgcactcttcaaaactatcaaggtcatgaaagacagacctcttcctgattaaaggagacttaatagatacaatacctaaatgcatatgatttggatcctaaacaaggaaaacaaaaagattttttgttgttgttattctatttttttttttttttttgatatggagtctcgctctgtcgcccaggctggagtgcagtggcgcgatcttggctcactgcgagctccacctccggggttcacgccattctcctgcctcagcctcccgagtagctgggactacaggcgcccaccaccacgcccagctaattttctgcatttttagtagagacaaggtttcactgtgttagccaggatggtctccatctcctgaccttgtgatctgcctgccttggcctcccaaagtgctgggattacaggcatgagccaccgtgcccggcgtgttgttgttattcttttgcaataatggacatgaaattaattggtgaaatctgaaaaagtttttagatctaaataataatagtgtatcaaagttaatttcctgattttgataatgtcctatgacaagcttgtccaacctgccaccctccagccacgtgcagctcaggatgactttgaatgcggcccaacacaaatttttaaattttcttaaaaccttatgagttttttttttttttgagactcgtcagctatcattagtgttagtgtattttatatgtggcccaagacaattcttcttccagtgtggcccagggaagccaaaagattggacacccctgttatggctaagtgaaagaatttccttggttttttttaaaaaaaggaagcactgcaacatttagaaataaaaggcatcatgtctgcaacgtaagagtacacaggagaagacgtagtaacagattaacatttgaagaatctaggtgaatattatacaagaatcgtttgctctataattgcagcagttatgtaaatttgaattttttgaaggtgatgaattaagatacagactaaaagcacacttccaaaatggcaataacttataggtgagttcagtgaattggcagggaagggaacaatagaaagacagcttggaagattttcaatagcagctgtccatttagtagaacaaatcagcagttcctgcttttttctcaatgctgtggcattgttttcactggggctttaaagggaagtggctgcatgccagtttctgtgttctcatccagctgttcagacactaaaatgacttaagtaacaaaggctgaagtttgagaagccatgcagtttgcctccaagacaagtgaacatgttaacagaatatttacaaatttatttaaaatggcaatcattggtcctgagagatagggaagaaagcgttcttacttaactaagaaaatgatcagtaggtgaaatatccaagaggtgtttcttaatacatctctattctgctcctattttatcctgttatactgcagttccctgaattctcaaactcagaatttgacaaagtagaaaaaaattaagtgaatttacttgatgttttgaaaacaaaacacaaacagctttgcctagtacatgtataaagttattacatagtcgctatagattgactttccacctttcaaaataatagacaacaaaaatgaatctgaatttgtaaagcacatttaacctcctcaagctcttgaaataaagttattcattagcaatatctcaatgattaaattcaggataacatgggattttttgaaaaagtgtgaaagcaaatagaagcatttaatagctggtttactattttgtgttctgtggaagattatgtttcaatttaataaataatgaaaaagaacatttccttcctatttttaagtaaaaatatgagttgtattcgagcatggttgtggtgcacttcttttggagacttacttagttatttaacttgtaaatatccaggaaatctgaaaaactaaaataaaccaaatattttcattataagtagcataccatttgaatatttaaagtatgctacaaaaataacacgtaaggtgtacacttcttgttaagaagattaaaaaaagcaatgcttatagtcttccaactcactcatcatggggcttcattatttgaatttattcaaagagtaaacaagcaaaacctctcaaatctcattctgcataaatctgataatggttctgaccaattaaaacttaggtgaccaaaatagatcatctgtactttattatgtggagcacttcacagaataattatttgaaggataaataaaagttaactactctccattttcaaagctagcaaaaaccagttccattgtatgttttcaattaagcaacacaatttaccagaacccaaggatttttataagcagtttatctacccctaataatggactagacagtaaagtaacttgatctctgccttttgttttttttcttggccaaggaggtgatggtaagtaactctatttgcagtggtgtgagagccctcttttttctactgtaatgcagtgatttttgacttcacattattcctacatgataccttccatgctattctaatgtctatatataattttctgtaaactactttatcatagactgtatcatatgaggcatttacgaattatttcaagcttcaattctatggacggtcacttctaatggaaaatccacagtccaggatggtctatctggtgttttataaaaaaattcacactccagaggtggctaccacaagcccctgtgctatctgtatctccaccagtaccaagcattttgctgaatttcatcctaaatgtcaaaaggagttttaatcaattaaattaaaaattttataattggcatgattactttcattggtgaaattacaatttttcttattatttagtttggttataatatttttaagatatctccactgttaaaatgaataagatataataatgtaggaaggatcatacaaataatgtgattcagtaattctactactgggtatatatccaaaggatttgaagtcaggatcttaaagagatccccgctaccctatgtataatgcagcattattcataatagccaagatatagaatcaacctaagtgtctgtgtatatatgaatgcataaagaaaatgtggtgtatttacataaagtaatactatttactttaaaaaagatggaaatcctgtcatttgcaacaacgtatattaacctggagacattatgctaagttatataagccagacacagaaaaacaaatactgtatgatcttatatatggaatctaaaaatgttgaattcatagaaggaaacaatagagtggtgattaccagacctgggacttggggagattggagagagatattggtcaaaggatacaaaattttagttagatagtaggaagttcaagagacccatggtacagcatggtgactacaattaataacaatatactgtatgctggaaaattgctaagatatttggtgttctcaccacaaaaacgaaggataagtatgtgaggtagtggatatattaattagtttcatttagtcattccacaatgtatacatatgacaaaacatattgtacaccataaatatatgcgatttttgtcaagttatcattagaaaaagaaagccctgtatatgtttagcataaggcatgttcagaaaacaactgaaaagtctccaaactttcacctcaggctgaggcctaggctcattgcaatcctggatatgtgttaaggaagagcaccagcacagggacaatctgcaaatactgggagggtaatattgtttgttgttgttggtggtggtggtggggtgtgtatgtgtgtgtgtgtattttgttgtcatttttataaacttatattcaagaaaatctctgtcaaaactctagctgaacagagacttcggtgatgacttatgacaaggaacacatggatgcatacactggtccctgaaatagttgagtattatagccttcaacaataataacatcaaaacaataaaccctggaaaggaggggaatttgattccacagttatcacattataatacttaagtgcccattttcaacaagaaaataacaaagcatacaaagaaaatgaaaaacatgacccatacaaagaaacaaaatgaattaacagaaaccatctctgagtaagcacagaaattggacttattagacaaagacttttaaaatgtcttaaatatattcaaagtcttaaaggaaaacatggacaaacatgtaatgaaacttcggagaataacgtatgaacaatatgagattagcaattagaagatagaaatttttaaaaaataagcaaacaaattgtagaactgaaaagctcaatagctacaatgaaaaaacactagaggcactcaaaagtagatgtgagtagaaataagacagaatcagcaaacttgaagataggttaattgaaattatgcagtctgtagagtgaaatgaaaaaagaaatgaagaaaagtgtacaaaggctaaggaacctgtggaacactgtcaagtggaccaacatatgcattatgaaattctaaaaaagggtaaaagaggaagatataaaggggcagaaagaatatttgaaaaaatcatagtcaaaaactttccaaatttgttgatagatctagcttcatagtcaaaacccaaacttcactgagaattaaaacttttccccttttctgcttgtatcagtctcaaaaaaaaaaaagccacattgcaatatatgtccctttatcctttttgttcattcctttctttttttaagctacacagagcacttcttttcccttaactcacaggatatatttgctgaaccttttaggtttaggctcacaaatagaagggattaaaagggaaagggcatatgttttctagtttggcttttggcagatatactaagttggcatattttctcatagggtgttttaattaatgtgaacttgtgagagattcccctgctgggaatcttcagttgaaattcctacaaggtgaacttttttttttcttcaataagctttttactactccagccataaattttgagcattcagcagtccacccctttatatatttttaattgaattatttgggagttttattgctattgagttatttgtgttccttatatattctgtatattaacccattgtcaaatgcatagtttgcaaatactgtcctttatttttgtacattatctcttcactttgttgattgcttcctatgctgtgcagaacctttttagtttgatgtaatcctatttgtctgtttttgcttttgttgctggtgttattgaggtcttattgaaaaaatatccttcccagaccaatgttgtgaagcatttcctctatgttgtcttctagtagttttgtagttttagaccttaaatttcagcatttagctcacttgagttgatttctgtatacagtgagaaataaggatctagtttcattctcctgcatgtgaatattcagctttaccaggaccatttattgaagagacccttctttcaccaatgtgagttcttggtgccttttttaaagaatcatttagatataaatatgttaatttattgctgtgttctccatttcgttccattcatctatatgtctgtttttaaagcagtgccatactattatgttactatagctttgtagtatattttgaagctagatggtgtgatacctctaagctttgttcttgcttaagattgctttggctattcagggtattttatggttccacgcacatttcaggattttttttttttatttctgtgaggaatgtcatagttattttcatagggattgcattaaatctgtatattgctttgggtatttggacattttaacaatattagttcttctattccatgaacatgtaatatctttctatttatttgtgttctcttacatttctggcatcaatgctttatacttttcattgtaaagatctttcacttccttggttaaatttattactaagaatcttattttttgtagctattgtaaattggattcctttcttgatttttttcagatagtttgctattggcttatagaaatgctattgatttttgtatgtttatcttctattctgcaacttactgagtttattaagtctaacagttgttttctgtacagtctttaggattttctatatataagattatgccaactgcaaacaaggcaattctacttcttgctttccaatttgaattgtctttatttatttctcattcctaagtgcactggctaggacttccagaggcatgctgaataatagtgataaaagcggacattttgtcttgttccatatcttagagagaaagctttcaaattttccctgtttagtgcaatgttggttgtctgttgttgtatatgaccttcattgtgttgacatacattccttttatacctaatttgttgagagtttttatcatgaagggatatggaatttagtcaaatgctttttctgtgcctattgaaataatcataaggttcttgtctttgattattgtaatgtgatgtatcatattcgttaattttctttagtggttgttgaccattttgacttttaattatcatactagacatctgaaagattgtatatcagcattcgagtaatgaagtattctgaattttacaatgaatttacccataaaagtgaggtgtatactttcatatgtttgcgtgatagtaattattgtctttttgctcccacttttgacattccatttagcattttttgtaaggcttatttagtagtgatgactatttttccttcatttctgaaggaaagctttgttgggcataccatgctagccaggcaatttttttttccccagtacctttaatatagcatcccattctttcctggcctgcaaggtttctgctgagaaatctgctgatagtctaaggggaattttcttatatgtgacttgacactttactcttgctgttttttagaattttttctttgacttttgacaacgttattataatatgccttggagagggcttctttgacttgaatttatttcaaatcttttgagcttcgtgaatctggatgtccatatctctcccaaatcttgggtagtttttaggtattgttttgttaaatagtctttctgtgcacttcttcatctcttctccctttaaactccaaagatgcaaatatttgattgcttaataacgttccacacatcctgtaggctttatttgctccttttgattgtttttttttctttcttgctgactggcttatttgaaaagacttgtcttcaagttcagaaactcattattttgcttgatacagtctgctcttgaaagtctcaattgtatattttagttcattcattgaattctttagctctagtattcctgtttgtttcttttttggtcatagctgtctctttgttgaatttctcttttggatcccaaactgttcatctaatttagtttgtctgtctgtattatcttttatcgtaaatttccttgggtcattattttgaattcctttttaggaaactcataaatgtttatttttggagggtcaattataggaaatgtattgtgtttctttagtagtgtcctattcgctttcttttttatgtttcctgtatcactgtgttgatatctgtgcatctgatggaacagtaaccacttccagtctcatacagtgtctttcatggggaaagactcacctgcccatgtgttgtagggtgttggttgagcagggtattttggatttgcttctgggtgaatgccgtaatgtggtctccatccagtttcttcagctataggcaacatcagtgatgcctgagtgtgcctcagtgtgcctcagtggttcatgctgtaacagtgtttgtggctggtctacctactcagttactgctccttgatagtggggcactggtatagtctgtgttttggggatatttagggctggtcaacttgtgacttgggctttgcttcactaggggctggacagtgggctggtccatgctgtggggtagcatggggctggatatctgatggctctgctcaggagttgttccccttaaggtagggtacgaagctggtccatattctggaaaaacatgaaactggttgactggcagcttggattgagatctgctttcctgaaggcaaagttccaagctgatccatgcttaaaggaagtgcaaggatggctggcaagcagctcagctcagtcgctgctcccctgagggtggagtgatggggtcatggttgttccactggatatagatttcaagtaggttgggttggggtgctatagcccctgaagtaaggaaggtactgtacctcctaggcagctttttcctaggagtagaaagctgtaacagctcagctgggtaatgctgcgctattgtgtgcaagcatggcgtaatggaggtggagcctcaaagatggaaagatgcagtagctactggtccccggaaaggacatattttattactgactctggtttagggatggcatcttgcagtaggggtttgggtaatgtggggaaaagggcatgatgttagctccttttctggagcaatccagctgtgtgaactcctgaaagctcccaaaactggatggagagcctgagaaaactgcaagattctccagcagcaaaacctacaggtgtctacagcattgatgaggagtgctgagggccttctgtttactttctcccgacatgggaaagtccctcctggttctgagctgatcctaactggagaggtggcatggcaatgtcaagatgtctcactcctttctttatgtggcaatcttgagtgtctgtgttccacagaatttctgccagtctcctgctgtactttagcattctcattcaaatactcttgtcaaactatagttgtttatttgtcgtttttgtccttttgtgtggtgggtgacaagcaccaagcaccgagcacctctagtcagccatctttctgacatcgctctcttaatatctcttattgtctcatttgaaatctgttttaccaatacatttcccattacatgtcaccagtaattatactttgacagataccaatgctgattaaaggcaaagtaaaactgaagaaatatttcattacctgaatgaaaaaaaaatcacactcctctatgttatgtcacagttaactaaaactaaatactaatagtcctgagtactatagtaggtacatgagccacatattttactatttatactatggtttgtattaaatttaaatgttctttgagttcagtatttttaaaaagtagaaaggaattcaaagatctcaaaccagtggtacagcctcagctaaggcacacagaatgtttctccaggtaatatgtctctaagcatgagctatcaatagcttttctatttgtattccaattataaggagcttcttgaactggaattttcagagaagccatgaaaatgtactagtttagagactctatgaaaggaaataattctgatgtaatttttatataataatttctaatatgcattgtacattaggtacaacattttcttctctatttttctttatttgacaagaagaaaattaaaggtcagtatttttgatatttttcttttctctttttttatcattctacaaaagatgctaaagttagtctatcagtctgaagaccaattgtatttgaagctaacctatatagcaagattaattttttctgtcagtggttttctgtcactaagcaaatggtccaaaatgagccacttgactaactaacattaacatgtaattgtctagaaatctaaatagtatactactcgtattcaagaaaaaaatacatttggaggattcctgtcactttttttttttttttttgatgattcagggaaagtacccatgaaatttagatttggggaagggcataggggaacatagtataattgcagtctacttttactcaccagtacttcaagagtaacattctatcccatttttactaaaccattatatgttgaaataagattcatttcagatgtcattttgcaaaattcctgttaagatttaagcactggaaaaaaattttttaaactagtgcaattactttcttttcagctacagattttcttgacatgactagccacaactgtctaatattttttatattttaataaacactgtataagaggaaacacaaattttctccaatgaatgcctatcaacacacatataataactaattttcttgacaggcttaacaacggataatgtattactatttagcaaccaattctagtagacagatttgaaaaacaaataagctgttgtctagttctatttcaatatatatactcattgctaatttaaatgtagacaaaatcttactcagtcctctctataagtcaagctttatcttgcaggcaaatgtagtcagatatgtaatttgcttgtcagctattgccatgtgttcagaaatggagttatttttaacattttaaaacaaacttagattcttaacccaattaatattatgtctgaacctaaaattaccaaattatgttggcctccatacccattctgtgcacatacatacacaaacacactcatagatcatttatatctactaaagcatttgtttttcattttgctgtatatagataatttcacaaaaagtaaagcaaaatcttgagagttttaggaaaggcagagccatctactgccttcacctgccatacacaaatattaattcaactatggttttgagaatataaacactagaaaagctgatataatataaaaagtttacagcatgtcaaccactgtgaacaagacatttaggtcatttttaaacagttacttatccccccaatcatgtgaacaatacagcttctgaattaaccacctagcattttaggaaaaccagaaggagaacatcagccatctttttatctccctgtggtaggcaggaagaataaccctcccccttaaaaaaagtctatgcccaaatcaagaaaacctgtaaatatgttgtcttaattggcaaaaagaaactttgaagacataattaaagttaaggaatttgagatgggaagttattcttaattattcaaatgggcccaataaaatcacatgagttcttaatagtggaagaggagggtagaattgttgatgtgggtcggagagactgggtgatggaagaagaggtagaggtgatttgaaacgtgtggaagactccacttactgtttctgtctttgaagatgaagaaaggaggcagtcttagtctgttcaggctgctataacaaaataccataaactgaattattataaacaatagaaatttatcacagttgtggaggctaggaagtccaagatcaaagtcctagcaaattcagtgtctggactcactgtctggctcatagatggcactttgttgaagtgtcctcacatgtcagaaggggcaaggagcttctttggggctcttttataagggcactaatctcattcatgatgcctctgcccttgtgatctaatcagttacctcacaagggccctacctcctaacaccatcaccttgaaggttaggatttcaatatgtaaattttggggagacataaacattcagaccatggtatgggctatgtgccaaggaatgtggacagcctctagaagctaagaatgaccctcagctgaaaaccaccaagggaaaggagacctctcttctaaaactgcctggaactgaattctgccaacaacctgaatgaacaagaaaatagattctcccttagcgacaccaggaagaaatgcagccctgatgacacctagagtttagcatagtgcaaccaatgtcagactttcaacctacagagctgaaagatacatttgtgctgttttcagtctctaagtttgtggcagcaatagaaaatgaatacactcttcttacaaattttgtctgcatatttttattggagtgggtttattttaaaacaagataggacttgtgagtttaaactaaagattcttagaacattctggaatgatatttatttttatgaaataatttctagtttaaacacatgaaattgattttagcttgcattctaagtcatctgagatttgaaggatgttccatgtcttagtcttatttattggggcaactttgcaattccaaaaattatatacacaaaatgaactcctcttgtttctgtgtcactttaactagagggtctatgtgcaagacaaaataccaatccttcagatttatttatttatttttagacggagtcttgttacatcgccaggctggagtgcagtggcgtgatctcggctcgctgcaacctctgcctcccgggttcaagtgatcctcctgcctcagcttcccaagtagctgggattacaggcacgggccaccatgcccagctaatttttgtatttttagtagagacgggatttcaccatgttggccaggatggtctcgatctcctgacctcatgatctgcccgcctcggcctcccaaagtgctgggattacaggcatgagccaccgtgcccagtccatatttatttttatactcaagctttccctttacaaactttacccaaattacagtgataatgccagttactttttcataagaaacagggcatctgcaacattgattatcaagtggttctgaaattcccactgcccacactttgttctctcaagactttgagcatcataaactaactataatatacattcatcatgaagaaaagatttactttttacccttaaaaaatcacaacctaccagccgggcatagtggttcacgcctgtaatcctagcactttgggaggccaaggtgggcagatcacctgaggtcaggagttcaagaccagcctggccaacatggcgaaaccccgtctctactaaaaatacaaaaattagccgggcatagtgatgcatgcctgtaatcctagctacctgggaggctgaggcaggagaatcgctggaacccaggaggcagaggcagcagttagccgagatcgtgccactgcactccagcctgggtgacagagcaagactgtctcaaaaaaaaaaaaaaaaaaaaaaaacaagctaccattttctttgtctgtttctgccacaatgactcagtgtgcaaagtagtatgattcacgggaagtctaaacaatctatttctttgtagactacacacacacacacatatatatatatacacacacacacacatatttacatatatgcatatgtgtgtatatatatatacatatatatatacacatacatataaaggttgagctcaataaagaaaaaaaaaaatgccagttagccattgtgtgtgctttactcgattgagaactttttctaactgagaatgagctttttccaacttaaacctatttgtaggtttgtgccaagtgaaaacaaccagtatgagcataattttttatttgaattttcctgttaccttttaactcacttatactgtttatattatatgaattttgtatctgacctcctcattttgttggtagttgtattcatttgcctttctatctgtccccaaaatcaccgaactcattgaatgacaaagaaaatgttctcagtagaaatgcttgttgactccttgtgctcaaagagctggaatttaaggaaaatagaccttgagttaaaagacaacatttcacgatgattaaaaatgatagagacaggtgtcaaacaaacttaaaatacatatgcaattaatttgaggtacagttagtagggaacacttgttgagaaatctaaattggcaggccatcactctaagcaggagaaataacaaaagaggtcacttggggagattcaggagacaacccagccctttgttaagaactgtcagggaatacaattgagtatgtatggagggcaacaagatggaaagttattcacaagatatctgaaaaacaaaattggtgtttctgaacaggagaagaatgagagcaaagagaactaacatttattcagcaattactataagccaggcactgtggtatttgtgtatgttatctgtttaaatcctaccatcagtccagaaaataatattatctctatttttagaaaaacaaaccaagattcatagaaattgaagtcatatgagcagttgatagggtttaaacctagaactgcctgatctcagtgcatctgcacttgttctataatattgagagattaaattctccttcaacacttttgagctataattctgcagaatatcagtaaagatatttgaattgtccatatgaaatcattcaacactgaagttcttaattcctttttaacagtcctttttaaaatcaggtaacaaattcttaattgtttttcaacttcatgccatctctatatatgagtattattatttgactacttttaggtcacatggaatctacacatggaaggacataggcattgcatgcaggtatccggaatcattgatattggtcttaaaatttggaagtttccacttttgctaaggtatgttttccttaatggtggaggtttactaattgggtgtacctccagatctaattctttcatgtaatcctcatatgataggaagtaatgagatgaatatcattaggcattttcaaatttgaattgaaacatattacgatatgtttatattagagactggacaaaattatcattaagattctaaggttctacttatcattaccatgaatgggttttaaactgctaactagttaaagaactgtaaatgaaaaaagaaaaaacaactttgatcactcctagctatcaaattaccatatttaaaaatgtctaaaagtcattactgttgaaactatgattgtttagagtttagacagttgtatacactcaagcagggagtataaaaagggtcgctattctagaaatcgttagcctatactttaaaaaaattatagccattgatactgtgataaactttacctgaaatctgttcatttgtttaagtatagacaacttaatgtctatatgttaagtaatgtcagtgttaagtaatgtctatacttacagaaattaacagattttaggaaaaatttatcagttatattgattatagcttaacttgtattaattttttaagatacagacacagtggccaaaataaagaaaaggtcgatacattttatccacaaaatgggaataaaattactttttttttttgagatggagtctcgctctgtcacccaggctggagtgcagtggtgtgatctccactcactgcaacctccacctcctggcttcaggtgattcgcctgcctcagcctccagagtagctaagattacaggcgtgtaccaccacacccaacttaatttttgtaatttttagtagagatggggtttcaccatgttgcccaggctggtctctaactcctggcctcaagtgattcacccgacttggcttcccaaagtgctgggattaaaggcatgagccacagtgcctggccaataacattacatttaaatccaatttaaaatgtttctattctttagcatgattgcaatataatattagataaaatacataataaagttaataaaatctctaagagaaatgactgagaagaaattgttaaaagtattaacaataattaactgagaaatcatgggttatgagtgatttttaacttttgattataactttggatttctctatgataatcagatattgcttttaccaaagcaaaaagtttattaattgccaattgtagaagccaatttgcctgtatattttatagacaaagaggatttgtttgttttccttgttctacattacattaccatgagttctcttagaatttttaatttaccacttattattcccactgataaaataattcaagttgagtttgagtgtattcattcctttccaatcttggttttgaggtaatatgattttttatttacataccatttaatatcattattaccaatgtgtcatttacatgaactaatttacttaattttaagtgtaaatgtcaatgaattctgttagattgtatatcattttatttgtgcttgctattttaatgctccaagtttaaagttagagtgtgaataacatcctcccccaccttcacacttacaatactgaagcccattaaagcccaggttaggaggatttcctgcttcctcctctcttctactttccttctaactccatgaaatatttaagaatccccccctgaggatcctacaattgttaggaatgtagtcctttttgtttcctcagtcatccctggggctctaaattgagcaactcaatctttattttgaagccaaagactttcaattgccaccaaaatttgctttgaaagtaaccagtgttggataacaacctgaaaacttgggagcccagtgtgaagctaaggggcataggtagccagcaatattacttcagaggtggtatagctacattacatttaataaaaacagatcttcaacattcagttatttttagattctatgatgttagtttcccatttaaattgtatcctcataaccaaccaccaacctccaatcctcacaaaatctttcctgatggtcaatcatggagggggcggacataaaataaaaatataaataaacagggtcgggctggtaagagaaaccagaaactgagaagacaaagttagaaaccagtaatcaacatgaaaatgtaaggttccaggggattttaaaatctttgggagagttttgggttacacagactatggaatgaaaattgaagaaaatttatgcagttagcaaaagctaaggagatttgaaaaatgtgttctttagcacctcaacaatttctgaaaaggcctggagtgaaggtaatgtaagtattttgctgagactttcaaaaacaaaaccagggagatggaaagtataacataaaataatattgaggaaaaacaacaacaaattattagaaacttaaacaagaaatatagtttggatggcaaaatcttcaaaaggaactgtattcaacacagcagtacaaagtcacagggatcctgagtacataaggtcaatcaggaggaaaaagggggctgtgggttaaggccaataaaatagaattgtttttgaagtgaaagcctcaaagaaattttatttacaaagatttttattacagcaatatatttaatgtaatatcatcgagagtctcctaaactatgttttgagaccttaaacctctttgagcattgcattgtaatctatgctacttttcaagaatattaccactgtcaccagtgattgaatattaaacatttcctgtgtttttctctctgtatatttctccccactcttcctgctctttacttctgtactaacttcttaaaactatagttaagggcccacaaactcaaatgccgtcagggatgaagcaggcaaaggcaaaatgaatgtatcacaaaagtaggtgatggagactgtgaaaagacagtgtgtctggctttttttttctctctctgtcaaacacacacacacacacacacacacacacacacacacacacacacacttctatagtctgaatccatggagcactggtttgtaactccaggtgtaattatagtggcctctggagtaagacaaataggaaacccactttctacatttgtaagaaatgttgacttgggcaagttatctcacttctataagtctacatttcctcttttgtaaactgggaataataataataatacatatatataatatgtataacaacaacaatataatatatatatattttaaatattttaatctcatttttcaagatggggattactatagcactttttgttaaggaaatattgagaacacatttccatcttcagtcttactccactaataatctactaagttatttgaaccagattagttttataaatctattttaaacatttttaatatttaaatataatatttagttaattatatttgttcctaagaattccaaagtataaataatttgatattttaacacaatttattttcttctttcatttcatgttcctagtacgaactcttatgaaaggaagtgaccacttatgctattttgacttgattcatttagcaagggagaagttacaaatatgctgtccaaaagatgtttgtatggaaacagtttctcccacttcagtccccagattaacagggaggattagtgttattgacattaatatttataaataccatttagatgttcctccctctttttactcttctttcaattttacataggggatatgggctatgaagtgggcttgtcccatatctgaccctgaaggcttgagagagatagtatccattgaatgaagaaaatggcctgatgaaaatatgttgtacaaataagcacatttttaaaagtatttatttactctttatattgtattggtatatagtatgttttataccaacagttatctactgaaaatgaaaccctagaatgtaaacatgattttggcctgtgaaattcccagaaagaaaatttggaatagtatttcagaaaatcctcttatcaaatacttctgtagatgacaaaagtaacttggagggatcatcacactctagtaaattgttaaaagggttttttaaattaatgttagttgcttggtagtggcagtgaatcaggtgaacacgattacaattttccttatattttaaactgaaaatattaaatgggaaaaataaaaatatgagtcattgaggtaaatgcacaaaccagtgctcatgcatgtacacacgtacacacctaaatttttaaaggtcttttcacatcttaatatcaggaaacaagataaatatataaggggatatcaacaaattaataatatagaatcttaatataatgacatctatctaaaagttttcaagacaaaataatttctatttaaatagtgaacgtagtatttaccttttgtctttaaccagtcctttcgtgataataaatagaacaaatactgtgtcttcactgcatattcaaggtagtctaactgctataaaaaagaaagtcaataacttagcaaaataataattaattgttctttgaaacaacagcccaatgtgtttgtttatgatcaactggcccggttatccagtattgaaagtccatctgggagacacagaagggtgagagcagtgtaagggatgataaattatttaatgggggcaatgtatactatttcaatgatggttaaactaaatgcctagacttcaccactatacaatatatccacgtatcaaaacggcatttgtaaccccttaatttataattgaaaaaaaaaagtttatcttggggaatacacatagcttctcttaactgtcttggtctgggaatgacacatggcatttctttttttcttttttggtaatagttaaacccatgggcctacctagttgcaagaagctggtaattatagcttagctgtatgcccagggagaccaagaaaaccaggtactgattaacatttacagtctctgtcatacccataaagaaaataatgaagtgtttcagttcatttttttctggctttgccatttaatgctccttaaaggtgtcaatatgtttcatatgaaggtaaatgtaacaatgaaaacaaagcattaccaagaaaaataataattatcaaacataacaatatttctcctataattataatacttgtatttcaagatatgtagttcagcctttgaaattatgtaattctacttggatggtagtcatgagccttggcagattagacctgggcatttgggactgaactaaatagttggtctttacctcagttccaaaaagtcaaaacgacatatgaaacaatgtttgagaatgttgactctttattctaacagattcattactctaagcttgagctaacccccatgtattaggcagcacatagcatctatttatccagcttcattcagctcatattatttgacacaaagtatcacaagaatgtatttttcataattatataggactttcccactctcctgaaatacttttctcttcctttgtagcaacattattttccaaggaggcctcctgaacatgttcagtggctcaaaagatacagtttaagatcaggactgtatatgaatgaatgctatagtgttatcaaaccattaacctctgagctaatatgattatctgtacttgggttggacaggagacatctccaccccatcatttactttgtatcagagattgaataaacatctggaactctgcccaaatagcaatgcacatgatgatcaattagtagcaccatttttttttgttgcactgtatgcataaactacaaatgcctcacactgttcccattacatcttttcatctgcatattgaccaacataatcaataaaggtctattggagactttctgtttaggatccagctttgggagtacaattaataattcaagattttctaatgcatagaaaattgtcatttattacaatagtccctcagtttttcccacgaactgagaaaatacactgaatgttttctgccatcttggaccacattaatcacaatgtcttacccaatcctgaaaatccagttttaatgcctggtcctcagaaccatgatgtaaatgttttaggttataagaaaatgaaaaatttgtctagcccattcaataagtacagtagtacctagtgcagcattatcttgattcacactaaagtctagtagactcaaaatggttaactcaatattgacagaagtgctgaatgtttctattaagaaggtcttctctgactccttccgactactgtgggtttatcattgagctctcttatattttttctccagataaagtagaatctgattcatagcaatattgcatggtattgatgtgatctattaacagttaaaactggaaacagttcgccttgacaatgtcctttgaactattcagtggcactccgctttaacacacaaacttcagtttgcaaataaactacaatatctctctttcggacatactttctgtgcaaaattccataatcttttcacataaatcctcatggtaaagagcagcccgacatcctcaaggatctcatcaatatacaggaaaaaagaatagatagtagcatcaagtccacaaacactctcaaacacagcctttgcttcaaggattccaaaaagtattaaagaaaatggttgcctctatttcccttaattttgagttcattttagatcttactaccaggctgactaagctcagatcatagaggttggcaaggtagaagttatgtttgacaaaaatgttttaatgtctactgaagcagacaaattaaataaacaagtaattgtatatgctagtaagtgaaaagaaggaagtacaccttatgctttaatggagagtacatttatgtgcagagaaatttaaagaaggtggtcaggatagacttagctgaagaggtcgttgtgatctgatattttaagaagaatatgagcaatctacgcgcagtgtaggcaaatagtaattcaagcagagggaatagtaagtataaaaagctggaaatggaaatgggcttgccgtgttgaaagaataaacttgagtgatgtacttcaagcctactgagccataggagaatagtggaagatgtgtttggagatggaggctgaaccagcgaatacagataaattatgaaatatattgtatttccttttgaattaaatgagaaactaccaaatgttttattaaaagaatgtcataacagatatttgtttcaagacattactgtgtttgctccgtgaagaattaatcagataagagcaagtgtagaaccttggatgtcattttaatactctgttagataatggtttccagaacatgtaagtttgcagtggagatggagaaaagtgaatggattttaaatatattttggagttaaaactcatgggacttgctgaggaattgaatatgagatgtaaagagtaagggaagaggatgaatgaagactaatacctagtgtttttgttttgtttcatgcgttgggttatattttggtaaagttgattatgcttgtggaaaataagaaaaaattggggggagagtgtgtgttgaaagctctgcttttgatattctttgagatgtatagtaagcttccacactgaaacattcagtaggccatttgatgtataagtctgaaactcaagagtgtggtatataggggatacaaaaaattctcaagtcataagaatgtagatggtatttgaaacatggatattaagtgtgatcacctaggctgagagagaacataaagaggagggatgagagaatacctgtggaactattttaatacttagtgtttggatagaagaagccaaaaatacatagaacatcatgaccagtgatttacaagtaaatgtggtggcaaaaatgccaaaaaagattattcaaaaaatagagggtgaattttggcaaaggtagctgagcagtggaatatcgtaaaaacagagaaaaatccattagattttggcaacaaggaggatgttgatgactttgtacagaacagcttatgtagaatggtgatatgtgttatgctagagtgaattgactgaaggatggcttgaatataaaaaaaatccaattggattaatggcttgtctaaaatcaaaggaaaatgcacaattaaatcattattaactatagacaccctgttgtgtaaccacccaacaggttctcctagtccactactcagaaatgatttatcaagacaggagaactgcaacagagaaagagtttaattcatgcagagccggctgaatgggagaatggagttttattgttacatcagtctccctgataattcagagactgtttttgtttgtttgtttgtggtgtgtgtgtgtgtgtgtgtgtgtgtgtgtgtgtgtgtgtgtgtgtgtgtgtgtttaggataatttggtgggtaggggattagggagtggggagtgttgattggctgggtgagagataaaatcatgggaagtcgaagctgtcctcttgtgctgagtcagttcctgggtgggggccacaagaccagatgagagtggcacctcctgattcatcgaatgcagaatctgtaaaatatctcatgcaccaattttaggttttacaacagtgatgtcttccctgggagcaactggggtggtttcaaatcctgtggcctctagctgcatgactcctaaaccataatttctaatctggtggctaatttgttagctctacaaagggagtctggtccgcaggcaagaaagtggtttgttttggaaacagctgttaccgtctttgttttaaagttaaactataaactatgttccttccaaagttagttcagcccacacccaggaatgaacaaggacagtttcgaggttaaaagcaagatggattcagttaggtcagacctctttcactgtcataattttctcagttatgatttttgcaaatctagtttcagttgtgctatcaaatgctaagtcttattcattctttctatttttttgtacccattaaccatccccacctcccctccacacccacccactatccttcctagcctctggtaaccatccttctgctctgtctccatgagttcagttgcttgaacaaatggatatcagaggatgtaggaaatgacattgatctattaataaaaacaataaaagacttgaaaataacacaaaaagataggcatgtgttcttttaataacatactgaagcatcatctaaaaggacaccccaggtattatttaattctctaaggtatgtacctttattaacatactattgtttgtgcatacacctatgaagttaaatgttaatttgtattttttatctgataaagatgcaaatgatttctgtctggtagaacaaagcaatacgattttattgtcctatagggcattaactagttctgaatctaatatagcaatttcattccaaaagtctttcttcagttttaataaatactcctcagctcttcaaatgttctttgaatcaggcttattattctgccgattaactctaagttcaataaatttgacatatatttatttattctatatttttatcatatgttagtttgttagggctgctataacaaaatagcacaggctgggggtctcaaacaacagaaatttactttctcatgattctggagggtagaaggccaagatcaaggtatctgtaagtttgatttctcctgggaactctctccttgactggttgccctgtcactgtgttctcatatggtcttttctgtgtgtatgcacattcctggtctctctgtgtgtatctgaatttcctcttctgataaaaacatcagattggtttaaggccctcactaatagccgtattttaacttaatcatctctttaaggctctattgtcaaatgcaatcatattctgagttaccaggggggttagggcttcaaaatgtaaattttgggggaacacaatttagttcataacatgtgaaaatcatgtttgttacttttttttttcaaattatgccttggtagttttagaggttacacaaataaatatttggcctataaggctgtattgtcaaatgcaatcatattctgagttactggggtgttagggcttcaaaatgtgaattatgagggaacacaatttagttcataacatgagaatcatgttttttagctttttttttccaaatttatgccttggtagttttagaggttacacaaataaatatttggcatgttgattccccattctctattttaaaaaatacttaggacgggcgtggaggctcacacctgtaatcccagaactttgggaggccgaggtgggcagatcacttgaggtcaggagttagagaccatcctggccaacacggtgaaaccccatctctcctaaaaatacaaaaattagctggacatggtggcgggtgcctgtagttccagctactcaggaggctgaggcaagagaatcgtttgaacccgggaggcagaggttgcagtgagccgagatcgtcccactgcaccacagcctggtgacagagcaagactccaactccaaaaaaaaaaaaaatacttagaccaactctttcaaacttcatattgcccatatctctcagatacttgcaaaatgaaacttgatgtttgatagaggttgagttttctgggaagtaaatgatgagctggaattatgagggaaaatgtttattgtagaataacaacagatggggaaagaaaagggagataaggcagatttagacatgcggagttgttaggacatgatttgtacttgacaaaacttctgaacatcaactgagaactctggaataaagattactcaataaaaatatctttccttggaagttgcctatgcccttgtaccaccaccatgctcagtcattggctgattgcttcaggagagcatgactttggctcagaagttgatagggattctgttaaagctaacggttggaggctgtcaactaaccacagccttcagaattggacagcaagttctttcttgaagaggtctatgagtgatgtatccgtaggtctgtcacaaagtttaaatcacaagaaaaaaaaagatatatgaaaagggaaagaaatacaaaaccattcaaaatattttagtaatggtaataatttataacatatttagttaatatgtgccacagactatttaacagttcataatattatcctctttttcccccattttcctcaatccaaagaggagaaaattataaataaacgaactgaatctttttactgtcaatgattttaattgtcatatttgagcactaagaaatgttaacaacaaaaatacattgtttagaaaggaatatcgcatttttagtagcatattctgatttgaaatcatttaacttcgagggtaatttatttagaattatattctagcataaaaatagcacaaaattttaaatagaaattaatacatgtcatttaataatccctccaaacaaaatttattgagggatgtgcatgcttacaggcatgtataattctaagtattgagctacaaacatttatgtatatctattaatcattaggcttttacagattttcaaataaactaaaaacagtattttaaagttttaaagagagtgaaacatgtaacacttcaaagcctgaattttcatttttgacttttttatttttaattgaaattattttattacttaaatatgcaagaaataaatagggcagtttgttgaaaacatgtattcatgggttaagtaattagatccatgttcatgaaactgagaactatctgataaaactgcttgaattaagagtccaaaaactatacactgaactggatatcatctataaaactgatcattaccttaagcagttaaattttaaaactctgtaaatctgcttggtgtggtatatgtcttggctctgtgtccccacccaaatctcatcttatattgtaatccccatgtgtcagagaaggggcctggagggagatcactggatcatggggtggatttctctcttgctgttcttgtgatagtgagttctcatgagagctgatgattgaaagtgtggcacttcccctgtgctcgctctcttctctcttgctctctctctctctctttcgcctccacataagacatgcctttcttcccctttgccttctgccattattgtaagattcctgcggcctcctcagccatgcagaatggtgagtccattaaacctcttttcgttataaatgacccagtctcaggtagttctttatagctgtgtaaaaatgaattaatacagtgtgcctaaaaatacctcaaaattagatgatttatgtctagattccacctcaataaacaataatggtaaaatttggaagtatgattaggtaataaaaatggaaaaagtaacagatatttctataaatatgtaaatttgcaaataaaacagtgtttgatagatcaacagaatgactatagttaacaataatgtattgtacatttgaaaatagctagaagataataattcaaatgtttttagtgtaaagaaaagataaatacttaaggtatagatatcccaattgctctgaattgttcttttcacattatatcaattaaaatatcacatataccctaaaaatatacacatctattatatatttttatttaaagttacactcttcattgattaatatttcccaaatggctttaccttgttttaaaaacttaactcttccttgtgtcaagtaattaccttggataatttcttttaaaagaattaataattgttaaaggaaattatctttaaaaaaactaactttatgtggtacagaatctcccttttatttccctctctctctaaattgtagctgtggtaaggcttgtaaattaagaagtgttacactctggtaacatcttcaggatatctttttaattagtctctagagtgaaaatttccagaatattcaaatgcatccccaaataacacattttcagcgaaactttgatccaggacttttttagcacatttattcatttatacaattttctcaaacacaaattaagtatattttgcagcccctatgattgaaaacaatattctctcttaactccgccagatccctaagcacctttaaacaagaaatattaaggcctccttatctaacatctattaataaatgtatctcaaattaaaatttttcaagtattgggtttttctatttgcccaaaagtcccctccccaatacatatagttaattgttgcaatgatccctagtaacttactagtaaaatggttattttcctcagcacaacacacatgggctccaagtccttgtccctgcctttctgtccaggcttatctggcaacactctgtcttataatttaagtgttagcaaaagcaatggtaactcctctcttccagatagccatttcaacacactctttttcactcttttctaaaagtgtactgcagaaaaaaaatttgatacaattgaacacctcttcatgataaaaacacaacaaactaggccttgaagtaacatatctaaaaatagtaaaggtcatatatgacaaacccacagctaacatcataacatcataccgaacagggaaaaattgaaagtctttcctctaagaactggaacaagacaacaatgcccacgctcaccaatcctattgaacacagtagaggaaatcctagccgcagcaatcaagcaagagagaagagtaaaactggaacataggaagtcacattttccctctttgctgatgatatgatcttatattataaaaccctaaagccttcaccaaaaatctcttagatctaataaataagtaaatttggaggatagaaagtaaacatacaaaaataagtagcatttctatataccaataatgaactacctgagaaagaaatcaggaaagcaatcccatttacaatagctacaaatggataaagaaaatgtggtatagaatactattcagccataaaaatattatgtcatttgtaactattgatgaaactagaggtcattattttaagtgaaataagtctgacatggaaagacacaaacatcacacgttcccactcatgtgggaactaagaaaatagatctcatggaggtggagaatagaatgatagatactagaggctgggaagagtatatggatggggagcagataaagagtgattggttagtggttacaagtatgttagatgaaaggtgtaagttctaatgtttgatagcagagtaaaatgactgtagtcaataacaatgtattgtacatttcaaaatggctagaagagaaaacttgaaatgtttctaacacagagaagtgataaatgataaatgctcaaggtggtgaacacctcaaataccctgacttgaagagttattacaccacctatgtatgtaacaaaataaattttcttaaaaagaagaaaaaaagacaagtgttccacttttctccctgtagcattctatgcatgtctttatcatttttttcttctcattttattgtgattatcaatacttgtacaatagtttacttcaatgaggcgtatgttgtagacatctttgcatcacatgtttcaagctctggcaatgtgatatttttcttctaaattcacaataatattttcaagagttcatggatgttttttcacatatagatagccatagcctaatgtactgatattgagtgttcagaatgtacaaagagtaaaatcatagtgaatatatcaagctgagtcactttttctcttttattttttgtatatgacaactttctcctaatactaagagagagagagagaggggactgacttgagtaaaaataaaaataaaaatttagtaccttttcccctcattaacctcctgctggtgggttggcattgtgtgtgcaatatattgactccctgtatttttctatttcttttttttctttcttttttttttttttttgagacagggtctcacactgtcgcccaggctggagtgcagtggagggttctcggctcactgcaacctccgcctcccaggttcaagcgattctcctgcctcagcctcctgagtagctgggactacaatttttagtagagacagggtttcacaatgttggccagcatggtcttgatctcttgacctcgtgatcctcctgcctcggcctcccaaagggctgggattacaggcgtgagccactggcacccggccgactgcctctatttttctaatgctgtgctttttctatcagagctttttagaattcctattaaatggcaattctgtttacttcctgtattagcaaactgatatatattgtcaggtgctgagcatgggataggttgtatttctaaacacattactattgatttctggctcctttgaaattttcctccattgttctaaatctgccctgttagattggtcatgtattttcactgagacctttgtgttataactgaatccccatttagcttccctctattaggcttatttttctgtgttaaagttcctgttgattttggtaacttagagaaaataccatgaatctagaatcatttgtatttacaaagtcattccatctgcatcagaactgtttgattctattatttttgactgatagagattagtgagaaacatggaattagatagttttgctatatgaacaaccaacccaatctcaatggcttaaaatagtcattattagagtttcctagaggtcacctggtttaggttagactcaactgagggtcttgggtttaactcctttatgtatctgtaggttgaatggcaggctctaggctgggagccaagaagcttagctgcaaagctctgttccatgtgccttgaatccatgaattttgagccatcctagatagttctacctcaacagatataatggaagactgtcagtttgggtcccctgagagacaaatgataagatagtattggatatgtgcaagacttattgagagaaatgcccttgaaggataaaggggattgggaatcagattaatgtggacacactttagactccagtgcagatcttacacttgtgaaaggggagaaaagagagtaagaaggatcagcagaaggagccttagagtgcaatgcagtttgagaaagtcttggccagtttaaaggtgagtctcagaacatagatgcccattagatgagccccaggagtcccacgttgacatgggactggcttttgtataccaactgtattcagtcactagctaagaccaacctgagaagagcatggcttttgcatgaatgcggaggcaaatccaatgtgtgtgtcagctggaggctctcagataattactcttctccaagttctcttttgaaaagaaatttgagtggcaaacataatgattgctcctaagattctttccagaaaatgaagatcaagatttcttttaatcaactaaatataggctcttggatttattctgcattaactagcatgtaaggtttcacttcttgattaatataatcataagagaaagagaatagaaaaacttttatttggaaagtcactcaatgaattagtttccttgctgtatgctctcttggctgtaagctaaaaacaaacaatccacaataaccaacacaatactgaagcagaagatcaaagttggagaactgatactacttgatttaaagtcttgtattttagaagttttgtagtttcacataatacattgaggtctgtgatccgttttgagttaattcttgtgaaaggtgtaaggtttgtgtctagatttaattttttgcatgttgatatccatttgttccagtataatttttgaaaatactatcctttctccattgaatggcttttgcttctttgtcaaagatcagttgactatatttatatgggtctatttcagggatttctattctgtttcactgatatatttgtgtattcttttaccaatatcatactcttgattactgcaaaattgtcatatatatgatttgcaaatttttttattccatcggttatcttttcattttgctgattgtttccttttctgtgcagaagcttttaagtttgatgtagtgtcacatgttcatttttgcttttggtgttgtgtccaaaaacaattattgccaagactgatgtcaaggagcttttctcctaagttttcttctaggaattttatggttttagctcttacatttaaacctttaatctatttcgagtttttttgtgtgtgtgtatgttgtaggttaaaggtccaatttcattattgtgcatatggatatccaccttttccagcaaaaatttttaaagagactgtctttagttagaacaccagaagcatgacgcatggaagaaaaaacatgtataatttgaacatttttgaaattaacgtgttttgttctgtgaatgttaagggaatgaaaagactagctattgacttggagaaaatcttttcaaaagacttatctgattaaggacttgtagccagaatatgcaaagaaatcttaaaatccagctgtaagaaaacaaatgttgtagtttattcaggctgctaaacaaaatatttagactgagtaatttgtaagcaaaataaatttatttcctatagttctagaggctgggaagttcaaggtcaagccaccaggagattctctgtctggtgaggcgcctcttcctcatagatgataccttcttactacaccctcacataatagaagcaacagacaagcttcctcaggcatcttttataaggacactaatcccattcatgaatgctgcgtcctcatgacctaatcacctcttaatggccacaccccttaatagtattgtattgggaattaggtttcagcatatgcattttggggcaacacaaacattcagattatagaaacaaacaaactacaaatcacaaaagatcagaatagacacctcaccaaagatgttaaacagattgcaaatgtgcacatgaaaatctgctcatcatcatatgttattagggaaatgcaacttacaacaatgagatgacactacatatctattagaatggccaaccttttttttttttttttttttttttaatgataataccaaacaagtagtggtgaggatatggagcagaaacactcattcattgctggtgggaatgcaacgtggtatagctatgatggaggacagtttggcagtttctttcaaagctaaacatagtcttactatacaatccagcaattacgtttcttaatatttaccaatgagttgaaaccttatgtcacatgaaaatctccacatgaatgtttactgcagctttagaaatttataatttctaaaacttgaaagcaaccagatatcccttaatagattaatggataaacaaattgtgatatatccatacaatggaatattatccaatgataaaaagaagtgagctatcaagttataaaaatacatgaggggactttaaaggctattgctacattaaagatgcctatcttaaaaggctatacatggtatgaattcaaatatatgatattctgtaaaaggtaatactatggcaagagtgtattagtccgttttcatgctgctgataaagacatacccaagactgggcaatttgcaaaagaaagaggtttaatggacttataattccaagtggctggggaggcctcacaatcatggtggaaggcaaagaggagcaagtcacttcttacatcaatggcagcaggcaaagagaagtcttgcgcaggaaaactcccccttataaaaccaccagatctcatgcgacttattcactatcatgagaacagcacaggaaagaactgcacccatgattcaattacctctcactgggtccctcccacaacacctgggaattcaagatgagaattgggtggggacatagacaaattatataatttcaccccagccactcctaaatctcatgtcttcacatttcaaaaccaatcatgccttcccaacagtgccccaaagtcttaactaatttcagcattaactcagatgtccacggcccaatgtctcatctgagacaaggcaagtcccttccacctatgagcctgtaaaatcaaaagaaagttagttacttcctagatacaatggagttatagtcactgggtaaatacagccataacaattgtgagaaattggccaaaacaaaggggctacaggccccatgcaggtctgaaatccagcaaggcagtcaaatcttaatgttccaaaatgatcttcttttactccatgtctcacatccaggtcaccttgatgcaagaggtgggttctcatggtcttgagcagctctgtccctgtggtttttcagggtacagccttcctccaagctgctttcacaggttggtgttgagtgtctgtggcttttccaggtacatagtgctagctgtcagtggatctactattctggggtctggaggatggtggccctcttctcacagctccactaggcagtgccccagtagggactctgggtgggggctctgactccacatttcccttgtgcactgcgctagcagagcttctccatgagggccccacccctgcagcaaacttctgcctgagcatccaggcatttcctacattctctgaaatctaggcagaggttcccaaacactgattcttgacttctgtttactcgcagcctcaacaccacgtggaagctgccaaggcttggggcttgcacctctgaagtcatggcatgagctctactttggcccctttcagccatggctggagcggctgtgatgcagggcaccaagtcactaggctgcacacagcagggggaccctgggtctggcccatgaaaccgtttttttctcctaggcctctgagcctgtgatgggaggggctgccgtgaagacctctgacatgtcttagagacatttttcccattgtctttggcaataacatttggatccttattgcttatataaatttccacagccagcttgaatttctcctcagaaaatgggattttcttttctatgacattgtcaggctgcacattttccaaactttcatgctctgcttcccttgtaaaactgaatgcctttaatagcaccaaagtcacctcttgaatgctttgctgcttagaaatttattctgccagataccctaaatcatctctctcaagtccaaagtttcacaaatctctaaggcaggggcaaaatgccaccagtctcttggttgaaacataacatgagttacttttactccagttcccaacaagttcctcgttcccatctgagaccacctcagcctggactttgttgtctgtatagctataagcattttaggcaaagctcttcaacaagtctctacaaagttccaaactttcccacattttcctgtcttcttctgagccctccaaactgttccagcctctgcttgttacccagtaccaacatcgctttcacattttcagatatcgtttcaacagcaccccactgctggtaccaatatactgtattagtccattttcacactgctgataaagacatatgtgagactggacaatttacaaaagaaagagatttaacggacctacagttccacatggctggggaagcaccacaatcatggcagaaggtaaaaggcacatctcacatggcggcagacaggagaagagagcttgtgcaggaaaactgtcccttatgaaactatcagatctcacaagacttattcactatcatgagaacagcacggaaagacctgcctccatgattcagttacctcccactgggtccctcccacaaaacatgggaattcaagatgagatttgggtggggacatagccaaaccttatcagagagtaaaataagtggctttcaagtgttcagggggacaaagggagggaggaataggtgaagcaatgagatttttacagtggccaaactattctgtgtagtactgtaattgtaggtacaaaacattatgcatgtgtcaaaacccatagaactttacaatactaacggtgaacccttagataacctatgaattttaattaataacaatgtatcaatatgggtttaccagttttaacaaatgcatcacactattcaagatgttaataatagtggaaaattttggtggggaggagttttgggaattttcttgtacaatctgctcattttttgtgtgaacctaaaactgctataagaaaatgaagttggttgttaatctaagaaaatcaaacaataatgccagtactcattgactcatgttttagtgatctttgtctttcctttgacaggttttagaaagatataaattgccctcctaattctgccttttgccagttatatgatcttggtccattttctgaacctcagtgttcccattggtgaaatatggttaacaatacgcaacagataacatgttgaggatacctgcaggaggaagagttgcatgagatcttcaatacatgtcccttcctttcaccttttttaaatattctctcctagcaataaataaataaataaataaataaataaataaatgtggggcttccccagccatgtggaactgtaggtccattaaatctttcttttgtaaattgcccagtcttgggtacctgcaggaggaacagttgcatgagatcttcaatacatgtcccttactttcccctttttcaaatattctctcctagtaataaatgggaacaatttgagacaaacatcccttgcatattttcttattgaaccatgtttatttcaatacccactctcctttcctcaatatcactcaaatttttgtattttgttcttcctttttttatattttcagatctcagaacacaacttagaaagtacctagagtatttacaatagggtagaaataagttgttcagcattctattaaggaattatttttggtgaattgttgaggcaaattgtttggtgaattgactgtactctagccatagcaccatgagagattgaaaaaataatcatgaataaaacataagtcctgcttttaagtaattcacagtcagagaagatgcatgagaagaaaccatactgatatagtcatcaacacctcagtgtgaattcattttagatagttttctcagacatattgatgcatgagatgtggcctcagcataagaatgctgtgaatcccagtgggagaaggtatcccttaaaggaaggtggggaattagagaaattgaagtttactagcactaaataatactctacttactttgaaattatattcattaagagcaaatactctccccttaaaatcctatgctttgaagtgaaaaattcagtatgaaagatttgtatcggtggaaacaaaaaaaaagaattatttatgtacattaagctttaaagagattttggatttttaatccttttatattgtttctaagaaactcattttggtctttttgcactacaaaattaatgttcctacagtgtttgaactttttgtttctcctgcatgtataaactttgaatataggtttcaaagaaaatttaataatcttgttttgttttacatttccttaattaaggtgttaattatgatcaaactgcatgacatcacaatttgtgagggtaaaattcactttaccctcactctaatttttactaattttattaataaatgatgtgttttcagcaatgttttaattctttttattcatgaatattatttcctagattaatgatatctgtagaacctgaaattaaaaagctattctggagcaattaatttatttacctgaattttcaatattaacagtgttattttcataatatttatattcattcatttcataatttaagtttttcatgaaacagtgtatatatttttaggtaatacccacaattctaagtatgtatgtcccaaatttcctgaagctctcttcagaaaagttacagagaatattaattagatatgtatattagctctttatctagataataggatataaaatagatcattcaaatataatagtatgtttgccttccaactcatccctactttcctttttaaatatagcatacttttaaaatattattttgtattatttcaaagttaaagagaccaaaaaaaaagccctaccatttccatgaaattaaatctcccttctagaaaagatgtattcagcatctacttgggattctttgctttaaaacttctgaaagatttcacaaaattaaccatgaaaacatgaccagcagcatatattttccaatacagtatctttcatcacctttatgtctgttggatttttatttctcactatgtctcaaacccttagtgttttacatagtagttctgtcttaagatataatgaaacttattttagtacagagacttttattaagaataatacagtgaattttattatggtgtattagaccagaatctagacaaatattcttacagtggatgtggatgttcttatgaatctattacactctagagattaaaatttctacaataacatcaaatacttcctagtggacacaaacagatatgatatactatgaagaataaaacttacaatttaaccgtagaatttagatttccagcagtgaatatataagcaataaattatacaagtgactttaccagcagtagtagcaaattttgaatagagaataaagcaactgtgttccaaacgtgtcaggagaacattagtagtatcattataaatgccagatacccactcctgcatcaattccacatatttgaaattcactagcttgtgtgacctcgaagtttccaaatattgaagttgtatctggcaaagtgaataccataacactagttaccttggccctagaaatagtccctgttttagggttaaagcataattactttattactaatgataattggtgaaaatgtgaataaccggtaggggaaatgatattggcttgaatgattctgaagatcagcaactgagcttgctatgtgatatatttttttaaaatgtttgagccagctggtaagaccttgtgtcagagggtaacaaaactccagttggtgggctgacatttaggattaccaatatatatagtccatctgacctttttttacacttccttttggtgagactgataactgatattcaatacaaagtatttaaatataaacaggtcatatttgtagctgccatgctcagaatagtgatgctgtaagagtattctagcaggtctattctgattctctcactgttgcaaaaccagaaaatctgagacaggtcttagttaatttagacagtttattttgccaaggttgaggacacacccataacacagcctcaggaagtcctgacgacatgtgcccaaggtggtcagggcacagcttggttttatacattttcaggagacatgagacatctatcaatatgtaagaagtaaattagttccatccagaaagacacagacagctcaaagcaagccctaccccaccccactgagggcttccaggtcacaggtaggtgagagacagatggttgcattcttttgagtttctgataagtctttccaaaggaggcaatcagaatatgcatctatctctgtgagcaaagggatgacttgaatagaataggaagcagatttgccctgagcagttcccagcttgaagggtcccaaaggtatttttcttacatactctgttttctgctctttatctctacgttctcattattgattgctatttcaaggttctgtcatttcttctttcattgttctcaagatcactctcacttattttcaaatattctttctgttgttaaaacctattatatttatagcaactaactgaaaataaataagaaattagaatacaaacaaataaacaacacttcaacaaataaatcttgggctgggcaggtaccacttcagagtaccatctatgcttttcccattgaagagaaactggccatcccagaggtgtttcaggctggctatttacttggccacactttgtactgtcttccccttaaccacccaaggacagctattccataaaggctaagcaatgcttcataagaaatattttcctctgttagcattttgaatgtgtaattttaatagaatgtgacagttaatagtaggagctgaagaacaagaggtatgtgatgtagaataaaagacagaaacaactataatgtgctatgaccaaaatgtacatggaagcagactaagtaaggtttcaaaagagcatagaaaaacactcactaagaaccatcacgtatcctgatgaaacttcagcccagttccagttttattgcgtagatgtctccacaataatttttttttctgagttaaacggaatgagttcttgttgtttatatcaaacagggatatcattaattctgacatggtctcagagcatctaaatgaccactgtgatccaagaaccatcatttctctggataataatgtagcctctttattgctctgcttcggtctttgctccagaatctactctccaacagcagtcagagaggtcattataaatgcatgatagataatatcataacttgtgcaataacctacaatgatttcacatcccagagtaaaaataaaaagtgcttgccatggcttaaagaggcctccatggctattcctctatacttgtccagctccaattaggggcactggcctcttgactcttctggaaatactcagcaaactttttttttttccttcagtcatttgcacctgtttcctctgccagaagtgaagcctcttccctagacatcaacttggctccccctgtcacttcccatcactttgagaagcttcaccctagcccttcaccagcactctatgttccgtttatagtgtcattattttactaaattgttacaacctgatggagcatatattaatttattatgtttgtggtcattcatcccctgctagaatagaagctctacaatggacagtggttgttttagtatatgggatcactagcccctgaaatactaccaagtactcataaagcactcaatagatattttttgaattaattagttaatatacaaaacttatgtatcataacctcatgattagaatcatctaatttcacactgaaggaatatatgatagttagaaggggataaggaaagagaggagaatatgaataaaaaggtggagtaactaaattaaaatacaatgtgcatttatatcttcacaatacaactaaacttcatcatcatttgtctagagatctgagacaaaaatcagaaatagagaacaaggaatgtgagaattaaaaggaaattacatttaataatgatgtttatgtaaaatgtgataggctaatttaatataaatccaagaaagaagcataaaatggaggatatatggtaaatatgtgacacataaaatttttattaaagcaaattagtttaacatcattttatcatcaattacttccttattcacaattcagtttcacctcctttgtatatattttaagctgtaactttgacacaatttatgacaaaggaaatatatacttcaatattatcacactgttagccgaaaatatttgaacaaaaataagtattgctttccaaataattttcttaaaggaagtacagtcttaccactgaaaattaaaacaacaatctaggtgaattgttatattgttccaaatatgatttataagattctaatgtttttatgacttacaggtcttttaaaaaactatttgagagacaggaatgtatattagattattttatctggtttaggtagaataaatgtaagcaatgacaagcgatatatacctcatcatgcttatattttcttttcttttttttttttttgagacagtgtctcgctctgtcgcccaggttggagtgcagtggcgcaatctaggctcactacaagctcctcctccctggttcacaccattctcctgcctcagcctcccgagtagctgggactacaggcgcctgccaccatgcccggctaattttttgtatttttagtagagatgaggtttcaccatgttagccaggatggtcttgatctcctgacctcgtgatccacccacctcggcctcccaaagtgctgggattacaggcatgagccaccgcgcccggcctcatcatgcttatattttctaaatattgaaaagacttaatagcaatcaattattccctccttttctccctcctttatcctttcctttctttcatcatatacataatatatataaatattagatatataaagtgcttataatgtatcaacgtacaacatcagtcaaaatccctacccttaaaacagactagtcagtcttcttttcttcattacattttcatttctttctgccttcctttctttcaattataagatgtaattcaggaatatatcattcctccctttttttttcttctcctcctttcctttctcccttccttccttttttattttcttcctcccttccttccacaggtattccacgaataagtacatgtaaaagatccaaatgatacggaagtataaagagtaaaatacaaatgcctacaactgcccttcttgtattctactgctcagagagcaaatgtgggtcatgagaatactccaaacaaatattctgcttcaggagaagaatgacagattttgtatggaggtttagcaacagagtcagttgtagatcagttggtttggggaataattactccaaactggttcttaaaagagggaggaatttatgttgtgaattagctgtcaaaggctgggcaatttgtgttttcaagaatggtgaggtggaacagttagggcctaaaaatatgtcggtgccagagtgggaaatattaagtcctttgtggtctcttacctatatttcataattatctctcattgtcaagtaatgagatgctccccctgagttcattttctacacatttaaaacttacccctgtgaacaggcacatattttttttttttttgaaatggagttttgctcttgttccccaggctggagtgcaatggcgcgatctcagttgaccacaacctctgtctcccgggttcaagtgattctcctgcctcagcctcccgagtagatgggattacaggcgtgcaccacaacccccagctaattttgtatttttagtagagatggggtttctccatgttggtcaggctggtcttgaactcctgacctcagttgatctgcctacctcagcctcccaaagtgctgggattataggtgtgagccaccatgcccagccaacagccaaacattttataattattttaatatttgtgacagaatgcttcctaaatggtaacaacagattgctataaggattattcccaaaagaaaaaaatcaaaattttttattgaatttcaataatgacctacaactttactaccttctatggctatgggttatttatctacaggttaaaacaataaaaatagctgtgtttcaggattttgtatgatgttgactttcattttcaaaattaatttcatattttcactcatattacctgcttattatcacctgtttttttttccttatttttccacccccactttctgataattattatgcatattaaaacaaacatatatactatcaaactgggaaggcataaattattgctgagtaaaatccccataccactttcccccagtcccaccttttgaaggtaactatttctaggagtttgctgcacagtcgtcttactatattttatgagtattccagtatacatatgttaaagcaaaggcaaacatttcatctatatatatacatatgtgtgtgtgagagtgtgcgtataggcatataatgtcttttaaatacaaatttaattctacagttcatataattttgcatttaaaaatagaacaaaatcatcatggatatttttttggatcagtacatagagatttattatattctttaacttctttgtattataggcagacttgtaactaacagctcctttccactttctaatttaatctgattttgtaaatcaaagattgcaccacttagaattgcactgtatttacttactggatgagagtgattgtctaaaacattctcctatgaatcaagtagctaagtcttcacaatttatttcaaacgtcacattctcacagcagccatcaccgaccactgtctataaagttgcacctcccaacatacacccaccccatcacactgtatctttcctttacagtgctaagcacgatatgaaattatcttttttttgcttcttcactgggactaaatcttcattaatcaaaatccttgtttggcctcttctttgatctatttccccgtatctagatacctccctgacacatagtacatattcaatatacattgataaaatgattgaatagatgaatgcatgggtgtgtccttattgcatcaactttacttacacatttacctgtcccttatttacctgtccttttacactgtagaatgttgagaatgccaggttagtgaactgtaagaaaatgatcaagaatgcatacaaactggaagacctagactcctaggagtaatttcacaaaacgcagatctgaagcttgaaaaactaaagttaagaataacttgcagggtttttagaatcattttcagagcatgactcacaacagcaaaaagatcacagtctaatttattgagagtagatggggcaatgttatgaggtgacagaaaaaaaagtaaaatgccttagcttctattttgtttcatttttttcttctgccagagtgaaagagcatcagactggaggggatagaacaaataattcaatgaaaacattgaactttaaaacaagaggagagactaaaataatatctccctcagaatgagttgtgttgtaagactgaagacagtctcttgatatggattctcctaaaagtcaactttgattctaggcatgggtgtaagtaatttatctgaaaagttatctaagaaagcacaagtagggaacactaaggtggggaagagagaatggcaatcaaaggcatattaatgagtggcttactcatacaagttttgtcagcctttttgggattgggatcaaagcatcagcagtttttaaagttccccaggttattctaatatgcagccaagttagagccagcgttcaaaaacttaatatttaaagtgtgttccttagagcagcagcaacaacaccagcagcatcttggaagtattgagaatgcagaatcttgggcctggcccagacctgaaaaatcagaatcttcattttcacagtatcccccagttatacacatgaacatttaagtttgagaagatttagtacttgatatggtttggctgtgtccccacccaaatctcatcttgaattgtagttcccataatccccaggcgccttgggatagacctggtggtaggtaattgaatcgtgggggtggttacctccatgctgttcttgtgatagtgagtgagttctcaggagatctgatgattttataaggtacttcccccttccttcactctgcacttctccttgctgccaccatgtgaagaaggatgtgcctgctttcccttctgccatgactgtaagttttctgaggcctccctggctgtgctgaactgtgagttaattaaacctctttcctttataaatcacccagtctcaggtatgtctttattagcagcatgagaacagactaatatagtaaattggtaccaggtagtagggtgctgctgtaaagataccccaaaatgtggaagcgactttggaactgggtaacaggtagtttggaacagtttggagggctcagaagaagacaggaagatttaggaaagtttgaaacttcctagagacttgttgaatatctttgaccaaaatgctgatggttatatgggcaataaaatccaggctgaggtggtgtcagatggagatgagcaatttgttgagaaatggagcaaaggtgacccttgctatgccttagcaaagagacttgtggcattgtaccccgaccctagagatctgtggaactttgatcttgagagagatgatttagggtgtctggcagaaggaatctcctaagcagcaaaacgttcaggaggatgcagagcataaaagttggtaaatttgcagcctgatgatgtcatagaaaaataaaaccaattttctggggaaaattacaagcctcctgcagaaatttgcataagtaatgaggagccaactgttaatcaccaagacaatggggaaaatatctccagggcatgtcagagaccttcatggaaacccctcctatcacagccactagggcctaggaagaaaaatagttttgtgggcggggcccaggactccccagctgtgcgcagcctagggacttggtgacctgcatctcagccactccagccttggctaaaagggaccaaggtacagcttgggtcgtggcttcagagggtgcaagccccaagacttggcaacttccacgtggtcttgagcctgcaggtgcacagaagtcaagaattgaggtttgggaacctctacctagatttcagagaatgtatggaaatgcctggatgtccaggaataagtttactgcaggggcaaagtccacatggagaacctctgctagggcagtgcagaaagcaaatgtaaggtgggagcccccacacagagtccccactggagcactgcctagtggagttgtgagaaaagggccatggtcctccagaccccaaaatggtggattcactgacagcttgcactgcatgcctggaaaagcaacaggcactcaacaccagcccctgaaggcagctaggagaggggttgtaccctgcaaagccacaggggcagagctgctcaaggctgtgggagcccacctcttgtacagtgcgacctggatgtgagacatggaatcaaagaagatcattttggaactttaaggtttaatgactgccctattggatttcagacttgcatgcagcctgtagcccctttgttttggccaatttctcccatttagaatgggtggatttacccagtgcctgttctctcattgtatctaggaagtaactaacttgcttttgattttacaggctcataggtggaagagcatgccttgtctcaaatgagactttgaacttggacttttgagttaaactgagaatgagataagactttgggggactgttggaaaggcatgattggttttgaaatgtgagaacatgagatttgggaggggctaggcctaaatgatgtggtttggctctgtgtccctaagcaaatctcatcttgaatggtagttcccataatccccacatgccctgggggagacccagtggcaggtaatagaaacatggcggttgttacctccatgctgtgctcatgatattgagggagttctcacaagatctgatgattttataaggcacatgcccccacttcactctgcacttctccttgctgctgccatgtgaagaagggtgtgcctgcttcctctcccaccatgattgtaagtttcccgaggcctccccagcgatgctgaactgtgactcagtcaaacctctttcctttaaaaattacccagtttcaggtatgtctttattagcagtatgagaatggagtgatacagtaccacacattgaaatcacttgtgaagttttacaaacattaatacctaaaaaccaaaggcaccacccccagaaatagtgatttttttagtctggtgtacagcctgggaaacgggcacttcacaccctcctccagctgattaaattatgtaacaggatttgatgctgctgttatttctgtttgagttagatttaaagaggtttctaggtttcttctatagtatctcaatgccccgcccttataaagattattgtgctaattgtaaagattatcatttcactttgattctttgttttctcaattaccactgaattctatgttctattttctttattgtcttgtacttttacatctcatgtttttcactcacctgccacttccttacttgatccttctacctgagactatatttacaaataattcagtttttcaccttagctgctctttagaatcatatgggaaacttaaaaaatactgatgtttgggtactatgccagagaataagattcaattatttgtggtagtttcaaatatgcctttttttctttaattataatattctgctgatgacttcaatgtgcacctaggattgagagcctatgggtttatttatcttgtctgaaaatttaaaagacaaacagaaaaggataaatggttgtatagaacttgtaaaatgcttttgtgtataaaccccttaatagttccatctgtgcattctcattttattgtttagtgctataactgtacacttttaatgtttaataaatacttggtgaaaaactggaaataaatagtactaaaaattctcttatttcattttcacaacacccttgagctagatattttttcatgatgcagatgaggttatttggtggagtaaggatctccgtgaatttatggttattagaataagatggatcatgttatcattcataatatttttcctagctaaggaacagaactggtaacacttgctccatattgctcccagggtaacctcatgtgtatcttgctataacatatgcaatctagaggtatgaaatgttagaacagttataaaattgagtgctatgtaaattcgtggattttcatgaagatgcatccaattctgggacaggagatggattacttttcctgctattaaaagttctactcaggccaggcgtggtggctcacccctgtaatcccagcactttgggaggccaaggcaggtggatcacctgaggttgggagttcgagaccagcctcaccaacatggagaaaccctgtctctactgaaaatacaaaattagccgggtgtggtggtgcatgcctgtaatcccagctactcagaggctgatgtaggagaattgcttgaacctgggaggcagaggttgtggtgagccaagatcatggcattgcactccagcctgggcaaccagagcaaaactccatctccaaaaaaaagagagaaaaaaaaatgttccactcaggctaagtgcagtagctcatgcctgtaatcccagcacattggcagactgaggcagaaggatcacttgtgtccaggagtttgagaccaacctgggcagcctctacaaaaaataaaaaattagccaggcatggcaatgcatgcctgtagtcccagccatttgggagactgaggtgggagtatcatttgagcccaagggaccgaggctgcagtgagctacgatcacaccactgcactcagcctggttgacagagtgagaccctatctcaaaaataaaagttccgctcaagttattgttgtcaatttttttagtataaaattatttatattttctagtattcaaagaagtttaattatcatctattaaataggcataatgtctaatttattggttgtaatgatatgaattatttataagctataattactggacctacaggagatgtatagtatggtaattcttagtattaatattgattatcttatcaacgacatctaataaggagcagaaatatatttactattgatatgctaatgagcatggcattcatacatgcttctagatattctaaatttattcatgtgataaaatgagcttagagtttcttgaagtgagaagtgtaaaagcctggtccctcagaatgttaaccagctttagtctcaaataattcttgtgataaaatgcgtttgaaaaatactagtttgagtaacttttagtaggttcctttgtgatggcctattcagagcctatagtgtggttttattaggaatatacaaagggttataatatagtatacagcatttcaacaacttaatttgggtattttgaacatcttattatattatggaattgatattccttggaacacattttgaaaaacatccatttaaaccattagcttataccatatcaagttagtctccagaacaactgacttttctgaaatgcactttaatgttttgtgttcagtatctctcataggtaattataagaaagatctctataatatatagcattcacctttgctatgatatgtaattttcatcaatgtacaccttatcataaaatgatctgtaggttaatttctatcgagaatttgtaggactttagttccagagatacttacaagttctctaaataagtgctatgcttttccatgctgattatgagagctatgtcgctccatgatgtttggccttccttgctcaaatatcaaaagtcaaattttatgcacacttattgcagatcgtaaaagctctcactgttggatattttaatttttcttcttttcttggaccaaatattcagagtctatactgtatttttattgtatataggttttacttgaagcccctacaaaccatttcagagacgtggcatagaagtaagctttataaatggaattcactgcctcctattttttcatgcctcttctgggctatctgtaattacccttggctccagtgactctatgcttttcattctgagcctcagctggggccattttttttctcctcaggaaatcttaccatttgagtatgaaaatgcctcttttccagtcaaagctatcagaacaaaaaccatttctttatttaactctcattcatctttgcatgaaggacgtttccagtggcagaaactcctctgcatcaaaatcattagaaataaaattgttattccaagcttctgcctttaatactttaccaaacatctattgaagttatatgaccttttctcagattaactgtagttcctatctatgatctcctgagatttcctatggaatgtctgcttctgtcatgtttttaaggattggaccagtcatgtcctatttgtccccagatcaattactgtcttccctgctctccccttcactaccggagatagaccactgaagactatatgtctcaggtttccttgtcaaaaagattcctgttgggttcgaccaagaagaggtactggcagttgattaaaacaagggaggaagcaagaagccagagtatttccgttacctctctctgattaagcagtgtctccacaaagttgttgcttctgcagtatgtttcctctgtgattctagccttcagtggaaattatcttcattcatggtcttagctcatacctttcattccccactgtgttgccttaattttgtcatgtcttcttaccccctttgttccttcagtcctagaagaagtaagaccttcctgatgttgaaaatctctggattactttgctttagattactttgcttttgtgtgtgtgtattttctatatattattttctttttttttgagacggagtcttgctctgtcgcccacgctggggtgcagtggcacgatctcggctcactgcaagctccgcctcccgggttcacgccattctcctgtctcaacctctcgagtagctgggactacaggcacatgctaccacacccggctaatttttttgaatttttagtagagaggggtttcactgtgttagccaggatggtcttgatctcctgacctcgtgatccacccaccttggcctcccaaagtgctgggattacaggcgtgagccactgcacctggccgtgcgtgtgcattttcatttcttccaacatatgtacgtatttgctatagaactatctggtgagggtttccttttcctgcctagaatgtgacttatatgagtatttaaatattatcttattttttcccagtttatgatttccttaaggaagtatatttatattttaatgaaaaatgtatttctaaaatgttctcacaaagttgtaacatatctagatttctatttttcatctactcataaataaacattaatgcattgtgactttgttatttagttgcactaatatttgtacacacaaatatatatttggtgacaaattatgacaactccttttgtacatatataagttggtttgattttgaattcaaaccagaataatggaaaccacatgtttttaagaaaaattccatataaacatgctgggtatatccactgcattgaactaacttccaaaattaatagatgtaggaaaatgccaacatcacatgcagtgatagctaagcatggctggtaattatttggtattatagttgagaaccactgattaaatatgcaatttataatgtacactgctgatataagtagttttgttctattgctgctgagaattagccatatttccatgttacatgtgtattttgcatttcatttcgataaactcttaaatatgtaatggtctcaacagttataattttcatttatcttacacaaaaataggcatcattgtatggttttgatagctggtttgtcatgcaaggttttaattctctttccttcagaaatagcatgttcatgataaaataagacagatcaaagagagtatatgtttaaaatttagtttcacggaaggaataaaaatgtggtctctgagtaattagaaagtatcattgatttttctcagtatgatgattggtacaaaatctattctggagtttctttttcatcaagaaggacttaaggtggacttagataaaattatagtattaagagcggcttgaatatagaggaaagcattagaacataggttttataaatattattaaatgtatttaggccatgtaaataatggaacccatattagcagataattttttaaattttgaactgcaattaatggttttacttttatttctttccaaaatatcagagtcagtaaataaggttataagtagcaatggtaatattggaaaagtagggacaagcttgaaaagtgaagtagagcacctttaaacattactcaaggaaaattaattaggttttcttcgtttaacttatttattattaaggaaatgtgtcatcctctgccactatccctatcacattagagtgtaccttggaaaagaaattctcaaaatagccttttttcgagtttaaatgagcaaaacatatagcaacaatgacaaaatttcacctttttaaaattctatttctggataatgtatttttctattaattaaaatgaaggttgcctttgtctctatacataaaatcactttgggatgtgtattatttcaattattgtgaaatactgaaatgtattcaactagaccatgtctagcagaccctaaattccatgttcacgacttgtgactaaaatacttgcaagaatatagaaaacaaacaagaacagaggtaggtggttaatttggtgtaagaatccacgaaaaattttcactagcatcaagaactgtgaagcaattacactggttgtaaaagaagatggtagggagctacataggcgactctctccctggtgtttccttggctccagtgaaaataagcccatgtagatatttctctgacaaatgctacttgtagtttgtagttccggaagccagattgtgaaagtggattggtgatagccaacgacattctgggaagtgtagtttttcatacacaaactgccaatgtcaggggtataatttggaaggattctggtagcagaattattctccatgagtttggaaagtcaggaagtggaaaaaaataaaacaccaaatatttagtttccattcttaataagtggatgctgcatatttttagttaaaataacttctgtgtatattaattttcctgaaatttacatttgatatgcagatactttcagctccttaaatgacaataaaagtaaaaaaaaaataagaagaagaaatgaaacaacaaacatcctatggaaacaaaaccttttctgaaacctgtgagaaaaaatatatctgtatgctattatttttctcacagtaatgtttcttgcagatggttcttggagatttgtagaggtgtaccaccttgttggtctttgacaagatccaggcgatttttctccattaccaggcagagactcgtgttctcttcccttactttctcccaaacaaatagagtctttctctctctgttctgagccacctaaagctgggaatggagtaacacaagcacctctgtggccaccacgactatgactgtgctgggtcagacccaaagccagcacagcactgtgtctcacccaaggcctgctgttgaccactctctggctactgcctatgtttgctcaagtccttggagctgtacaatcagtgtgtggcaaagtcagccaggcctctgtcttttcttccagggcagcaagttctcccagtttccagggagttcaagaggtgctctctgggagacagggactagagtaaataaccttagaaatgtacctggtattctattatactgcagctaagctgacactgagaccacaaaatggagtcgtttccacccttccatccccttttcaaaggcagaggagcctcaccttgtggccactgccaccacaagcctatgaggaattctgccagactactgctgtttcctgaagacccaaggtctcttatgtcagtttgtcatgaatgcatcctgaccagagactcagccttcaaggcagtgtgctcccctctggctcagggcaagtccagaaatgctgtccaagagccaagttctggaactggtgaccccaagagcccacgtggtgctctagctccctgtggctgatctggtcacagatcaagtccaagaccaagtgccctttacttttccctctactcttctcaagcagagagtctgacttcatagccaccacagttgagaatgtgtcgagtctctcctgaagccagcagatctcaaattatcacccaaggccctcaacgtagttcccgggtatcactgctggttattcaaggcactcagactcttcagttagcaggtaatgaatcctaccaggactaggtcattctttcccaggcagcaggctcctttctggcctgaagcatgtctagaaatgtcatccaggagctgcggcctagaaagaaggccttatgcttccaaccactactctatcttactgcagctgagctcgtatccaaggtgcaagagaaagtcctgtttattcattcctcttctctcctcaagcagaaggaagggatcttttttggagccatgagctgttcatcctggggttatgggaggggtgatgccagcactgccttagctgccaaagctgtcgtctgttgtcccagtgggtcacatgacccccctagtctattctgggcccagatcagcactaaaactttcctaaaagtagcagtcctggtggcctaggctgcttttcacatttatttagagccacagagcagtttagcccacggtggtaaagtttgtggaaactttttgagatcagtaattcccctaaggctagaggtggtttaaatgctccctccattggcaggcatctgctgagtttggtctcattttcctttctgctataacaggacatcactgagttaaatgtctcaaaattgctgtactctctctctcccagtacacaaaaatgctctccataccatgctgtgtctaccaagtggtgggagaggggttacgttgacgattcaagactctttttaaaatagttaggattcaaataatagaaaggtctctgaactgaaaaaatattaagctttccagttgaaagtattccataggtccttattggagagaaaaccttataagctttcagataacaagtaggttacttgcaagttcagaggcctttctattattttaatccctgaagtattcaatagatatacactaacacatacatgataataataaagatatatactgatttgagagtaaataaaattttataattatttacattgtcctgggaacaaaaaagagaaattctcagacatgttatgattcagaaagaaaaccatcactgtgtatcaaaaaacaaagaattaggaatttcaatatcagaaataatgccattgaaggccacatgcatcaaatgtgacaaaaacagtattttggtatcataaaaaaagatgctgtgcaaattatacatagcagtcataaaattttatgcgacaaaagacataattgtgaaaaacacaagaaagaattctccgagaaataaaaagttaaagtctctgtaatggttgtaaccttcattatactccttttaaaatttgatctgtcaagtgtacaaaatgtaagcaaagatataaaagataggaatgcaataagcaagtcagctgaagatttattatttcaatacaaataaagaacagtatatttacactaatggtattatatataatagtatatagtatatactctgaggcaagggaataattcagttaactgacaagttccatgaccttgtaagcttacattcaagttgaagaaacagaaaataaattttaaaatattttcaaaaatttaaagtttttagtaagacctacaaataaacaggtgataaaattgtatcacctgttaaaggtgataaatagagtaacaaggccccttaggtacaaattagaatggaatgcacggtgtgtggagaaagcaaggagtcagggtgaagatcacctttagttctcagcccctttagttctcagcaccttcaggggtctccttgagctgcagagctgttttcccccaatgcacacccttctcaaggtagcccacttcctatgacagatcaaggtagggttatgaaggcccagacattttggctaggtgctagacaactctgataggtgatgtactttccagagcaccccataagattagctgagctgtcaggcctggataagacttgcatttctccttctgctcaattctgagtttttctgctcctttctacaggtaataataacaagggcattccttaataaacatactgcagactacactttgcctcagcacccaacctgtaaaatacacaggagataatatatgtatataggcctcattaagctatggtagcaacttagagttttttcaaactgcagtggaattaaaagaaaaattttcagcatacttttcacatgtccacgaaatacttaccaatattgagcatatacatggccataaaaatgtaccttaataagttccaaaaattagatatcacacaggtcacatgctcttgatttaattatatgatctatgggtgcctgagtgtatcgtgaactgccagtagaatacaactgaggacctcatggtgttcaattatcttcactgcctctaccatatttaaaaatttttataatgtttcacattcataaaattattcttgacctacaaatgttcttttcttgggattaatgaatgctcatttcatggaatttcttgattcttatttaggtatttgctatggtttgaatgtcccctctaaaactcatgttgaaatttaattgccattgtgataatattgagaggtggagcctttaagaggtgattagctcatgatggatggattaatgccattataacagaagtgggttagttcttgcaggaatccaggctctgtgtcttgtgttcttacttgcccttccgtcttccaccatccactgagggataatgtggcaagaagatccataccagatgcaacccctcagtcttgaaacttcccaggcttcagaaccataagccaaataaacctcttttcttcataaactgcacagtctgttgtagttattctgttatagtagcagaaaacagactaagaccacatttattcaagaagagttaggttgtaccttttcatgttttagacaatatcctagggactgcggattgagtgataaaaataacagccttgcactgactgtctaggggaagtaaatgaaatttcaaaaaacacattcttatctagaatttttctatgttctcacctccctccctccctccctctctttatctcttgctacaaatctgtatcaataatcccattcaatttgacaaatatttattgactgcttcttaagtactaggaggcaatgacccgtatattgtgaatacaacactggtcttgtgcctttagacagagatatttactctaaaaatttcataaggtttcccctatctaaccagtagaatctttccataggtctagtgaattttctcttttctgttttaagtaaaagctcagctgtgttgatttagctcttgctacagctgcttctctgggagaaaattcttctgtcccttgtttgttgaggctacctgctcccagaggatcacccaaaacagacattcctttatgcttgcttgctgagaagtgtgtgagtgtgtgtgtgtgtaattccatttttcttctaatgagcttttagctttctgaaaatgagatactactgcgtttctgttagagtctcctcctctatttctcgggatacagaattagaaataaagtataagcataaatactaggatataattaaaagacaaataaaactttatacataacacctgggtgaatcaaaatggacattctagccatgttcaaatatctactcaattgttaccttcttcatgaaatgttttgtgatccataaataggttagaatgtctttcttcttggaatgtttatagttctttaagattttaataagatattctcataaaacttgaaactttcatgttgttgatagttgaaattaagtgccatccttcacatgacatatagattgataaagacagacattttagcctaaatgatataagtaaagatgatcaatattgcacccacacatttacataggcatagattgtgcagtggttcttgcctgtaatcccagcaatttgggaggctgaggcaggaggatcacttgagcccaggagttccagaccagcctggacaaaatagcaagatgtaatctctacaaaaaagagttttaaagaattagccaggcatggtactgcatgcctgtagtcctagttactcagaaggctgaggtgggagaaccacttgagcccaggagttccaggtagcagtgagttataatcacaccactgcactccagcctaggtgacagaaggagaaattttttttttttaaggtaaggacaaagagaatggttcccaaatttttctatagaattatatcatctggatttctttaaaaatcttgatgcctggctcctacttcaaaaattctgatttactctatctgaggtgtgagctgggcacactcaactaaaaccactaaattagggtcgtagctcttcttccacaaatgagaggtaaagatatttaaatttgtcttataagttagggtaataccctttaaactccgattgtagaaaggaatagccgtcattcttaagaaaaatgtactccaagatttggggctgagtatctgagctatttttggtgtgaaggccaactgggaaaatcttgctgaatgcctttcctgaccagataccattttgcctcatgtcaactccagaaaaaaggcctgaagctgtgtaattcaaaataatttttaagactaaagaactgtatcaattggggctgggtgagttttgctgttgggccctactgattgtgcataactaagaatgttctattgtaacttgtcaaatcacttaagttatagaaaactagcaaagatatcctctagtaacaaatagtgcacatgagtggaataggggtatgtgtggtgtgggtggcttgttcaggacctcatctttctgttgtggccaggatttcaatggtatgatcagaaactataattgccaagacaggcatccatgcagctgcatggacaggtggaacctacgagttggaatcctcaaggagtcagttgatgcacagtctagcctcatacacaagtatgctttaggcaagtcaaaaaaggtgcctgaaagctgtgggtgattgcccactgggtactggtactcaaacttggggactctttgaaatatgtgaaaagaggcaccacatgtgaaagttgatcataagaattgggtcattcttgtcacaaccaactaaaacagagttgaagcgaaaaggcattcagggtacaaaacattgctccaagtaactctttgcaagcctaactggtaaaactgcttgttgtgagctaaaaccagtttttttctatagcttctgagataacttgctgaaactctgggactaatttcgcctaccactgtaactcaccaattggagcttaccaactccccaaacccttactagtgtcaaagaactttctcaaagagcaatacgtaacatttctccttttaataaaacctttaaccttctctttgttattgagacataccaaagaccacctggtctgcatgtatgccctaccatgcaattctttcttcccaagtaaaacattaagtttagagattagtctcttcatttttattttgactctgacccttactacaggctagatttgctgctaaacaggcctgtcagcacttgtccaatgtattttggatatttgatgatgtgaccttatttggaagtcggatttgttgagaaatctacctgtattttgtacttggcatctgtgctttggggctttgtcttattcctctaccggcctcactagttattaatatcaaccaaaatttaagagaatttaagagggctgactgtgaccttgaaagcttagattctaatcttggctcagtcttttcacaaaggtgtgattttagatttcttaacctgagtatgaaataagaagcataatatacctgacaaatagttctcttcttacattaattgaaatattatagataatgcatttggtatttctcctgatatatagtaaatgatcagttattagtaatcattgattgtattttatattgcctgaaatcgacagtacaatgttttgtatatgatagctatttaataagtatttctttttgataagaactgtattctgatgacatcaacctgaaagagatgtatgtttgactgactggattgaggaaaagggtgtattttagaaagacaatctttttaaacccaaactgtttttattctaagcagcaaaatgtttccagaaatatttgagacagtacgaaagaagattgtatatttgatggaaaatgatgagatttgtagctaaaaaacatggagcaccttcaaagtgttcagaaaatttattgccctatacatttggaactaagctgatcagcaagcttaaacagtatatttatatgtacttccaatgtaagcatactgatatctcttgcaccttgagtagattttcttcctcttagtcttttgatagttaggagggaaaagaaaataacttcaagtgccattttatagttttattgcttaggtatttcattcgacttcttcaggctcagcttccaaagattcattcatctaaatcagccttaggcttcacttatctctaatccccccaaaatcatgttcagactgatgccataaagcagagatctcactttaaatttatttaaccttccatttcagaagttacaatgtgattttttttattctgctcaagcaatcacaaattttaagtttctttgagtttgttctttagtggaagcctttaggatgcacttagaaaaccccattacaagtaagagtggcaagcaaataggacacatttcctcagcattcatgtgttgctatcctagggcttacccaccttgctaaagtgttcatgacatactatttttttaaaaattgctcctgccttgaaatgtagtgctcattcttatttagcttatattttctcttttaaatgtgcctatacataactctcatgaattcttatcaactaacttgcacatcagttctgatcttcctgtttcttagatatctctcaatcagaatttatctgattaataagtgagttgaagaaattgcttttgataattttattattgaatgcttatttttatgaaaaatgtttgctcagtataaagcactgcaacacatagagtaaaaatttccttctttacagtaaaatatggacttctgtttttctttgtgtttaatagaaaaaaatactagctattcaagtgccaaaaatggtcaatgtgactcagagtttcctaatctaactgtaaattctccaacacaaggaaactaacatttgccctcccaaacactatgtacaaacaaagtatgtctttgtgaaataaattatattagtacagataggatgtaagcttggtccataatgaaaatatagatttttgagctgtttttgtcatctctcctatttaaaaaaaacttttgagaggaagcatttgaaatgtggtgttctgcctttgtcaacactgtattacaatgttctcctgtcctacatttattcagatttattagctagaaatttgaatatgttcacctgtatatccttgttattaacaattattagaataattgttcttctaattaacaattagaagaatgttttcaatatatattgaaatctttctattgaaacaattttaaaaaggtgatttgcagccaaaatggaaagctatttaattgcacaaattggtagacaggaatcaaaaaattatgataacttcaagaaatagaacagaaattctaggactctaccaatcattatgaataaacctaccaagaaaaggcagcttcaagttcaactgtccatgatgatacagactaaagaagaagcatgcctgcttttccatggcaactttcccatatgttctcattatttttgttttcttaggacatttctcttctggaagtggctatggaaaaagcgacatgctatggtagacatgcagggtctcagaatacttgagtcttggctttgccacatttaggtcatgtcatgcctgttacctatttgtaaaattatacctgtcccatctaccttaataaattgttataaggatcaaatgacatgtactttatgcaaattccttgaacattataaattgctataaaaatatgaggaattattattctgcacgaagcttttcccaatattgaatcttagtaattttcaacttgttaagtcaaataattaggtatcgattaaatatactcgaggcattattactttttgctaaatgcttctatcatgatccctaccttttgattagcttctctcaaaccccttctgggcttggatatgtgacttgctttggcatatctgatatgagtaggcatgacgaaagcagaggattgaaatgttcttttgcattagtcttgccctcttgatgttctgccatcaccatgataaaagctggtccagctagcccagatagcctgcgggtctcagaagaattaggggcatgtgaagcagacctcaaccaatctgagccctggagataaagcccagattaaaccagcctaaatcatctgaatgccaaacaattcacagatgtgagaatgtaaaattaatgtttcttactataagccacagagtggaatgacttgttaggcaaaattatggtgagtatatattactcatacagaaatgcatactagaggcaggagagtgccatcacagaaacttaattattgtgtttgtttgtttgtttgtttgtttgttttggaaccaggtagcaggcaataaggaagctcacttagaagactgggataaaggcaatttgtattatttagaggcaatgcgttttggtaaaagagttgcttgacataatgtgtaagatatgaaatgaacagaatgaccatttacactgggtgagggaattttctaggcagatggctaaaagcataaactgattgctgccagttacgtataataaggcactaaaagagaaagatgagaaagtggaaaactgggtgatatacaaacaaaaaatgatgttatgacacagcttcaggttaaaaatcaaacaaatttagactaatgcccataagacatagcgaacaaaataaaactttatgggtccaaggtatgtataattaagtcttgagagagaggcatgtagatgtgtggctttagaacatggcaatcctgtgtttaaagccagtacatagaaaattcaaaaaatatacactcttacagattttaaaagattacagaaaatctaaatttcaactggcaagcattgaatacaaattataggaggccatggttttggactaaactcccacattaggcacctacagactagactaaaaatcaaaatggggtcacccatgcttaagttccatatccccaatcccaaagtaagttgttatctgacctttcaagaaatcagatgtttgcagatgacatcctatatagagaaaatcccactgtctcagcccaaaagcttcttaagctgataaacaacttcagcaaagtctcaggatacaaaatcaatgtgaaaaaatcgctagcattcctatacaccaacaacaggcaagctgagagcccaatcatgaacaaactcccatttacaattgccacaaaaagaataaaatacctgggaatacaactaacaagggaagtgaaagatctttacaaggagaactacaaaacactgctcaaataaatccgaggtgacaaaaacaaatgtaaaaacattccatgctcatggataggaagaatcaatatcattaaaatggccatactgcccaaagcaatttatagattcaatgctattcccactaaactacctttgacattcttcagagaactagaaaaaactattttaagattcatatggaaccaaaaaagagccaaaatagccaaggcaatcctaagcaaaaagaacaaagctgcaagcatcatccaaactgacttcaaactatacagcagggctatagtaaacaaaacagcatgatagtggtacaagaacacatagatcagtggaacagaacagagaacccagaaataagaccacacaactacaactatttgattgttgacaaacctgacaaaaacaagcaatggggaaagaattccctattcaataaatggtgctgggacaactggttagccatatgtagaaaattggaactagacccctaccttacactgtatacgaaaaatcaactcaagatggattaaagactaaaatataaaacccaaaactataaaaactctcgaagaaaacctaggcaatatcattcaggacataggcacgggcaaagatatcatgatgaagatgccaaaagcaattgcaacaaaagcaacaactgacaaatgggatctaattaaactaaagagcttctgaacagcaagggaacctatcaacattgtaaacaagcaacacacagaatgggaaaaaaattgtgcaaagtatgcatctgacaaaggtttaatgtccagcatctatatacaatttaaacaaatatacaagaaaaaaaccaaacactcccattaaaaaagtgggtaaagaacatgaacagacacttttcagaagaaggcatacgtgtggccaacaagcgtgtgaagaaagcttaacatcagtgatcattagagagatgcaaatcaaaaccacaatgaggtatcatctcataccagtcagaatgagataatagccaatttcccaaacagggcagtttaaatcttcaattgtcatgataataaaatttcctctactttaatccttacacaaaaaaggtagcctagtgtaacctgatgttacctaattttttgcgttgttatgtctccccttccctgccttacaagaaaagtagctttagtaggactaataacactatgtgttacttgtttctgctttcttcaacccttctctgtctataaagtcacttcttgtgctcaactcatcagaacacttattctgaaatgtatggaatgaagtgttgcctgattctagaattgctaaaaaagccaattaagatttttaaactaaatttgttgtaattttgtcttgtgacagaattgatgaccaatcaagggacttgataaagacttctgatagccctgagaccccttgaggaacacacataaaggcaccactaatcccctttgttgtgggtgatggtattttttcttcctcatggggcccagagagccccaaatgcctctcaggtgtgagctctgctgttttttgcgtttgaaccctctgatctttttgtaatcatctaacaggttcttcctgcccactgaacagacaaaaccaattcactgagacaatgctattgcagtaagaaaagaatttaattaacattatgccagccacatggcagatgaagttattacttaaatcagtctccccgaaggctcagaagttagggtttttgatgaataatttggtgagcagggggctaggaaatgggtgctgctgattggttggagatggaatcataggggtgtgggaaacagtcttcatgcgctaagtctgcctctgagttggggcgggggtcggggtcggggtgcacaggaccagttgagtcatgaatcacaagtctagttggggtcagtctgttgccagaattcaaaagtcttaaaaacatctccaaaagatcaatcttaggttctaaaatagtgatgttatctatgcaatagtgagggagttctcatgagatctgatggtttaaaagtggcagttttccctgcacactctctctctcttcttccaccaagtaagatgcaccttgcttccccttcaccttatgccatgattttaagtttcctgaggtgtccccaggcatgtggaactgtgagtcaattaaaacccctttctttataaattacccagtctcagtaattttatggcagtgtgagaatgaactaatacaacagtctattcactctctgtctgaattacattttttcccctgaaaagaaatgttaaacactctccttatgatagaaccacacaaaaattcaggaggtaatccccaagtgacttaccctccctagaaaaaaactgagttcaaagccatagttaaaaattttcttaaacttacagaaaaccttcaaaagttttctaaagaattgagggccttaattgtaacttttcaacctgaaatacctgacctctgctaaccatacaacatgttggtgagaactggggagttccaaaaaggataaaaaaggcagaatagtgttctcctgagaatagtattaaggacccaattgcaaatgattttttgaaagccattcccggccgggcacggtggctcatacctgtaatcccagcactttgtgaggccgaggcgggcggatcacaaggtcgggagttcgagaccagcctgaccaacatggcgaaaccccgtctctactgaaaatacaaaaaaaaaaaattagccaggcgtggtggtgggcgcctgtaattccagctactcaggaggctgaggcaggagaattgcttgaacccaggaagcagaagttgcagtgagccaagatcgtgccattgtactccaacctgtgcaataagagcaagactccatctcaaaaaaaaaaaaaaaaaaaaaaagaaagccattcccaaagtgtttcagctccatggcaattaacaactgagaatgacttttaggcctgccctaggccgcttgtccaataagcaacccataaaacaacagtttctaaagaatttttgccatttgtgcaaacaaccagtaaattggaaaagggactaccccaaagttttcaaagaaagcccctgaaaacaggctactaccctctgataatctccgtgataaacaccaggactgagtggcctccaagggaagctcctgcaagtttctattggttatgctttgccctgcttgttaaagggctcagccttgaagttggtaatttaatgtaaaaataagcaacattaaagtgaccactattaaactgaatggtctccaaaatacaactttctgacatttatctagctattttgaaactctttgtagaagatatttacacctataaaggcaatctccatttataagggcatttcactctctgcacctaaaacactagaaacttttacaatggaaaatacattggtttaaaatttatacaacaaaccttacctttctttaaggtacatttcctagtcggcttgtcttaattgggcctttatctacacctttcttttttctgcaactaatagtgtttagatctatgttctgtaaatttgactacatggtttcatccgggatgtttgtctaaaggagggaaactgtttgaaaaatgacaaagaatcttattggagctataagatgtgcatctgaaactgcctttgaaaaaattataactgaggaaattatgacagtgaaagagatcagacctaaccaactatatcttgcttctaacctttaagctttccttgttcattcctgggtgtaggcagaactaactttggaaaggaattcagttcatagtttgaaacaaaattgatgatagccctttcctgaaaagagctccttttgtcttggggactagtctgccttctcaggactaacaaattggctacgagattagaaattacagtttaggggtaatgcagcctctggctccaagagtcttgtaaaacctaagaacagtgcttgagctattttgcagaccctgcactggatggattatctgacaccacccaggtcagtaatctggctcaaccagttctgccatcctacccaagaacagaggacggcaagaaaaactcacttcaaccccctatgattccatctccaacctgaccaatcagcactccccacttcccaagcccctacctgccaaattatctttaaaaactctgttacctaaatgttcaaggagactgatatgaggaataataaaattcctgtctcctacacagctggctctgtgtgaattactctttctcccttgcaattcccctgttttaataaatcagctctgtctctgcagcgggcaaggtgattgtgttgggcggttacacttctgcctgagtgtctgtatgtctacatgtgttatgtatatgtgatacttttctgccaaaatgtgtgagagagctctaattaatttacttaaagaaaaaagtaagtgcttaaataacatgttttaccataaaaaaagaacctaactcaaatgctttggttcgtgtgacttgggtaaaattttggtaaataagactggaaaagagctgtgtcttctgatcagaaaacaacatatatttgactttaggaggtggtgactgcctaacttttacatgctgtagaaaatggctaagagggaaataggttaagatgatgtaaaccaaaaataaaattctaagattccccccaacctacagatagataccccctttagtccaagggcatttgaaagtaaaattgaaaatctagttcaggatctgacatgcctcattataccctcttctctttggaattcaggaacaactgaccagcattaacattaaaactgagatcttaagactgacaaaacagactttttatagcaataagacacccaattcaagcctgaatctagtatagcatcacataacagaaagcaagccctgaaagaagtattttacccctaaatatatttatttgacatattttgaaatggccctgcaaagctgtttcttgtgaagaaaacctacattctgtacagaatcccctttcctttccaggtctttcctctgatccaggagagaattaattaagactcaggcaactttttaggtctaattacagctctgaagactgctacctggaggtttcatttgcatgataaaaccttggtctccagaaacccttatcttaaccctttctactgattccagctctttagataatatctctttcaactaattgccaatcagaaaatctttgaatcttcctatgacctggaagcccccaactccctgtttctagttgttctgcctttccagaattctgggtgaaccaatgtacatcttacatgtattgaatgatgtcttatgtctccctaaaatgtataaaaccaatctgtagcctaatcaccttgggcacgtgttctcagaatctcctggggctgtgttttgggccatttctcactcatatttggctcaggataaatctcttcaaatattttacagagtttgagtcttttttaatcaacaataatggctagttttgtttcacgtctcataaaatttgccaaaagagttctaacataattgttaaaaatcagtatattaggtaagtatcaatggcataaacattcataaattcttcataatttaaaagcaatttttttttgataatgtaaactccaaatatctgagacaggtcccagtcaatttagaaagtttattttgccaaggttaaggatgcaatctcaggaggtcctgacagcatgcgcccaaggtcgtaggggcacagcttggttttatacatttagggagacatgagacatcaatatatgtaagaggaacattggttcagtctggaaaggtggaacaactggaagcaaaggcaaaggcgggacaacttgaagtggggagggtgcttccagatcacaggtagataagagaaaaagggttgcattcttttgaggttctaattagtctttccaaaggaggcagacaggtacgcatttatctcagtgagcagagggatgactttgaatagaatggaaggcaggtttgccctaagcagttcccagcttgacttctccctttagctcagtaattttgggtcccaagatttgtttttctttcacagtaccatgaaacgttaaagtgaaattgagtaataggtactcattaaatgtctgggtcattttctaaaaaagttaaaatacgaaaacattttgattaagcctaagtgtaaagtttatatactttggcattttgtttttatatggtatagagcagctaaatatttgagtctataagtaaagatttttttaaaaattgttctgtgaggaagtgcatgtttctaaatattgtaaaatatgcatttaaaaaatgttggtttgatagagttcaaaattgcttatttcctaggttgtcacaaaaaattaaagttactgagagttaagaattctaactatatgtgtaattaaaactactagaagtagggggaaaattctgtatgcaaagtatagaaggaaagtaagatgtgtttttgctgagaaaaattgtaaaaaatagaaggatatatttttgtttagaaagagcatttttttaattcagagattattacagattgttccaaaatacagaattgggaaggaaatagaaacaaggcaggaaggtactagttagtaggagagatgtgaaaagaagttataagtatgaggaggcattattggtaaagagggatgaaaagtgagagtaatatttacttttgtatgagagaaaactttgcatggttaaaatgatgaggaagaagggaaaataggtgtttgtcctaatatgccaggccaggtctccattagcaaccagagccgtcagcctttaccagcaccttagtgtcactctgatgaatgtataagttaaacattaaagaactggagaaactggtgccttagtacagaggctagaatgtaaaaacaagtccattaagatactgtctgggctttctcagaccttagaatttaattaaaataatggagacatacttgcacaccatgtaccaggacccactttagattaagtaatttttccaagtctctgaagtaattgtccagaccctggaccctagttaaagatgagatagagtgaaacactttggctttcggcttgtaggtgcactgaatgtatataagcactaggaaaaacttgtaactttgagttggtctggtgggttactccaacctcctccctgtaaccagctacagaaatgaactcccttctttcccagtctgtctgcatcttgttattgaaccgtgagagcaagcagccggaccttgttctgtccaggaacaaatctagcaagccagacaggagggagctgccctcagtggccagcctcttgcaacgagatggtcactgggaaactcccagcacctgccaggtacagtttgtcctgagcttacctgatgcaaagactgcccatccttctattgctgggtaagggcagaggttaggagcaaacatgcttgaaggatcattcaaactggattgtaagtggattgtaagccagaagactattatttcctctatttgggctcacgtagccatttgttttggtaccattgagaaagcaatatgacttgtttgtgtaactgctttgcatttgtttgaggattcatttgcatttgtttgtgaaaatttgttctgtttgtctgatatttgttaagtttagagtactcactatgggcaacactgcatctattcctacaaatagtcctctggggagaattttgtcagattggaagcactttggttatccacccatgactaaaaaaataatctattgtagcagagcttggtcaatgtatgttttggggtctgtgaaatggtggccagttttggatctctaaattttcataccctctatcaattagaattgttctgccagaggtcaggaaaatgaggcaaaatacattatgtccaggcatttatgttactgcttaataaggatggtaaagaaaatggaaataagctaatggtgcagtacactgctaaagtctgtcccgactcccaaggggagagagaaaaaacctctgaaatccaacagttaatgaacactctaaaccccatagtggctgccctcccatctcaggaaagagaaggaatgtcactgccagagtacagggaagtagcagagctactgtcttcttctcggactaaccaaggtactaattttggctggggagtcaccgagtccaaagcagggctattcccactacgataatacccagtaggagtcaatcagcaaggagttccagccagatgttattgggcctataataccactatatttgctacacaatgtcccacctaagatgtgcaggctctcctaaacattaaggtatctggttttaaataaagcaaaggaagaggcgcaacatcttcataatgaaaatccaaatgacactccagatcctgacagggcgattcaccacatggacccaaattgggatattgtagaggacgtacatcgcagtgtaactaacatgtatactaagttcccttattttcctggagatcataaagggtttatactattggatttaaaagatgctttcttttgcattctcatagacacagaaagtcaattgttgtttaactttgaatggacagatcttgaagccgcaatgcagtttcaatattgctggactgtactcccaccaggatttaaaaactctccgactacatttggaaaagccttcgtttgaaatttaaggagtttaagattgggaaatggaatactgttacaatatttggataatttactaatagctaccccatgtgaatgggaatatcacaataatactattaaaactttggaccatctagcaacctgtgggtataaggtttcaagtaaaaaggctcaaatatgccaacaaactgtgcaatacttaagttttttcttacagaagggaaccagagctctaacaatggaaaggtaaaatacaatcacttccattgcagcacccactaccagaaggttgctgagaggatttctagatgtggcagggttttgtctattggatatggattcctaaccatggactactggtaaagccactgtttgaactgtttaaaggagctaacaataacatctttgactgggagcaaaacaccagcatgcattcaaacaactgaaacataagttaacccccaccctagccctggggctcccaaatcctcataagccatttcaactgtgtatgcatgagagactgggtctagtgctcggggtccttatgcagaagttaggagaaataagacagctggtggcctacttttctaaacagctggacacagtggctacaggctggcccccctgtctgagagcacttgccaccaactgcctattattaaagcaggctgaaaagctaaccttgagaaagcctattacaatctacatgcctcatcaggtactagtgctactttagcaaaagagaggctattgactgacagctgatgggttaggcaaataccagggcagactcttagatgaccccactatgaaattacaaaccaccagagctctaaacccagctacattactacatcctaccaaggaatcagaggaccccatgcgtaattgtttggaaatcattatcaagtgttttccagctgccctgatttaaaggatacggacttgctgcatgcagactggatattgtttgtggatgggaacagcctggtagccaatgggaaaagaaatgctgcatatgccatggcaaccttttcagaggtaatagaagcaaagattgtaccaatgggaacctctgcacagaaggcagaactgattatccttgtgagagacttgcagttgtcccaagtatacaaggcacatggaataaattggagactacagtcagcatggagaccacaatcttctggacagactaaaagtataaatcaaacactaaaaacaattattgccaaactgcgccaggaaattcaaccaagataggctcaggtagttggcattgcactgctccaggtaaaagtgaccctcagaagtaggagtaagttaagtccctatgaaattatatattacgagaacctttgccgctaatctgtctctggttactagggtggtccttaatagaaagtcaactattaagcaggatgttgctcatttgggacaaattcttaacattttgcataagcttgcttccatctggagcattgtctggtgatcaagtactgctaaagaatggagggcccaactcaacaactacaggagaaatgggaaggaccctacaacgtgttgctgaccaccaattcggcactgaaactggtgggcatcaagccaccacatatgggtaaagaagtttctactagatgaaacatccatgacagaggacaccaaggcccccaaatgggagttggaacccatggaaggcctaaggtttctgttcaaaagatgataagctattcttttataatatttttcttcactgttcctcttgttgtttctgcttacacctctaaccttttcctataatgggcacaagaatatgcagatagcctacagcaagactcttgctggatctattacccctctctagtaccacaggactgctttggtgggtctccccccatacaaggaaaattgggttacttcctagaaaatcataaaaaatgggcagggtcgcaggtgagggggataactagaaaaaaagtatttctgaatggcctataaataaaactttaaataatccagggcacaggttccttcttgagctataggtaaaactgaatgttgtatgtatattcccaataactcagaaaacatttatttagctttaaagaatatgaaccaacagattgaagccctctatagctctgcactgtctctcaataaattaatagcatcttggttgggtgaaggaccttcttggtggcagaaaattctggttgtcctagccaccctcttgggcataggcataggcataacaccatgttgtggactatattgttgttgtacgctgttccaaaacattccctgagctcataaaatcatgtttcaacaggcactggctttgagtccccgaaaccaagaacactaccaatggcaagtagatatttaacactccaatgtctcttgacgatgaccctcttcagtaggaagtagccagagagaataagtcatccacctgcccttactgctattatattatagcttatactctgtactaacccataatagattaatgcttgaaactaacatgatggaaatcatgcacaaattgacagtgatgattgtggcaggccgggtctccatcagcaaccagagccgccagcctttactgacaccttactgtaactctgatgaatgtataagttaaacattaaagaaatggagaaactggtgcattagtacaaaggctaggatataaaaacaagcccgttaagaccccacctgggctttctcagacctttgagtttaattaaaataatggaggcattcttgcacactttgtaccaggacccactttaagtaatttttccaaatctctgaagtaattgtctaaacagaccccagactccagatgaagattacacagagtgaaacactttggctttcagcttgtaggtgcactgaatgtatataaaccataggaaaaacttgtaattttgagttggtatggtgagttactccaaccttctccctgtaactggttgcagaaatgaactcccttctttcccagtctgtctgcatctcgttattggacttcaagaataagcagtcagaccccattctgtctgggaacaataaggtagaatgccaagatgttttttataaaagaagtataagacaaaaccgaacgtttaagcaagttgtagaagatttgtggaagataaatgtcatgaaagaaattttatgtgtgatcaagatgggtaaaatgagaagggaattatttatgtttctttctagaaattgaatgttaatatcaaaatacactaatgcaaggataaagtttgagcccatgtgttggaacaacagaattttttcagagcattgaaacgctctttaagaggaaattttgagaggtctatttttactttttagataactggcctaggaggcagagattctattttttaagataatttattgtgctttgtggctttaaatattttagcagtttggtttgatttcctagtgacctatgatcctattttgatcaaatgttttaaatctttgatatttgacaaacttctcaaaaatcaatgttaaatcattttaatctccaagcaaagttgggacattccagtgatacctggaatttctccaaggatctgtaaaagagagatattaaacctgttgatttaatgtgatacgttaaattacatgggaagcattgacaaaataaaaaatgatgtttaagcttctacaagttatattaatataaatatgttattaatatgtgttctaaaactgtataaagttcctagaaatctaatataacttggtagagatgctattagtcataattttgctttagaaataacaaaatgtcttggcaattgtgttattattataatgaactctcatcaggtttttagccatgtccattgtaattcttgatgtctactgtgaattcctttattcttatgcttttctgaaagcttcttgcaagcaattataatcctgaagttttctgtctttaagcagcttcatggaaagaataaaaaaacctctgaaaagtacaagtttctaataagtttacttgaattttcaaaattctaatgaagaaactgatgggtttgttaaactgctaaacaagaacagagctagaattaattacatgagacaataaactgatgaccaaaaaatgggcttttaaggcttcatttcaaaccttgctggttctgttagtgttttcttttcaagatttaagaagctgtttcctttaatctctctatagcttacaaaaatttggaaaaacatacttttctaaacaaaaattgaaacattttcttttcctctctccttggtctcttcagaattcagaaagtatttgtgagtattcttatttttatggcaatatgattatttgtataagttcaatacaaaatatgtttttttataacaagatactcttgaaaacattgttatattgccaaggctttgactggaacgttatatttgaaaatttcccatttgagaatgcctggcttcaaaaatttctggccttagagtgagtgggcaaaagttttcacttcctggaaggctcagaaacatcaagacattagatacagaatgaaacattgaatgtctgccttggtttggcttattagcattgagagatttttaaaagttcaatctgaaattccttgtcaaaacttccagcatggcaaattttaaagggatgtatttaattattcttgccacataaatacataaataatcaggctaaatttgacactaaatttattttgcaaccactttcgtcttactatgatcatctttggtagaaatgggagtcactatagagataaaaattattttccaaaagaaaactcagtacacctgttattagattgcagtgctgttcattgttttttagtttttcctgtctacttataggtaactggattctaaattctaaattcttctacttttctctaatatatggctacaactttccaatgaagaatgaaaactgctcagttactgaagccctataagccaaaattggacaaattttatgtaaattacaaggaacaagtctcatgccagatctgtgggttccatagagttcaccagaatatcctatgccacaactggagacatttaaacttcaaaccaatacaagaagttgctgacttcatgctgtggacagcatttccaagaccatcagaacaagattttctgtcatgttgagactcttacccctcttaatatttccttatgcctgcctctttcacttggcaggaaaatgctgtagttaaaatttcacattcagtagatttagcaagtaacttgtacttcctgctttaatttaacccagtcatgggatgctagattacctattattttcatagagagaaatctatgcagatgatgacctttattgtcaacatggataaatacagtgggtattatagagtggactacttggttcaaatgtgtaagctccttgtctggttatttaattttagttggcttggttcacggggacggtggttaagaagcatactccaaactcttgttattatcttcctggtagtcataacagtagtcttcctggtgtgccgtatccacctaaaaagttttgaatgtttctatatagccatcggtcaaacatcaaatattctctctctggctataacaacaaaactcaaagaaatgcataataatgaggaggacactgtaacccataaatgacatgctaagacaacaaacacaaaattatggtaaccaggagtagcaatgatgtcctatggtgatgtctcacctaggtgagaacctggcagaaagaagggaattgtaaaataaaaattttaggagaccattattttggactaagcttctgcactaggccttaacagaccagactagaaatgaaagtagagccacccgtgctaaagttctatgttaacatacccaaactaagttcttatgtgaccttctgagaaatcaggaaaaaaagagataacagccaattttccaaacaggcaagtttaaatcttcactcagcataatggagttccctttgcttaatccttacacagaaaaggcacgtgttggtgatcagatgacccccagaaaaactgcagatgcgtaagtgagatataaatgattattcttacattccactgagttttgggttagtttgctttatagcaatattaagctgactgatagaagcatcattgctagactaaatttttataaatctggaggaatttaatggatttcaaattgttggcctgtaaaatgaatgaaaaatatgttcatagtggtagcacatcgtgtgctggtatgaaaggttacctaagttttgagtcaaaagagtagggttccagaaacagtatgtttttttatattgggcttttataagttctctcaactttttttttttttttttaccattttgatatgttagtctttctaataaaatgatttgccttttagtgacagtattgcatttttgataagataaagcacaataacctgaactatctgaagaaacaagcatcatagagccataattgctgtgttaaaagttttcctagaataaacacaaaaaataattgaaatacctatataataagtaatattaattacatagagttaatggactggaggaaaagaagcattatagttattaaacatgatatctcaaattgtttctggtagaaggtatccaagttactggcagtgaatctgtacgagtctacagcaacaattcttgcctcctcagaagaaagaatttgactgaggagcacaaggcagaaaaagagaccaaggcaaatttcagagcagtaatgaaagtttatttaaaaaggatttagaacaggaaagaaaaaaattatgctgggaagaaaaccaagtgggcaacttgaaggacaagcgcagtgctgaaccttgatcctaggactttatagggtggcccaactctggcattttgtgcctctttcccatgattctttccttaggctgggctgcctgcacgtgcagtgccctccttatcctttggaagtgagcacacacagtgtatttaggaagttgtgcacatgcccatcggagactttcttcccttttccaggggagtgccaccagaagatcatacgctaccattttctctctttttctttgtcttttctttctttctttctttctttctttctttctttctttctttctttctttctttctttctttctttctttctttcctttctttctttctttctttctttctttctttctttctttctttctttctttctttcttttcttttcttttcttttcttttctttctttctttttttttgagacagaatctcgctctgttgccaggctggagtgcaatggcgtgatcttagctcactgcaatctctgcctcctggtttcaagtgattctcctgcctcagcctctcaagtatctgggattacaagtgtgtgccatcacacccagctaatttttgtattttcagtggagacgggggggtctcaccatgttggccaggatggtctcgatctcctgacctcatgatctgcgcgcctcagcctcccaatgtgctgggattacaggcgccagccactgcgcctggcccattttgtctcttaatgcacatgcccaggaagttgtttctccctggagcctgcattcaattaacacttaagtgcaacaggtgtggaccatcaggaactggccttcccctggcaccagctgccaattatcattttcagagaggcaatgtgataattgtcgaaccatcacctgattttcctggtgggtgggggaagccttcctctgccctactcatgcctatctaactgtctgtaacattccccctgtcaagagcccaataccccacatctttggggtaaacttggtggtcagtgttctataactacctcccactgacaaagtggtggtgattctctgggtcttggcctcttgctagctgtgagggcaggagggtgactctgtgtgttggtgaaagcagtgtatagccaggtcaaagggagatgggcaggatttcacatccttcctgtcccactgatgggcagcctaggggtcccctgtagaagggtgcctcttgaaaatttagaggacagtatccctcactgagaatcttctggagcatgatggcctaaagcagaggagacaaattaggttattataattagaagaatgttaaaatgaaataaggtagtgaaaacagctccaaaaaatcctgaggcagtcaacactacatgctaaggtaactggtagctatagacatgcctgctaaaacttggatgcattgagctgctagccaattccaatgtgtgcccgtaattagaatattatctagatttttacattacccatcctgtttatttcttctgagctgcagcaagagatcactggttggttcacaggaataagcagggttgttctaaaatgcagacaaaaacttaaaaacaactgatgagactagaatctaatgataggtgtaccataacttttgaaacataatttctgtctctctagtcctcatttttgttaaaaacaaatcatgataggattgatttgtccaaaaaataaactttagtcttattatacttggcctcattattatcataaagtgcaacaagaatagttatttttcacataggcttttaacttggctttgatggaactttgttccatagaaggaatctcagataagacttttttaaaccccaggccggccatggatttgtaccatcaaatacctagtggggtaaatttctcttctcttgaggtcccaaaataactttgacctcctgatctgttagaaagtgacattctttacttaccacaggtcagcaactctgtacaggactgtgtagacaaggtatgaagccaggtttcccaaggggtttttattggctctataagtcaaatttgattccttaaaggaaagcatgccattccagtgaaagccttggtaagacaacccttttctccaattgtcctgttacaaaagaaaacattctcatgcacttatgcaaataaccatattgccgtaagttaagaatactcacacatagtttccaaattatagagaaatcaggtagagagaagcaaatatgcaacaaattttgttcacaggaatatcctgtactcaattgctacaatctgtcaattgctcaaaagaaaagtttccttgactctgaaaaacaaagcaaaggatcagcaacattttaaacaaaaagtcaaaaaagattacttcagtcttctgttaattcacttcattcagttaactgctattctgctttatattcatgaacattttagctctccatgagagtcatgaaggatttttcttttattctaatgtcacaatctccaaagttatcagaaatctgcatttaagaacacctgttaatgttgtatagctgattataaaaccaccatttaaagaggattaaaacaagacaacaattgtctatgaatgaccaagagtcttagggcagccacagttaaagaaacaattgacaaagaaatgtgttacctctgtggcacacaacagttttacataacaattttaattattaataacatatactaagttgtattagaattccatagttttggagcacataccaataacatatttatatgaatacagctcagagaaagaactcttagcaacttttggtgaaaaacctagttagtaagcaattttaattatgtgcttggtttggagcagataagaggtacagataagatctgactcttttgagaatagctaggggtgtggctaactccacatatccccaggtcttacctacctgtaaagcaggcaagttgtatagttaagattcatagtgaagcattgaggaggtctaataacaattaaattgtataacatttattgtataaattacctttcatgaatcctttcacggcttacactgaccatctttgacatgctcggacattctgatttgtcctaaatatccctctttttaaacaaccagtcattttactttaggacaataagattccttcttatataaaatctcttttctttataacctctctaccaaaaatacctctttgcctttataacctttgaattaggcaaaagtcattttccttctgttaaaaaattaaagtttgtactgcacattgctatgcaggccctgtgaagggagagtaaagacattatctacatactgtagaatttagctctcctcaagtgattacttggttagatttttgctagggctattagagaggaagatgaattggacaaatattaagtgaacacccatcttggagggtacatttttgcaccaaagaggtgaggggtagccagaccttacaaggcactgttgagagaatggtaattggtcccttaagtgatataaaggggtgtgaatctctttttgagggaggggatgctatttgcctcacccaacaggtttatccctgtcctccttattctgctctcggttataaaagactaaagaacctaatctgaagaccccctgcacaggagcactgtgttgcaaggctgacttttgtaatttcctaccagttcatttttaagccaaacagtttaaggttagggaaaattaaacttttcccatttttagggaatgcatccaaggggtgtgtcctgtggtatgaagacacagttactcatctgccatttgtgaagagggaacagaggggaaaaaaagaggaaaaagaaaaaagaaggcatctcccctttcttcctattatcccaaatggggtgtcccccatcatcctgggttctggacttaagcagtctttaccatgtaccattggtcccatcttgtcacaattacccacttgagaacagaggagatattggaatgaacagttggtccctgttcattcctggagtttcagaattaagtggtcctcactgtgtaccaccccccagcctttcatctctgttctcatggtaatctgttagcctgggaccacccttcatctctgttctatgggtctcttgcatctgtggccttgggccagcctccttgtctccataaccttagagtgaccctcactcagagcattttacgaataaaatgattatcccttttcttagaagaatgtttctccattaactgctgcaaggactggacttctttccctcctcccttagaatatgaccttgaagatcttgatacaggttgagaagggcatggaagtaattagagaaatggaggctgcaggaggaagtagaaggaagtgagagaaatattcatggaaaggcttcatatgctcttgaaaatagctgctcttggattccagagggtcatgtgtattcaccctctggacataaagcagtaacctccggaggacttggggcttggggtaagaatttctcctcttcccaaagtcgtgctggctaaaaaggcaagagggtggaatccttaaagggccagagtgaagccacatgcagccagacaagcttgttatgatagctatcagaaaacttagcccttgggcataacagcaatgaaaagcacctggtgagttctaagaagctggcagagctgaggttccagttagtgtcctggccatgtgccagcagggatgggaaggattgaaggtcatctgaactggcaaaaaacaaatataaacctccagaggtattcgcaagggagtccatgactttgctgctgcacaaacgcagagaaccatgggggcatcaataacagggagtgtgtatttaagaagtcacatggcatgcaaagtaaaagcaaagaagcaggcttgtccccaaggtggaaggtccagtggatgtccaaagccatttcagaacacacatacagagaaaacaggaaattgagcagttcaggtttttggaaaagagctgattttagatggaagaaataaaagcagaagcatccccagacattgcatagtttgtaagccttagcctcaccactctcaggaccctcctgtctaagagggccatttagtgcctctaatcttctcattgtgaaccctaaggtctttcctacccacaggagccacctataagggtgagctgagaaatttgctggggaaagcatcgtcacctaaggccaagaggaattgttctgggggttggttagtaagcaggagagagagagagagagagaggaaaaaccacacacggagttggatgcctccagccaaagaagacgaggcatagagatatcttaccactaaggaacatatctgagtcacgtggcaccaaatatgttagtggtggcaaatatcaatatctgagtcacttggcatcaaatatgttaccagtggaaggtatctgtgttaccagtggtgaatctgtataggtcagcagcaatctcaattcttccctcctcaggagaaagaatttgaggaacatattctccaaaagagaccaaagcaagtttcagagcaggagtgaaagtttattttaaaaggctttcaaacaggaaagaaaggaaagtatgcttggaagatacccaagcaggtgacttgaaggacaagtgcagtgttgaaccatgatcctaggactttataggctgacccatctctggtgttttgcacccctttcccatgattcttcacgtagggtgggctgtctgcatgctcagtgccctccttactgtttgaaagtcagcacgcactgtgtgtttaggaagttgtgtgcatggctatctgaggctttttcccttttctagtggagtgcccaacagaagacgattctctgccattttgcctcttaatgcacatgcccaggaagttacttattcctggagtctacattcaattaacactttagggcaacaggtgtggaccatcaggaaatggcctctccttggagccagatgccaattatcatttttagagaaccaatgtaataattgtcaaatcatcacctgatattcctggtaggtgggtggagccctctcctgtctaactacctgtaacaaaatgtatttgagtattgtcagcccaatcatgattttagaaatggagagattcttcaaaagacctaaaaatcaatgttaaaaaaacctattttcctgtaacctatgaaattagtataaaagaaatatttaaaaaattgtttactttcataaaatttagctattatatgtaatttatcttgacattaacactgtgactctgaagcaaaacaatgttagtggcagctgaagttttaacttaagcaaaatgtataggtttaattgattttttcaaaattttattaatagcaaagttgggaaatgtaaggtgggtaataaatagaatcttataattttttctgtgcaaatgaggatgttttaaatattatttgtcttcatcttttaaatgctagcataaaataaaaacaatgtactagacatgttctataaacttttgtaaacaaatttacatttgttaatatgaaataaatggtaacatgactaattttagaatctttataatgttgcaaattgtgtattgatatacacaattacaggcatgagccactgcacccagccttagttttttttaatcatcagtttaaaaatgatcagttttattacaaattagtaattttacaataatattaaggggtttaagaggctctatttcttttattcaattattgtctatttatttggatccaaacataattatcaccaaatatttcattttttccattgtttaaccccttaaagttctatctaaaatgaattacgtgattggacttaataaatttttgctgatgataattatctctctgtctgtactcctggagataaactccaggagtttactccacaggagtaatgttaatagatcccatctacatgtaagacctgtctagacatggagacgagtagggggtttgaaggcatcactttatgcgagagtaacaataagaggagccatccacgcactgtatcattgaaataaagtttaacaaaatcacaagatgttgtgggaagtcagggaccctgaacggagggactggctgaagccatggcagaagaacataaattgtgaagatttcatggacatttattagttccccaaattaatacttttataatttcttatgcctgtctttactgcagtctctgaacataaattgtgaagatttcatggacatttatcacttccccaatcaatactcttacaatttcctgtgcctgattactttaatctcttaatcccgtcatcttcataagctgcggatgtatgtcccctcaggaacctgtgatgattgcgttaactgcacaaattgttcataaagcatgtgtgtttgaacaatgtgaaatctgggcaccttgaaaaaagaacaggataacagcgatgttcagggaacaagggagataactattaggtctgactgcctgggagccggggcaggacagagtcatatttctcttattgctgaaaatgggtaagagaaatatcgctgaattctttccccagtaaggaatattaataattaacagccctgggaaaagaatgcattcccagggggtggcctctaaaatggccactctgggagtgtctgccttatgcagtggtagatagggatgaaacacgccctggtctcctgcagcacctccaggcttgctaggattaggaaattccagcctggcgaattctagtcagactggttctctgctcttgaaccctgtttcctgttaagatgtttatcaatgacagtgtgtgcacagtgggacatgaaacttcatcagtagttctagtttcgccctggccttgtgacctcgccctgcccatttgccttgtgatattttattgcctttgaagcatgtgatctctgtgacccacaccctatttgtacactccctcccctttgaaaatcgctaataaaaacttgctggttttggggctcagggggcatcacggaacctgccgacatgtgacgtctcccccggacacccagctttaaaatttctctcttttgtactctttccctttatttctcagaccagccaacacttagggaaaataggaaagaacctaccttgaaatattgggggctggttcccctgataacaaggaaaagttgaaagaaactgagtggagttttattctttttatcttttagttttttaaatttaaatgaaattgtatatatttaaaatgtacagtgtgatattttgatatacatatacatggtgaactcattactacagtacagttaatgtgaattaacattcgtggttgtattttttttcttgtgttgagaatacttgggacatgcaatcttagcaattttttttctaaagaagacatatatatatggccaataggtataagaaacagtgccaggcacagtggctcacacctacaattccagcactttgggagaccaaagtgagagaatcacttgagcccaggagttcaagaccagcctgggcaacatggtgagactctgtctctacaaaaattagaaaactagtcaggcatggtggcacatgcctatagtctcagatactcaggaagttacggcaagaggatcccttgagcccaggaattcaaggtggcagtgagctgttattgcaccactgcactccagcctgagtgacagcaagactcagtctcaaataaaaaggaaaaaagtgctcaacaccactttgcattaggaaaatgcaaatgaaaaccaccatgagatataatcataccccagttagaatggctagtatagaaagatgaaagataacaagcgttggtgaggatgagaagaaaaggaaaccctgtgcactattagtgttaatgtaaattagtacagtcattatgaaaaaatatgaagttttctcaaaaagctaaaaatggaactaccaagtagatattttcactttgaagtttatcagagaaaaatacaacattgatgaaactggaaataattaggttaagtgaaataagccaggcacagaaagataaacatcgcatgttctcacatatttgtgagatgtaaaaatcaaaacaactgaactcatgagcatagagagtagagggatggttaccagaggctgggaagggtaatgagggctgtgggagaaagtggggatggttaatgggtacaaaaaaaaattgaaagaatgaataagacctagtatttgatagtacaacagggtgactaaaattaataataacttaattgtacattttaaaataattcagagagtataattggattgtttgtaaatcgaaggataaatcctagagatggatactccattctccatgttttgcttatttcacattgcatttatgtacccacaagaattaaaaaatcaaaaattaaaaaattaaaaaagaaaaatacaatgtgtttattatatcttttaaaaaattggtgttttgtttttgtaaaagaaaatacagtaattatttggttgattgcttcataacatatgtaaactaacagccaactagcaagataacttgaaatattaattttttggcccatttttattcctgctcttccagatgtatgaacttctctcctacttagaaaaaataaattgcataaaaaattaagatttccataatttattagtttttactttccaaaatataccttgattagacacaacagtttcggaagccaaaattttctttttttatataggtttgtttagatcaaaggtatttgacaatcaaaagcctgtacatgaaaaattttgagtttattccatttcaaagaattggggaagagaatcaatagacacgtagactaggtaatctttaggaaagactggaggagagtacctgggctgaggaagacaggagtagttgatgcagcaagggtaagtaggactatagaaactgacaaggaaggaatcgcatctaatggaggaggagtgggataggagattcagtacaaagagactgttgaacactcttgcttagactattaagcactcttgtttatagcaccagaaagttggataaatgggagttggtgcctacagagtgctctggtctgaatgcgtcccctaacattcacagtgtcgaaacttaactaccaatgtgatagtattaagaaagtaaggccattaggatgtgattaagtcaggagtgaagagccctcatgaatgggattagtaaactcataaaagagactgaagggagtgacctagtccttttttgccctttttttcttctttgaccatatgaggatatagtgtccaccctcattggaggatacagcaacaagatgccaacttgaaagtagagagtgagcccttaacagacaccaaatcttctggcaccttgatcttgtaccagctttgaatatacttttaagtaattattgagaagtaaatttttattatttttgaattattttatctgtggtattttcttatagcagcagaaacagactaacacagagataatatgttatcacaggcctttgagtgaggcttgcctatgatgagtagctgctgtcattgtttttgtcactgttgagaggcaatcatgacagctctctgaatccccaaaagattttccagattaaatcagaactacctgtgattgacttgttcagtccactttatctgcttataatgacaaatctctttcagtaatatatggtcttgaggctcctaaaacagagggcaggatcttgaatatccagactacacatgttggtggtggttataactgtttagaagggaaaccacttctaaacttcttagtcccaatacttgtatgagtccaaagcagtggtcacaatttgctaccacaccaattccattagctgtttttgtgttatgttataaggtgaacaattcatattgtaaatgggaagtataatggtgagaatagactctcatctgtgacaaattgttttcaggtggagtcatgagtcttgaaagatgagtaaaaaaaattccaggcttgggccaggatattggtgtgagtgtatatatctagcaataaaaaattgttttaaacatgaaaatactgaacaatataagtcattatagatgaatttgaaggatcaatgatgagataaggctggagaattaggaaatttctatatcatcaaggaattcttttcacttgaaatctattagattttatcctctaggccaagggtccccagtccctgggctgcggaccagtagcagttcatggcctgttaggaactgggccatacaacaggaggtgagcagtaggtaagctagcattaccgcctacactctgcctcctgtcagatcagcagcggcattcgattttcaaaggagtgcgaaccttattgtgaactgcatttgtgagggatctagattctgtgccccttaagagaatgtaactaattcctgatgatctgaggtggaacagtttcatcctgaaacaatcccccacctcccgtcccacggaaaaagtgtcttccacgaaaccagttcctggttccaaaaagggtggggatgactgctctaggccaaagagatttttaaatctccattgaggaatttcaaagagatgaaggaaatgataagatttgcattttagaaagattactctgtgccgtgatcaaggatgttcagactgaaaagagacctttgaaatgctatagaccttgagtcttgcttgaagtgtaattagaactaagatacatggttcttttgaatatagttgtaagtaattattaagaaacttctgctattgctatttttattttatttatgctttgtgtgtgtgtgtgtgtgtgtgtgtgtgtgtgtgtgtgtgtgtgtgtgtggcagggtctcgccctgtcacccaagtgggagtgcagtggcatgatcatggctcactgcagcctccacttcctgggctcaagtgatcctcccacctcattttttgatttttttttgtagagacgaagtctcaatatgttgcccaagctggttttgaactcttaggctcaagcaatcctcctgcctctgcctcccaaagtactgggattataggcttgagccactgcacccagctgttgctatttttaatatttcataataatttatcttctacattttgtttttatgagcatgtattttttattacaggtctgttgtcctttatttcatgtggactataaagccctattttatatctagtatactgagtcacggtggtggcaggcagaaggagagaaagacaatatttattgaccattttctgtttaatatgtactctgctaggttcttttaatttatagctacctaaatgatattcagtgagaagtagttaaacagaaataaaagtttagctgctatatctagggatagagttactgcttttttagcaaatatgtgatggtgtttgtttttcagcctgaagggactatatgtttgattttcaaccacaataaagaaatagcctttcttattaaataattgttaaagttatttcagatggcacaacatgtgaagaatgtgttttgttgtagtgagtaagtaaatataacacacgtacataagccaccaagttattaaaatagaaaagcatttatagaggcacacaaaacgaaaagtcacatcaagaataatcccttgttaacaaagggcagaatagaccagaacaagaatattcttgaagtagattcatcaacagaagaaaaaggaataaagactatcataaaagaatcgctacttgtagtaatattaggtcaaggattttccattgctctttagtgaggggtaatggcaaagttagataaaaccttcactgtaaggtgttcactcttgccatttgtaaggctagattatgctattaatctttgatgaaggttctgctagtcccaacaaatacctttttttctttataaatctcctacttaagcatgccatccaaatattgtttgaaatagataactggattggatgatcctttattaacttttaatcaagattttgattcccagaatgaagcatggtgaaccatatccctcacagacttttgtttttacttaataaagctaattattacatattctacttgattcacataaccagtctataagattttattcacattttacagaaaaattgaagttcagaaggaattatgcatcttaatcaagaccacatatccagtaagaagtagatacaagaaacaaacataaaattgggtaattttgttttattttcagttgccatgcctttttaatattttttaaactggaacagtttctggatcctttattgtatttcttgacattgatgtttttgaattgcacagaccaattgttttgtagactgtcttagtccacttgagcttctgtaagaaactgccatagactgggtggtttatgaaaaacagaaatttatttctcacagtcctggatgctggaaagttccataatctaggcaccgacagatttggtgtctggtgaaagctagctttctggttcataaagggctgttttctcactgtgtccttacttggtggaaagggaaagagagtcttttgggatctcttttgtaagtacactaccctcatgatctagttaatgacttatcaaaggccccacctccaaatatcatcacatttgggatcaggacatacatttagcctatagcatagactatccaacttgagttttttttaaatatttttttcaaattttttatttatgtttccataggatgagattcaggtcatacaattgtggcaggaataccacaggagttatgctaagttattgtatccagaggtacatgcattactgataatcttatctttgatcatcttggtaaaatgttgtcttccaggttactccactataaagttactatttttcccccttagtaattaaaaagtatttgtaaggtgataatttgagaccatgtaaatacattgttatttcttaagtttttacctaagagatttagaatccattgatgattcctgcctgaattatttattaccatgatgattgctgtcatagcccattgtatgcagctatgccagaataccacagactgggtaatttacaacaagcagaaatctatttggctcatgtgttctagaggctggaagtccaaggttgaggggccacttttttcctgtgttatcccatggtgaaaggtatcaagtgggtgagggagagggaaggggaccaagcccatttttttgtaagcaacctacttcccggtaaatggtaataatccattcacaagagcagagccctcatgacctaattctcttaaaggttcaatctggcaacactgttgcacaggggattaagtttccaacatatgaaatttagagatgcattcaaactttggcagttgctaaggggtactttttaattctatcatttcttcttatcagttggctttctactatgtgtaaggatattccaacttgttgtttgtttctgtgtagactgatggattatttaataggttataatgttttaatattgttagttcatattattatttattttgatgttcttattgtcccagatttggacaaaatatgctgtttttaatatgttctttgttattttaacatgtcagtatcattagttgagtacttttttactttttggcaaaaagatattttagattcttgtaattgtccctcctccagccttggtatcagctaccctttttaaatacccccagttccttttagtagaaaatgcctttacaaactaagatttgaggagtaggtatgctgattgttattggggagatgttgcttctagtctttcagcagaaacatctagggaaaaagtatatgtgtatacatacatatataaacatatacatacataaaaatacccacacatatctgtatttttgtgtatgtttaggtgtatgtagatatgaagcctatgattataattagaatcaaaatcatcattgtgaaattaaatttaggtctgaactttcttgaagaaataacagataaagaaacctgagaatatttatgttttcaggatagaaattttttcctgtaattaattctaagacttcttattatgatctttgtacaaagcaaaccgctaatgtttttaacagtagttttatgtgagttgcataaatgtacataattaatcatagataccttcaaatgttcttatatttactcttgatacaaatcaaactattaaaccattattccatttaagtattattatagaaatttaaatcattacaggtcttgtgacttgatattgaaaaagagcttagtacacatagttcaatgactttttagtcttgctatttgattatctttctcatatattacttgtctcaatttaacttggcagaagcttgattacagaaatgaaatggtggtcaattcaatatttggttcttttaaaaacctgggaattgacaatttataattgtatacattttgggggcacaaaatgatgttaaaatttatgaacacagtatggaataatgaaatcatgctagctaacatactcgttacctcaaatacttaaattttattgttgtaagaacatgtgaaatttactttctcagcaatgttgaaaattaactatattctccatactgtattattaactatattctccatactgtgcaataaatctcaaaaagaaccctatatccttcctgttctactaagattcaatgtcctttggatatcatcttcctattcccctcaaccccagcttctgtaaaccattcaattctctgcctctgtcagttttattgttttagattccatacatgcagtatttttttatttctgtgcctggcttatttcacttaacctattgttctccaattccttccatgctgttacaaatgacaattttgtttttaatgtttaaggctgaatggtattacattgtgtatttatactaaattttctttattcatctgctgatgaacaattaagttgattctataacatagctattgtgaataatgctgtaatgaacatggtagtgtagatgtctctttgacaaattgtttttaaatatttttgagtaattacccagaactggggctggtggattatatggtaattgtatttctaactttttaagaaactattatagttttccataatgactttactaaattacattcccaccaatggtgtacaagggttcccttttctgcatatcctcgccaacatttattatcattcatgttttttataatatacattctcacaggcatgagatgatatctgtattagtctgttttcatgctgctgataaagacacacctgagactgggcaatttacaaaagaaagaggtttaactggacttacagttccacatggctaaggaagactcacaatcatggaggaagaaaaggaagagcaagtcagcagcttacatgtatggcagcaggcaaagagagagagggagcttaatgcaggggagttccatttttaaaaaacatcagatcttgtgagacatattcactatcatgagaacagaacaggaaagacctgtccccataatttaatcatcttccaccaggtctctcccaccacacatgggaattatgggagctacaagatgagatttggatggggacgcagagtcaaaccatattattccacccctggcacctcccaaatctcatatcttcacatttcaaaaccactcatgccttcccaacagtcccccaaagtctcagcttatatcagcattaactaaaaagtccaaagtctcatctgagacaaggcaagtcccttccacctatgagcctgtaaaatcaaaaggaagttagttaattcctagattcaatggaggtacaggcattgagtaaatacagccattccaaatgggataaattggccaaaacaaaggggctacaagcctaagcaagttcaaaatccagtggggcagtcaaatcttaaagctcaaaagtaatctggtttgactcgctgcctcacatccacgtcacactgttgcaagaggtaggttcctatagtctttggaagctccgcatttgtgactttgcaggatacagcctccctcctggctgccttcatgggctggcattcagtgtctatggctttttcaggagcacaatgcaagctgtcggtggatctacaattctgggatctggaggatggtggccctcttctcacagctccactaggtggtgccccagtagggactctgtgtgggggctccaaccccacaattcccttcgccattgccctagcagaggttcttcatgagggcctacccctgcagcaagcttctgcctggacatccaggcatttggatacttcttctcaaatctagatggagcttcccaagcctcagttcttgacttctgttcacttgtaggctcaacaccatggggaagctgccaaggcttgggacttgaaccctctgaagccatggccagagctctatgttggcccctttcagccacaggtggagtggctggggcacagggcaccaagtccctaggctgcacacaaaagggggaccctgggccaggcccatgaaaccactttttttcctaggccttcaggcctgtgatgggaggagctgctctgaagacctctgacataccctggagacattttgcctattgttttggggtttaacattcagctcctggttacttatgcaaatttctgcagccagcttgaattactcctcagaaaatgggtttttcttttctatcaaattgtcaggctgcatattttccaaacttttatgctctgtttcccttataaaactgaatgcctttgacagcaaccaagtcacctcttgaatgctttgctgcttagaactgtcttctgctagataccctaaatcacctctcttaagttcaaagttccacaaatctctagggcagggataaaatgccaccagtctctttgctaaaacataacaagagtcaactgtgttccagttcccaacaagttcctcatctctatctgagaccacttcaacctggatcttattgtccatattgctatcaagcttttggtcgaagccattcaacaagtctctagaaagttccaaactttcccacattttcctgccttcttctgagccctccaaactgttccaacgtctgtctgttacccagttccaaagtcgcttccacattttcaggtatcttttcagcaacaccccactctactaataccaatttactgtgttagtccattttcatgctgctgataaagacacacctgagacccggcaatttacaaaaaaaaaaaaaaaaaaaacagatttaattggatgtacagttccacatggctggggaaacctcacaatcatggtggaagacaaggaggagcaagtcacattttacatggatggcaacaggcaaagacagacaaagagcttatacaggggaactcctctttttaaagctatcagatctcgtgagacttattcaccatcacaagaacagcataggaaagacccaccactgtaattcaatcatctcccaccagttccttcccacagcacatcgaaattatgggagctacaagatgagatttggaaggggacacaaagccaaaccatatcaatatcccattgtgttttaaatttgcatttccttaatgattagtgatgctgatcatttttcatgtctgttggccatttgtatatcttcatttgagaaatgttgatatgtacctgtattagtctgttctcacactgctaaaaataaatacccaagactgggtaatttataaagaaaagtggtttaattaactcacagttctgcatggctagggacacctcagggctcttacaatcatggagaaaggcacctcttcacagggcagcaggagaaagattgattgccagcagggtaaatgccagatgcttataaaaccatcagatctcatgagaacttcctcactatcatgagaacaacgtggggaaccatgcccatggttcagttacttctacctggtcctgcccttgacacatggggattatggaactacaattcaagatgagatttgggtggggacacagccaagccatatcagtaccccttgcccacttttaagtgagtttcagttttcttgctattgagttgtttgagctccttatatattttttatattaccccattatcatatgtatggcttgcaaatattctctcccaattaatagattttcttggcatagtgttgattgtttcctctgctgtgcagagctttttagtattatgtaatcccagttgcctatgtttttgtggcctgtgcttttagagtcgaatcaaaacaaaaaaaattattgcccagatcaatgtagtatcattttactcctgtgttttttttaatacttttagagtttctggtcttttatttaagtctttaataaaactggctatttaaaatcacatatcttttttgccaaatgaattttatctgtatatgcatcatatctgtgaatgtcctattaaatttctcactgaattacaagtggtattggtgtgtcaatggaataactaaggataaaagaaaatgttattttatttacccattcaacaaatatgtatttaatggctattgtatgccaagttcagtctaagagattgttctggagataatggctgttgtattctgtgtaaggtagttggtatttgtcaagaagagtgttggagaacattaaatgtagagtcctttgtatgagaatgagatgtagtgcttgaagagatgtcagaatacactgggttcctagaaattacaatgaacagatcttgatggaataaccagatttaaccttttgcacattttcattaatggatacattctctttgagagaggttaatatagaggtgcttgaaagtaaggatttgaaatgtcaacattttccagttatctcttagtatacagtgatgtattcttaatctttctaaatgctttttttggaccaaatgaattaccaagtaaatcaagaaacaatctttcgatacctaacaaaactgacatcatgaaagaaactagatttttttcagctaatgaaatagcgtacataaaatttaccataatttttacattttttcaacatttaaaaataataaggcattctaggtttttaaaccatttacaacaaattttttttttcaatcacaaagaaaaatctaaaatattcttatagtaaatccactgatatagtttggatatttgtccccacccaaatctcatgttgaactataatccccaatgttggaggtggggcctggtaagaggagtttgggtcacaacggtggatccttcatggcttggtgttatcttcaccaaagtgagtgaattcttaggagatgtggttgtttaaaagtttgtggcatctcccaccacctcttgcttttgcttacactatgtgacatgcttgcttccactttgcctttcaccatgagtaaaaagctccttgaagctttccaagaagccaagcagataccggtgccatgcttgtacagctcacgaaactgtgagccaattaaacctctttttttaataaattacccagtctcagatattcctttatagcaatgcgggaagagcctaagatacctacataccttccatctagattctataattataattttttctacattctttaccatatatatatctatacttccatcaatttgtcagtttatcttatttttacattacagttccaaagaagttacatacatcagtaaatcttacacctaaactcttcaatatgcatattatttacttgacatccatatttatgttatttttcttacaatatgaatgaggtataatttatatgcaataaactacacacattcaagtcacacaattttacaagttttgacataagtatgtatacatgtaggaatccaacacttcaatcaacatacggaaaatttgtttcacccacaaaaaaatttctcagatctttttgaaatccctccctctctctaatccctacataaccactgatctgttttttcaacagcatgtattattgttcactttttaaaattttatatggatgaaataatacagtatctgactacttttgctcagcataatgcttttgagattcatccacattgttattttatcaacttatttttcctttttattgctgagtagtatttcattgtactcaaaaatgttgctgggaaaactggatatcattatgcagaagaatgaaactagacccctgtctctcaacatatacaaaaatcaaatcaaaattatttctctctatattcatactacagtttatttaccatgctcttgttgatgagcaaactggactgtttgaagtttggtcaataataaaactgaattttacattttaaaataacttaaagactttaattggattgtttgtaactgaaaggataaatgcttgaggggatagatacctcattttccatgatgtgcttatttcacattgcatgcctgtattaaaccatgtcatgtacctcatgttggaggctcaaatgaataaatctactgttcttgtattgccattcttgtactagacttttgtattcatgtttcatttccttggatgaatgaaattgggaaatagtgtgtaaaatataatagttaaaatacaatattgatcttataaaaacaaaaaaaaattatctatcatatgttaatagtgtttttttacaggaacctctgtcacaccctatgccttagggattattcaaatgttaaacaaatgtatcataaacaatagccttttaatttttcagtcactacaattctttggatgaagttacatgtgaacacaattgttttatcatgaattttacttagtatatattggtgtcagtatagttaacagacttattttctaatagtctagtgaccatcaagcttttaaaatttgaatctagacgagattgtcataattctgtaattttttccttcacattatggagtaacaaattgttaattgctttagtggtgagaactgaaaagcaatgaacaagtttaatggtacatttctcttttttgtccctcaaaatcaccaagtatgagatgattttcagaatgtctagattttggaattatcatcattgttgattatttggttttgccaatacatttattaaccttttcagaaaacaatgtcaatgtttttggtaaaacattggattgattataaagaccctcataaacacacatacacatacacatacatgcacacacacagacatgcacagaagcatccatgcacatacagagacagatagcattgtagttagctaagattaccgccttttatagcattgaggcagccacagatagcagaagtaaagtattacttttttgcaattgcccttggttcctaaaatctctaaagaaggcatttgattgtgtgacataatgcccaccgaggcttatgccctacttcactggagtagctattttttgttgtatcattcagaaatgaagaaaatagccatgatctgaaatattaagagactttcaggaactggaacgtttctgttctccagccaaacttagcatcagctaggctacattccctaggaagaaggaagacaacaaaatatccagatgcacagtgatattgtccaactaaatgtcaggtgatattgtccagaaatcctcaaataatatatctccataattccagtattcctgagaaccaagttatctccccaaatatttgataataaaataatttaatagcatgcttcctcattgaatcttagggtgacatcaaaatactaaaataacgttattttgtaagagcagaaatatcttgatttagatctcagaactaatatttgcactatgcactacactcagtgaagaaaggcactaaatcaaataacaaaaatcacattaagaaacttgagaattatttcatatataaaagcctcattcatagctcccacttcgaacaattaggtaagtgaaagtactaaggtttgaatattatctccctttccattgtatattgtggcagttttaaaaagcaaatccacagtgttgtcattcctctcctcaagagagggagcttaattcccctctttttgagggtggactcacttagtaactgttctaaattttagaagtgtttgcgtgtcacttctgaatttaacttattaaaaaaacacagcttgcatcttgggttcattctctctctctctccctctctctctctctcatcacttgccctggaaagcagactgccatttataatgagccctacggagaggccatgtggcaagaagctgaggctgccagagggaacctgaggcctgccagcaaccacatacatgagtttggaagttaattcttcagcttcctttgagtcttgaggtagctacagcctggccagaacttgactaaacttcataagggacactgagccagaaacacctaactaagcaaattctggttttatgaccttcagaaattgtgtgaaataataaatatttgttgttttcatta

SEQ ID NO: 4471 - DNA, 200117 bp, human
gctgtggagaatgggggtaagattcctaggtcactggaattgtgtacctaagatgattatggctacctctgctgagtcatgcaggttgtcagggaagtgggggaaagccagcagttacaggcctcagccagctcccacacaaaccgaagggcctgtctcacttctaacatgtccacggctccccaacagccctgagtatgtttacaggtggagggcgagaggggcttgaaacttgcctgaggctctccgcctcccagctgccaaagaaagggctttagttccctgccccccacccccgccccttccgccgcctgtgaagggacccaccgagctcccagggcctttctgctgcttcctctacccctgtattttgctcggctctgtaacttgactcagcttcaggtaaagtcagaaacttctgcaaacagaccttcaacttctcctgtaggggtatgtgttcgggagaggagggtctccctttcccacttttgtagctggggcactcacagtatttagggtgtttcccaggtcctgcagtagtccgcttccttcagagggtctgtgagtcctctcaggattgctgatttgttcttttagttgatctggcgctaaaattcacagtgcaagtctccagatgctgttctatctggagctgcaatgtagtcctgcctcccatccgccataatcccctccatctcctaattccttgacatgtgagaaacccttcaaatttatgcttctggaaaccctgagaatataaagatcatggcattattccaagaagagatgtcggtttatttaatgtactttattaagcaagatgcaagtcagatgttatgattttcagttacaagtttttcctatatctataatttgaagattatagtatactgaaagcattagctttgggctcaattataaatgtattatccaaagaacttgctgtattatccaaatttaaatataaaatagtctttcaataacgattgagttctaaaagtaaaaataaaaggaaagaaataattatactttagacaaaaaaccgtactcaatttaacacataccagacacacacacacacacacacacagacacacacacactccacacacacaattagcctggtgggctataagtagagtgaatgaaaaataagctacattgttttatttttattgtgttaatgcagtaatgaagttaaaataaatgcgatgtcttcttttgaaaggtatctgttcatgtaatttgccctctttttaatgaggttgtctttttcttgtgaatttgcttaagttccttatagattctggatattagacctttgtcagatgcataatttgcaaaagttttctcccattctgtaggttgtctgctcactctcttgatagtttcctttgctatgcagaagctcagtttaattagatcccatttgtcaatttgtggttttgttgcagttgcctttggtgtcttcttcatgaaatatttgcctatgcctatgtcctgaaagatattgcctaggttgtcttccaggcttctatagttttgggttttacatttaagtctttaatctatcttgagttaatttttgtatatggtgtaaaaaggggtccagtttcaatcttgtgtatatggctagccagtaccattaattgaaagggaatcctttccccattgcttgtttttgtcaggtttgtcggagatcgtatatgtgtaagtgtgtggccttatttctgagttctctatcctgttccattggtctatgtgtctgtttttgtattagtactatgctgttttggttactgtagccctacagtatagtttgcagtcaggtagcatgatgctcaacaccagtgatcattagagaaatgcaaatcaaaaccacaatgagatgccattgtacaccagtcagaatggctattattaaaaggtcaaaaaataacagattctggcaaggttgtggagaaaaaggaatgcttatacactgttggtgggagtgtaaattaatttaaccattgtggaagacagtgtagcagttcctcaaagacctaaaaatagatataccattcgatccagctatcccattatgggatatatatacctaaaagattacaaattattctattataaagacacatgtatgtatatgttcattgcagaattattcacaataacaaagacatgaaatcaacctaaatgcccatcaatgttagactagaaaaagaaaatgcggtacatgtacaacacggaataccatgcagctgtaaaaaagaatgagatactgtcctttgcagggacatggatgaagttggaggccattgtcctcaccaaactaacacagaaacaaaaaaaaacaaacattgcatgttctcacttataagtaggagctaaatgataagaacacatgggcacacaaagggcaacaacacactctggggcctttctcagggtggagggtgggaagagggagaggatcagggaaaacaactaatgggtactgggcttaataccagggtgatgaaataatctgtatgacaaactcccatgtcacaagtttaactatataacaaaccttcacatgtacccctgaacttaaaagttaaaaaaataataaaaaattaaaattaaaatgaatgggataatattgtaattcagaaaattgctactaatcaaaatgggaaatcaatgaatgattgatatgttttttcataaaggactaattataatactatgctttgggattttgcaagatactataatgaactcatagataccttcaagtgtttctgactatcacctaccataggaaatacattttatttgtacttacacatacaacacacaaacttacacacatatgtgaaaaatgaattaaagtctcctgaagcaatgatcacccttttctttgttgggcatgctagtatttcctcttctattatgtcttatcttattctatctcatttttataaatactgactatatactactaaattgattttatcatcaactaatgcgttataacacataatttgtaaaaacaacttatatacagtaatggttgctttctgcagaggagtagtagaaaaatttttattaacttcttcacacatcaaatattgagataaaaataagaaaacacctagttgattgatttttccaatgtgcaaatattcaggcagttatttatattatttatattgatatcatttatgcaacttgtaaatctgtgcttaactgttgttcaaatagcctcatggtaagggtcattcacattgtgctgcaaggaaattttgaaggactttattttcaaattgttatttggatatatgtgaatcaagatgtaataactatcttggctccagaagttctttaaatttttatccccatgtgaaaatgtgtatttatcgctctattagggacaattaatcagggaaatctcaaatattaattccaaacatgcaccatcagtgggctgaataactgtgcatatgaataatgtatatgtccttctgtgtatctatggttactgcaatttcctcttacgttgtaatttgtaaaagttatacaagaggagtttaaaaatagtagagtgtaaatgtgactggcgagaggagttggtaacaatagacaacaacccagaagaatattaactaatctacctcaataggacctactgtaccttacttgtgaatacctgaatccatccccagtaggtctaggtggatcaaagggaccatagagaacaaaaccaacaattgcaaaagatctcacataaacggactactaaaatcacttgtcttaaaccatgggtgttaaaaaaaatctatattttctgattcattaaaagcacattttagaccacatatgtaacctaaaccctattattttttagataacagcaaagagttaatatctctactttccagcatgtgaaattctgctgtaaagctttatggtattcttttcttaaacctttttcagtagaagataaaaaaactgccatttcaaagctgcaacaagtttttccagtcacaagaattgaagcctcattgttctattgttttgggaaataaaatgaacatttgaaaaaatcttttaatttcataaatgtgagatccacaccctcctcagaaatagggagatttcagatgctgtggtttttccaaggttgtataggcagggatcatgtttccttttgagaaatgattattggctctatatggatttaaagtttgctttatgtgaaatggtggttatactcatggcattcttttttttttttttttttttttttgagaaggaatcttgctccgtcgcccaggcgggatggagtgcagtggcgcgaacttggctcattgcaagctctgcctcccaggttcacgccattctcctgcctcagcctcctgagtagctgggactacaggtgcccgccaccacactggctaatttttttttttttttttgtatttttagtagagacagggtttcaccatgtcagcaggatggtcttgatcttctgacctcgtgatccgcccacctcggcctcccaaagtgctggcgtgattacaggtgtgagccactgcgcctggccactcatggcattctatgtagctttatctgatctatttatttggggaagacaaggagatgagaagggatttgattgcagttttggttactgtagccttgtagtatagtttgaattcaggtaatgtgatgcttccagctttgttctttatgcttaggattgccttggctattcaggctcttttttcggttgcatatgaaatttcaaatagtatttttaataatttggtgaagaatgtcattggtagttttataagaatagcattaaatctgtacattgctttgggtggtatggacattttaacaatattgattcttcctatctatgaccatgtaatgtttctccatttgtttgtgtcacttccgatttctttgagcagtgttttgtgattctctgtgtggagattttcacctccatgattagctgtatttctaggtattttattcttttgtggctattgtgaatgggattgcattcttgatttggctttcaggttgggtgttcttgatgtataggaatgctactgatttttgtacattgattttatatcatgaaaatttctaaagttgtttatcagatcaagcagcttgtgggcagagactatggtgttttctacatatagaatcatgtcatctacagagatattttgacttctcatcctcctatgtgaataccttttatttttttctcttgcctaattgctctggctaggacttccaagagagagggcatccttgtgagggatggcatctttgtcttctgctggttttcaaggggaatacttgcagcttttgaccattcaatgtgatattggctgtggatttttcatagattgatcttgttactttgaggtatgttccttcagtgcctagtttgttgaaggtttttaacatgaaaagatgttgaattttttcaaaagccttttctgtgtttattgagatgatcatacagggtttttgtttgtttgtttgctttttagttcactttatatggtttgtcacatttattgatttgcatatgctgaaccttcattgcatcccagggataaagcttacttgtacttcgtggattagctttttaatatgctgctggattcgctttgccagtattttgttgaggatttttgcatcgatgttcatcaaggatattggcctgaagtttctttctttgttgtgcctctgccaggttttggaatcaggatgatgctagcctcacagaaagatttggggaggactccctcttatttttcggaatagtgtcagtaggaatggtaccagctttaccttatacatctcgtagaatttgacgacaaatttttctggttctgggccttttctggttggtaggctttttatgactgattctttttaagaaatcatagttgatctgttctgggattcaatctcttcctggttcattcttgggagtttgcgtatttccagaggtttatcagtttcttctaggttttctagcttgtgtgcatagagatgtttgcagtagtctctaaggctttcttatatttctgttgggttggtgttaatgttcgctttgtcatttctgattttgtttatttggatcttctctctatttttctttattaggctagctaatggtctattttattagttctttcaagtaaccagctactgaattcatttatcttttatatggttttttactagttcagttctgattttggttatttcttgtcttatgctagccttgggattgttttgctcttgtttctgtagtttttctaattgtgcttttaaattgttgatttgagatctttctaagttttagatgtgggtgtttagtgctataaacttccctcttaacactgctttggctgtgtcccagagattctggtatgttgtatcttttttctcattagtttcaaataatttctggatttctgccttaatttaattatttatcgggaagtcataaatattgggagcaaattgtctaatttccatgtcattatatggttttgagtgattttcttagcattaatttctatttttattgcattgtggtctgagagcattgttggtatgattttggatttttcacatttgctgaggatcattttatgcctgattggttgattttagagtatatgtcatgtgcagataacaatgtatattctgtttttttataggtggagagttctgtacatgtctattaggtccatttgttcaagtgctgagttaaggcttcaaacatctttgctagttttctgtgtcagtgatctgtctaatattgtcagtggggtattaaaatctcccacttatattgtttggttatctaagcctcttcacagatctctaagaacttgctttatgaatctgtgttctcctatgttgggtgcctatatatttagtatagttatgttgtcatgttgaattcaaccctttaccattatgtagtacccttctttgtcttttttgatctttgttgatttaaagtctgtttttttgtgtgtgaaattagaatagcaacccctgcctttttatgtatttggtttgtttggtagatttttcttcatccccttactttgagactatgagtgtcattgcatgtgtgatggatctcttaacgacagcataccattggttttgcttctttattcaacttaccactctgtgtcttttaattggggcatttaacccatttacattcaaggttaatatggatatttgcaaatttgatcctgtcatgttgttaactggttacttgttattaacaaacagaattgtttgtttggctgctttatattatcactgatctatgtacttaagtgtgttttatggtggctgataatgatctttccatatttagcactccctatagttcttaactccagtcaccctagtctgctataacatgaggatgcatgtatcatgttgacatactgatttccttttctttggagagacagccagtagtgggattgctggatcatgcagtaattcttttttttttcttctagaaatctgtatactgttttccacagtagacatattcatttacattcccatcaacagtgcacaagagttcccttttgtactcatcatatccagcatcatttttttttcttcttttaaaacttgtttctcaggttcaagagtacatttgcaagtttgttaaataggtaattgcatgccacaggggtttggtttatagattattttgtctgtcaggtattaagcatagtaccagtggtagtttttttatcctgaccctctcccaccctccatcctcaagtaggccctggtgtctgttgttgccttttttgtgttcatatgtactcaatgtttgtttgtttatgatttaggatctcactgtcagccaggctggagtgcagtagagcaatcacagtttactgcagcctcgacttcttcaggctcaggtgatcctcccacctcagcctcctggatagctgggactacagatatgcataaccatgcctggctaatttttcagtatttttttttgcagagacagagttttgctatgttgcccagactggtctcatctcctgggctcaaccaatccaacttgcttagcctgatcctctccctccctcctcccaccctccaccctctgaaaggccccagagtatgttgttcccctctatgtgtccatgtgttctcatcagttaatttctatttataagtgagaagatgcagtatttggttttctgttcctgcattagtttgctgagagtaatggcctccagctccattcatgtccctgcaaagaacatcatctcattctatttttatggcttcacagaattccatcatgtatatgtaccacatttcctttatctagtctatcattgatggccatttgggttgatgccatgtctttgctattgtgaatagtgctgcaatgaacatgtgtgtatgtgtctttttaacagaaggatttatattcctttgggtatatacccagcaatgggaatgctgggtcaaatagtatttctgtgtttaggtctttgaggaatcaccacactgctttctacaatgactgacttaatttatactcctaccaacagtgtatatgcattcctttttctacacaacctcatcagcatctcttattttttgactatttaataatagccattctgactggggttaaatggtatctcattgtgattttggtttgcattttttttttagtgataagtgatgttgagcttttttcatgtttgttggctgcatgtatgtcttctttgataagtgtctttttacgtcatttgtccactttttattgcagttgttgttttgtaaatttgttccttataaatgttggatattagacctttgtcagatgcatagtttgcaaaaattttctcctattctgtggattgtttactttgttgatactttcttttgctgtgcagaagcttagtttagttttattccatttgtcaatttttacttttgttgcaattgcttttggcgtcttcatcatgaaatctttacctgtgcctatgtcctgaatggtattgcctagattgccttctaggatttttatagtgttgggttttacatttaagtatttaatccatcttgagttaaattttgtacgtggtataaggaaggggttcagtttcaatcttgtgcatatggctagcctgttatcccagcaccatgtattgaatagggaatcctttcctcattgcttgtttttgttaggtttgctgaagatcagatagttgaaggtgtgtggtcttatttctatgttctctattctgttccattggtcagtgtatcttttcttgtaacagtaccatgctattttggttactgcagacctgtagtattgtttgaagttgggtactgtgatgcctccagctttgttctttttgtgtaggattttttggctacatggactctgttttggttccatatgtattttagagtagtttttttctagttctgtgaagaaagtcacctgtagtttaatgagaacactattgaatctataaattcttttgggcagtatggccattttaacgatattgattctttccacttatgagcatggaattattttccatttgtttgtgtcatctctgatttctttgagtactagtttgtagttctccttgtagagatctttcacctccctagttatctgtattcctaggtattttattctttttgtggcaattgcgaatgagagtttgcttatggtttggctctccgcttgactgttgttggcatatagaagtgtgagtaatttttacacattgagtttgtatcctgagatttttctgaagttgtttatcagcttaagaagcttttgggctgagatgatggggtattctagatatagggtcatgtcatctgcaaacagggatagtttgatttattctcttcctatttggataccctttatttctttctcttgcctgattgccctggccaaaacttctaatactttattgaatagacatgatgagataggctatccttctcttgtgctgcttttcaaggggaatgcttccaggttttgcccattcattatgatgttggctatgggtttgtcatatatggctcttattatttggaagtatgttccttcaatacctagtatattgagcatttttaaaatgaaggaatgtttaattttatcaaacaccttttctacatttattgaaataatcatgtggtttttgtctttagttccatttatgtgatgaatcacatttattgatttgcgtatgttgaaccaaccttgcataccagggatgaagcctatttgatcatggcaaatacactttttgttgtgctgctggattcagtttaccatcattttattgaggatttttgctttgatgttcatgaaggatattgacctgaagtttttgttgttgttgttgcatctctgccaggttttggtatcataataatgctggcttcatagaatgatatagggaggagtccttcctcctcagtttttttttttttttttaatagtttcagtagaaatggtaccagttcttcttttacatctggtagaattcagctgtgaatccatctggtcctgggctttttttggttgataggctatttattgccgcttcaatttcagaactctttattggtctgtcagggattcagtttctttctggttcagccatgggagggtgtatgtgtctcagaattcatctatttctgctagattttctagtttaatatatcatattttcttcattattctcatgatgaacatttagggtgatttcatgtctttgctattgtgagtgctgctgcaatgaacaaaagcatgcatgtgtctttatggtagagttatttatatttctttggatatacccaataatgggatttctgggtcaaatggtaattctgtttttaaattctttgagaaatctccaaagagccttccacaggggcttaactaatttacattcccaccagcagtgtgcagacatttctttttttctgcaaccttcctagcatctggtattttttgactttttaataatagctattacgactggtgtgtgatagtatcggattttggttttaatttgcatttatttaatgattagtgatgttgaagcatttttttcatatgcttgttggccacgtttatgtcttcttttgagaagtgtctattcatgtctttgcccattttttaatggcagtgttttttgcttgttgatttgtttatgttccttagagattctggatattaaacctttgccagatgcatactttttaaatattttctcccattctgtaggttgcctgattactgtgttgatagatggttttgatgtgcagaaggtctttagtttaattaggtctaatttgttcctttttattctattgcagttgcttttggcatcatcatcatgaaatctttcccaaggcctatgtccagaatggcattttctaggttatcttctagggatttttatagttttaagttttacatgtaagtctttaatccatttttagttgatttttgtatatggcataagcaaagagtccggttaaaatcttctgcatataactaaccagttatcccagcaccatttattaaatagaaagtcctttctgtattgcttgtttttgtagattttgttgaagagcggcttcttgtgggtgtccagcattattttttggcactctattctcttccattggataggaagaatcagtatgttaaaatggccatattgcaaaaacctatttgcatattcaatgctatcagtctaccaataatattcttcacacaattagaaaaaatgactatattaaaataaatatggaacccaaaaagaggccaaatctccaaggcaaaaagagcaaaactgatatgcagaaaattgaaagtgaatccatttcttacactttatacaaaaactaactcaagctgaaaaaaaaacttaagtgcaaaacccaaaactataaaaaccctagaagaaaatctaggcattaccattcaggacataggcatgggcaaagatttcatgacaaaaacatcaaaagcaattacaacaaaagcaaaaattgacaaacagaatctaattaaactaaagagcttctgcacagtaaaagaaactgtcatcagagtgaacacagagccaacagaatgggagaaaatttttgcaacctatccatctgacaaatgtctaatatccagagcctacaaggaacttaaacaaatttgcaagaaaaaaaaaaaaaccctaaaaagtgagcaaagaacatgaacaggaacttatcaaaagaagacatttatgttgccaacaaacatatgatcattagagaaatgcaaattaaaaccacaatgagataccatctcatgccagtcagaatggcgattattaaaaagtcaagaaacaacagatattggtgaggctgcagagagataggaatgcttttacactgctattgggaatgtaaattagttcaaccattgtggaagacagtgtggtgattcctcaaagacctagaaccagaaattccatttgacccagcaattccattaaagggtatatacccaaaggaatataaataattctattataaagatacatgcacatgtatgttctttgcagcactgttcacaatagcaaagacatggaatcaacccaaatggccatcaatgacagactggataaagaaaatgtggtacaaatccaccatggaatactacacagccataaaaaggaatgagatcctgtcctttgcagggacatagatggagctggaagctattatccttagcaaactaacacaggagcagaaaaccaaacaccacatgttgtcgctcataagtgggagctgaacaatgagaacacatggacacaaggaggagaacaacacatgcgggcctgttggaggggtgtggcaggggaggaagagcatcaggaaaaatagctaatgtatgctgggcttaatacttaggtgatgggttgataggtgcagcagactaccatggcacaggtttatctatgtaacaagcctgcacatgtaccttggaacataaaataaagaataaatactcagaaaaaaattcaaagctgaaggtatcacattacctgacttcaaactataccacaagactacagtaaccaaaacatcatcgtgttgatattctttgtagtagccattttagcttgggtaagatgatacctgcatgtggttttgatattcatttcccttatgattagtgataatgagcatttttttttttgatacggagtctcgctctgttgcccaggctggagtgcagtggcacaatctcggctccctgcaacctctgcctcttgggttcaagcaattcttctgcctcagcctcctgagtagctgtggctacaggtgcacgccaccacacccagctaatttttgtatttttagtagagacagggtttcaccatattgaccaagctggttgtgtactcctgacctcgtgatccacccgcctcggcctcccaaagtgctgggattacaggcgtgagccaccgcgcccagccgagcatttttaaatatataattgttggccatctgtatgtcttctttgccaattgctttttcatgtcttctgcccactttttattttttttattattattttctgagatgaagtctcactctgtggcctaggctggagtgcagtggcatgatcttggctcactgcaacccctatctcctgggttcaagatattctcctgcctcagcctcccaagtacctgggattacaggtgcacaccaccatgttcagctaatttttttttcttttttttttttgtagagacagggtttcactatgttggccaggctgggcttgaactgctgacctcaggtgatccacctgccttggccacccaaagtgctgggattacaggtgtgagccaccactcccggccctgcgcaccctttaatggaatgattggtttatttatttgttgagttgtttgagttccttgtatattccagatattagtgtcttaatagtttgatgaatagtttgcaaatatttcttccattctgtcttaatagtttggatgaatagtttgcaaatattttcttccattctgtaggttgtttcttcactctctgcattgttttctttgctgtgctgaagtgttttactttagtataatactatttgtctattaaggtcttagccagcaaatctttgcctagaccaatgtcctgaagtattttatgtatgtttccttctggtaatttaatagttttggttcttaagtttaataatttatcttgagttgatttttgtttataatgtcagagagttccagtttcattcttctgcatatggatatctaattttcccagcatcatttattgaggagcgtattctttccccagtgggaaaggaaatctttggcacctttgtctaaaatcagctggctgtaagttggtggatttgtttctgggttctgtattcactttcattgttctatgtgtctatttttataccaataccgtgatgttttggttactataggcttgtaatctatttttacatcaggtagtgtgatgcctccagcttatgttctttttgctgaagattgctttgcctacacagacattttttttagtttcttatgaattttagggcttaaaaattgtttaaatgatgacatttttaataggaattgtattaaatctgtatgttgctttgggcagtataattattgtaatgaaattaatttttccgatctatgagcgagatgagtctttacatttatttttgtccttgtcaatttctttcatcagcatttttcagttttgcttttagagagctttctccttcttagttaaatttattcctaggtgttttattctgtgtgtcactattataaagggaactgtcatcttgatttcttttttggctatttattattacattatagaaacacttgtgatttttgtatgttgattttgtattctacaactctactgaatttgcttatcagctcagagatttttggtgcagtcttttgatttttccaaatatataagatcatgtcatctacaaagatgaacaatttgcattcctcatttacaatttgggtctcttttatttttcttgcttgtttgcactggatgggacctctactaccatgccaaataggagcagttaaagttggcatccttctgtagctccagttcttaaagaaaagactttcacatttttcctattcagtgtgttgttgactgtgtgtttgtcacatatggacaaatgaattgaagatataatccttttatgcttagtgtgttgagagtttttgtcaacaagggatattgaattttcccaaaggctttttctgtgtcgattgaaatgatcatatagtttttgtccttcattctcttgatattatgtattatgttccttgatgtgtagatgttaaaccatctttacatccctgatataaatactacttgatcatagtgtattatgtttttgaagtgctgtttaattcagtttgctagaattttgttgaggatttttgcatcggtgttcatcatggatattgccctgtagttttctactttgtgtgtgtccgtatctggttttagtatcggggtaatgctggcctcataaaatgagatagggagagtttctccctctttcattttttggaataattttaggaagattcatattaattttcatgcatttgatagaaatcagcagtggagccacccactcctgggctttttttttttttttttaatggaaggctttttattactgcttcaatctcattactaattgttggtctattaaggttttctatttcttccgtattcaattctgataggttgtatgtttttaggaatttatctgtttcctctgggttttccagtttgttaatatatagttgtccctaatagtctctggtaatcttttttgtggtattagtggtaaaatgtctcatttttcagttcagattttggttatttagatcttttcttgtctttgttagtctagttagtgatttattttctttattttttgaaaaattaactttccctttcattcattctttttttgtttttagtctctattttgtccagtcctgttctgatatttattatttcttttcttctcgtaaattgggatttggtttgttcttgcttttctagttcctggagatgtattattagattatttatttcaaatctttttactttctgatgtaggtttttattattataaactttgctctaagtactttttttcctgtaatccacaggttttagtatgttgtttttccattttcatttgtttcaagaactatttttatttttgtcttaattttttctttgacctattggtcattcaggagcatgctgtttaatttgtatgtatttgtatttaatttgtattgtatgtatttgtatgtaaattgtatacaaatttgtatgtaaattgtacacaaatttgtaattgtatttgtacacaaatttgtaattgtatacaatttgtacacaattgtatacaaattatacacaaatttgtaattgtatacaaatttgtatgtaaattgtatacaaatttgtaaaacattcctctgcttttttgtttctacttttatttcttcgttatctgagaaggtactgaattggaaacatttttgagtctttatttgtggcctaacatagagtttatcctggagaatgttgcatgggctgtagaagaaagtgtattctatagtcattgggtttaatgttctgtaagtgctttgtaggtccgtttggtctaaagcctagttcaaatctcatttttcttgttgattttctgtgtagattatctgtctcctgccaagattgtggtgttgaagtcccccacaattattgcattgaaatctatctctcgctaaagatgtaatatttgaattatgaatctgggtgccctattattgggtaatgtatcctgttgcaggattaatactttttgtgggtagatgctatgtatgtatatatagtattggggtatctgggatattttcatacaggcaatactgcataataatcacatcctagtaaaaggggcatccatcacttcaattatttatcccttctttctgttacaaacaatccaataatactcttttagttactttaaattgtacaataaatgattggcaactgtagttactctgttgtgcaatcaaatactagttcttattcattctgtcaaactatatttttttaatacatgaacaatctctacttccctctactcacattaccctgcccaaactcataaccatcattttacctgtatctccatgggttcaattgttttaattttaactcctataaatgagtgaaaacatgttttgtttgcctttttgagcctggcttatttcatgtaacataatgtcctccagttgcatacatgttgttgcaaatgacaggttctcaatcgttttttatggctgaatagtactccattgtgtatatgtacacatatgttctttattcattaatctgttgatggtctcaggttgctttcaaatcctgcctatagtgaatagtgctacaataactagtgctgcaataaatgtgggagtgcagatatgtctttatatactgatttcctttcttttgaatatatacctagcagtgggattgctggatcatatggtggttctgttttaagtttttgagaaacctccaaactggtccataatggttgtactaatttacattcttaccaacagagtacaagggttcccttttctccacatactcaccagcatttgttattgcctgtcttttggatataagccattttaactaaagtgagataatatcccattgtagttttgatttgcattatctgatgaccagtgatgttatcacctgttctgatacctgtttaccatctgaacgtcatgttttgaaaaatatctattcatatcttttgcccattttaaaatcacattattagatattttctatacaattgttcatgctccttgtatattctggttattaatctcttctcagatgaattgtttgcaaatattttctcccattctgtgcgttgtctcttcactttgttaattgcttcctttgctgtgcagaagccttttaagttgatgtgatcttatttatatatttttgctttggttgcctgtggtttttgggtattactcaatgaatctttccccagaccaatttcatggagactttatccaacattttctttagtagtttcataatttgaggccttagatttaagtttttaatcaatttttatttgatttttatatagagagaaagatagtgggctagttctgttcttctgcatatgggtatccagttttccaagtaccatttattgaagactgtcctttccccaatatatgtcttaccacctttgtcgaaaatgagttcactatgtatgtatgtttttatttatgggatctaaattttgttccattggtctatgtgtctgtttttgtggctgtaccatgctattttgtttactatgcctctatagtataatttaaatcaggtaatgtgatttttctagttttgttctttttttctctggatagctttggctattctgggtcttttgtggtttcatgtaagttttaaaattgtttctttggccaggcacggtggcttatgcctgtaatcccagcactttgggaggctgaggcgggcggatcacaaggtcaagagattgagaccatcctgaccaacatggtgaaaccccgtctctactaaaaatacaaatattagctgggcgtagtcgcacacctgtagtcccagatacttgggaggctgaggcaggagaatcacttgaacccaggaggcagaggttgcagtgagctgagatcgtgccactgcactccagcctgggcaacagagtgagcctccgtctcgccgtctcaaaaaaaaaaaaaaaatagattttttttttttctatttttgtgaagaacatcgctggtattttttttttctttctttctttggagatggaatctcactctgtcaccaggctggagtgcagtggcgcactcttggctcactgcaacctccatccctcaggtttaagcattctcctgcctcagcctcctgtgtagctggaattacaggcacctgccaccatacctggctaatttttgtatttttaatagagacggagttttgccacgttggccagactggtctcaaactcctgacctcaggtgatccacctgcctcagcctcccaaagtgctgagattacaggtgtgtggcaccacacccggtattttgatagggattgcattgaatctgtacattgctttgggtagtatgtacattttaacgatactgtattttctaatttgtgaaaatggaatatctttatatttctttgtgtcttctttgatttcttgaatcagtgttttatagttttcattatagaagtatttctttcctttcattaagtttattcctagatattttattttatttgtagctattgtaaatgggattactttttatttcttcttcagatcatttgctgttgtcatatagtactgtctttttaaaaaaatgtttttggcttaaagtctatttcttctgacataattatagctacttctgctcacatttggtttctatttgcatggaagatctttttccatccctttactttcggtctatatatgcctttacgtgtaaagtgtatttttttatgcgtactatgtagttggttgatgtttttgtgttttttaatacatttttggaactaatcaacaaggctatttgttttaagtagatactttaatccatttacagccaagtttattatgataggtgaagttttgttcctgtaacaatgttaattgttttctgattattttatctattttttgttcctttctttctctcttattgatattgttgtagtttggtggttttatgtactggtactgactgagtccttctcttccttatgtatgtttgatttactaatcagttttatattttcatgtgttctcattatagtaaatgtcttcctttcctttccatgtttaggactccctttagcatttcttgtaggtccaccctagtggtgatcaactccctcaacttttcttgtctgggaaagattttatttctctttcatttataaaggataattttgctggatttaatatccttggctaacaattgttttctttcagtgctttgaatatatcatctaattctttcttggctataaggtttctgctgagaaatctgctgttagtctgatgaggggtacatatataggtacagatgtctagatgccttactcttcatgtttttagaatattgtctttgtctttgacttcagtttgactgtaatgtgctatgcagaatacctttttgcgttgtatgtttgagaatctcagatgctcctgtatctggatttctaaatctctcactaaccttgggatgttttcatctgttattttgttaaacatttattttaactcttttgctctctctttgcctcataggccaccaataatttgtatatttgatcacttaatggtatcctttatgatatgaaggcttcgcttattttttttattattttacattaatttttatctaactggattatttcagaacatctctgtaagttataagattcttctgctttatttagtctattgttgaagctgtgtaatatagtttatttttcattcaatgaattcttcagttctagaatatctgtttggttctttttttttttttagaaagctacctctttggtaagctattcatatctccttcatatcctatattatttttatgattctttgtgttgtctctcagaattctcttgcatctcattgagcctatttagaatcaataattgaattattttccagaatttcataaatttctttttgattggtaaatgttactaaataataattgttttcctttggaagtgttattttatttgctttttcatgtttcatatattcttaggttgatgtctgtgcatctggtgtaacagtccctttttctaattttttatatttgcttttgtagggagaaacattctcctgaagatatatctattatgttggctgggtaaggcaatttggttttgattctgagtatatgtaatagcatgtattttctttatgatttcttcagctgtgaacagtatcagtggtatctgttatttccttggtggcttagagtacagttattcatggaggctgtggataagcttccctggggctgtgacaccaggtaagccagtctttgggccatttggggcccaaggtgccatacactggcaccattgctagcagatccaggtggatcagcctctaggtggcttacttggatgctgatactggcagtaatgacctaggtaggtgtgaagattctcaggcccctgtgcagctggcatgacatggaaaatggcagtggcagttgtggagtgatcctctgggtgccaaacagtgtgtgctcatgttagcagttgttgcagtgggttgggtggactactgcccagacctgcaggtagtacatgcaggtagctgccagttaaggtgttaatagctgggtaggtaagtcttatcttaggcccccagaggagtgtttcagtgtcaatggtggtaggctgggatgggcagtcctctggcccctggattctgtgccctgaccaagagtagggatgaagctgggtcagccaggcttgtcctcatgcccctcatcaggggtgtgtgcgggcaccagccatgataggcagggtcagggcaatgccactgatggaattctcatgtggggggcagcagtagccacatttctgccctgctgctgggcaaggcgatgctgccagaaggtagaaagcatgtgccgctcacagctcagccctggccctgctcatgccttacactttgctgcagtacattgcctgttttgtgcctcagccccaagtgcagtagcccacacctcaatcacacctcagcacttgttgtggtatcctatacttcacttcacacctcagccctgggagcaccagcccacacttctcttgtgcctcagccccagtgcctctgggctcctggatagcgtgcaatatgttggggatggggctctaaaatcgagcctttctgtacctgtttatgactcagggaatgcgtgggacccagcattagctctatctctggaacagtaccatcgcacgatcttctggcaactccctatgttagtttcagggcccacgagggtcgaggggctctcttagggttaggattgtaggcagccagaagagaatgtaggctactgatagtctctcacttcccctttccctgttttgaggagtctctcttcacttctagccagtcccaacagagtagactgcctcactacttcttccttccttgctttaggtatttcttgtcacctctctgttgaattctagagttctgtcttgaatgagctatgcaaaatgtgattatctgctcactatttcatttattcttagtggaggaggtgagtacaaaatgcctctagtcagctatcttgatgtactctctcagattagatattaaatgtcctctcgaaggtgataccaacagtggaaatttatcattagtacatttttccaaaaaacttaacatactttaacatcatgaagtatttattaaactgctgtatatacatggcacagtgctctgaaatgttttgccctggggattttgacactagagattattatttccacgtaaagatgacaagatttagcaaaaaagtaaagtgagttgaagattcccaattcagtggcaaagctgaaactagaagctacctcacatttatatattatttacatattttaattatgggtttatattttaataattgtgagactgtattttacataaagttatcaatattctaagcttttatgtataatattcacaatatgtaaatcataataatataacagtatttacactcaatatttagagtatttaaaatgataatatacaactatttattaaaactaattttactagggaaaatattcatgtggtcagaagtaagttttgatgaattattatcatatacagattaaaattaaaattagtttattttgttttttatgatactctgacttcttactaacatttgagtgggaatgtgattggcaaatcttaccactgacctctcacctatataagagttcctcacagctaaatgttcaagaatgatggttttgataatgatggttgtgctaataaatacaacggcaaagttttaaaatgtactaccttattaaaagcaaccccataatttctaatatagcacttctctggtaatctgcatgagaatgtatttcttggacttagaaacgttagtaaggcttcctgccatttaacactcccccagaccactccatacccctaacatggcccaggtcagtttattggttaaggatataggacagattggcacacagaaaatgtaaagttcaggagatagttcagaaagttcagaactcagtggcaaattatttaacttttgtacatttctgaccacctagttttatctacttttaataagcctaatctcttgaagcatcaagtgacaaagactgctcctaatctaagtcaatttacagaagccatctgtaatggtttttaaacatgaccacaaattatttagtaccaattttagtgagaaattggatgtatgcataccctcatgttaaatctaggttgatttgcaaagcttcatccgtgtagtatttaaaaagtgatgctatattacttctgaagctagcttgtaaaaggccatacagctttgttcttatttactggagcactttctctaggagcctggagccaccatatgggaagtctgaatacccagacattgtcttgctgggtaggccatatctatgtgttccagctgacagaattgagaatccactgagcccagctttctagtcatctgtgtcaaggcaatagatacatgaatgaagccatttcagtagaccagtttttctatcagctaaatactatttagagacttgtgtagacaccattggttctgtttgaatttctgacacactaacttatgagattaaaaaatgattgttttaatacaccaagttttggtgtggtttgttatgttacaatagataatttaaacaccatgacttcaggaaaataagctttgcctctcccatcattcattaagttttatattcatgtatatatacgacagatatttatgaatgtcttcaatgtgctatatctgtttggggccgtaagaatataatggtaaataaaacactaaccttcctattttcatagaatttatattctacacagtaaaagccaataaaaatgttataaaatatgtgcaatgtatcaattggtgattattgaaaagataaagcaaaaataaaacaggataacaacatattggagagtaccagaggtgagttactattttatatagcatggccataagtggcttatttgacgttatttaatcagagtccataataaaatgagaatgtaagttatatgagtatctgaggaaagaacattacaagtaaaatgagacctaaagagaagcaaatttttggtatgtctgaggaagaccacaactaggtcagaatggtgtgaatacagtgaaagaagcagagagtatcttcaggtaggttaacaagatgttcaaccatgtcgaaggttgctttttttttgagacggagtcttgctctgtcgcccaggccggagtgcagtggcgcgatctcggctcactgcaagctccgcctcccggattcacgccattcttctgcctcagcctcctgagtagctgggactacaggcgcccgccaccatgcccggctgattttttgtatttttagtagagacgggttttcaccatgttagccaggatggtcttgatctcctgacctcgtgatccaccggcctcagcctcccaaagtgctgggattacaggcgtgagccaccgcgcccgacctgaaccatgtagaagcttttaagatggtaaaaggcttttaattttattcacaatgagaagataaatcattgtagaattttaaatagagaagtaccatgtcatgatttaacttttaaaagacgctctctgggtgatggagagagaaaagagtgtaggagggtagggccataaaaagagagacaacttctaatttctgcagtagtccaggtcagtgaagatgatgatgtagcctaatgtggctcttgtgtaggtgattaatatagtaaaatgtctgtttaggatatatctcaaaatggagttgatatggataatatccatgcagcaggtagaaaggttgtgcacctgtgatgaatatgacatttaactcatttaaatatttaccagattagagaaagaaaggtctgctggacttacacagatgctaaacatacagactttctacactgccttttgctcaagaccatccccctatgatttcaattgttttctgtttctcaaatctcaccctcctccaaacaaccctcccagttgggactaaagtattggctaccatcctatttactgttaacctcatcagcatgtgaattttttaattgtaatatgaatataatgccaggctgtagccatggtgaccaggaactaaacatacatagtttaatcttctttgagaaaatttacttgtccagattcttcccatgtccttggcttatctttggacataattgagtcttctttatctcattttgtctttcaaccatatacattctttctagttatattgatgaccaagacaatattggcacacacttaaaattttccaagtacttatgtccatgtaatctctgtcttctttacatgacttctaaatcaaacttattggagtttacacatgttctttatactaattttgttcccataccattatatttatttcttcaatttatcagatcctataaacctttcctctagtaagacatgacccactcaagacctcaaacactgaggaatctgtttaatatcgtggttttgatacatgtttaattgtgtggataagtgggtgattactagacaatagaacatggttagaagttttctttatggattattagtgaaacataactaaaggagaattatgatctatttgtcctgatacctttgatcataggtactaaaagtgatatttccatgtcctagtaattaattcatacattattattaaaaacagggactagagcacaaattaggaatcccagaagatataagattagaatgagaatgaatttgggatgtttatatttagtctctatttttcatacacgtgttcatacatacatctacaaagtgctaagctctttgttactaattttcacatcatggtaataagttagcaagaaagacagaatatatactattggctagtttgatagagccaaaataatatagagaagcaaatcaaatctgtgggtaaatagatactgtgttagagaaaatggtatgtttgcaccaaattgtatttgtttcatcttcttgataagactgtatttcccaacctctttcacagctcagttaaggtcaagtgtcactctcaagtatggccataaaactgcccatacaatttatctatattctttttttccctgtactgtggcaatcttggaggtcatgtgttttaaactgtttagtcaccttataaaaggaacatggtttcataaatcaccacattgagtaccaataccacccagattaacaacccaacccatattggcatgtgccatgaggaaaaattaaatttatgtttattacaccactgagatatcagtgtttattacttattgcagccaaacatagcctattctcagttatgcatggatggaaaggaagggaagggaaaagggaagggaggagggagggagagaggaaggaggggagtagaggggaaaggagaggaggggaggagaggagaggggaggggaggggaggagaggagaggcgaggggaggagggaaaaaaagaaatatcaaattcagcacaagggggagagaagaagcaggggagataagtttcttgtccaaaagagtagatatgttagacatatgccatttttcattctaatcaaaagtccccaagcacacagaaaccattgaccagaatgtaaccatttgtacatgccaagataaaaattataggtgtttgttagtttcacactgatttcttcaaattaagcaattcaattatgaattaccacaatgtagctttatttgtccatagctttttattttttaatgtattttccagcaaattttttcttagtcaaagacatacttcagtgaatctcagaagcatcttctcttccagaaaactcatacctgttcatttcaagtcattatacactggcagctgaggaagacagctgttatctaaattccataaatactctgtggaggctaaactttagaacctcagtgattccaaactagctgtgttctgaactcttgcattttgatgagcctctccttttattgccttcctgtataagaaaatgttaacaaatcagagatctagattcaataccagactaaggtggttgtataaatgatacataattactggtgaaatgcccatattcttaccattaaaaatagtggagtggacacatttactatccctagatgtcccagaatacttatcttgaccataatgagtttttttatgatccttcatcatatagaaaatttaccacctttaaatgaacacattgttgatgccccccccccaacacacacacttaactttgcagtcgtgtatgtatttctcagtttaattccttaggatgtatgatagcatctaaggaatgtctgttatcttctcataggagaagaataagaaataactatctttacctactttatcgtgttaatgtgtttagcatttttattctatagcacactaatgacttttatgtacaggtttttggactgagtgcttctggcccagccacttatatcattgagtatggttgattttctgtgaacctacacattgcactaatctttctaatacaatgctggagaatcaagctcagagtacaaaacgttgatgttatatttcaaaaggcagatgggattgcgcattatattatatattagaaaaatagggaaggggtactaagtctcccttgtttttctcttcaattggcctgcctacggctcatcaatactggaaataaacagctccagaggctaaatgtggcaaatgcagcaaattcagcaaatccaagtcccttagcattatataatgttgactgcatccattctacagaattttaatttgatatcactctcatgttaatccatttatacattttagtgggcaataaaagaagttatgggcaatcacaaaaagtacatagtagagctatgtgtgacactgatgtcagaaatttatatttttgtggaaaattttaaaaggggatcccatggtggtagatttttaaaattctaataacaattttttaaatttctaataaattaattagaaaaataacttaaatgcacccaagagtggtgaattttaaaaaatcacaaggtaggtaaagctttaagtgaagtgattaaaactgaaagtaagggcatttgagacatgaaaagtgatctaggtcttaagaattacaaactgtgtgtaatgcattttaccaacaataaagtaacatgttctttatccttgcgattaatcattatagtagtccttgggcacccaaactaaagtgagacataaatcaaattgacccaatcaacactcagtaactttaatgacataaacaagcagccagcctttaccaacatcttactacatttaacagtcccgtattactacccaatgtgtggagacagcacagtaggccacaaagagtaccagcttatggaattttggttttacagccgtcactagctttatgaaattgggtaaacaataaattttgtggcccttcagtttcctctaaataatgaaaacaggagtatccattctttcttactatgcaggtagctgcaattgtcaagttaatttctgtaaacctatattgaatattatagcactcaagacaattgtgaaatattagattcgcttccaaataaatttgtttagatgcatggtggtgtttgtttttctggaagaaaattactgagcatcaatggtaatctcatatatatagacctcaggtaaatataggccagattttaattattagaaaaagagctaaactgaatcacttaggctaaacagaaaatgataattgaatttaattattaacataggtgcccatctgtaaccctcactggacattaatcagaccttcattaagacacagttttgtactgatttccatgttttatagataatttatagaaaccgatagaaactgagcagagttcatatcatgaaaaaggggagaaaatacaattatttaaagaaaatgagttagagaattgaacaatatggaaggtcaaaagtttagtgtcagttttcaagcactagataattattgagattcctgcctgttcttcttaatcattttcattttaaccaaccatatatactgatacagttatgttcataacactgcactgtgccagatttaacaaaaataacaccaactaaaaaattaaatatagtccttcccaaggaagccgtgtaggattttgcagtcaattttggggggaaatgggccagcatagataaagcatttaaaaaacaatgctttctttacatctatcataaaggtccagtatgactttataaatgggccagcatagataaagcatttaaaaaacaattctttctttacatctatcataaaggtccagtatgactttataaaaaattagtcaaggagattatttggaaaagaaactcccattaatgttttggactttgaatcctttatgatatttaatactggacggatgagtacctgccttagttaagtcctggaatatgagatgtattttctaggtttagacatgctattatctttctactttaattcttttaaaagttttaaaagagaaattaaatgtaagtttttgaaaagacaatagttaatttatttgtataaggaaaaagtcatctctagtgagtgattgcaattaaaagttaaaaactagcagatgtatactttccctcttatgcacataaaaaccaaatccatactatttcctcttcagttgtttctccgtatatcttctctattactatttatggcaggattattctcccagatatgcccactctgaaacctacttaacttttccttccatttcctttactcctacatccaaatgattggttaaatgccattgaatcgaccactgtactatctttccttaattctaccaattaattttttcttaattccacctctcttaatttcaccaattacatttaaatttaaatttcagcttgtagtattaaaccccattatttatattgcatgttgtggccatacttacctctctaaaattttctcttattgtcaaagtgctactttaaaattttcagtgaattaagtttgtctaaagcatgacatctcaaaatgccatcccagagtcagcaacattaaaatcaccttggagcttcttagaaatacagtgtgtgaagtcttacccggaaacaactgattcagaaattctgaggacgaagcctagtaatctgtatttgaacaagccctccagttttacattttgttgtgttgagactttatttttagagcagttttaggtttatagacaaaatgaacagaaagtacagagagttattatatactccaactcccccacacatacattatttttctatttttagcatctggcgttagtgtggtacattttttagagtagatgaaccaattagaacatattgcatttttttcaaaattcattttactgtggtaagtacacaacatgagatctatcctgttaaatttttaagcacaaaatagttttgttaactattggtacaatgttgcttagctgacttttagaatttattcattttgtatgactttctgtatgtttattaacaactcccaactctccatttctcctactccctgctcctggcaaccactattcattccactctgattctatgagtttgactattttaaatatctcctataagtgaaatcatgcagaatctgttttcatattcccggcttgttttccttaacatcatgttcacagaatttatacatgttgtcacatattacaaaattttctagttttgaaggctgaataatattccatgcatgtgtgtatgtgtacacacacatacacatacatatatatgtcttacattttctcaaccatccatggacatttggattgttactgcatctggaccatcatgattagtgctgcagtgaacatgggagtactaacgcctcttcaacattctgatttcagttcttttagagaattaactaaaaattagtttgctaaatcatatcgcacgtatattttcattttctttttgaggaatgaccataatgtgttccatagcagctgcaccatttggcattcctagcaatggtgtagaagggtggcaacatccccacatcttcaccagtattttttgtctttttgaagatagctatcctgacaggttgaggcagtatcattgtggttttgatttgcatttctctgatgattagtgactttgagcatcttgtcataaacctgttcgtcatttgtatgtcttatttggataaacgtctgttaaaagtctttaacccattttaaaaattgggtgattagcttttttttgctgttgagttgtaggagttccttatatgttttggaaattaaacccttatcagatatattgtttgcaaatttttttttcctattctttaggttgccttttcaatctgttgataatttcctctgcaatgcagaagcttttagtttaatgatatcccaattgtttattttgctttttttgcctacgcttttggtttcatgtgcataaaatcattgctaagattaatgtcatgatgctttttcactgttttcttcttgtagatttctaatttgaggttttacacttaagtctttaattcatttttagttgatttttttgtgtgtggtgtaagttaagggtccaatttcattcttttgcgtgtgtatatccagttttcccaacaacatttattaaagagactattctctcccaattgtgtatcctatactgttttaattaacatagccgtgtaatatatattgctaatcaggaagtgtgatgcctccagtttcattattttttctctcgagtggtttggctttctggtgttttattgtggctccatataaactttgggtttttttttttctatttctgtgaagaatgtcattaagattttgatagagattgcatagaatctttagatagctttgggtagtatggttgttttaacaacattaagtctgccaatccatgaatgtagaatatctctttacttgtttgtgtctctttcaatttctttcatcaatgttttatagatttcaacgtaccagtcttccacctacttactttactcataattattttgttctttttgatgctattgtaaatgtggttcttttcctgatttccatttcagataattcattgttagtgtatagaaatgcaactaatttttactcattgattttatatcctggaactttactgaatttgtttattagttttactaggtttttatggagtttttggagttttctatatagaaggtagaagattatgccatttgtaaacagggagaatttcacttcttcctttctcatctggatgatttttacttcttgatcttgcctgatttctctggttagaacttccagtactatgttgacaaatggtgagattgggcatcctgcctatttcctgttcttagaggaaaagacttaagattttcctattgagtatgatgttagctgtgggcttgttatatatgaacttttctgttaaagtcatttatttctattcttagttcattgagaggtttttgtcttctggttgtaaaaagatgtcacattttgtttaaagatttttatgtatctattgaaatgatcttgtggcttttattctttactctgttaatgtggtatatcccattattttatttttatatagtgaatcatccttgcattccaaagttaaatctcacttggctatggtgtatgatccttttaatgtgctgttgggtttagtttgctagtataatattggaggattttggaatccatatttatcattaattttggactgtaattttcttttcttccgatgcctttgactagcttttttatcaggataatactcacctcaaaaaatgaatttggaagtgttcattccacttcaggtttttggaagattttgataatatttgatgttaattctcatctacgtgtatattagaattcaccagtaaagtcaccaggttctggaagtttccttgttgggaggtttggattactaattcaatctccttgctgtttataggtctgttgaaaatttatatttcttttcatggtttgatcttagtaggttgggtgtttctaggaatgtatccattgatttttttttttctaggctatccaatttgctggcatataatcattcatagtagtctgttattatcatttttatgtctatgggttcagttttgtcttcttttcatttctgaatttatttatttgaatttcctctcatttttttagtttagcaaaaatattgtcaattttatttcttttcagaaaactacctcttaattttgttgatttttttttcaattgtttttctatgctctatttcatttatttattctctaatatttattatttccttctttctgctaattttgggttgaatttattcttttactagtttcatgaggtatagagtttggttgttgatttgagatctgttttatttttaaacgtaggcatttactgctataatcttcccttttactactgcttttgctgaatcctataagttagggtatcatgtatttttgttttcatttgtctcaacattttttaaattttttttatttcttctttgacccatggttgatcaaatgagttgtttaatttccacatatttgtgaagtttctagttttccttctgctatggatttctagttctgttccttttgtggtcacaaaagatatttggtatggtttcaatcttattttttatgtcttgttttgcgacctaacatgtgatttatcttgcagagtgtaccatgtctgcttaagaagaatgtatattctgttacttttttgtggaatgatctgtataggtctgtcacatccatttgaactatagtgttattcatagccactattcctttgttgattttctgtctggttgttctgttcattatttgaaagcttttattaatactattgttgtattactggctacttatcccttccatgctgtaaatgtttgctttatatatttaaatgctttaacgttagccacatatatatttataatcattatgtattccttgtgtatttacacttttgtcattacatattagtaatgtccttctttgtctcttgtgacaactttttacataaaatctatttttcctgatacaagtattgccacctttgcttttttgggtattatttgcctgtaatattttttctttattcttccgctttcagcttatatgaatcattaagtataaagcgagtttcttatacacagaatatagtcatatcttgtttttttgtttcattcattcactctatgtatgctgcaaaatccactgatggttttatggggatttccttgtacactttcctatcattgtattttaagtgtatgttgtatattctggatataagtactttgtcagatatgtaactcataaacattttaacctggtctatgattgtcttttcatgcttttaacagtctctttcacaaagtacttttttatagttttaatgaaatccaacttatcaattatatcaacatatctaaaaacttatcaccaaaccccaaatgtaagattttcttacatttacctttgaagaggttaaagctttgtgctttatatttaggtctatgatccattttgagtcaattccttaatgtgtaaggcctgtgtcacattcagtattttgtatgtggatatgcatttgtttcaggatcatatgttgaaaaatctttcctcagtttaaggatagttgtctgtttagaattgcatttattcctttgttaaagataaatttactatatttgtctgggtctgtttttgtactctccattctgttttgttgatttatttgtctgttgtttgctaataccatactctcttggttatcatgctcttatagtaattactgaagttgggtagtattaacccttcaacttagtgcctcttcttcaatattgttttggctattctgttttttttttatgtttttgcctttcaatataaattttagaatgaatttatcaattgatttatcaattggatacaaagtaacttggtgagattttattgagattgcattcaatctatagattaatttggaaagaactgacaatttaacaatatttagtcttcttatctgtaaacatgagatagctgtccaattatttagatcttcaattgtttcatcagtgttttgtggttttacttatatagaacttgtgcatctttatacacacacacacacacacacacacacacacacacacacacacacacaaggtcttgctctatcactctggacagtggttggaaaggagtggcatgatcatgactcactgcagtctcaacctcctgggctcaagcaatccccttgccttagcctcctgagtgggactacaagagacttttgtatattatccttctattctgcaaccttgccatgattgtttattagttctaagaggtgttttgtttgtttgttttggtttgtttgctttggagtgttttttatgattgcttagtatttttcatgtaggaagttatgtcatctgttaacaaaggcagtttaatttagttattccaagtctgtataccttttatttacatttcctgttttctgtttcatcagctgggacttctagtataatattgaataggagtggtgatagtggacatccttgccttattcctgatcataagaaaaaataatctagtttctcaccgttaactgtgatgttagctgtaagtttcttgcagatgttctttatcaaatagagaaagttctctttctagtttgctgaatgatttttatcacgactaagtgttgcatctttctcaaatactttgtctgcatctgttcgtatgatcatatggtttttcttctttagcctattgatgaaattatgttaatttatttctgagtgttgcaccagtcttgcatacctgagataactgccacttggtaatagtgtatatttctttttttatagtgatatatttaatttagtaatatttttgaggacttttacattcatgttcatgagagatattggtctgtgcttttcttttacttgcaatgtgtttgtttgggtgagagtaatgttagcctcatagaaagagttctattttctgcttctatcttctggaagaggttgaagataattggtctaatttcttcctcaaaagactggtagaattcatcagtgaagccatctggacctgttgctttttgttttataaagttactaattattggtttaatttcatatatatatatatatattcattaagattatttatttctccttgtatgactttagatagattgtgtctttagaggaattggtccattttatctaaattataaaacttgtgaatatagagttgttcatagtgtccctttattattcttttaatatttataggatttgtagtgatggctctcctttcatttgtaatattagtgatttgtagtaatttatgtcttcactcttattatttttttggtgagccttactagaggttaatccattttcaaagaatcagttttcagtgagatgtgtctttgggctgtgcctttcacaggtgcttctcagctttcctctcttcactccttaggtaatacaggaaggctatagagaactagagtttggtatttaccttctaccagatgggttagcctgtagtcaaaatctagttcaggttaggctctggtaaaatacttttccttgaggccaggcctttgttaagaagtatccaacactctggacaaatttcaagtgtttattttttcccttcccctgctgaaagcttgagggaattttcctctgaaatgtcaaactctttacattttggactagaaactagaaaacctctaggagcttttgatgcacacttgattttgagaagtactggcctataggatacattctaaactctttaccatgaattctaggtttgaattaatctgtctccaccaagtttctaatgttattttctgtattctgctctctctatattttctattattttaaaaatatttttatattcattcctatattttatccttcccactttttccttctatccctttgccatttgactataatgctcttttctttctctctttctctacctctcctatcttttttttgtctctttctccgtgtgtatatatacacacacatatatatacacacatatatgtatatataaaatctctaatgtgtatatatgtgtgtgtataatctctagtctataaagatatcaataattctttttcttcaacacatattttaagcgtttattaagtagcagtagaggatagaaggaaaaagaaaatatttttgccgctttccaggaatttattaaccaccacgggagataaaaacatctatacaattccatgccttacatttcacagaagtaaaagtttagacaccagtatagtgtttgtttttatacatacctgtagggaaaaaaaacaaatgcctaaatcattttctaagacctattttgttattcttgaagtgcaacccaaccagtgtcattgaaaatcataagctacataaacatcatattttatattttacatatgaactatctcatttacagaaaataactgcctctagtgaaacgactcaactcttttcatttaaccttctcattaattatttttaaatatttttcaaaattatttggaatgtgctaatttgtaagcctatacattgtaggaaagcagtttttaatcacaaaacagaggtatctaaataaagttgcagaagatagcttctctggtaatgatcaagcagaaatttgatttgtcactgcattctactaaagtaccttgaaggagaaaaggcacccgtaagtatttccacaaagcagccaagttgcctcaagattgtggcttagagcattacatggtatcccgctgaaatgtggcatcaattgttttcaattccaaatgattgcggttttaactctgctcgtagttggagacacagaaactatagaaaagtcagaagaccctctttagatttatcaccttgcataatgatggtgtacttgtaatttactcactcattcaaaaatactgtagtgctaatgtgatggttaacactgagtgtcaacttgactggattgagggatgcaaagtattaatcctgggtgtgtctgtgtggatgtttccaaaagagattaacatttgagtcagtgggctggggaaggcagatccacccttaatctggtgggcacaatctaatcagcttccagcgaatatgaagcaggtggaaaaacctgaaaaggagagacagacctagcctcccagtctgcatctttattccattctggatgtgtcctgccctcgaccatcagactccaagttcttcagttttggtactcggactggctctccttgctcctcagcttgcatacagtcattgtgggaccttgtgatggtgtaagttaatacttaataaacttccctttatatacacgtatatatatatcctattagttctatccctctaagaggaccctgactaatacaaatttctagacaaatagtttctgttgtcatgtggaaagcaaagaaataccttcaatgggaagtagaaaacttccagtgaagcttttgatgttaattacacctgaagcatccactaacacagtacttcccatactttattgtacataggtatgacttgagaccttgttaaaatgcacattatgatgcactttgggcatggccgaagattcctcatttctataaggttcctagttaatgctgctgcttaattaactgtgactagcaagactctagtatatggtaagctttctaaaagaagaggctgtatcttacttgtgtttgcccttaagcctagagatattttgcttacttttatttatcacatctatctatctctctaacttctaaaagttattcaacgctgttcatagagaaatatcagatattttaaaataagttaaattaaaagaaacacggaaatcagggcaaaaggaaaaagtaagattaaggaatttgttaaatttagttttctactagaagcgaacctacgttgtggctccgaacattgatgcccttatgtcctgggcacagtcttggtttatgcccattgcatcaatgtaattattgataaaaacatttactagtctaggttaaacggaacaagcggataccctactgttagccctggtaaataactcttaacctggaaaaacaatgccttacattgattaatgagcagtgtaatgtatggatggaaagagtctttaagcaaatgcccagatattggaaagaaaagatcaggattctatgatattcttaaaacagttattaattttaccactgtgaatattgatggcacattagaccttaaaactatagttattttacatatataggcaatgaatgtttttaaaaatattatatatcaataaaatatcttgatttttttaaactataaattattttataatatacattatgatatttatatataagttcttatctttaggattcttgagaattaacattttagaaagaaaatatctagatgcaaatctagatatataggatgactattaatcttacattccctaaagggacccacaaaaataatgaggggctttctcttagatggatgacttttcattttgcaattaaaaagggtgagaaggcccttcatcaaacttttatttagggcaaaataggtgtcatgaaagaacttaaggccattactaattaataatataaagtaacaaagcagaaaaaaataacctttcatagatttcctgtaggttttaagcagcttcattgattagatcttgatagtagtaagaattctaagaaatacataagataatttagagtatgttcagatatttatacttattatttttatatgcataattgtatttgaaattatatataatttaatttcttattttagaaataagactcttttcaacaaaaaacttaaaatttgcaattattaaatctctgctgatggcactgcccataaaaaagttgtgtttgctaacctaagagaaatttacctaataaaataatttaattgcagagattgtccttgttctaaaataaataacatcttcctaaacatcttactaaaagatctctttcaaatctgctggactgtgttggatgcatctatagtggacttccttcaagcctgtctttcttttaattttaaatacattttcaatttaaataaaatgaccatattctatttaaattacttgtttaactgtgtaacttcctcaccagactattcattctatgagaatagcagatgtgtctttcttgtctttttgatatccagcccctagcatggtactctgcatataatagaggctcagtaaataactgtatataaagcaaaagttgataaagttttagacattttgtatagtaaaaacataatccaaactatagttaaattattgtgatacagaaagtggtagatgacagcaaagttatttaccatctaatctgaatttacaaaatattaaaataatgattaatttgtacaaaaatgtgattgcaagtgtaatattgctttagtctatgtaactatatgctcctttgttccttgcaatttttcaacattttctattgcttcctttcattgttcatcctctttcttcaagtctcaatttaaaggtcatgtcttcagggcaaccattcctgactacagtatttttgtgtgtttcaatactgtatttatttcctttatggctgttatcacaaaatccagttttcttctttattggtttattatctattttccttctattaaattccatgtgagcagtgacattgccagtttttaccattgtattcttaactcctaggagattgcccaacaatttaatgacagaattaatggatggatggatggatggatggatggatgaatggatggatatacaaattcagagatgtgacagtaagttcagcaaaacacatgttcatgaaaacatagaaaaagtaaataagataaagctattctgtttcccacaaaataattcctgatgtatttttatgcttggatacacaagctactgcttgagtctaaaatttatcaaattcatatattagtaatctaggatcatacatcgttgttaagctatgtgtttcttaagatctacctctaatttgaccataggcaatgaggttttggtgctttaaaagcctactcttgctataaaagggaatttatcattttaaattttactttgttagaaatcacttaaaataattaaacacagttttttagtcagtttcaagatataggacatattatttgtacatatgtaagaatttttaatttggcataataacttaagacttattctttaaagtgaatattacatatgcatgggaggagcttgaacctagagatatggtaaaaatatatcagagcaattatatagcttatcttaagatgacagtgatttcaaggttaattcttagcccaacgtatccagacgattattacattctgttcctccttgtgtaggtcagtctggctgttgaaaatgctttcttacttgatgaatcttatcaagttcacattgtggcattttctccagcttttaaataattttttctctaatgtgataaaatgagagtaataagaataatgcacagttgaccatcttgaacaaaaagtgtgggaatacagcgtttacataatggaaaaagaagcagagaagataggctcaaatctccatgtcagggaaaatctgagtagaaaagaaatgacctcatttttgtcaagagtttccttccttcattccttccttccttccttccttccttccttccttccttccttccttgtctttctctctttccttctttctttttcttttcctttcctttcatttccttcccttccctttcccttcccttccctttcccttcctttccttcctttcctttctttccttcttcccttccctttcccttcccttcccttccttccttttctttctttctctcctatctctctctctctccctttctttcctcctcctttgtctttttcttccttcctttcttcctcttacctcttcctcctctgcctcttccttctcttactcctttcttctgtcttcctaaaaagaatagtttttgacacaacactctgaatttctctagggaaatacagtacattcatgttttaaatgtataccttattggatcattgatgccaagggacaagtcaagtctacatcataaaattggtaatcttgtagagatcagattaattgaagttgctttttataaaacttctttttttttatttcaacttttattttagattgagggggtacatgtgcaggttgtgctacatgggtatattttgcaatgctgaggtttggggtatggattccatcatgcaggtagtgagcatagtacccgataagtagttttatcacacatgccccactcccatcctcccccctctagtagtccaggttgtcaattgtttccatgtttatgtccatgtatgctcaatgtttagctcccacttagaagtgagaacccacagtacttggttaactgatcctctgttaatttgattaggattatagcctccagcttcatccatgttgctgcaaaggacagaattttgtcatttttttctggttgcataatactccatggcatgtatgtaccacattttctttatccagtccaccattgataggtacctaggttgattccatgtctttgctattgtgactggtgctgcaatcaacctataagtgcacatgtctttttggtagaatgatttgttttctgtttggtatatatccagtaatgagattgctaggtcatgtggtagttctgttttaggttctttgagaaatctccaaactgctttccacagtggctgaactaatttacattcacattcccaccaacggtgtataagtgttcccttttctccacagcctcaccagcatctgttgtttttttgactttttaataatcaccagtctgactggtgtgagacggtatctcactgtggttcagatttgcatttctctaatgatagtgatagtgagcattttttcatgtttttttcatatgtttgttggcttcttatgtgtcttttgacaagtgtctgttcatttcgtctgcccattttttaatggtggtatttgctccttgcttgtcaatttaagttccttatagattccagatgcaagacttttgtcacgtgcatagtttgtgaactttttcttccattctgtaggttgtgtttactctgttgatagtttcttttgctatgcaaatgttctttagttaattagatcccacttgtcaaattttgtttttcttccaattgcttttagggatttagccaaaaatgatttgccaaggccagtaccagtaagggtatttcctacggtttcttctaggattcttagagtttgaagtcttacatttaaatccatcttgagtttatttttgtacatgttgaaagataagtgtccactttcatttttctgagtgaggccagccagttatcccagggccatttactgaataggagttagttttcctattgcaccacttatttaatagggggtcctttttctattgcttggccttgtcggagatcagatggttgtaggtgtgtggctttatttccgagatttctgttctgttccattggtctatgtgtccatttttgtaccaggaccatactgttgtgattactgtagccttatagtataatttgaagttgaatagtttaatgtctccagttttgttcctttttcttaggattgctttggctattgggcctctttttttggttccatgtgaattttagaatagtttttctaattctttgaagaagatattggtagtttgataggaatactgttgaatctctaaattgctttggggagtacagctattgtttttgagaaattgctgatatatctaagatttaggaaacatgggactaaaactcaaaaattatttcattgcttaaaacttgaatgtacaataagaaatagtttttttttaaatttttgtcaggctttagttctcttatttttaaacagatattttgaagtataatgtgacattcagcctcaaaaacgtcatgctaagtgaaagaatccagatccaaaagactacatattgtatgattctgtttgtacggcatttctagaaaaggtaaatttatagagatggcaagcagatcaatgtttgccctgcagctggggatgggaatgtggaatgatcacaaatgggcacaagagagcattttgaggtgattcaaatgatctaaagctgggttaccatgatgattgcacatctaaaaatcattgaattgtacatttacgaggggtgaagtttatggcatgtaaagtatgaccattttaacaatattgatttttccagttcataagtatgggaataatttttcatttatttttatcatctctgatttccttcagcagttttttgtagttcttcttatagagatctttcacctccttggttagctgtattgccaggtatttcattttctttgtggccacttaaaatgggcttttgttcttaacttgcctcttagcctgggcattattggtgtatagaaatgctactgactttcatacaatggctttttatcctgaaactttactaaaattactagttctagaagccctttggcaaagtcttcagggttttctaggtgtaagattacatcatcagcaaagagagatagtttgatttcttcctttcttacactatcagtggggtgttgaagtgtccaactgttatatatggctgtctaagtcttttcataggccgtgaataacacgttttgtaaaactacttacttcaattttgggtgtatatatatgatacttcagtctttttgttggattataccctttatcattatgtaatgcccttccttttccttcttatttttattggtttgacccttttcccacttagaaaaagaaaaagtgcagcttgctgccagtgctcatttaattttatataaagacactcttagaggctgaagcaaatctgactgattttcaatatgaaaataaaatataaaaactgttcttggagttatttctaaacagaactaatatcacaatcgtctgaataatcagaattgtctattttggaaaaatcaaattcatgaaatgaatctttggccaacaactctttgagaacaatgttaacatcatgcgtagaaatgctgtgttttctaggatttcacattttcagtgattgataattactatattttgtaaatagaaataccactactaaaaacagaatgctataaatagaattctgtcttttgtttctaaagtcaatatgccagagtgacgtgaaaataataaaagtaagatattttgtggaaaaattactactctctctccctactgaaatgtaaactccattgaggcaaagctttctctcatgtttgttcattgctgtatttgagcaactataacattgtcagatgttcaatacacatttattgaatgactgaattaatattaggggacttatgtcatatacaggttctttgttttacatcttgggggcttctgttttctaataatttaaatcctgatcagtatatcatgctgcttctaccacccataaatatacctgcttacttgcttctttctcaagtaaaataaaactcacaagttttattaaagttaactaagatgtctatattttaataaagcatagttattaagcataccagaaaagtgatattataaagttagaatatttatgcagagatatattttaaaataagaatctttagaaactgaaacttagagtataataaatcaattcatttgcttgcaatagcaaatagttgtcacatagaactatattaaagaaatttaatacatgtgaacattaccagtagtttcatgtatggtgcagtttagtaaaattctatcataaagtattttataattatacaaataatttaaaagttatttagtttactacacatcctttttttggttttgttttttacttatcatctttttccatgacagatggttctcataaagctatgaattacaataaactgccttttggttaccgggatagccacattacccaggcttaaccaactatgttcatcaatattactgccgagagagaaagttccaattatacagtttcagattgttgaatataccaatctggctttgcacagttctatgtactaataaactaccttctttgtaaaaattagccttcattgattttctttttttaatttttaatttttgtgggtcatagtaggtgtatatatttatggggtacataagctgttttaatacaggtatgcaatgcatagtaattacatcattgaaaatgggatatccaaacccttaggcatttttctttgtgttatgaaaaatccaatttcactattttagatatgtttaaatgtacaataaaatcataattaaccattgtcaccctattgtgctatctaatattaggtcttattaattctttttaaatacttttttttactcattaacaattgccacctctctcaccctgacacccattacccatcccagcctctagtaacgtaacccgccttctactctctatctccatgagctcaaaggttttgaattttagatcacacaaaactatgcttatcctaagtaaaaagagtaaataatcaaccaatgaaaaataatgaccataacaacttttcatggcatagttcaataggatataaacagaaacaataaaaagttaagaagcagagagacaaagttaagacagagtttttactcggtttatttttgcttttttgtttgtttatgcaaataacataaagttgttatcaggttaaatattacccactccactgccctttccagccttgaaaactatccttctactctatctccatgaaattaattgtgttgatttttagatctcacatgtgaatgaaaacatgtaaagtttgtctttatgtgcctagcttattttacttaatgttctgtagttccatccctgttgttgcaaatgacagtactacattgtgtatatgtaccacattttctttttgcatttgtctgttgatagacacttaggttgatttcaaatcttggatattgcaaataatgctgcaacaagcatagaagtgcagatatctcttggatgtactgatctcctttcttttgggtatgtacccagcagtgggattgctggatcatatggtagctcaatatttagttttttgaggaacatgcaaatgattcttcatactggctgtactaatttacattcccaccaacagtgtgcgaaggttcccttttctctgcatcctcgccaacatttgtttttctagggtaagatgatatctcattatagtttttatttgcatttttctgatgatcaatgatgttgagcaccttttcatatggccatttgccttttgtatgtcttcttttgagaaatgtctattcaaatattttactcattttaaaaatcagattattagattgttttctacaaagttttttgagctctttatatattctggttattaatttcttgtcagataggtagtttgcaaattttctctttaattatctgtgctgtctcttcactttgttgtttagatcaggggttcccaacccccgggccatggactggtactggtccatggcctgttaggaactggaccacacagcaggaggtgagcagcacgagagtgagcattaccacctgacctttacctcctgtcaggtaagcattggcgttagattctcataggagcacaaaccctactgtgaactgcaaatttgagggatctaggttgcgtgctccttaagagaatctaatgcctgatatgaggtggaacaatttcatccccaaaccaactcccctcctgtcccagggaaaaactggcttccacgaaactggtccttggtgccaaaaaggttgaggaccactggtttagctcctttgttttacagaagctttttctctttatgtgatctcatttgtttatttttgctttgattgctagtgcttgtggggtattgctcaagaaatttttgcccagaacaatgtcctggagattttccccaatgttttcttgtagtagttccacagtttgagatcttagatttaagtctttaatacattttgattttatatttttgtatagcaatatgggatctagtttccttcttttgcatgtaactatccagttttcccagcaccgtttattgaagagacggtcatttccccagtgtattttcttggtacctttttcaaaaataagttcactgtaggtgtgtggatttgtttctgggttctctattctatgccgttgatctacgtgtctgtttttattgcagtaatatactattttggttactatatctgtaatatgattgaagtcaggtaatgtaattcctccttttttttttttttttttttgttaagataggctcggctgctctgggacttctgtggttccatataaattttagaattgttgctttttctttttttgtgaagaatgtaattgctattttgatagagattacattgagtctgtagcttgcttttggtaatatggacattttaacaattttgattcttctaatccataaacgtggaatatccttccattgtttggtgtcctcttcaattatttcttttatcagtgttttctagttttcattatagcaattttcacttctttggttaagctcattcctaggtatttaattttatgtgtggctattgtaaatgggattacttttttattttcttttcacattgttcactgttggcatatgaaaatgctactgatattgtatgttaatattttatcctgcaactttactgaatttgtctatcagttctaatagttttcctttgaagtcttgaggtttttccaaatgtaagattatatcatctgcaaacagaataatttgatctcttcctttccaatttggatgttggttatatctttcttttgtcttattcctctagcaaggatttccagtactgtactgaataacagtggtgacagttagcacccctgttgtgttccatatcttagaagaaaggctttcacttttttcccattcaatgttatacgagctgtgggtctgtcatatacgacttttcttgggttgacatatgttccttttatgtccagttcgtttagcgtttttaatgtgaatacatgttgaattttttcattttttcaacatccattaaaatggtcatatgtttttatccttagttcgttccattgatatggtgtatcacatacattgatttgcacatgttgaaacattccttcatcccagggataaatcccacttgatcatgatgaataatctttctaatgtattgttgaattctgtttgccagtattttgttgaagatttttgcatcaatattcatgagatatattgtcctgtaattttctttcttttttttttttttgatgtttggagggtaatgctggccttgttttgtaagtttggaagtaatctcactgcctacatttttcggaagagcgtgagtaggattggtagtatttcttctttaaatattagttataattcagcagtaaagccaacaggctccaggctttcctttatttggagaatttttattatgacatcaatctcgttacttgttattgatctgttcaggttttggatttcttcctggttcaacgttggtaggttatatgtatttaggtatttgtccatttcttctaggttttccaatttattgatatatagttgctcatagtagccactaatgatcctttgaatttctgtagtttcagttgtaatatctcctttttcatatctgattttatttatttggaacttctttttttcttagtctggctaaaggttggtcaatttttttaacttttcagaagaaaaaccacaactatttgttgtattgatcttttctattgttttattcatttcaattttatttctttctgctctgatctttatttcttttcttctactactataattttgattttggtttgaccttggattttaagttcattaagatgcatcattagattgttcttaaaaagtttttcctctttttaaatgtaggtccctatagataaaagcttccctcttagtacagttttttttttttgtatccaataggttttggtatgctgttattttattatcatttgtttaaggaaatttttctctgttttttctcaatttcttcatcgacccactggtcattcaggagcatactgtttaattttcatatatttgtatagttttcaaaatccctcttgttattaatttcttgttttattttattatggtcagagaagatatttgatataattttatttttttgaatgttttaagacttgttttgtgaattaatatttgctctgttattgagaatgatccatgtgctgaggaaaggaatatatattctgcagcttttggatgaaatgctctgtaaatatttattaggtccatttaatctatagcgtagattaagtttgatatttctttattgattttctgtctagaagatctgtccaatgctgaaggtagcgtgtgggtctccagctattattgttctgtgttttctcattctcttttgctctcatagtatttgctttatatatctggatgctccagtattgggttcatatatatttaaaattgttaggccaggcacagtggctcacacctgtaatcccagcactttgggaggctgaggcaggtggatcacgagatcaggagatcgagaccatcctgaataacacggtgaaaccccgtctctactaaaaatacaaaaaaatagccaggcatggtggcgggcacctgtagtcccagctactcgggaggctgaggcaggagaatggcgtgaacccgggaggcggagcttgcagtgagccgagatcgcgccactgcactccagcctgggcaacagagcgagactccgtctcaaaaaagaaaaaaaattgttatgttctcccgctgaattaacccattttctttacatagtcgccttctgtgtctcttatagtttttgccttgaaatctattttgtctgatgtaagtgtagcgacttctgctcttttttggtttccattggcatggaatatctttttccatccctttattttcagtctaagtgtgtctttatgagtgaagtgtgtttctttttggcaacagttcagtgagacctttttttttcatccattcaactagtctatcccttgtcattggagagtttatttcatttatattcaatgccattgttgataagcaaggacttactcctgccatattgttgttttctagttgttctatggtcttctcttcctcttttcatttctttccaccttcctctagtgataataattatctctggtaatatggtattgttttttggttttttttttgtatttactatatgctttgtttatttgaggttatcatgaggcttgcacatattatcttgtaacctattatttaacctgataaaaaccttatgttattttcataaacaaacaaaaagtcaaaaagaaaactagtaaaaactctatgtcctaactttgtccctctgcttcttaactttttattgtttctgtttatatcctattgtactatgtcatgaaaagttgttgtggtcattatttttcattggtcgattatttagtctttctacttagggtaagagtagtttactcatcacaggtacaatgttaataatatcctatgttttcctgtgtacttacttttatcagtgagttttataccttcaggtgattgtttattgctcattaatgtcttttactttctgattgatggacttcctctagcatttcttgtaggataggtttggtgttgatgaaatccctccgcatttgtattaatacccttaattttacagaagataaaatttacttgagagaagttaagaaaattatcccttgctagtctactagttagtgaatgttccaaaaatcaccaaatatcctaatattcagtcttcttattttaaatatgtctttaaaacttttttgatgctttttcttctgcctctgctgtttcttctttctttgtgaaaacatctactttttatactgttatgaaaaggaatattgatacaactgggtccttttacttaagtacaacttctatcagttctgcaacttcatgaatacttagtggatttggtaacatcaattgtctccaaccatctgtttgtagcttattacagaaatgtgattattttgccttaggggatccataatgagctccagaaaatcctagatgtcatctccattttgagctttttaaccaattctcgcttctcatatattttctttttcttatttagtagaccagaaatgtagagaaaccccatggccatcaccagccattactttgtcattcttctaattccctacttctaagtttctactttatttaaatgttaacattttttaaaatctataaattattttttgtgaggtgtaatagagatttcccttgatcagtaaaatacatttcatcttcatagtatacaactataagtgagtagcagctggccaggaaaagttcatatttgcatgcacccatatagttatgaacatatgattagttttcatcaatggaatgtaggtgaacatagtgagtgccacttttggatcaagactttgaaaatataaatgtgccaccttttttcctgtttctcttcattgatttgctgtatatttaaaatgataaggcctatgagctgtactgttttatatggtggccattagccacatgtgactatttcaatctaaaataattaaaatttaatacaatttaaaattaagtttctcatttacactagccacatttcaaaaatataaaggttatattgtcattattgcaaaatctgttattgaagggcactgacttagataatggtagagataagatgcagagagccttgttcattgcatcttagtgaggagagccaatcagctattcacctctgatgagtgcatgaaataaacttctagtttagtccagtgtacatctatatatttggcggtctttatttcttagtattttagattgtcctagttgacatagaagctaagtggtaattttaaaaatattttaacatctttttagacatttggaagatttcctacctccttttatttttttatttgtttttttctacatttaaaatcaaaacaatatagaatatgtttttttaaagtagaatgttttaagatgtagtgtattcaagaaaaaagtccaatagaaacttctcatggtaatgcatccacagtgaaaaagccatgatgaaacttcaggtttctttttccaccttcttaccttataagataatatccttaaaagtacaagcccaggaagggcatggtctttgggctcagattctttgggtttgagtcatgattctaacacttcatatttacaacctttgtagttttatggccatctataaataacaataatcgaaaaagtcaccagagttctgcacatagaaaacaatatatcagtttaattgctgataaaacctgggctggagaatatgaattagatatgtggcaataatgagcttcatgatactcctgaccccaccaatttagatattggcacagtctactgcaggcaaagcttgagtcttcaggaaagacttgcacagaattgttgcctttcactgcaggagggggttgagaaggagagtagagtgcaaattttcaaagtttaggaatttcaatacattaacatcaccaaattcatagatttggaccaaggtatatctgacaattcaattagccactgttgagaggcaaagaagtgtagcagaagaccagaataatataaggaaaatttattgtcaagaaaaccagagaaataatagagaaggctttagcattgtgagtttgtttctttacagtaaatggagatggtaatagtgcttaggattgctatgaccattaaatgctataattttagtaaaacatataatgctttatgaatggtaaacttttactaattctattagtaataataatgtcattttttattgttgttgcctgaacatttatagttgtagattaattatttggtaaacttactggaggggtgatgaagcaaagttgattaatgggtacaaatatatagttagatagaaaatataagatctttagtttgatagatcagtaggtgattataattaacattaatctattgtacatttcaaaatagaagaaaataattcaaatgtttctggaatacaaatatataaatgtttaaggtcatggatatacaaattacacccacttgatcatatggatatatcaaattttcacgtgtacctcaaacacatgtacatctattatgtataagtacaattttatttaaaaagtaaacattttagtttttatgaagtagaatttttttaatgaagctagaaagaatgaatacttgggaattcctaagggatgacaataactaatgaaagttttatggaaagtaggaaagttgctgttttattttctctgtaaatttgactggctctggatcaggcctgaaacaattgctggcaaacaatatgggaggtaagttttgtatcttaatcaaaaaattagaaattaagtattcattctttgaaatagaaaatataatgagcacatattattataattagcatttgcaactggaaaaatattggggaccattaaaatttaacaggaatggaatcattcttccatctattaatttttactaatctattggataattctttagtgtcatagtacatcacattgcactgtgggcctgttggggatgcaaattagctcaacattcattctgtcttcaaaaacttgtagactaatatatggaatttagttctaaatattataatccttataatcctataataaaaagtaaaaattagagctttgggagtttagagaaaaatattttcaattgtagaatttagaggaagtattattttcagctgtggtgtggtttgggggaggaaagcttcaagggaagtttgaaggaggagatagcatatgaactcagttacatttggacaaaagtcatggtggtagggttttccatgccaatgaaacaagaggtaaaaaaattatttccatctgggtaaattaaagatacacaaataaaacagaagcaattaacaaatgtaatataaattatttgccaaataattttatagttttacttagtataagaaaaatgttgaacttatgttaatagatctagataatctaaaagctaaaatgtttaagattgacttaatttagaaagttttgaattggtttaaaaggaatgaatgaaaataaacgaatgacttagatgtaatttctgaggaagttttatatgttaatagtgagctattctaaatcttgctaccttcttatagacacattggaataagaatcagttgtacagatatgtactaaagatgatggaatcttgaagtgaatgtacaacataaataagaaatgtatatcattctctttaacatgagcacgtagtatttttaaaactaacttgaaatatagtaaattgtcaaatttaaaatacaggtttggagtattgcattcaatttcaattataaatctcaaaaaatatgagtaatttcagaaactttacaagtaataaaacaaatcttcaattgttattattttattgggtagataaaataaataatataggcaggcacatgtacacatacacacacccatgcatacatagattcacagagatgcacataaacagcatagcacatgcaagttatttatgcatgaaaatttttaaagttatactattataacaggtatagtgccatttgtttaatctctttaaatgaaagatatttacatttaaaaatattccagtaagattcactatgcctattatattttaactttttataatttctattatgtttagtgttatctgtgatattgggccatgcataaaagctaacaataaagaaatttccatgtttccacactgggctgaatatatcctgaaattgaatactgaacaatgaattatattatgcaaaacagaagacatacaagcagaaaaggctgaagtattttaatggcacttcaaacgcttcacataatgggaacatagatggaggcacactttttttctttgatggctcaacccctctatttcagtttcatgaaccttttgttcatgtcctctctaaaagaattttaaagaacattttagatgttgcacatttatgatgtcatatatttttattatctaagttttattatctagaagtggcaaaagatagaatttttggcatattgcatacattgtcattttaaataaaacagttacatttgcttaaaatatctcagatcatccaaattccataatgatctgatacaaccaaactgttacacaatataatgaataaacaaactcttatttcaaaatctgaaattacgtattatttgttttcccccttgtaattatataaacagtgcacttctttcacataaacttaatataatacattttgtatttgaaaattcttattgatcaaagcaacttaagtttcttcagcaaaataatatgtatctaaattgaaattatattttgtaaattttcagttaccataaatctctaaatgctaaattttcttctgtttggttgccaattgtaattcttagtagtaaacaataggtcaaaacaacatgcatctttcatcaattttgggaaataaccaaagtataaaaattattataattatttctaaatgagatggatgagttacgcttttgttttttcaattgacttattatgtatctgtagatagatattacttattgctacagtgagtcaaaacacaatattctgttttttttctcatttaatagggataagtgctgagtaaacctcttcataaacaaatagatgataatacagttatgatgttacagcaatgtttctcaagtctttgtacttttttttttttttttttttgagacggagtctcgctctgtcgcccaggctggagtgcagtggcatgaactcggctcactgcaaggtctgcctcccaggttcacgccattctcctgccttagcctcctgagtagctgggactacaggcgcctgccatcacgccaagctaattttttttttgtattttttagtagagatggggtttcaccatgttagccaggatggtctcgatctcctgacctcatgatccgcccgtctcggcctccgaaagtgctgggattacaggcgtgagccactgcgcccggccactttttgtaactaaatgaggccttcttcaattttgttgtaagcaaataattggaaatccctcaaattgcaaaatgctttgatacctagtcactggtggaattaatttccttaacataagcagtaattttgcaaactgttgaattgttaaacctataggtattaaaccactggacaactctaatataattagtcaaagggaaggctttcttttataaaataggaaaatagtgaaggtgaagaggaagtgggaaccaagatgatgccttcaccctgtgaaaggtgtatgctcacttttactcatacaaatccattttgggacagacaacacatggtatttcaggatacggtaattgctttgctttaaaattatctatacccttatatctttttgagtgtcttcaggtagccaagaggttgcaggcagtggaattggctgttgtttttcatccctgtgagcagggttattctgtcatgagttgctgtaatggcctgaggtagctggcctccaaccaggaggtggtgctttcaagagagcaccagccacaatggtagcagaaggatctaagcttgccctaagttggccagggaaagtattctggtttctcaggtggtgggtggggtcataaagttcccaggagtttatgtcttttgtgtttggctaccagggcgggtagagaaataccatcggctgggggcaggtttaggtgggtctgggctcagactctccttgggaagggcttgctatggccactgtgaaggatggggatgtggttctcaggccaatggggttatgctctggagattattatggctgcctctgctgtgttatataatttgccagagaagtccaggatggctggtagcaaaaaacttcactcagcttccacgcggttggcaaggtggtcttgttcccacagtgccctgctcagatcttgccccaagctatcagcttccctgttgagaaagcaagcttgcctttcaggcctccccctatctcatctacccgcagtatttgctgtgtctccctgtactcgtatctgcatcagttctcatttgccccctggattctgctcaagaaaatttatgcccagttgaaattattacgaatttagttcgaagcgtctttcacactgtgacccctccctaatcctgctggctgccttccccaagggcctctgtgagatatagtctgggatggcttccctgggaacgagctggagactggaagtgcctacaagtctcttcttgcttctgtttctacttttgtattttgtgcaactccctaaatctgtttcagctataggtaaggttaaatccttttcccatgatctggattttcagattccctagtggggatatgtgtttgaaggtaggctttctccctttcacactttgggaactcacagtttttcacttgtctcatggaatttgcaatagtgtgccacttctttaaaaggacctgtaaattatttcagttttctggtacatttctgtgatggttcttggagcaaaagttcatggtgtgagtctctacacactgttctgtctatctaagtggtagctgcatgttagccctgtcttctatctgccatctttgctagattcacctgtattatctttttgatttgttgttggcttcacgttagtggtattttgttggatatttttgcatctatgtttatcagggttattagcctatagtttttggtttcttgcatccttacttggcttttatatcaaagaaattatggcctggtacaatggattaagaacattttccacctattcagtttcttgaaacactttgagaaaaaaaaaatggttttcgttcttttttatgagtttggtagaattcagctgtaaatctgtctgtccctaggcttttcattgtttggagcttttttattactgattcagtcttattagtcactattggtttgctcaggttttctaattattcacagttcagtcatggtagactatatgtttctgggaatgtatatattttctctggattttatctaactttaaacatagtcatttataatttttaaattttttaaatgtaggatctgttaaaatatctcctttatatatgtaattttatttatttggacgttttcttttttctttttttatggttaagctatctagtattctagcaattttgtgaatcatttcaaaaaaacaaagttttgttccattgatcttttgtattgttctttgtccctattttgtttagttttgctctgacctttattattgaattcctactaattttgattttggtttgttcttacttttctattttcttgagttttatttgtaatatttctacttttatgatgtaggcatttatataaacttttctcttgccactgcttttgctctatttcataggttttggtatattatatttccattattatttatttcaagaaatttaaaaattttcttcttaatttctttatgaatacaatggtcatttaagatctggttatttaatttcatgcaggttccaatgtacctcttatttttgatttctagttttattcttttgtggtctaaggtacatgacatgatttcaattaaaaaaaaatcctgagacttattttgtgttctaccatgtgatctatcctaaagaatgttccatgtgctgatgagaagaatgtgtaccttgcagctgttgtataaaatgttctgtaaatatttgttgagttcatatactccaaaatgcaatttaatgttttttggtcatttatttttgtctagatctagatgatatgtcatatgctgagattgggatgttgaagtgtccctctattttcatattggagtttcctctcacatttgatctaataaaagttgctttatatatttgggtgttctggtgttcagtgaatatatatttacaatcattatatactcttgctgaagtgatccctttatcgttatatagtaaccacctttgtctctgtttatcattttttactttaaatctgttttattttatgttagtgtggctactcttgcacacattggatttctgtttgtgagggctgtctttttccaatcttttacgtttattctgtgtctttacagatgaagtggcttgcttgtagacatcatatacttcagtcatgtttttgtaatctattcagccaatgtgtgtcttttaggtgggaaatttaatccatttacattcactattattattgataggtaagaatttataattatcattgtgttgattgttttctggttgttttgaatgtcctttatttctttctctattcaataaggaataatcgtttctctattattgtttatagttatgtttgttggctttctgtaatggtaacttttcaattctttcttgttttcatttgtgcatctgctttaccagtgagttttatattttcatgtgttttcattatggtggatattgcccttttacttccaggtttagggctcttaaagcatattttagcaccagtctagtggtgatgagcttcctcattttttgctagtctgggagagactatacatatccttccattttaaggacatctttgctaggtatattatacttggctgacactttttctttcagcactttaaatatattacacattctctcctggcctgtaagacttctgctgagaaatctgctcatggtctaatatggattcccttatatgtgacttgtttcttatgtcttgtagcttttagaatcctctcattgtctttgaattttggcattttgattttaatttgctttggagaaaactttactgagatgaatctatttagagattttgagcttcctgtggagagttgcaatgtttttgctattctcttgatgaaataattttctatgcctttgcccatctttttccctggaatttctaaaactaatatttggttgctttatgtttttttatatgtctcataggctttttttatctttttaatttattattctttcttctttttctgactgttatttcaaaatacctatctttaatttcagaaatcctttatactgctagatgtattctattactgaagtactcaattacgttttttttattgttaattcttgtgtgtacatagtatgtgtatgtatttatgaggtccattagatgttttgatacaggcatgcaacataatcacattgtaaagaatggagtatccatccactcaagcatgtattctttgtgttacaaacaatccaataacattctattattttaaaatgtacaattaagttattttaaatgtacaatgaagttattatttactgtagtcaccctgctgggctagcaaacagtaagtcttatccattttttctactttttgtatcaattaactttccccacctccccctcaaccccccagtaccctttcctgcctcttataatcatccttcgattctctatgtccagagttcaattgttttgatttttagattccacaaataagtgagaacattcaatgtttctctttatgtgcctggcttatttcacttaacataatgatctccacttcaatccatgttgttgcaaatgacaggatatcattctttttatcattgaatagtactccattgtgtatatgtaccatattttctttatccactcgtctgttgatggatatttaggttgattccaaatattagatattgtgaacagtgctgcagtaaacaagggagggcaaatatctctgtaatatagtgattttctttcttttgggtatatacccagcagtgggactgcttaatcatactggtatctcaatttttggtttttggaggaacctccaaactgttctccatagtgattttacttatgtacattcctgtcaacagtagacaggggctcccttttctccacatcctcactatcatttgttactgcctttctttggatataagccattttaactggggtgagatgatatctcattatagttttgatttgcatttctctgatgatttatgatgttgagcaccttttcatatgcccatttgtcatttgtatgtcttcgagaagtatctattcaaatattttgcccatattttgatcagattatttgatttttttcaatagagttgtttgagcttattacatattctggttaataatcccttgtcagacagtaaatttgcaaacattctctctcattctctggaatgtctcttcactttgttgattttttatttgtttacagaagctttttaacttgatgtgatcccatttgtcgtttctactttccttgcccttacttgtaggttattgctaaaaaaaaattgaccagaccaatgtcctggagattttcctcaaagcttccttctagtagtttcatagtttgagatcttagatttaaatctctaatcccttttcgtatgattttatatatggcaaagggggtctagtttcattcctttgctcatggatttctaatttccaagcaccattaattgaatagactgtgtttttcccagtgtatgctcttggaacctttgtcagaaatgagttcactgtaggtgtgtggatttgtttctgggttttctattttgctgtattggtctgtgtgtttttatgagagtaacaccctgttttggttgctataactctatagtacaatttgaagtaaggtaatgtgatttttcagttttctgctttttgtttaggatagctttggctattgtgtgtcttttgtgctttcatgtaaattttaggattttttttctttttctgtgaagaatatccttagtattttgatagggattgcatttagtctgtagatggcttttggtagtatggacattttaacagtattaattcttgaaatcaatgaacatgaaatatcttcatttttatgtgtcctcttcaaggtatttcatcagtgttttacagtttttattatagaggtctttgacttccttggttaagttaattgttaggtatttaattttatttaattttatgtgtagctatcgtaaatgagattaccttttaatgtctttttcagattgttcactcttgacatatagaaatgctactgatttttgtatgttgattttgtatcttgtaactttactgaatttatcagttctaatagtatttttgtgtagtctttagtttttttcaaatataagatcatatcgtctgcaaacaaggatactttgactttttccttttcaatttggatgccctttatttctttttttttgtctgattacactagccaggacttctagctatgttgaataacagtggtgaaagtgggcatccttgatatgttcccaattgtagagaaaaaatttttatattttccctatttagtataatactagtagtgagtctgttgtatttagcttttattaagttgacatatgttcattctataagcagttttttgagaagttttattctgaagggacattgaatttgttttgtacttttagataatttctccctgctcattaacatccttttttctgattgaaatactaccgttagcatttcttgtaggataggtctggtattgatgaaattccttagctgttgtttgtatgggaaagtctttatttctccttcatgtttgaacaatgttatcagcagatataccatttgaaactaagtactttttttctttaacactttaaatatatcatgccactctctcctgacctgtaaagtttccattaaaaagtctgctgccagatgtattagagcttcattgtatgatatttatatattttatcttgctacatttaggatactttctttatccttgaccttttggagtttgatttttttttttttttaagactgagttttgctcttgttgcccaggctggagtgcaatggcgcaatctcagctcaatgcaacctccgcctcccgggttcaagcaattctcctgcctcagtctcccgagtagttcggattacaggcatgtgccaccacgcctggctaattttgtatttttagtagagacggggtttctccatgttggtcaggctggtctcgaactcccgacctcaggtgatctgcccactttggcctcccaaagtgctgggattacaggcacgagccaccacacccagccgggaggttgattattaaaggccttgaggtagtcttctttgggttaaatctgcttggtgttctataacctttttgtacttaaatatttatatcttctgtgcagcacaccaacatggcacatgtatatatatgtaacaagcctgcacgctgtgcacatgtaccctaaaacttaaagtataataataataataataaaaataaagcttctgcttcagtgcagctaaaaaaaatatttatatctttctttaggtttgttctcttttattatccctttgaatgaagtttctactgctgtctttttctctactctctctttaaggccaataacttttagatttaccatttcaatgctattttctagatcctataggtgtgcttcattgttttttattccttttccttttgtctcctctgagtgtattttcaattagcccatcttctagctcactaatactttcttctgcttgatctatactgctcttaaaggactctgatgcattcttcggtatgccagttgcatactgtatgccatttttcagctccagagtttctgcttatttttaattactccaatctctttgttaaatttttctgatagaattcttaattccttctctctgttatcttaagtgtctttgagtttcctcaacacagctattttgaattctctttctgaaaggtctcatatctctgtttctccattactggtccctggtgtcttattttgttcattttgtgaagtcatgtattcctggatgatgttgatgatagtagatgttcttctgtgtctaggcattgaagggttaagtatttgttgtagtttttactttctgggcttatttgtagccattattcttaggaagtctttttagatatttaaaatgacttgggtgttgtgatctaagctgtatctgctttagggagtaccctatgtccagtaccagtgtggttcttgcagacttgtaaaggtactgcctttatggtcttggacaagatccaggagaattctctggtttacctggcagagacatgtattctcttcccttactttttccaaaacaaatggagtttctctctctctgagctgaactacctaaagctggatgaagtgatacaagcacccctgtggccaccagcactatggctgcactggatcagacctgaagccagcacagtgcttggtctcacccaacgcctgctgtaaccatttcctggctactgccaatgttcactcaagactctggggctttataatcagcaggtatgaaagccagccagggctatatccatttcttcagagtggcaaattccctgaggtcccaggttggtccagtggtgctgttcggtagtcaaggactagagtcaaatccttagaaatctacttcatgttctattatactccagctaagctggcactgaaactacaaggcacagtcctttccactctcttcacgtttttccaaatgcagaggagcctcgctccgtagtcactgccaccacaggcaacagggagtactgccagactagcaccaatgtatttttaaagcccaaggacttgtaagtcagtttctggtgaatgctgcctggcctgttagtcacttttcagggcagtgagctcccatctggccctggacaggtccataaatgccatttatgccccctgttctgggattggggaccccgagagctcacttgttgctctaccatcctgcagctgagctggtacctaaggttcaagaccaagtgccctttacttttccttctgtttttctcaagaagaaggaattttgccccatagccaccatagctggtagtgcactgagtctcacctgaagccattatgtcttagaggctcattcaaggccctcaacatggtacgtgggtatcactgctggttattcagggcccaagagctctttagttaacaagtgatgtatactgctaggaatgggttcttcccttcaagtcagtggattcccttgtatctcagatgttatctagaaatttcttccagtagctagtgcctggaacaggggcttcatttctcttactggtgccctattatactgtggctgaactggtatccaaaatgcaagacaaagtccatcccagtcttttctctcctctcaaatagagggaaggggtgtcttttgtagctgtgagctgtgcttcctggggttaggggaggagtcatgccagcacttccttagccaccccagctggagtctcagtaggttacaggccacccccaaccccgtcaccaaccaagttcactgtctcttggcccagttcatcactaggacttgcctcagcgtcgcagtccttgtggcctctcctgtctttgaggtttacttttagacccagagcactttagccctcagtggtgagcaaggtatgtaagaactcaaattttcaccattgggatggcaagtccccttcagctagaaatgctccttccatgggcaagagtcagctgagtttggtctggttttcctttctgctctaacagcacagctctgagttcaatgcctcacaattactatactctctctcccccagtaccctgagatgctctccacaccatgccaatcctgctgggggataggaaagtagtcatgtcaatgattcaaaactactttttctgtctcctcactgcctatcccagtgatatgaagttaaaaccagtactctgaggactcacctgatttttgtttcttatgaagttatatatttttttcttttctgtataaatagttgtaaaattggtgtcctcacatgggggactatcaattgagcattctattctgccactttgcttcctctctctctcatatattttcttgtttgtatttttttattacattcattaattttttagttctagagttcccatgtgtttcttttttaagatgtctatttctttgttgaatttctcatttatatcctgaattgtttttctcgtttctttgtattatttttccatattgtctttatcttactgagcttttttgataacattatttctatttttttaggcatttctttcttgtttttcttttttggagtcggagtcttgctctgtcacccaggctggagtgcagtggtgcaatctcagctcactgcaacttccacctcccgggttcaagctattctcctgcctcaccctcccgagtagctgggattacaggtgtgtgccaccatgcctggctaattttttgcattttagtagagatggggtttcaccgtgttgtccaggcattagcagtagcagtagcagtggtaggtcaaccgttgggcctctgagcagagcacacgagcaccagtagtggcagcagcaggctggacagactattccaaggccatgaggtggtgcctaaaggagagtgccagagactgcaccagtggcggtaggctgggtagactggtcacttggcccctgggatgtgcatacagtcactggatgtggcttgaatgggcctatttttaggtccccagaaggtgtagatgggtaccagtggtggttgctgggctgcattaatccccaggaacccagataacgtttgtgggtggtggtcatgttgagtgggacatacctgtcctcaagcccttgagaatgtgcaagagcaccagcgtccagtggcagggtggatttatctctaggcctcagataacatttgtgggcactggggggtggtgatggtgggtggaacacatctttcctcatgtccctggatcatgtgtacaggtgcctgatgtggcaggcagggcaggttgatccctaagcctccagatggtttactgggtctctggtggcagtagtggtcatcagtggtacagatttattcttaggccactgatcagcatgtgtggtctttagtagtgacggatggattagattgattcccagttcccctggcggcatttgcaggtgcctggtagtcctgccactggtaggggaaggattgctatcaatggcagtggtcccaggcaaacaactctcaggatctggggagcatacacattggttccctttgtcctggaggcagccttccagatggactgaaccatccattacccagagtgtaagacactgtgtgagctagagtgctggggaccctcctgcaccactggatccagttggtggtgtgatactgcagccctctgagtgtatgtggagagatgtcagtggggtttcagaaatgaggaaatgcagggattattggaccctagggcaggatgcagtctggggtgctggactctcaaaatggcactgtgctgcagatgcttgggtctcaggggctgtgtgggactcagtgtgagctttctctctggaacaacaccatcacgtggattccacgcacctctgcgtactaaccttagggcctggaagtgctctcctgtggctacaattctaagaatccaaggtgcgaatgttgacggctggagatatcttgcttaccttttcccagcaatagggagttcctgctggctacaagccaattccagtggggctggttgctttgcttccctcttgttctgtgcctcagagtttccctgtcacttcactttggaattccagtgttctctcttagaagctctatttaatgtgtggttagctcactgttaagttgttcttttttggagaaggcaagtcccggtcacctctatttagacattgtgaatccccctcctatactgtgttttatctatttaaaggaaacaacaataaactgttaaattaactgcagcttttcttatcaatttattcttgcttataaatctacaatcatttttaattaaaaaatcttttaaggctttcatatgaatagctttaaatttataattcaatcaaaagataatagacaagaaaaaacagaatgtagtgtgatctttttacattttttatactaagtatgccatatgtatttgagaagtacatagcaaatatcttactaatagagctgttaagattatggtttgtgggttctgttagccaaagttgaaaccccacttgggtattcactgattatatgaacttactcaaattacttcttaatgaatatttctttctccatctgtaaaatagtacctgtctcataaggtttttgtaaataaggcagtccatgtaatttgttataatacttggtatgtaattgatgttcagtaaatattatttgttgtaatttttaaacatatcatccttaggataaactccaaaattgtaaggccttgagtattctgatctctacctatcatttaatatatgggagttttatgtattagaaaaagatctagatttacattgcagagatgagaaaattcaaaccatgtagtgacttaaaaatattttttctaaattataaaatataagttcaaagggaccaaaatctgtgagaaaagagtttgaataaattttggtttagtttcctgactaaaacattagacaaaaccacaaattatggaagaaatccccttgaaagttacatttaggagagaaaattttctgaacctagattcatttcaatgttaagggacttgtttcttgtttctaatattaccttgagtgacatttctatctaaaattgacacttataatatctaattttatttgcttctaggtgagttcttggatgaagtgcatccttatagcttctggggactaatctcaagtcatctgaatttattaacaaatccatgatctgagataaatgactctctagattcatgctatagttatttgataagtgttgactatcattaacccaaaaagccacattttggaggagcacaaacttcttgtagaattaatatgatattaacataaaatgcttcattttatggggtctggttcagaaatgcattgctctcccatctccgtgatcaaattggaccataagttacatgctgggctgctttttgttgctttgggatgctggtacgctattatctcactgctaatggtagccttagtggcttcccccggtgttccttccaaagtttccaggccattgttttaaaaatatgttttggtcttttatagcaagtggttgttaacatgttgtttgtataatagagaggaagtggaacttcacagtctttactggtggagagccattttcagttgccgctttgcttattaacaagaaaagatcttaatagtttctgagaaaattcagtcccttttactcaacttacaatctctgtggggtttatagagaatcttttacagagaatgaaaatctgtgtttaaaagaatgtaaagaggttatgtgtgggattataaatggtatttaagtacatattaggcatgctttcacatttatgtttatacagaattcaaaaaaatagtgcattcagtttgctgtatcccattcaaatatttatcccttcgtgattaattacagttacagaaatgactacatagtttaaaaggttaaaaatgaagaaagattgtcctacggatttttggtactagttctttgcatgtctggtagaatttggctgtgacttcatcatgcccatagctcttttctggatggtagggtttttttattagtgtttcaattttagaacttgttattggttggttcagtggttcagttactttctggctcaataatgggaggttgggtgtttccaggagtttacccatttcttttagtttttgcagtttgtgtgcttataagagttgataattgtttgaggatttttttttttttttgctatggggttaattataatgtagctttgttgtttctgatgtgcttatttggatcttcttttttttcctttgttattcaagctagtagtctattcttatttattctttcagaaaacaaattttggttttattgattttttgtattttaatgtttcaattttcagttcttctcgaattttggttatttattttcttctgctagattttggtttactcttgtttttctagttcctctgggtgtgacattaggttcttaatttgagatccttctatcttcttgatgtaggtgtttagtgcttgatatggtttggctgtgtcctcatccaaatctcatcttgaattgtaaatcccgggtgttgagggagagatgtggtgggaagtgatttgattatgggggcagtttcccctatgctgttcttgtgatagtgagcaaatattcagatatgatggttttataaatggtagtatttttccgcactcacacacacttgttctctctcgcctgccaccatgtaagacgtgcctcttccccttctgccatgactgtaagtttggcctccccaaccatgtggaagtgtgagtcaattaaacctctcttctttataaattacccagcttcaggtatgtcttgatagcagtgtgaaaatggactaatacggtactgtaagcttttctcttaatactgatttcgctgtttctcaaggattctgttatatcacgtctttttaattaatttcaaataattttttgatttctgccttaattttgttctttacgcaaaagtcattgaagaaaaagttgtttcacttccatgtaattgtatgattttgagagatcctcttggaattgctttctatttttttattgcactgtggtgtgagagtgtgcttattgtgattttattttattttttgaaatttgttgagacttgctttatagccaagcatgtggttggtcttagaataggtgccatgagtagataagaagagtgtatattctgtgtttgttgggtgtagtatcctaaagatatctactgggtccgattggtcaagtgttgagtttaagttcagaaatatatttgctagttttctgccttgacgatctaatgccagcacctgttattttttgactttataataatgaccattcagactggtgtgagacggtatcacattgtggctttgatgtgcatttctctaatgatcagtgatgtagagctttttttcatatgattgttggtcacctatatgtcttcttttgaaaagtgtctattcatatcctttgcccactttttaaagaggttgttaggtgttttttaataaatctgtttaagttccttatagattctggattttagaactttgtctaaatgttttttcccattttgtaggttgtctgtgctgttgatagtgttgtttgctgtgcataagcacttttgtttaattagattccatttctcaattttttcttttattctaattgcttttggcatctttgtcatgaaacatttgcctgtgactatttcctgaatgatattgctaggtttacttccaaggtttttatagttttgggttttatatttacgtctttaatctatcttgagttattttttgtatcttgtgtaaggaaggggtccagtttaaatcttgtccatatggctagccagttatcttagcactatttattgaaaagggaatcatttctccattgcttgtttttgtcaggtttgtcaaagatcagatagttgtaggtatgtagtcttatttctgagttctctatcctgttccattggtctctgtgtctgtttttgtaccagtgccatgttgttttggttactgtagccctatagtatagattgaagtcaggtgggatgatgcctccaggtttgttccttttgcttaggattgccttggctattttggctctttgttggttccatatgaattttaaaatagtttttctggttctatacattgctttgaaaagtgtggccatttaaacaatattgattctttttatgaatgagcatggaatattttttcatttgtttgtgtcatctctgatttcctttagcactggtctgtagttgtccttatagagatctttcaccttccttgttagctgtattcctaagtattctattcattttgtgtccattgcgaatggtcgtacattcttgattgggctcttagcttgactgtttttggtgtataaaaatgctagtgatgtttgcacattgatttttatatcttaagactttgctgaagttgtttgttagcttaagaaactttttgactgagactatggggttttcttgatataggatcattttgcctgcaaacagggatagtttgacttcttctcttcctatttggatgccccctaatttcttgctcttgtctgattgccctggtgagcacttccaatgctatgttgaatacgagtagtgagagagggaatctttgtcttgtgctggttttcaagggaagttcttccagctttttcccattcactttatgttggttgtgggtttgtcaaagatggctttttgaattttcagcattcttgtgctgattctttctcatctttgtgggcttatctaccttcaatctttgagatcgctgacctttggatgggtttttcttttattttctcctatttgattatcttgagtgcgtgattgtggcataaggttgattcagccaactggctttgtttctgggagatgttagaaggcaaacactcagttcccaactcctgggctgtgtgctctaactctgggggacttgtatcgagccccgactttgttctctggctccttgaggtttggagtccactgcgctggcagtcctaaggtgcagcagcttcagcagagtgttagtggatgtaggggtggctgcgtcactgcaggcattaaccacagtggcacaagcaaggcagctgaggggggcaaggggcgccttctggatactgtgcgctcttgaactggaggtgatgttgccttggggctgggtgctggccagtacaggtctgggtgccttctctgtgcctcacaaacaggagtgatccctcagggtgtgagaggatcctctgttctcttcaaagtgttagcacgagggctggatgctggtggaggtagggctggatgctggtggaggtagggcttgctggttctgtgcctgccaagactccaactgcagtggtggtcctgggggacagagggaggagactacactcatgtgtgctgatgggacaggtgaaaaaaaacccactcttgcagacacgcaccagctgcagtatggggagggtacatctggggtggtgcacagccctaggggccgccttgctggagctctacgctggtaaggcatagcctgccagcatggaagctatggtgtgggccactagggcactcaagactgacctgtaagcaggtgtggccaggctggggccctgggaagaccaatagaccaagaagtgctcaggtcggaccaggcccgttggatgagcaagaccgctctgcagagattgggtctgacagttcccctagggctaaagtctcctatgggagcaagtcaagcctatagggatggctatcgctggccatgctcaactacagacactcctgcaccaaaccctctacatcagtggccttgctgttccaccagttctctaagtagttctccctaccacctcaagtgtccatggtggacgatgggtctccttcgcaggcttccagaggcctgtgatgagagtgggttgctccttgccagttcaactcaccctttctcctgaggtggttgtggttcaaaaatgaatcccagtgtgtggcagcccatgcagggtttccaactttctcccccttaatcccagctcctgtgtctttcctctgtccactttcagtgccttccctctgaagatctgttgaaaggacaccagttgcctcagtctctccatgggaggtcttccacttgtctgtgtctagctgaccatctttccttcccccctactttcttgaggcacagagttaagttgtttatctgaaatccttcttctttttcaatggttgtagttactgctgttagtgtccctcatagtactgcttttgctgcattccataacttttggtatgttttatttatttttgttttcattagtctcaagatgttttctaattatttttgtgatttcattttgtacatttgttgttcaaaagtgtgttgattaatttctatatatatgtgaattttccaagtttcaactattgatttctagtttcatttcactgtgtttggaaaaggtacttgttacgatttcggtcttcttaatttgttaagatttgctttgtgacctaccatgtgatctatcctggaagatgtttcatttgctattgagatgaatgtgtattctgttgctgctcagtgtaatatgtcttttgacctattaatatttttcaatcctttatttcctcattaaactgtttttttatttccattatttaatttttggtttgaaatactctattattgttttactatttcttcatttaattatgttaatgtttatatatttgggttctcttatgttaagtgcatatataattgttatatattctcagataaatggcccttttatcgttatattcttgtaagagttttcacttaaagtactttttgtctaataagtatggcaacctgtactctcttttgatgctatttgcatgcaacaactttttcccttttactttcagtctatgtgtgtccttcaatctaaagtgagtatcttatagacagcatatagtttgatattgttttattcttttcctatcaatcaaccactctacctcttttgattggagagtttaatacatttacatgtaaaggaattactgatagggaaggacttgctgcattcattttggtactgtttactttcttgacatagctattttcttctcctcttattctcttgctgccttcctttgtgttttgttgatattttgtagtgatatctttccagtattttctcattttctgttctatgccatctgtgagtattttctttgaggtttccaggaacttataaaaaacattttatacttatgacaatttgttttcagctgataactatgtaactacatcagtgtacagaaactctgccattttacgtctcccccactttgtgttattaacatcacaaattacatatttttactttttgtattcaataacatagttttatagttataataattttatacttcataagtttgatgacagaaataaaactgatttgcacacatatatttatgacatacaacatgttgtttcaatatacatatacggtgtgaaatgattatcaaaatcaatcaaattaatgcagtaatcacctcacagttacctttttttcttttttgtagtgaggacacttgagatctactctcttagcaaatttcaagtgtacaatacattattgttaaatattgttaccatgctgtacattagatctccaaaacttataatagaaaatacatataatttaacaacgtctaccagtttacccaccccctgacacttggcaagcacccctctactctgtttatatgagattgactttatttatttatttattgttttgagacagagtctcgctccatagcccaggcttgagtgcagtggcatgatcttagctcgctgcaacctctgcctcccaggttcaagtgattctactgcctcagcctcactagtagctgggattataggcctgtgccaccacacccagctaattttttgtatttttagtagagatggggtttcaccacgttggccaggctgctctctaactcctgacctcaagtgatctgcccacctcggcctcccaaatttctgggattacaggcatgaaccaccatgcccagcaaagtttgactttattaggttccatgtatcagtgagatcatgcattgtttgtctttctgtagtggcttatttcacttaacataaaataccccagtttcattcatattgtcgcaaatggcatggttttcttatttttatggctgaataacaatgactaattatatatatatatatataaacatatataaacattctatttatttatctgtagaaagatgcttaggttgttttcatatcttagctattttgaatgacatggtttggatgttttgtctctccaaatttcatgttcacatatgacctccaatgttggaggtgggcttagtgggaagtgtttgggtcttggcagtagatcccttatgaatgtcttggcaccatcctcatggttatgagtgagttctcctcctggtagctcatgtgagagctggttgtttaaaatgagtgtggcgctttcccccctcactcttgctcccctctctcttttgctcccactttcaccatttgatgtacctgcttccccttcaccttcttcctccatgagtgaaagtttcctgaggcctcactaagagaaaatgctggtgccatgctttctgtacagcctagagaatgacaagccaaaacaaaaactttaatttttacctacatttattgagtctcttcggtctggtagaacataactgaacctagtcatttctgtagaactgttaactcagtaattttttttttttttgaggtggagtttcactcttgtcacccaggctggagtgcaatggtgcgatctctgctccctgcaacctcgccgcctaggttcaagcgattctcctacctcagcttcctgagtaactgggattgcaggcacccgccaccacgcccagctaatttttatatttttagtagaggtggggtttcaccatgttgaccacgctggtctcaaactcttgacttcaggtgatccacctgcctcggcctcccaaagtgctgggattacagacatgagccactgcgcccggcaactccgtaatttttaaattcaatccataattttctacattaggaaaggttttacattccctctccttttttttctaaggtggtatttaactacaggtgtagatgacaggctcatttagaatcaaagatgtattcagagaggaattatctgattctagattgtcatgtgtccatctcatgtatcctttgcaataaatatcgttctgtattgctctcagctgtaatcatttttcatcctgatattacctaagatagtcatgctatctctgaaatcgtagttgtaagattaatgctgttttctactacaacatgacattatttcaacaatgagatccttagaatctaccacctaacttccttgcttgtttcaaatccttttttttttctttgcttacttttatgcctttcctgggagcagagaaaaatcttgcttctctcttctgtcacgctgcagccacaaaaagcttcacaaactgtctcagagcaaactgatctttctagtaaaacttgacctctttgcctaatttgtctgctgttacacgatgctgaagtgtagtaaaggctggagtcttgaagatctctaagtcatatgataaacaaagcacagatttctactctttgtaaattgtattctatttggaagttctattcccctcaccttcctcaaaacttgaatgtgctttaagtgaggcataattcaagatccttttaagaaacactctccagcatctaatatgtatgtttcttttcttactcagcctctgccccctcttgccaagccaagcagttttagtgaaatgtctgccgtggcctcccttccattggacagtggcagccaaagactagcttgagtagtgaccaacaatttgggagacaaagttattgcaggtagatgtgcacagacacatgcacacataggtaaatatttcaaaaaataactttgtcacagctaaccctattctaatattgctatggaacatacaatatgataaacacatagtacatattcagtatgtttgtgaatttaaaaatgtattggttctgctctcttcaagacagagatattacatttgaattcatgtaagttcatttttttgcattgatttactatgaattaaaagtaaaacaaataaggaatgtataccagagaaatcgtcaacaccttgggagatactaagatggatttacatgtaaaatctgccctcaatgagtttatatgctaataggaagagacatatttgttcataaataactctaacacaaagcagattgtgtgccataataataagacatattaatagctacaatttattagactttaatatctgccaagctccatgcttggtacttcatatacattaacttatttattgcacataacaactagtgatgttgttgttatcatttcagtagaaataaaaaatcagagaaagataagattaacatgagtggggtgggattaagaccttcctcattaatgaagcaacatttaaactaggtctttattaaaatgggtgggaaacttagaggtgtatttggagaatacaatgttattggcatcaaaataacaagagatttgtgaggggttaatatgattaggaatgtactttgaagagatttctgatagaagtttgaagatcagagagtaaaaataactctctcatcaagaagaataaaattaaatgttaaatgcatctttaatgaataattggcacattaactgaaaattgcagattttaataactctataaattcttataacttaagcaagtctacaaatccatagtccagttatgcatcagtgctcaaggtacagtgaaattagaagccaatgacatgtatgtccccttttaaaaagccggatatttaaatgtcttttgctatcaaacacataaaaatcttcaaaaatgccattatttgataattacattatatctattaagtaatgagtatttgatgactatatttcaatccttgaaaaaagaaagaaactatagttatctaataatgtgattgattcacctaatccaagggacctctcttttgaatgaatcctataattatttatggtctttaatcgagcttacatagacaccaatttttgtcacctcaactttatgttataaatgtgttaatagataagaatctggagcaaaataaaaagatcaaagattttacaagtctaggcgataaaatttgatctgaactaaaaatcaaatttaaaaggcactcttttaagcaatgtttctgtccattatagctgagatttaataattaattactgatgtctccataattttctgataagattatggggctaataaaagcaaaattacatatttttgtaattgtataagtcgattagctttccacagataaacacaccatcttttctcagtgctattgatgaaaattatgctcaacaaaccactgatttcattagatattgataggaattatgttagaaagagattctctggacaacttagtttgagaaagtactaacttcaaaattactgcgaattacttcaaaataccaacttcagattttcattttgttttgtttttattataaactttctcttcacgtttaaaatgcccatatgcactgcaaatttctaagaaaataatatagtatgtagtatttcttaaaattatatcacagaatcctttattatgtaaactttttacccaaatattaagctataaaatatatttgaatattccgctgtatgccatacaataaaaattcttgtaatatgtgttttttaaaaatttttattataagttccagggtacatgtgcaggatgtgcaggtttgttacataggtaaacgtgtgccatggtggtttgctgcacctatcaacccatcacctaagtattaagcccagcatgcattagctatttttctcgatgctctccctccctcaacctcacctaccaacaggcccaagtgtgtgttgttaccctccctgagtccatgtgttctcattgttcagctctcaggtataagtgagaagatgcagtgtttggttttctgttcccgtgttagtttgctgaggataatgacttccagctccatcaatgtccctgcaaagcacatgatcttatttctttttatggctgcatagtattctttggtgtatctgtaccatatgttctttatccagtctatcactgatggacatttgggttgattccatgtctttgctgttgtgagtaatgctgcaaagaacatatgtgtgcacatatctttataatataatgatttatattcctttggatatatacacaataataggattgctgggttaaatgatatttcttgttctagatcttagaggaatcatcacaccatcttccacagtggttaagttgattcacattcccaccaacagtgtaaaagcattcctatttctctgcaaccttgccagcctctgttatttcttgactttttaataatcaccattctaactggcataagatgatatctcatttttgttttgatttgcatttctctaatgatcagtgatgttgagctttttttcatatgtttgttgaccacatgaatgtcttcttttaagtagtgtctgttcatgtcctttgcttactttttaataggcttgttttttttcttgtaaatttgtgtaagttccttgtagattctggatattagacctttgtccaatggatagactgcaaagattttctccattctgtaggttacctgtttgccctgatgacagtttcttttgctgtgcagaagttctttaattagatcccatttgtcaatttttgcttttgttgcaattgcttttggtgatttcatcatgaaatatttgcccgtgcctatgtcctgaattgcctagattttcttctaaggtttttatagttttgggtcttacatttaagtctttaatccatcttgagttaattttcatataaggtgtcaggaaggggtccagtttcaattttctgcatatggttagccacttctcctagcaccatttattaaatagggaatcctttccccattgcttgtttttgtcagtttcgtcaaagatcagatgattgtcgatgtgcagttttatttgtagtttctctattctattccattggtctacattcctgtttttgtaccagtaccatgatgttttgtttattgaagccttggagtgtggtttgaagtttggtagtgtgatgcctccagctttcttctttttgcttaagattgtcggggctatatgagctcttttttggttccataggaatattaaaatagtttcttctagttctgtgaagaatgtcaatggtagtttaatgggaatagccttgaatctataaattactttgggcagtatggccattttcacaatattgattcttcctatccatgagcatggaatgtttttccattcgtttgtgccctctctgattttcttgagcagttatttgtaattctccttgaagaggtccgttacttcccttgttagctgtattcctaggtagtttattctctttgtagcaattgtgaatgggagttcattcattatttggctctctgcttgcctgttgttggtgcataggaatgcttgtgacttttgcacattgattttgtatcctgagactgctgaggttgcttatcagcttaagaaccttttgggctgagatggtggggttttctagatataggatcatgtcatctgcaaacaaagacaatttgacttcctcttttcctatttgaataccctttagttctgtctcttgccttatttctctggccagcactttcaatactgtgttgaataggagtgttgagagagggcatccttgtcttgtgctggttttcaaagggaacgcttcctgcttttccccattcagtatgatattggctgtgggtttgtcataaatggctcttattattttgaggtatgtttcttcaatacctagtttattgagagtttttaacataaagggatgttgaattttattgaaggtctttcctgtgtctattgagataatcatgtggtttttgtcttttgttctgtttatatgatggattatgtttattgatttttgcatatgttcaaccagccttgcatcccacagatgaagccaacttgatcgtggtggatacgctttttgatgtgctgctgtattcagtttgtccatattttattgataatttttacattgatattcatcagagatattggcctaaagtttcctttttgttcttgttgtatctctgccaggttttggtgtcagggtgatgctggcctcatagaatgagttagagagaagtccctccttttcaattgtttggaatagtttcagaaggaagggtataaggctcctctttgtatgactggtagaattcaggtgtaaatccatctggtcctgggctttctttggattggtaagctatttattactgccttaatttcagaaattgttactggtctattcagggatctaacgtcttcctggtttagtcttgggagggtgtatgtgtccaggaatttatccacttcttctagattttctagtttatttgcatagaggtgtttatagtaatctctgatggttgtttgtatttctgtggggtcagtgctgatatcccctttatcattttttattgttgtgtctatttgattcttcccttttttccttatcattagtctagctagtggtctatttattaatattttccaaaaaccagcttctggattcattgatttttttggaagggttttttgtgtctctgtctccttcagttccgctctgacgttggttatttcctttcttctgctagctttggagtttcattgctcttggttctctagttcttgcagttgtgatgttaaggggtcaatttgaggttttctaggtttttatatgggcatttagtgctataaatttccctcttgacactgctttagctgcatcccagagattttggtatgttgtcacttcattctcattggtttcaaagaacttcttgatttctgcctcaatttcattatttatccaggagtcatgcaggaacaggttgttcagtttccatgttatggtatggttttgagtgagtttcttaatcttgagttctaatttgattgtgctgtggtctgagagactgttatgacttcagttcttttgcatttgctgaggaatgatttacttccaactatgtgatcaattttagagtaagtgccatgtagtgtcgagaagaatgtatattctgttgggtggacaattctgtagaaatctatcaggtccacttgatccagagctgagttaaagtcttgaatatctttattaattttcagtctcaatgatgtaatattgacagtggggtgttaaagtctcccactattattgtgtgggagtctaagtctctttgtagatctctaagaatttgttttatgaatctgggtactcctgtattggattcatatatatttaggatagttagatcttctcgttgaatttaacccctttatcattatgtaatgataatttatctttgttggtttaatgtctgtttcatcagaaactaggtttgcaacccctgcttttttctgcttttcatttcttggtaaatttttctacttccttttattttgagtctatgtgtgtctttgcttgtgagatgggtctcttgaatacagcatgcctatggatcttgatgctttatccagctttccattctgtgtcttttaatttggacatttagcccatttacctttaaggttaatattgttatatgtgaatttgatcctgtcatcgtgatgctagctggttattttacagacctctttatgtaggtgcttcatagtgtaactggtctgtatacttcagtgtgtttctgtagtggctggttactttttttttaaacatatttagtgcttccttcaggagcttgtgcaaggcaggcctggtgttgatgaattccctcaacatttggttgtctgaaaaagattttatctctcctttgcttctgaagtttagtttggccagatatgaaattctagacttaaatttttttcctttaaaaacgttaaatatagccaccaccccccccatttcttatgacttgtagggtttctgctgagaggtctgctgttggtctgatgggcttctatttatgggtgacctgggctttctctctagctgtccttaacattttttgcattcattttgaccttggataatctgatgattatgtgtattggggttgatattctcatggagtatcttaccggagttctctggatttcctgaatttgaatgttggcttcttgtgctaggttggggaaattctctggaataatatcctgaagtgtgttttccaacttggttccattcttcacatctctttcaagtacccctatcagtcgtaggtttggtcttttaacataatcccatagttcttggaggttttgtttgttcttttatattatcctttttctctaattttgtgtgcctgccttatttcagcaaaatagtcttcaagctctgatatcctttcttccacctggtctattgagctattaacagaagttacatagttatactagtgtttgcattgtgaaggtctcatgttgtgtttttctgctccatcaggtcattcatgttcctctctaaactggttattctggttaatagctcctgtatgttctagttaatagcttctgtaatgtcttatcgtggttcttagcttcttgcaatgagttataacatactcctttagttcagtgaagtttgttattacccatcttctgaatcctacttctttcaatgtatccatctcagcctcagcccagttctgtgcccttgctggaaatgtgttgagatcacttggagaagaggcactctggctttttgagtttttagcatttttgctttgatttttttctcatcttcatgggtttatctacctttaatctttgaggctgccgacctttggatagggtttttgtggggtcttttttgttgatttcatggttattgttgttgttttctgtttgtttttcttttagcagtcaggcccctcttccatagggctgctgcagtttgctgggggtccactccagaccctattcacctgggtccctcctgcaactggaagtatcaccagtggaggctgcagaccatcaaagatggcagcctgatccctcctctgtcccagaggggcaccgacctgatgccagccagaatgaacctgtatgaggtgtctggagactcccattgggaggtctcacccagtcaggaggagcaggatcagggacccacctaaataagcagtccggctgcccctcggcagagcaggtgtgctgctctggggggattccccctcgtccaacctgttctgactctcaaaaaccagcaggcagaaaagattaagacgattgatccacgataccatagccatccctcctcctaggtgctcctctcagggatatcagagttctgtccataaacccctggctggggatgctgaaattcctgtagggaggccccgcccagtgagaaagagtggattggggtcccacctaaagaaatattctggccactacctgcttcagatactgtgctatgctgtggggaattgctcctggtccatactggccagtctcgctggcaccagcagtaggggaaaaaggccaactggagccgcagtgattgcgactgtctctctcccccaggaactaagtcttcttaggcaatctccagcctgctgtgctggccagttgggattccaagccagtgagttttaccttgtggggctccatgggagtgaggctgcttggcttcctggcttcagcccccttcccactggagtggatggatctcttgccttactagagttcccagagccagagtatgcaaatactcctgtgtctcagtgcctgctcgagtttctgcccacttgcgcagcctctgtgagtctgcacagcagtgttcttgggatccaaggccctggtggcgtgggctcacgtggggacctcctgatcctcaggttgcaaggatccgtgggaaaagcatgatcttcagggaggctagcacaatccctcaccacctcccttagctggaggagggagctccctttgcgctgtgtagctctcgggtgggccctcactccaccctgctttttattgctctctgtgggtcacgccaaccacctagtcagtcccaatgagagaaccttggtacctcaattgaagatgcagaattcactcgcagttttcatccttcttggtgggaggtgcagagcagagctgtttctatttggccatcttggctgctcccctccatatgtgttgtttttatgttcagattcaaataatcctaatacatggggaaaaattaatgatttctttctctatgtgtatctggttggctactttattcaaataatacttagatggatgctgattggacacatttcataagccaatggctatttgctgcatggtgacagtttagtttctgtttccctgaagtcggagatttaaacgcaaagaatttacttgggtgggacagggaacaccagcagaggcattgatgtgtaagacagggaaggcaaggcagctgataatgagtatgttcttaagccagttaccacaatggacaaccaaatattaatcttgcaagcaaatcctgtaaaacttttcaaaaatgcatgctttcacattatcccagctatgggatgctggaactgtgatgttcatacctgcacaccaaccagtcatttgttaagggccgtccttgggagttaggagtgggttggggaggtgataagggagattgttttctaggcacttctgggcaaaatggtctctggcagtactactcaagacattatctgttaacagaacatgtttaccaattatgggaatagctttccaaattgccagtgcatatgaagtggtgaatagattgcaaggaatcatctaataatagattaatggggcttgagaacaagatggtgaattgggcatgcatttcttacctcctattgcattgaattttcaagacatggggaaaaagagccttgcaagggaaaaagtcattaaagcagtggaaaataagaaatggtaccaccagtagtctagaaatgttgagagacttctaacaagaggaaagtaggtagaatggcattggcaaagaaaattagatcccaaaatatgcagagaggcttcttataggtaagaatggttctgtggaagctctaagcatggggtcacttcatgaagaaatggaagagagtcttgaagtgtatatcagggtgattaattagaaaactttggagcagcaaagttttttttttttttcctctccacttcttttatttgtgttgaatacttggcagaaggccatgagtattagtcctgaggctgagaatgaacagcagagctcatattgcctttagacacccagaagaggcggggaatctctgacagtcagaggacaactgtatcaggaacatgttccctttcccttcactctgccagagcagaccgtggtaaacagattaggcaggagatggagacagaagtgctcaaaacaattctgagcacaccaacatgaactatcaaatatctgagggaaataaatatcatagaaagcaaaatgctaaaattaagcaacaggagatttaacactcccctccttcaccagatgagggggaggggagacacttaatatggtgtggttgaagagtagaatgttctctgataattggtgaattaccaagtaatattgaaccaaataattctttaccaaagcaagtgaaatgggtacatgctggaacataagagggaaaaccgaaccttggtgaaaagagatccagatatactattgttattctaggtagatttccagagagagaggttaaaataaatgtaaagaggaaaagtaactaaatcatggaagaaaatttcccagacttactgctgaccaccggcaagttggatggcaaaaaggataaatgttaactatccacacgtagacacatagtgatgaaatgttagaacagtgacgataaagataaaaacctttaaatggtttcacacagaaaaatgaaacaaaaacaaagcaaaaacatgcagagtctccacaaaagagaatgagtcatatcactgtcacacttattatctacaacatcaggtaaaaaacgtggagcaggaatacttgatattaaataatagcatcaagaaaggctcatcaacattaaatacaactgatttgttaggaaagagaagtaaaattcatcaaatgcctaacggattaaaacttttgtaatatgattttatctcacctagaggtagataaggcatagagatactaattactcaaagcaagacagaagttatgagtagatgtatgatacaaactcatgtcttttagatgctatgagctcttgtcctatccattgctatattctttgtatttctttttattattattcaaaaaatatttgtgggtacatagtaggtgtatatatttatgaggtacatgacatgttttggtacaggcatgcaatgtgaaatatgcacatcatggaaaatggggtatccatcccctcaagcatttctcctttctgttaaaagcaatctaattacattctttgttatttaaaattatacaattaagttattattgacttattgctaccctattgtgctgtcaaatagtaggccttattcattctttctatttttttgtttttgtatccatgaaccaaacctacccccatctcccacccagcctccactacccttcccagcctctggtaaccatccttctactctctgtgtccatgagttcaattgatttgatatttagatcccacaaataagtgagaacatgaggtgtttgtttttctatgcctgacttatttcacttaatgtaatgatctccagttctatccatattgtagcaaaagactggatctcattctttttatgactgaatagtactccacatttttctttatgcattcatctgttgatagacacttaggttgctttggaattttagctattgtaaatagtgcagcaacaagcataggagtgcagatatctcttcaatatactgattttctttttcgggggtatatacccagcagtgggattgctggattttatggtagctcaatttttagtttttggaggaacctccaaactgttctccatagtgattgtactaatttacattcccactaacggtgtaccagggttcccttttctccacattctcaccagcatttgttattgcttgtcttttggaagccattttaactagggtgagatgatatctcattgcagttttgatttgcatttccctaatgatcagtgatgctgagcaccttttcctatgcttgtttgccatttgtatgtcttcttttgagaaaggtttattcaaatcttttgcccatttttaatcagattagtagattttttttcctatagagttgtttgagctccctatatatattggctattaatcctttggcagagaggtagtttgaaaatattttctcccattctgtgaattgtcttttcacttttttgattgtatcctttgctgtgaagaagctttttaacttgatgtgatcccatttgtccatgtttgctttggttgcctgtgcttatggggtattgctcaagaagtctttgcctagaccaatgtcctggagattttacccaaagttttcttgtaatagtttcatagtttgaggtcttaaaattaagtctttaatccattttggtttcatttttgtatatgtcaagaggtaggggtctagtttcactcttttgcatatggatatccagttttcctagcaccatttattgaagagactgtcttttccctagtgtatgttgttagcagctttgtcaaaaatgagttcagccaggggcggtggctcatgcctgtaatcccagcgctttgggaggccgaggcaggcagatcacgaggtcgggagttcgagaccagcctggccaacgtggtgaaacctcgtctctaataaaaatacaaaaaattagccgggcgtggtggcagatgcctgtaatcctagctactggggaggctgaggcaggagaatcacttgaacccgggaggcagaagttacagtgagccgagaccatgccactgcattccagcctggacaacagagcaaggctctgtccccaaaaaaaaaaaaaaaaaaaaaaaaaaagagttccctgtaggtgggtgaatttgtttctgagttctctattctgctccatgggtctatgtgtatgtttttatgtcagtacaatgctattttggttactacagctctgttatataatttggagtcatgtaatgtgatttcttcaattttattctttttgcttaggataactttggctattctgggtcttctatgattccatataaattgtaggattgtttttctttatttatgtgaagaatgtcattggtatattgatagacattgcattgaatctgtggattaccttgtacagtatggacattttaactatattcactcttgcgatccatgaacatgaaatatctttccatatttttggtttcctcttcaattttctacatcagtgttttatagttttaatatagaaatctttcatttctttggctaattcctagatatttatgtgtggctattgtaaatgggactactttttaaatttctttttcacattgttcagtgttggcatatataaatgatactgatttttgtatattggttttgtatcctgcaactttactgaattagtttgtcagatctaataattttcttgtggagcctttaggtttttccaaatataagatcatatcactagcaaatagagataatttcaattcttcccttataatttgaatgccccttatttatttctcttgtctgattgctttagctaggatttacagtagtatgttgaataacagctgtgacagtgggcatccttgttgtgttccagatcacgaagaaaggctttcattttttctctattgagtatgacactagctgtgagtctgttttatatggattttattatgtgggtgttcgttctttctagtcccaatttttttgtgggtttttatcgtgaagggatgttggattttatcaaatgctttttcagcatcccttgaaataatcatatggtttttatctttcattctgttaatatgatgtatcacactgtttgatttgcatatgttgacatatacttgcatcacagggataaatcccagttggtgatgatgaatgatctttccaatatagttttgaatttggtttgctagtattttgttgaggattttgcattaatattcatgaaaagtattggcctgtaatttttttctcctcctctgtttttttggaataatttgagtagaattgatattaggagttctttaaatgtttggtagaatgaatcattgaagccatcaggtcctgaccttttctttactgggaaactttgtattacagcttcaatttccttacttgttattggtctgttcaggttttggatttcttcctaattaaatattggtaggttgtatgtatctaggaatttgtcaatccattctatattttccaatttatttgcatatacttgctcataggggccactaatgatcctctgaatttctgcagtatcagttgtaatgtctcctttttcatatctgattttatttggattttctttgttttttcttagtctggctaaagttttaccaattttgtttagcttttcagaaaaccaatttttttcattgatattttgtattttttaaaatttcactttcatttatttctgctctgagcttcattattttatttttcttttactaatttggggtttggtttgctcttgcttttctaattctttaagatttttagttagactgtttatttgtattttttcctcctttttgatgtagacacttaaagctataaacttacctcttagtacttcttttgctgtatcccataggttttggagtgttgtgtttccgttataatttgtttcaagaaaatttgcaatttccttattaatttcttcactgacccactggtcattcaagagcatattttttaatttcagtgtttttgtatagtttccaaaattcctcttgttcttaatttctagttttcttccattgtggttagagaagatgcttaatattatttcaatgtttctgaatgtttttaagacttgttttgtgacctaacatatggtcgatccttgagaatgatccatgtgcttaggaaaagattttgtattctgcagctcttggatgaaatatcctgtaaatatcaattagattaatttcgtctgtagcgcagatgaagtctgattttttttattgattttctgtctggaagatctgtccaatgctgaaagtgatatgttgaagtctccaactattattgtgtcagggtctatctctctctctttagctctaataatatttcctttgcatagcaatcaagcaagacccccatctcaaaaaaaaaaaaaaagaaagaaaaagaaaagaaaagaaaaaaaagcaacagcagccatgaggatatttggaagaaaatttgacacatgagtgctgttggtaataactttgtaaaaattacacaagccatggagcatgttgttatgacaattccagactgaaatatgagcgtaagacaacatagttatatcaactgtgacaagcttccaatttgctgttattacattgaatttcacgtgcttgcattaacatcagaaatacagtataatatatattagatacacacatacacagatagttttaccacccccctcctaaaaaaaaggagaaatggaaaggcatttctatataaacaataaaataacaaaagcaacataataaaccaaagtacttgtaaagccacaacataagcaaggattgatgtcccccaatacacaggactgatatggttctgtaaagttgcagctgatgctaatagcatggcttggaagcagtcataatccagaatgcatacaaaggcataagaaattctcattctgaaagtgagtgcttaacccagaaacatagattacccaaggaagcacaatgccattggtagaaacactccagtaagtgttaacactcatactggcacactaggaatactagagtactctatactgacttaaatacatttaataccctcaataaacaaagggatcaagttcattgtattggttattagttagaaattacgaaaaaaaaatgaaccagggaacaataagtagacatttatgaagaataactattgtggtattttgaaaaaaaatgtgttgaaatacagtaaaaatattaacacaagttttttgctgaataaacacagccaaaaaataagttagtaggcagaaaggtcaggtgtagcagtattctgaaacagattttaaaatatatataaaaaagggaagccatgaaagagaagactggaaaaatatatagatcaccttaattttttaactaagatttctgaatgaaagggttgaaaactgatgggtccaaaataattgaaaaaatcataaataaaaattttccagaattgaaagtacgtatggatcctgatattggaataactcttttggtatatagcagggcaaatgaaaaaatgaaacttgtccagaatcttgtagtttcaattttgagtcacagataagaagaaatttctagaagttaaccacagtacactttcaaattcccctagagagtggttaaaaattctcaacaaatgtgtcaatattttccaagtatgaaattttgggcgattaatatacatgatggctggtgttggtgctcttacttttttctgtttctttcagagtagaaagtaatgtttaactacattaatcctatttaagatttcttttcaatcattatttaaaactgctatagcaattaaaggatgttttactgtttggtattatgtcatagatttgaaaattattgctgtaaaatatcatcagtgttttaatgaatggagagcatcgtctatgtgtattctgaattcttagtcttgctgcccacatgtattaaattgtatgagctattgagaagagaagaatctcataagtaaacaggaaaaccaggataatattcctataagcactctgatactatttttctccttgctacaaaatgtctttttctactttttaaagtgattcatatttattttttatgaaattatctatctttgaatctatatagtctatcaatatatttgaatatacaaaatcatctctgtggctactgttttatataatatccctcattttaattcatatattttaagttacctatgatttaaaacaactaatattggcattgaatttcaaaatctacagattttagtgtcagtttaatggaatatgcaagcagaggtcaacggcatgatctttttataaatatatatttaaataaactattatgtacgcttattttacataagattatattctctgaagttcatgtgacagctttcaaatgtagctaacatggattgtctttagatgaaattacatcttctttgtaagctatctgttccctttaccacgtatttaactactaagcatggagtaaaggggaaaagatacgagtcagtgtctaagtcaaggatataaaataaaatacctcctatctctgaaaagcttagactgcaaaatttgttgagcaaatatgcatagtgatttaacagtttaacttttcttccctcatatcagaacattcagctaatgtatttactatgagaatttctactgtttttatgagtggaagattgaggttaggttgaggtacaaaataaactacctaacaaaaaaatccgcaagcaaacaaagaattgtacttatctactgctcaaaatttgggaggaaaagagatgttatgtaccacagttaaaaatatatttctgtatatagccatgcccaagggcagtaacgatgtcttatttaaattattacccctgatgcctacaacatataattttgctacacagttgagtaagctgcctatataaactaaggtttaaaggaaagttcacagatacttaatagaattgatagttaaagtacaaataagactttatatgcctggttattttgtaatgtatctactctagagtattggaataaaaaacatgaaggacattggcctgcactcttcaaaactatcaaggtcatgaaagacagacctcttcctgattaaaggagacttaatagatacaatacctaaatgcatatgatttggatcctaaacaaggaaaacaaaaagattttttgttgttgttattctatttttttttttttttttgatatggagtctcgctctgtcgcccaggctggagtgcagtggcgcgatcttggctcactgcgagctccacctccggggttcacgccattctcctgcctcagcctcccgagtagctgggactacaggcgcccaccaccacgcccagctaattttctgcatttttagtagagacaaggtttcactgtgttagccaggatggtctccatctcctgaccttgtgatctgcctgccttggcctcccaaagtgctgggattacaggcatgagccaccgtgcccggcgtgttgttgttattcttttgcaataatggacatgaaattaattggtgaaatctgaaaaagtttttagatctaaataataatagtgtatcaaagttaatttcctgattttgataatgtcctatgacaagcttgtccaacctgccaccctccagccacgtgcagctcaggatgactttgaatgcggcccaacacaaatttttaaattttcttaaaaccttatgagttttttttttttttgagactcgtcagctatcattagtgttagtgtattttatatgtggcccaagacaattcttcttccagtgtggcccagggaagccaaaagattggacacccctgttatggctaagtgaaagaatttccttggttttttttaaaaaaaggaagcactgcaacatttagaaataaaaggcatcatgtctgcaacgtaagagtacacaggagaagacgtagtaacagattaacatttgaagaatctaggtgaatattatacaagaatcgtttgctctataattgcagcagttatgtaaatttgaattttttgaaggtgatgaattaagatacagactaaaagcacacttccaaaatggcaataacttataggtgagttcagtgaattggcagggaagggaacaatagaaagacagcttggaagattttcaatagcagctgtccatttagtagaacaaatcagcagttcctgcttttttctcaatgctgtggcattgttttcactggggctttaaagggaagtggctgcatgccagtttctgtgttctcatccagctgttcagacactaaaatgacttaagtaacaaaggctgaagtttgagaagccatgcagtttgcctccaagacaagtgaacatgttaacagaatatttacaaatttatttaaaatggcaatcattggtcctgagagatagggaagaaagcgttcttacttaactaagaaaatgatcagtaggtgaaatatccaagaggtgtttcttaatacatctctattctgctcctattttatcctgttatactgcagttccctgaattctcaaactcagaatttgacaaagtagaaaaaaattaagtgaatttacttgatgttttgaaaacaaaacacaaacagctttgcctagtacatgtataaagttattacatagtcgctatagattgactttccacctttcaaaataatagacaacaaaaatgaatctgaatttgtaaagcacatttaacctcctcaagctcttgaaataaagttattcattagcaatatctcaatgattaaattcaggataacatgggattttttgaaaaagtgtgaaagcaaatagaagcatttaatagctggtttactattttgtgttctgtggaagattatgtttcaatttaataaataatgaaaaagaacatttccttcctatttttaagtaaaaatatgagttgtattcgagcatggttgtggtgcacttcttttggagacttacttagttatttaacttgtaaatatccaggaaatctgaaaaactaaaataaaccaaatattttcattataagtagcataccatttgaatatttaaagtatgctacaaaaataacacgtaaggtgtacacttcttgttaagaagattaaaaaaagcaatgcttatagtcttccaactcactcatcatggggcttcattatttgaatttattcaaagagtaaacaagcaaaacctctcaaatctcattctgcataaatctgataatggttctgaccaattaaaacttaggtgaccaaaatagatcatctgtactttattatgtggagcacttcacagaataattatttgaaggataaataaaagttaactactctccattttcaaagctagcaaaaaccagttccattgtatgttttcaattaagcaacacaatttaccagaacccaaggatttttataagcagtttatctacccctaataatggactagacagtaaagtaacttgatctctgccttttgttttttttcttggccaaggaggtgatggtaagtaactctatttgcagtggtgtgagagccctcttttttctactgtaatgcagtgatttttgacttcacattattcctacatgataccttccatgctattctaatgtctatatataattttctgtaaactactttatcatagactgtatcatatgaggcatttacgaattatttcaagcttcaattctatggacggtcacttctaatggaaaatccacagtccaggatggtctatctggtgttttataaaaaaattcacactccagaggtggctaccacaagcccctgtgctatctgtatctccaccagtaccaagcattttgctgaatttcatcctaaatgtcaaaaggagttttaatcaattaaattaaaaattttataattggcatgattactttcattggtgaaattacaatttttcttattatttagtttggttataatatttttaagatatctccactgttaaaatgaataagatataataatgtaggaaggatcatacaaataatgtgattcagtaattctactactgggtatatatccaaaggatttgaagtcaggatcttaaagagatccccgctaccctatgtataatgcagcattattcataatagccaagatatagaatcaacctaagtgtctgtgtatatatgaatgcataaagaaaatgtggtgtatttacataaagtaatactatttactttaaaaaagatggaaatcctgtcatttgcaacaacgtatattaacctggagacattatgctaagttatataagccagacacagaaaaacaaatactgtatgatcttatatatggaatctaaaaatgttgaattcatagaaggaaacaatagagtggtgattaccagacctgggacttggggagattggagagagatattggtcaaaggatacaaaattttagttagatagtaggaagttcaagagacccatggtacagcatggtgactacaattaataacaatatactgtatgctggaaaattgctaagatatttggtgttctcaccacaaaaacgaaggataagtatgtgaggtagtggatatattaattagtttcatttagtcattccacaatgtatacatatgacaaaacatattgtacaccataaatatatgcgatttttgtcaagttatcattagaaaaagaaagccctgtatatgtttagcataaggcatgttcagaaaacaactgaaaagtctccaaactttcacctcaggctgaggcctaggctcattgcaatcctggatatgtgttaaggaagagcaccagcacagggacaatctgcaaatactgggagggtaatattgtttgttgttgttggtggtggtggtggggtgtgtatgtgtgtgtgtgtattttgttgtcatttttataaacttatattcaagaaaatctctgtcaaaactctagctgaacagagacttcggtgatgacttatgacaaggaacacatggatgcatacactggtccctgaaatagttgagtattatagccttcaacaataataacatcaaaacaataaaccctggaaaggaggggaatttgattccacagttatcacattataatacttaagtgcccattttcaacaagaaaataacaaagcatacaaagaaaatgaaaaacatgacccatacaaagaaacaaaatgaattaacagaaaccatctctgagtaagcacagaaattggacttattagacaaagacttttaaaatgtcttaaatatattcaaagtcttaaaggaaaacatggacaaacatgtaatgaaacttcggagaataacgtatgaacaatatgagattagcaattagaagatagaaatttttaaaaaataagcaaacaaattgtagaactgaaaagctcaatagctacaatgaaaaaacactagaggcactcaaaagtagatgtgagtagaaataagacagaatcagcaaacttgaagataggttaattgaaattatgcagtctgtagagtgaaatgaaaaaagaaatgaagaaaagtgtacaaaggctaaggaacctgtggaacactgtcaagtggaccaacatatgcattatgaaattctaaaaaagggtaaaagaggaagatataaaggggcagaaagaatatttgaaaaaatcatagtcaaaaactttccaaatttgttgatagatctagcttcatagtcaaaacccaaacttcactgagaattaaaacttttccccttttctgcttgtatcagtctcaaaaaaaaaaaagccacattgcaatatatgtccctttatcctttttgttcattcctttctttttttaagctacacagagcacttcttttcccttaactcacaggatatatttgctgaaccttttaggtttaggctcacaaatagaagggattaaaagggaaagggcatatgttttctagtttggcttttggcagatatactaagttggcatattttctcatagggtgttttaattaatgtgaacttgtgagagattcccctgctgggaatcttcagttgaaattcctacaaggtgaacttttttttttcttcaataagctttttactactccagccataaattttgagcattcagcagtccacccctttatatatttttaattgaattatttgggagttttattgctattgagttatttgtgttccttatatattctgtatattaacccattgtcaaatgcatagtttgcaaatactgtcctttatttttgtacattatctcttcactttgttgattgcttcctatgctgtgcagaacctttttagtttgatgtaatcctatttgtctgtttttgcttttgttgctggtgttattgaggtcttattgaaaaaatatccttcccagaccaatgttgtgaagcatttcctctatgttgtcttctagtagttttgtagttttagaccttaaatttcagcatttagctcacttgagttgatttctgtatacagtgagaaataaggatctagtttcattctcctgcatgtgaatattcagctttaccaggaccatttattgaagagacccttctttcaccaatgtgagttcttggtgccttttttaaagaatcatttagatataaatatgttaatttattgctgtgttctccatttcgttccattcatctatatgtctgtttttaaagcagtgccatactattatgttactatagctttgtagtatattttgaagctagatggtgtgatacctctaagctttgttcttgcttaagattgctttggctattcagggtattttatggttccacgcacatttcaggattttttttttttatttctgtgaggaatgtcatagttattttcatagggattgcattaaatctgtatattgctttgggtatttggacattttaacaatattagttcttctattccatgaacatgtaatatctttctatttatttgtgttctcttacatttctggcatcaatgctttatacttttcattgtaaagatctttcacttccttggttaaatttattactaagaatcttattttttgtagctattgtaaattggattcctttcttgatttttttcagatagtttgctattggcttatagaaatgctattgatttttgtatgtttatcttctattctgcaacttactgagtttattaagtctaacagttgttttctgtacagtctttaggattttctatatataagattatgccaactgcaaacaaggcaattctacttcttgctttccaatttgaattgtctttatttatttctcattcctaagtgcactggctaggacttccagaggcatgctgaataatagtgataaaagcggacattttgtcttgttccatatcttagagagaaagctttcaaattttccctgtttagtgcaatgttggttgtctgttgttgtatatgaccttcattgtgttgacatacattccttttatacctaatttgttgagagtttttatcatgaagggatatggaatttagtcaaatgctttttctgtgcctattgaaataatcataaggttcttgtctttgattattgtaatgtgatgtatcatattcgttaattttctttagtggttgttgaccattttgacttttaattatcatactagacatctgaaagattgtatatcagcattcgagtaatgaagtattctgaattttacaatgaatttacccataaaagtgaggtgtatactttcatatgtttgcgtgatagtaattattgtctttttgctcccacttttgacattccatttagcattttttgtaaggcttatttagtagtgatgactatttttccttcatttctgaaggaaagctttgttgggcataccatgctagccaggcaatttttttttccccagtacctttaatatagcatcccattctttcctggcctgcaaggtttctgctgagaaatctgctgatagtctaaggggaattttcttatatgtgacttgacactttactcttgctgttttttagaattttttctttgacttttgacaacgttattataatatgccttggagagggcttctttgacttgaatttatttcaaatcttttgagcttcgtgaatctggatgtccatatctctcccaaatcttgggtagtttttaggtattgttttgttaaatagtctttctgtgcacttcttcatctcttctccctttaaactccaaagatgcaaatatttgattgcttaataacgttccacacatcctgtaggctttatttgctccttttgattgtttttttttctttcttgctgactggcttatttgaaaagacttgtcttcaagttcagaaactcattattttgcttgatacagtctgctcttgaaagtctcaattgtatattttagttcattcattgaattctttagctctagtattcctgtttgtttcttttttggtcatagctgtctctttgttgaatttctcttttggatcccaaactgttcatctaatttagtttgtctgtctgtattatcttttatcgtaaatttccttgggtcattattttgaattcctttttaggaaactcataaatgtttatttttggagggtcaattataggaaatgtattgtgtttctttagtagtgtcctattcgctttcttttttatgtttcctgtatcactgtgttgatatctgtgcatctgatggaacagtaaccacttccagtctcatacagtgtctttcatggggaaagactcacctgcccatgtgttgtagggtgttggttgagcagggtattttggatttgcttctgggtgaatgccgtaatgtggtctccatccagtttcttcagctataggcaacatcagtgatgcctgagtgtgcctcagtgtgcctcagtggttcatgctgtaacagtgtttgtggctggtctacctactcagttactgctccttgatagtggggcactggtatagtctgtgttttggggatatttagggctggtcaacttgtgacttgggctttgcttcactaggggctggacagtgggctggtccatgctgtggggtagcatggggctggatatctgatggctctgctcaggagttgttccccttaaggtagggtacgaagctggtccatattctggaaaaacatgaaactggttgactggcagcttggattgagatctgctttcctgaaggcaaagttccaagctgatccatgcttaaaggaagtgcaaggatggctggcaagcagctcagctcagtcgctgctcccctgagggtggagtgatggggtcatggttgttccactggatatagatttcaagtaggttgggttggggtgctatagcccctgaagtaaggaaggtactgtacctcctaggcagctttttcctaggagtagaaagctgtaacagctcagctgggtaatgctgcgctattgtgtgcaagcatggcgtaatggaggtggagcctcaaagatggaaagatgcagtagctactggtccccggaaaggacatattttattactgactctggtttagggatggcatcttgcagtaggggtttgggtaatgtggggaaaagggcatgatgttagctccttttctggagcaatccagctgtgtgaactcctgaaagctcccaaaactggatggagagcctgagaaaactgcaagattctccagcagcaaaacctacaggtgtctacagcattgatgaggagtgctgagggccttctgtttactttctcccgacatgggaaagtccctcctggttctgagctgatcctaactggagaggtggcatggcaatgtcaagatgtctcactcctttctttatgtggcaatcttgagtgtctgtgttccacagaatttctgccagtctcctgctgtactttagcattctcattcaaatactcttgtcaaactatagttgtttatttgtcgtttttgtccttttgtgtggtgggtgacaagcaccaagcaccgagcacctctagtcagccatctttctgacatcgctctcttaatatctcttattgtctcatttgaaatctgttttaccaatacatttcccattacatgtcaccagtaattatactttgacagataccaatgctgattaaaggcaaagtaaaactgaagaaatatttcattacctgaatgaaaaaaaaatcacactcctctatgttatgtcacagttaactaaaactaaatactaatagtcctgagtactatagtaggtacatgagccacatattttactatttatactatggtttgtattaaatttaaatgttctttgagttcagtatttttaaaaagtagaaaggaattcaaagatctcaaaccagtggtacagcctcagctaaggcacacagaatgtttctccaggtaatatgtctctaagcatgagctatcaatagcttttctatttgtattccaattataaggagcttcttgaactggaattttcagagaagccatgaaaatgtactagtttagagactctatgaaaggaaataattctgatgtaatttttatataataatttctaatatgcattgtacattaggtacaacattttcttctctatttttctttatttgacaagaagaaaattaaaggtcagtatttttgatatttttcttttctctttttttatcattctacaaaagatgctaaagttagtctatcagtctgaagaccaattgtatttgaagctaacctatatagcaagattaattttttctgtcagtggttttctgtcactaagcaaatggtccaaaatgagccacttgactaactaacattaacatgtaattgtctagaaatctaaatagtatactactcgtattcaagaaaaaaatacatttggaggattcctgtcactttttttttttttttttgatgattcagggaaagtacccatgaaatttagatttggggaagggcataggggaacatagtataattgcagtctacttttactcaccagtacttcaagagtaacattctatcccatttttactaaaccattatatgttgaaataagattcatttcagatgtcattttgcaaaattcctgttaagatttaagcactggaaaaaaattttttaaactagtgcaattactttcttttcagctacagattttcttgacatgactagccacaactgtctaatattttttatattttaataaacactgtataagaggaaacacaaattttctccaatgaatgcctatcaacacacatataataactaattttcttgacaggcttaacaacggataatgtattactatttagcaaccaattctagtagacagatttgaaaaacaaataagctgttgtctagttctatttcaatatatatactcattgctaatttaaatgtagacaaaatcttactcagtcctctctataagtcaagctttatcttgcaggcaaatgtagtcagatatgtaatttgcttgtcagctattgccatgtgttcagaaatggagttatttttaacattttaaaacaaacttagattcttaacccaattaatattatgtctgaacctaaaattaccaaattatgttggcctccatacccattctgtgcacatacatacacaaacacactcatagatcatttatatctactaaagcatttgtttttcattttgctgtatatagataatttcacaaaaagtaaagcaaaatcttgagagttttaggaaaggcagagccatctactgccttcacctgccatacacaaatattaattcaactatggttttgagaatataaacactagaaaagctgatataatataaaaagtttacagcatgtcaaccactgtgaacaagacatttaggtcatttttaaacagttacttatccccccaatcatgtgaacaatacagcttctgaattaaccacctagcattttaggaaaaccagaaggagaacatcagccatctttttatctccctgtggtaggcaggaagaataaccctcccccttaaaaaaagtctatgcccaaatcaagaaaacctgtaaatatgttgtcttaattggcaaaaagaaactttgaagacataattaaagttaaggaatttgagatgggaagttattcttaattattcaaatgggcccaataaaatcacatgagttcttaatagtggaagaggagggtagaattgttgatgtgggtcggagagactgggtgatggaagaagaggtagaggtgatttgaaacgtgtggaagactccacttactgtttctgtctttgaagatgaagaaaggaggcagtcttagtctgttcaggctgctataacaaaataccataaactgaattattataaacaatagaaatttatcacagttgtggaggctaggaagtccaagatcaaagtcctagcaaattcagtgtctggactcactgtctggctcatagatggcactttgttgaagtgtcctcacatgtcagaaggggcaaggagcttctttggggctcttttataagggcactaatctcattcatgatgcctctgcccttgtgatctaatcagttacctcacaagggccctacctcctaacaccatcaccttgaaggttaggatttcaatatgtaaattttggggagacataaacattcagaccatggtatgggctatgtgccaaggaatgtggacagcctctagaagctaagaatgaccctcagctgaaaaccaccaagggaaaggagacctctcttctaaaactgcctggaactgaattctgccaacaacctgaatgaacaagaaaatagattctcccttagcgacaccaggaagaaatgcagccctgatgacacctagagtttagcatagtgcaaccaatgtcagactttcaacctacagagctgaaagatacatttgtgctgttttcagtctctaagtttgtggcagcaatagaaaatgaatacactcttcttacaaattttgtctgcatatttttattggagtgggtttattttaaaacaagataggacttgtgagtttaaactaaagattcttagaacattctggaatgatatttatttttatgaaataatttctagtttaaacacatgaaattgattttagcttgcattctaagtcatctgagatttgaaggatgttccatgtcttagtcttatttattggggcaactttgcaattccaaaaattatatacacaaaatgaactcctcttgtttctgtgtcactttaactagagggtctatgtgcaagacaaaataccaatccttcagatttatttatttatttttagacggagtcttgttacatcgccaggctggagtgcagtggcgtgatctcggctcgctgcaacctctgcctcccgggttcaagtgatcctcctgcctcagcttcccaagtagctgggattacaggcacgggccaccatgcccagctaatttttgtatttttagtagagacgggatttcaccatgttggccaggatggtctcgatctcctgacctcatgatctgcccgcctcggcctcccaaagtgctgggattacaggcatgagccaccgtgcccagtccatatttatttttatactcaagctttccctttacaaactttacccaaattacagtgataatgccagttactttttcataagaaacagggcatctgcaacattgattatcaagtggttctgaaattcccactgcccacactttgttctctcaagactttgagcatcataaactaactataatatacattcatcatgaagaaaagatttactttttacccttaaaaaatcacaacctaccagccgggcatagtggttcacgcctgtaatcctagcactttgggaggccaaggtgggcagatcacctgaggtcaggagttcaagaccagcctggccaacatggcgaaaccccgtctctactaaaaatacaaaaattagccgggcatagtgatgcatgcctgtaatcctagctacctgggaggctgaggcaggagaatcgctggaacccaggaggcagaggcagcagttagccgagatcgtgccactgcactccagcctgggtgacagagcaagactgtctcaaaaaaaaaaaaaaaaaaaaaaaacaagctaccattttctttgtctgtttctgccacaatgactcagtgtgcaaagtagtatgattcacgggaagtctaaacaatctatttctttgtagactacacacacacacacatatatatatatacacacacacacacatatttacatatatgcatatgtgtgtatatatatatacatatatatatacacatacatataaaggttgagctcaataaagaaaaaaaaaaatgccagttagccattgtgtgtgctttactcgattgagaactttttctaactgagaatgagctttttccaacttaaacctatttgtaggtttgtgccaagtgaaaacaaccagtatgagcataattttttatttgaattttcctgttaccttttaactcacttatactgtttatattatatgaattttgtatctgacctcctcattttgttggtagttgtattcatttgcctttctatctgtccccaaaatcaccgaactcattgaatgacaaagaaaatgttctcagtagaaatgcttgttgactccttgtgctcaaagagctggaatttaaggaaaatagaccttgagttaaaagacaacatttcacgatgattaaaaatgatagagacaggtgtcaaacaaacttaaaatacatatgcaattaatttgaggtacagttagtagggaacacttgttgagaaatctaaattggcaggccatcactctaagcaggagaaataacaaaagaggtcacttggggagattcaggagacaacccagccctttgttaagaactgtcagggaatacaattgagtatgtatggagggcaacaagatggaaagttattcacaagatatctgaaaaacaaaattggtgtttctgaacaggagaagaatgagagcaaagagaactaacatttattcagcaattactataagccaggcactgtggtatttgtgtatgttatctgtttaaatcctaccatcagtccagaaaataatattatctctatttttagaaaaacaaaccaagattcatagaaattgaagtcatatgagcagttgatagggtttaaacctagaactgcctgatctcagtgcatctgcacttgttctataatattgagagattaaattctccttcaacacttttgagctataattctgcagaatatcagtaaagatatttgaattgtccatatgaaatcattcaacactgaagttcttaattcctttttaacagtcctttttaaaatcaggtaacaaattcttaattgtttttcaacttcatgccatctctatatatgagtattattatttgactacttttaggtcacatggaatctacacatggaaggacataggcattgcatgcaggtatccggaatcattgatattggtcttaaaatttggaagtttccacttttgctaaggtatgttttccttaatggtggaggtttactaattgggtgtacctccagatctaattctttcatgtaatcctcatatgataggaagtaatgagatgaatatcattaggcattttcaaatttgaattgaaacatattacgatatgtttatattagagactggacaaaattatcattaagattctaaggttctacttatcattaccatgaatgggttttaaactgctaactagttaaagaactgtaaatgaaaaaagaaaaaacaactttgatcactcctagctatcaaattaccatatttaaaaatgtctaaaagtcattactgttgaaactatgattgtttagagtttagacagttgtatacactcaagcagggagtataaaaagggtcgctattctagaaatcgttagcctatactttaaaaaaattatagccattgatactgtgataaactttacctgaaatctgttcatttgtttaagtatagacaacttaatgtctatatgttaagtaatgtcagtgttaagtaatgtctatacttacagaaattaacagattttaggaaaaatttatcagttatattgattatagcttaacttgtattaattttttaagatacagacacagtggccaaaataaagaaaaggtcgatacattttatccacaaaatgggaataaaattactttttttttttgagatggagtctcgctctgtcacccaggctggagtgcagtggtgtgatctccactcactgcaacctccacctcctggcttcaggtgattcgcctgcctcagcctccagagtagctaagattacaggcgtgtaccaccacacccaacttaatttttgtaatttttagtagagatggggtttcaccatgttgcccaggctggtctctaactcctggcctcaagtgattcacccgacttggcttcccaaagtgctgggattaaaggcatgagccacagtgcctggccaataacattacatttaaatccaatttaaaatgtttctattctttagcatgattgcaatataatattagataaaatacataataaagttaataaaatctctaagagaaatgactgagaagaaattgttaaaagtattaacaataattaactgagaaatcatgggttatgagtgatttttaacttttgattataactttggatttctctatgataatcagatattgcttttaccaaagcaaaaagtttattaattgccaattgtagaagccaatttgcctgtatattttatagacaaagaggatttgtttgttttccttgttctacattacattaccatgagttctcttagaatttttaatttaccacttattattcccactgataaaataattcaagttgagtttgagtgtattcattcctttccaatcttggttttgaggtaatatgattttttatttacataccatttaatatcattattaccaatgtgtcatttacatgaactaatttacttaattttaagtgtaaatgtcaatgaattctgttagattgtatatcattttatttgtgcttgctattttaatgctccaagtttaaagttagagtgtgaataacatcctcccccaccttcacacttacaatactgaagcccattaaagcccaggttaggaggatttcctgcttcctcctctcttctactttccttctaactccatgaaatatttaagaatccccccctgaggatcctacaattgttaggaatgtagtcctttttgtttcctcagtcatccctggggctctaaattgagcaactcaatctttattttgaagccaaagactttcaattgccaccaaaatttgctttgaaagtaaccagtgttggataacaacctgaaaacttgggagcccagtgtgaagctaaggggcataggtagccagcaatattacttcagaggtggtatagctacattacatttaataaaaacagatcttcaacattcagttatttttagattctatgatgttagtttcccatttaaattgtatcctcataaccaaccaccaacctccaatcctcacaaaatctttcctgatggtcaatcatggagggggcggacataaaataaaaatataaataaacagggtcgggctggtaagagaaaccagaaactgagaagacaaagttagaaaccagtaatcaacatgaaaatgtaaggttccaggggattttaaaatctttgggagagttttgggttacacagactatggaatgaaaattgaagaaaatttatgcagttagcaaaagctaaggagatttgaaaaatgtgttctttagcacctcaacaatttctgaaaaggcctggagtgaaggtaatgtaagtattttgctgagactttcaaaaacaaaaccagggagatggaaagtataacataaaataatattgaggaaaaacaacaacaaattattagaaacttaaacaagaaatatagtttggatggcaaaatcttcaaaaggaactgtattcaacacagcagtacaaagtcacagggatcctgagtacataaggtcaatcaggaggaaaaagggggctgtgggttaaggccaataaaatagaattgtttttgaagtgaaagcctcaaagaaattttatttacaaagatttttattacagcaatatatttaatgtaatatcatcgagagtctcctaaactatgttttgagaccttaaacctctttgagcattgcattgtaatctatgctacttttcaagaatattaccactgtcaccagtgattgaatattaaacatttcctgtgtttttctctctgtatatttctccccactcttcctgctctttacttctgtactaacttcttaaaactatagttaagggcccacaaactcaaatgccgtcagggatgaagcaggcaaaggcaaaatgaatgtatcacaaaagtaggtgatggagactgtgaaaagacagtgtgtctggctttttttttctctctctgtcaaacacacacacacacacacacacacacacacacacacacacacacacttctatagtctgaatccatggagcactggtttgtaactccaggtgtaattatagtggcctctggagtaagacaaataggaaacccactttctacatttgtaagaaatgttgacttgggcaagttatctcacttctataagtctacatttcctcttttgtaaactgggaataataataataatacatatatataatatgtataacaacaacaatataatatatatatattttaaatattttaatctcatttttcaagatggggattactatagcactttttgttaaggaaatattgagaacacatttccatcttcagtcttactccactaataatctactaagttatttgaaccagattagttttataaatctattttaaacatttttaatatttaaatataatatttagttaattatatttgttcctaagaattccaaagtataaataatttgatattttaacacaatttattttcttctttcatttcatgttcctagtacgaactcttatgaaaggaagtgaccacttatgctattttgacttgattcatttagcaagggagaagttacaaatatgctgtccaaaagatgtttgtatggaaacagtttctcccacttcagtccccagattaacagggaggattagtgttattgacattaatatttataaataccatttagatgttcctccctctttttactcttctttcaattttacataggggatatgggctatgaagtgggcttgtcccatatctgaccctgaaggcttgagagagatagtatccattgaatgaagaaaatggcctgatgaaaatatgttgtacaaataagcacatttttaaaagtatttatttactctttatattgtattggtatatagtatgttttataccaacagttatctactgaaaatgaaaccctagaatgtaaacatgattttggcctgtgaaattcccagaaagaaaatttggaatagtatttcagaaaatcctcttatcaaatacttctgtagatgacaaaagtaacttggagggatcatcacactctagtaaattgttaaaagggttttttaaattaatgttagttgcttggtagtggcagtgaatcaggtgaacacgattacaattttccttatattttaaactgaaaatattaaatgggaaaaataaaaatatgagtcattgaggtaaatgcacaaaccagtgctcatgcatgtacacacgtacacacctaaatttttaaaggtcttttcacatcttaatatcaggaaacaagataaatatataaggggatatcaacaaattaataatatagaatcttaatataatgacatctatctaaaagttttcaagacaaaataatttctatttaaatagtgaacgtagtatttaccttttgtctttaaccagtcctttcgtgataataaatagaacaaatactgtgtcttcactgcatattcaaggtagtctaactgctataaaaaagaaagtcaataacttagcaaaataataattaattgttctttgaaacaacagcccaatgtgtttgtttatgatcaactggcccggttatccagtattgaaagtccatctgggagacacagaagggtgagagcagtgtaagggatgataaattatttaatgggggcaatgtatactatttcaatgatggttaaactaaatgcctagacttcaccactatacaatatatccacgtatcaaaacggcatttgtaaccccttaatttataattgaaaaaaaaaagtttatcttggggaatacacatagcttctcttaactgtcttggtctgggaatgacacatggcatttctttttttcttttttggtaatagttaaacccatgggcctacctagttgcaagaagctggtaattatagcttagctgtatgcccagggagaccaagaaaaccaggtactgattaacatttacagtctctgtcatacccataaagaaaataatgaagtgtttcagttcatttttttctggctttgccatttaatgctccttaaaggtgtcaatatgtttcatatgaaggtaaatgtaacaatgaaaacaaagcattaccaagaaaaataataattatcaaacataacaatatttctcctataattataatacttgtatttcaagatatgtagttcagcctttgaaattatgtaattctacttggatggtagtcatgagccttggcagattagacctgggcatttgggactgaactaaatagttggtctttacctcagttccaaaaagtcaaaacgacatatgaaacaatgtttgagaatgttgactctttattctaacagattcattactctaagcttgagctaacccccatgtattaggcagcacatagcatctatttatccagcttcattcagctcatattatttgacacaaagtatcacaagaatgtatttttcataattatataggactttcccactctcctgaaatacttttctcttcctttgtagcaacattattttccaaggaggcctcctgaacatgttcagtggctcaaaagatacagtttaagatcaggactgtatatgaatgaatgctatagtgttatcaaaccattaacctctgagctaatatgattatctgtacttgggttggacaggagacatctccaccccatcatttactttgtatcagagattgaataaacatctggaactctgcccaaatagcaatgcacatgatgatcaattagtagcaccatttttttttgttgcactgtatgcataaactacaaatgcctcacactgttcccattacatcttttcatctgcatattgaccaacataatcaataaaggtctattggagactttctgtttaggatccagctttgggagtacaattaataattcaagattttctaatgcatagaaaattgtcatttattacaatagtccctcagtttttcccacgaactgagaaaatacactgaatgttttctgccatcttggaccacattaatcacaatgtcttacccaatcctgaaaatccagttttaatgcctggtcctcagaaccatgatgtaaatgttttaggttataagaaaatgaaaaatttgtctagcccattcaataagtacagtagtacctagtgcagcattatcttgattcacactaaagtctagtagactcaaaatggttaactcaatattgacagaagtgctgaatgtttctattaagaaggtcttctctgactccttccgactactgtgggtttatcattgagctctcttatattttttctccagataaagtagaatctgattcatagcaatattgcatggtattgatgtgatctattaacagttaaaactggaaacagttcgccttgacaatgtcctttgaactattcagtggcactccgctttaacacacaaacttcagtttgcaaataaactacaatatctctctttcggacatactttctgtgcaaaattccataatcttttcacataaatcctcatggtaaagagcagcccgacatcctcaaggatctcatcaatatacaggaaaaaagaatagatagtagcatcaagtccacaaacactctcaaacacagcctttgcttcaaggattccaaaaagtattaaagaaaatggttgcctctatttcccttaattttgagttcattttagatcttactaccaggctgactaagctcagatcatagaggttggcaaggtagaagttatgtttgacaaaaatgttttaatgtctactgaagcagacaaattaaataaacaagtaattgtatatgctagtaagtgaaaagaaggaagtacaccttatgctttaatggagagtacatttatgtgcagagaaatttaaagaaggtggtcaggatagacttagctgaagaggtcgttgtgatctgatattttaagaagaatatgagcaatctacgcgcagtgtaggcaaatagtaattcaagcagagggaatagtaagtataaaaagctggaaatggaaatgggcttgccgtgttgaaagaataaacttgagtgatgtacttcaagcctactgagccataggagaatagtggaagatgtgtttggagatggaggctgaaccagcgaatacagataaattatgaaatatattgtatttccttttgaattaaatgagaaactaccaaatgttttattaaaagaatgtcataacagatatttgtttcaagacattactgtgtttgctccgtgaagaattaatcagataagagcaagtgtagaaccttggatgtcattttaatactctgttagataatggtttccagaacatgtaagtttgcagtggagatggagaaaagtgaatggattttaaatatattttggagttaaaactcatgggacttgctgaggaattgaatatgagatgtaaagagtaagggaagaggatgaatgaagactaatacctagtgtttttgttttgtttcatgcgttgggttatattttggtaaagttgattatgcttgtggaaaataagaaaaaattggggggagagtgtgtgttgaaagctctgcttttgatattctttgagatgtatagtaagcttccacactgaaacattcagtaggccatttgatgtataagtctgaaactcaagagtgtggtatataggggatacaaaaaattctcaagtcataagaatgtagatggtatttgaaacatggatattaagtgtgatcacctaggctgagagagaacataaagaggagggatgagagaatacctgtggaactattttaatacttagtgtttggatagaagaagccaaaaatacatagaacatcatgaccagtgatttacaagtaaatgtggtggcaaaaatgccaaaaaagattattcaaaaaatagagggtgaattttggcaaaggtagctgagcagtggaatatcgtaaaaacagagaaaaatccattagattttggcaacaaggaggatgttgatgactttgtacagaacagcttatgtagaatggtgatatgtgttatgctagagtgaattgactgaaggatggcttgaatataaaaaaaatccaattggattaatggcttgtctaaaatcaaaggaaaatgcacaattaaatcattattaactatagacaccctgttgtgtaaccacccaacaggttctcctagtccactactcagaaatgatttatcaagacaggagaactgcaacagagaaagagtttaattcatgcagagccggctgaatgggagaatggagttttattgttacatcagtctccctgataattcagagactgtttttgtttgtttgtttgtggtgtgtgtgtgtgtgtgtgtgtgtgtgtgtgtgtgtgtgtgtgtgtgtgtgtgtttaggataatttggtgggtaggggattagggagtggggagtgttgattggctgggtgagagataaaatcatgggaagtcgaagctgtcctcttgtgctgagtcagttcctgggtgggggccacaagaccagatgagagtggcacctcctgattcatcgaatgcagaatctgtaaaatatctcatgcaccaattttaggttttacaacagtgatgtcttccctgggagcaactggggtggtttcaaatcctgtggcctctagctgcatgactcctaaaccataatttctaatctggtggctaatttgttagctctacaaagggagtctggtccgcaggcaagaaagtggtttgttttggaaacagctgttaccgtctttgttttaaagttaaactataaactatgttccttccaaagttagttcagcccacacccaggaatgaacaaggacagtttcgaggttaaaagcaagatggattcagttaggtcagacctctttcactgtcataattttctcagttatgatttttgcaaatctagtttcagttgtgctatcaaatgctaagtcttattcattctttctatttttttgtacccattaaccatccccacctcccctccacacccacccactatccttcctagcctctggtaaccatccttctgctctgtctccatgagttcagttgcttgaacaaatggatatcagaggatgtaggaaatgacattgatctattaataaaaacaataaaagacttgaaaataacacaaaaagataggcatgtgttcttttaataacatactgaagcatcatctaaaaggacaccccaggtattatttaattctctaaggtatgtacctttattaacatactattgtttgtgcatacacctatgaagttaaatgttaatttgtattttttatctgataaagatgcaaatgatttctgtctggtagaacaaagcaatacgattttattgtcctatagggcattaactagttctgaatctaatatagcaatttcattccaaaagtctttcttcagttttaataaatactcctcagctcttcaaatgttctttgaatcaggcttattattctgccgattaactctaagttcaataaatttgacatatatttatttattctatatttttatcatatgttagtttgttagggctgctataacaaaatagcacaggctgggggtctcaaacaacagaaatttactttctcatgattctggagggtagaaggccaagatcaaggtatctgtaagtttgatttctcctgggaactctctccttgactggttgccctgtcactgtgttctcatatggtcttttctgtgtgtatgcacattcctggtctctctgtgtgtatctgaatttcctcttctgataaaaacatcagattggtttaaggccctcactaatagccgtattttaacttaatcatctctttaaggctctattgtcaaatgcaatcatattctgagttaccaggggggttagggcttcaaaatgtaaattttgggggaacacaatttagttcataacatgtgaaaatcatgtttgttacttttttttttcaaattatgccttggtagttttagaggttacacaaataaatatttggcctataaggctgtattgtcaaatgcaatcatattctgagttactggggtgttagggcttcaaaatgtgaattatgagggaacacaatttagttcataacatgagaatcatgttttttagctttttttttccaaatttatgccttggtagttttagaggttacacaaataaatatttggcatgttgattccccattctctattttaaaaaatacttaggacgggcgtggaggctcacacctgtaatcccagaactttgggaggccgaggtgggcagatcacttgaggtcaggagttagagaccatcctggccaacacggtgaaaccccatctctcctaaaaatacaaaaattagctggacatggtggcgggtgcctgtagttccagctactcaggaggctgaggcaagagaatcgtttgaacccgggaggcagaggttgcagtgagccgagatcgtcccactgcaccacagcctggtgacagagcaagactccaactccaaaaaaaaaaaaaatacttagaccaactctttcaaacttcatattgcccatatctctcagatacttgcaaaatgaaacttgatgtttgatagaggttgagttttctgggaagtaaatgatgagctggaattatgagggaaaatgtttattgtagaataacaacagatggggaaagaaaagggagataaggcagatttagacatgcggagttgttaggacatgatttgtacttgacaaaacttctgaacatcaactgagaactctggaataaagattactcaataaaaatatctttccttggaagttgcctatgcccttgtaccaccaccatgctcagtcattggctgattgcttcaggagagcatgactttggctcagaagttgatagggattctgttaaagctaacggttggaggctgtcaactaaccacagccttcagaattggacagcaagttctttcttgaagaggtctatgagtgatgtatccgtaggtctgtcacaaagtttaaatcacaagaaaaaaaaagatatatgaaaagggaaagaaatacaaaaccattcaaaatattttagtaatggtaataatttataacatatttagttaatatgtgccacagactatttaacagttcataatattatcctctttttcccccattttcctcaatccaaagaggagaaaattataaataaacgaactgaatctttttactgtcaatgattttaattgtcatatttgagcactaagaaatgttaacaacaaaaatacattgtttagaaaggaatatcgcatttttagtagcatattctgatttgaaatcatttaacttcgagggtaatttatttagaattatattctagcataaaaatagcacaaaattttaaatagaaattaatacatgtcatttaataatccctccaaacaaaatttattgagggatgtgcatgcttacaggcatgtataattctaagtattgagctacaaacatttatgtatatctattaatcattaggcttttacagattttcaaataaactaaaaacagtattttaaagttttaaagagagtgaaacatgtaacacttcaaagcctgaattttcatttttgacttttttatttttaattgaaattattttattacttaaatatgcaagaaataaatagggcagtttgttgaaaacatgtattcatgggttaagtaattagatccatgttcatgaaactgagaactatctgataaaactgcttgaattaagagtccaaaaactatacactgaactggatatcatctataaaactgatcattaccttaagcagttaaattttaaaactctgtaaatctgcttggtgtggtatatgtcttggctctgtgtccccacccaaatctcatcttatattgtaatccccatgtgtcagagaaggggcctggagggagatcactggatcatggggtggatttctctcttgctgttcttgtgatagtgagttctcatgagagctgatgattgaaagtgtggcacttcccctgtgctcgctctcttctctcttgctctctctctctctctttcgcctccacataagacatgcctttcttcccctttgccttctgccattattgtaagattcctgcggcctcctcagccatgcagaatggtgagtccattaaacctcttttcgttataaatgacccagtctcaggtagttctttatagctgtgtaaaaatgaattaatacagtgtgcctaaaaatacctcaaaattagatgatttatgtctagattccacctcaataaacaataatggtaaaatttggaagtatgattaggtaataaaaatggaaaaagtaacagatatttctataaatatgtaaatttgcaaataaaacagtgtttgatagatcaacagaatgactatagttaacaataatgtattgtacatttgaaaatagctagaagataataattcaaatgtttttagtgtaaagaaaagataaatacttaaggtatagatatcccaattgctctgaattgttcttttcacattatatcaattaaaatatcacatataccctaaaaatatacacatctattatatatttttatttaaagttacactcttcattgattaatatttcccaaatggctttaccttgttttaaaaacttaactcttccttgtgtcaagtaattaccttggataatttcttttaaaagaattaataattgttaaaggaaattatctttaaaaaaactaactttatgtggtacagaatctcccttttatttccctctctctctaaattgtagctgtggtaaggcttgtaaattaagaagtgttacactctggtaacatcttcaggatatctttttaattagtctctagagtgaaaatttccagaatattcaaatgcatccccaaataacacattttcagcgaaactttgatccaggacttttttagcacatttattcatttatacaattttctcaaacacaaattaagtatattttgcagcccctatgattgaaaacaatattctctcttaactccgccagatccctaagcacctttaaacaagaaatattaaggcctccttatctaacatctattaataaatgtatctcaaattaaaatttttcaagtattgggtttttctatttgcccaaaagtcccctccccaatacatatagttaattgttgcaatgatccctagtaacttactagtaaaatggttattttcctcagcacaacacacatgggctccaagtccttgtccctgcctttctgtccaggcttatctggcaacactctgtcttataatttaagtgttagcaaaagcaatggtaactcctctcttccagatagccatttcaacacactctttttcactcttttctaaaagtgtactgcagaaaaaaaatttgatacaattgaacacctcttcatgataaaaacacaacaaactaggccttgaagtaacatatctaaaaatagtaaaggtcatatatgacaaacccacagctaacatcataacatcataccgaacagggaaaaattgaaagtctttcctctaagaactggaacaagacaacaatgcccacgctcaccaatcctattgaacacagtagaggaaatcctagccgcagcaatcaagcaagagagaagagtaaaactggaacataggaagtcacattttccctctttgctgatgatatgatcttatattataaaaccctaaagccttcaccaaaaatctcttagatctaataaataagtaaatttggaggatagaaagtaaacatacaaaaataagtagcatttctatataccaataatgaactacctgagaaagaaatcaggaaagcaatcccatttacaatagctacaaatggataaagaaaatgtggtatagaatactattcagccataaaaatattatgtcatttgtaactattgatgaaactagaggtcattattttaagtgaaataagtctgacatggaaagacacaaacatcacacgttcccactcatgtgggaactaagaaaatagatctcatggaggtggagaatagaatgatagatactagaggctgggaagagtatatggatggggagcagataaagagtgattggttagtggttacaagtatgttagatgaaaggtgtaagttctaatgtttgatagcagagtaaaatgactgtagtcaataacaatgtattgtacatttcaaaatggctagaagagaaaacttgaaatgtttctaacacagagaagtgataaatgataaatgctcaaggtggtgaacacctcaaataccctgacttgaagagttattacaccacctatgtatgtaacaaaataaattttcttaaaaagaagaaaaaaagacaagtgttccacttttctccctgtagcattctatgcatgtctttatcatttttttcttctcattttattgtgattatcaatacttgtacaatagtttacttcaatgaggcgtatgttgtagacatctttgcatcacatgtttcaagctctggcaatgtgatatttttcttctaaattcacaataatattttcaagagttcatggatgttttttcacatatagatagccatagcctaatgtactgatattgagtgttcagaatgtacaaagagtaaaatcatagtgaatatatcaagctgagtcactttttctcttttattttttgtatatgacaactttctcctaatactaagagagagagagagaggggactgacttgagtaaaaataaaaataaaaatttagtaccttttcccctcattaacctcctgctggtgggttggcattgtgtgtgcaatatattgactccctgtatttttctatttcttttttttctttcttttttttttttttttgagacagggtctcacactgtcgcccaggctggagtgcagtggagggttctcggctcactgcaacctccgcctcccaggttcaagcgattctcctgcctcagcctcctgagtagctgggactacaatttttagtagagacagggtttcacaatgttggccagcatggtcttgatctcttgacctcgtgatcctcctgcctcggcctcccaaagggctgggattacaggcgtgagccactggcacccggccgactgcctctatttttctaatgctgtgctttttctatcagagctttttagaattcctattaaatggcaattctgtttacttcctgtattagcaaactgatatatattgtcaggtgctgagcatgggataggttgtatttctaaacacattactattgatttctggctcctttgaaattttcctccattgttctaaatctgccctgttagattggtcatgtattttcactgagacctttgtgttataactgaatccccatttagcttccctctattaggcttatttttctgtgttaaagttcctgttgattttggtaacttagagaaaataccatgaatctagaatcatttgtatttacaaagtcattccatctgcatcagaactgtttgattctattatttttgactgatagagattagtgagaaacatggaattagatagttttgctatatgaacaaccaacccaatctcaatggcttaaaatagtcattattagagtttcctagaggtcacctggtttaggttagactcaactgagggtcttgggtttaactcctttatgtatctgtaggttgaatggcaggctctaggctgggagccaagaagcttagctgcaaagctctgttccatgtgccttgaatccatgaattttgagccatcctagatagttctacctcaacagatataatggaagactgtcagtttgggtcccctgagagacaaatgataagatagtattggatatgtgcaagacttattgagagaaatgcccttgaaggataaaggggattgggaatcagattaatgtggacacactttagactccagtgcagatcttacacttgtgaaaggggagaaaagagagtaagaaggatcagcagaaggagccttagagtgcaatgcagtttgagaaagtcttggccagtttaaaggtgagtctcagaacatagatgcccattagatgagccccaggagtcccacgttgacatgggactggcttttgtataccaactgtattcagtcactagctaagaccaacctgagaagagcatggcttttgcatgaatgcggaggcaaatccaatgtgtgtgtcagctggaggctctcagataattactcttctccaagttctcttttgaaaagaaatttgagtggcaaacataatgattgctcctaagattctttccagaaaatgaagatcaagatttcttttaatcaactaaatataggctcttggatttattctgcattaactagcatgtaaggtttcacttcttgattaatataatcataagagaaagagaatagaaaaacttttatttggaaagtcactcaatgaattagtttccttgctgtatgctctcttggctgtaagctaaaaacaaacaatccacaataaccaacacaatactgaagcagaagatcaaagttggagaactgatactacttgatttaaagtcttgtattttagaagttttgtagtttcacataatacattgaggtctgtgatccgttttgagttaattcttgtgaaaggtgtaaggtttgtgtctagatttaattttttgcatgttgatatccatttgttccagtataatttttgaaaatactatcctttctccattgaatggcttttgcttctttgtcaaagatcagttgactatatttatatgggtctatttcagggatttctattctgtttcactgatatatttgtgtattcttttaccaatatcatactcttgattactgcaaaattgtcatatatatgatttgcaaatttttttattccatcggttatcttttcattttgctgattgtttccttttctgtgcagaagcttttaagtttgatgtagtgtcacatgttcatttttgcttttggtgttgtgtccaaaaacaattattgccaagactgatgtcaaggagcttttctcctaagttttcttctaggaattttatggttttagctcttacatttaaacctttaatctatttcgagtttttttgtgtgtgtgtatgttgtaggttaaaggtccaatttcattattgtgcatatggatatccaccttttccagcaaaaatttttaaagagactgtctttagttagaacaccagaagcatgacgcatggaagaaaaaacatgtataatttgaacatttttgaaattaacgtgttttgttctgtgaatgttaagggaatgaaaagactagctattgacttggagaaaatcttttcaaaagacttatctgattaaggacttgtagccagaatatgcaaagaaatcttaaaatccagctgtaagaaaacaaatgttgtagtttattcaggctgctaaacaaaatatttagactgagtaatttgtaagcaaaataaatttatttcctatagttctagaggctgggaagttcaaggtcaagccaccaggagattctctgtctggtgaggcgcctcttcctcatagatgataccttcttactacaccctcacataatagaagcaacagacaagcttcctcaggcatcttttataaggacactaatcccattcatgaatgctgcgtcctcatgacctaatcacctcttaatggccacaccccttaatagtattgtattgggaattaggtttcagcatatgcattttggggcaacacaaacattcagattatagaaacaaacaaactacaaatcacaaaagatcagaatagacacctcaccaaagatgttaaacagattgcaaatgtgcacatgaaaatctgctcatcatcatatgttattagggaaatgcaacttacaacaatgagatgacactacatatctattagaatggccaaccttttttttttttttttttttttttaatgataataccaaacaagtagtggtgaggatatggagcagaaacactcattcattgctggtgggaatgcaacgtggtatagctatgatggaggacagtttggcagtttctttcaaagctaaacatagtcttactatacaatccagcaattacgtttcttaatatttaccaatgagttgaaaccttatgtcacatgaaaatctccacatgaatgtttactgcagctttagaaatttataatttctaaaacttgaaagcaaccagatatcccttaatagattaatggataaacaaattgtgatatatccatacaatggaatattatccaatgataaaaagaagtgagctatcaagttataaaaatacatgaggggactttaaaggctattgctacattaaagatgcctatcttaaaaggctatacatggtatgaattcaaatatatgatattctgtaaaaggtaatactatggcaagagtgtattagtccgttttcatgctgctgataaagacatacccaagactgggcaatttgcaaaagaaagaggtttaatggacttataattccaagtggctggggaggcctcacaatcatggtggaaggcaaagaggagcaagtcacttcttacatcaatggcagcaggcaaagagaagtcttgcgcaggaaaactcccccttataaaaccaccagatctcatgcgacttattcactatcatgagaacagcacaggaaagaactgcacccatgattcaattacctctcactgggtccctcccacaacacctgggaattcaagatgagaattgggtggggacatagacaaattatataatttcaccccagccactcctaaatctcatgtcttcacatttcaaaaccaatcatgccttcccaacagtgccccaaagtcttaactaatttcagcattaactcagatgtccacggcccaatgtctcatctgagacaaggcaagtcccttccacctatgagcctgtaaaatcaaaagaaagttagttacttcctagatacaatggagttatagtcactgggtaaatacagccataacaattgtgagaaattggccaaaacaaaggggctacaggccccatgcaggtctgaaatccagcaaggcagtcaaatcttaatgttccaaaatgatcttcttttactccatgtctcacatccaggtcaccttgatgcaagaggtgggttctcatggtcttgagcagctctgtccctgtggtttttcagggtacagccttcctccaagctgctttcacaggttggtgttgagtgtctgtggcttttccaggtacatagtgctagctgtcagtggatctactattctggggtctggaggatggtggccctcttctcacagctccactaggcagtgccccagtagggactctgggtgggggctctgactccacatttcccttgtgcactgcgctagcagagcttctccatgagggccccacccctgcagcaaacttctgcctgagcatccaggcatttcctacattctctgaaatctaggcagaggttcccaaacactgattcttgacttctgtttactcgcagcctcaacaccacgtggaagctgccaaggcttggggcttgcacctctgaagtcatggcatgagctctactttggcccctttcagccatggctggagcggctgtgatgcagggcaccaagtcactaggctgcacacagcagggggaccctgggtctggcccatgaaaccgtttttttctcctaggcctctgagcctgtgatgggaggggctgccgtgaagacctctgacatgtcttagagacatttttcccattgtctttggcaataacatttggatccttattgcttatataaatttccacagccagcttgaatttctcctcagaaaatgggattttcttttctatgacattgtcaggctgcacattttccaaactttcatgctctgcttcccttgtaaaactgaatgcctttaatagcaccaaagtcacctcttgaatgctttgctgcttagaaatttattctgccagataccctaaatcatctctctcaagtccaaagtttcacaaatctctaaggcaggggcaaaatgccaccagtctcttggttgaaacataacatgagttacttttactccagttcccaacaagttcctcgttcccatctgagaccacctcagcctggactttgttgtctgtatagctataagcattttaggcaaagctcttcaacaagtctctacaaagttccaaactttcccacattttcctgtcttcttctgagccctccaaactgttccagcctctgcttgttacccagtaccaacatcgctttcacattttcagatatcgtttcaacagcaccccactgctggtaccaatatactgtattagtccattttcacactgctgataaagacatatgtgagactggacaatttacaaaagaaagagatttaacggacctacagttccacatggctggggaagcaccacaatcatggcagaaggtaaaaggcacatctcacatggcggcagacaggagaagagagcttgtgcaggaaaactgtcccttatgaaactatcagatctcacaagacttattcactatcatgagaacagcacggaaagacctgcctccatgattcagttacctcccactgggtccctcccacaaaacatgggaattcaagatgagatttgggtggggacatagccaaaccttatcagagagtaaaataagtggctttcaagtgttcagggggacaaagggagggaggaataggtgaagcaatgagatttttacagtggccaaactattctgtgtagtactgtaattgtaggtacaaaacattatgcatgtgtcaaaacccatagaactttacaatactaacggtgaacccttagataacctatgaattttaattaataacaatgtatcaatatgggtttaccagttttaacaaatgcatcacactattcaagatgttaataatagtggaaaattttggtggggaggagttttgggaattttcttgtacaatctgctcattttttgtgtgaacctaaaactgctataagaaaatgaagttggttgttaatctaagaaaatcaaacaataatgccagtactcattgactcatgttttagtgatctttgtctttcctttgacaggttttagaaagatataaattgccctcctaattctgccttttgccagttatatgatcttggtccattttctgaacctcagtgttcccattggtgaaatatggttaacaatacgcaacagataacatgttgaggatacctgcaggaggaagagttgcatgagatcttcaatacatgtcccttcctttcaccttttttaaatattctctcctagcaataaataaataaataaataaataaataaataaatgtggggcttccccagccatgtggaactgtaggtccattaaatctttcttttgtaaattgcccagtcttgggtacctgcaggaggaacagttgcatgagatcttcaatacatgtcccttactttcccctttttcaaatattctctcctagtaataaatgggaacaatttgagacaaacatcccttgcatattttcttattgaaccatgtttatttcaatacccactctcctttcctcaatatcactcaaatttttgtattttgttcttcctttttttatattttcagatctcagaacacaacttagaaagtacctagagtatttacaatagggtagaaataagttgttcagcattctattaaggaattatttttggtgaattgttgaggcaaattgtttggtgaattgactgtactctagccatagcaccatgagagattgaaaaaataatcatgaataaaacataagtcctgcttttaagtaattcacagtcagagaagatgcatgagaagaaaccatactgatatagtcatcaacacctcagtgtgaattcattttagatagttttctcagacatattgatgcatgagatgtggcctcagcataagaatgctgtgaatcccagtgggagaaggtatcccttaaaggaaggtggggaattagagaaattgaagtttactagcactaaataatactctacttactttgaaattatattcattaagagcaaatactctccccttaaaatcctatgctttgaagtgaaaaattcagtatgaaagatttgtatcggtggaaacaaaaaaaaagaattatttatgtacattaagctttaaagagattttggatttttaatccttttatattgtttctaagaaactcattttggtctttttgcactacaaaattaatgttcctacagtgtttgaactttttgtttctcctgcatgtataaactttgaatataggtttcaaagaaaatttaataatcttgttttgttttacatttccttaattaaggtgttaattatgatcaaactgcatgacatcacaatttgtgagggtaaaattcactttaccctcactctaatttttactaattttattaataaatgatgtgttttcagcaatgttttaattctttttattcatgaatattatttcctagattaatgatatctgtagaacctgaaattaaaaagctattctggagcaattaatttatttacctgaattttcaatattaacagtgttattttcataatatttatattcattcatttcataatttaagtttttcatgaaacagtgtatatatttttaggtaatacccacaattctaagtatgtatgtcccaaatttcctgaagctctcttcagaaaagttacagagaatattaattagatatgtatattagctctttatctagataataggatataaaatagatcattcaaatataatagtatgtttgccttccaactcatccctactttcctttttaaatatagcatacttttaaaatattattttgtattatttcaaagttaaagagaccaaaaaaaaagccctaccatttccatgaaattaaatctcccttctagaaaagatgtattcagcatctacttgggattctttgctttaaaacttctgaaagatttcacaaaattaaccatgaaaacatgaccagcagcatatattttccaatacagtatctttcatcacctttatgtctgttggatttttatttctcactatgtctcaaacccttagtgttttacatagtagttctgtcttaagatataatgaaacttattttagtacagagacttttattaagaataatacagtgaattttattatggtgtattagaccagaatctagacaaatattcttacagtggatgtggatgttcttatgaatctattacactctagagattaaaatttctacaataacatcaaatacttcctagtggacacaaacagatatgatatactatgaagaataaaacttacaatttaaccgtagaatttagatttccagcagtgaatatataagcaataaattatacaagtgactttaccagcagtagtagcaaattttgaatagagaataaagcaactgtgttccaaacgtgtcaggagaacattagtagtatcattataaatgccagatacccactcctgcatcaattccacatatttgaaattcactagcttgtgtgacctcgaagtttccaaatattgaagttgtatctggcaaagtgaataccataacactagttaccttggccctagaaatagtccctgttttagggttaaagcataattactttattactaatgataattggtgaaaatgtgaataaccggtaggggaaatgatattggcttgaatgattctgaagatcagcaactgagcttgctatgtgatatatttttttaaaatgtttgagccagctggtaagaccttgtgtcagagggtaacaaaactccagttggtgggctgacatttaggattaccaatatatatagtccatctgacctttttttacacttccttttggtgagactgataactgatattcaatacaaagtatttaaatataaacaggtcatatttgtagctgccatgctcagaatagtgatgctgtaagagtattctagcaggtctattctgattctctcactgttgcaaaaccagaaaatctgagacaggtcttagttaatttagacagtttattttgccaaggttgaggacacacccataacacagcctcaggaagtcctgacgacatgtgcccaaggtggtcagggcacagcttggttttatacattttcaggagacatgagacatctatcaatatgtaagaagtaaattagttccatccagaaagacacagacagctcaaagcaagccctaccccaccccactgagggcttccaggtcacaggtaggtgagagacagatggttgcattcttttgagtttctgataagtctttccaaaggaggcaatcagaatatgcatctatctctgtgagcaaagggatgacttgaatagaataggaagcagatttgccctgagcagttcccagcttgaagggtcccaaaggtatttttcttacatactctgttttctgctctttatctctacgttctcattattgattgctatttcaaggttctgtcatttcttctttcattgttctcaagatcactctcacttattttcaaatattctttctgttgttaaaacctattatatttatagcaactaactgaaaataaataagaaattagaatacaaacaaataaacaacacttcaacaaataaatcttgggctgggcaggtaccacttcagagtaccatctatgcttttcccattgaagagaaactggccatcccagaggtgtttcaggctggctatttacttggccacactttgtactgtcttccccttaaccacccaaggacagctattccataaaggctaagcaatgcttcataagaaatattttcctctgttagcattttgaatgtgtaattttaatagaatgtgacagttaatagtaggagctgaagaacaagaggtatgtgatgtagaataaaagacagaaacaactataatgtgctatgaccaaaatgtacatggaagcagactaagtaaggtttcaaaagagcatagaaaaacactcactaagaaccatcacgtatcctgatgaaacttcagcccagttccagttttattgcgtagatgtctccacaataatttttttttctgagttaaacggaatgagttcttgttgtttatatcaaacagggatatcattaattctgacatggtctcagagcatctaaatgaccactgtgatccaagaaccatcatttctctggataataatgtagcctctttattgctctgcttcggtctttgctccagaatctactctccaacagcagtcagagaggtcattataaatgcatgatagataatatcataacttgtgcaataacctacaatgatttcacatcccagagtaaaaataaaaagtgcttgccatggcttaaagaggcctccatggctattcctctatacttgtccagctccaattaggggcactggcctcttgactcttctggaaatactcagcaaactttttttttttccttcagtcatttgcacctgtttcctctgccagaagtgaagcctcttccctagacatcaacttggctccccctgtcacttcccatcactttgagaagcttcaccctagcccttcaccagcactctatgttccgtttatagtgtcattattttactaaattgttacaacctgatggagcatatattaatttattatgtttgtggtcattcatcccctgctagaatagaagctctacaatggacagtggttgttttagtatatgggatcactagcccctgaaatactaccaagtactcataaagcactcaatagatattttttgaattaattagttaatatacaaaacttatgtatcataacctcatgattagaatcatctaatttcacactgaaggaatatatgatagttagaaggggataaggaaagagaggagaatatgaataaaaaggtggagtaactaaattaaaatacaatgtgcatttatatcttcacaatacaactaaacttcatcatcatttgtctagagatctgagacaaaaatcagaaatagagaacaaggaatgtgagaattaaaaggaaattacatttaataatgatgtttatgtaaaatgtgataggctaatttaatataaatccaagaaagaagcataaaatggaggatatatggtaaatatgtgacacataaaatttttattaaagcaaattagtttaacatcattttatcatcaattacttccttattcacaattcagtttcacctcctttgtatatattttaagctgtaactttgacacaatttatgacaaaggaaatatatacttcaatattatcacactgttagccgaaaatatttgaacaaaaataagtattgctttccaaataattttcttaaaggaagtacagtcttaccactgaaaattaaaacaacaatctaggtgaattgttatattgttccaaatatgatttataagattctaatgtttttatgacttacaggtcttttaaaaaactatttgagagacaggaatgtatattagattattttatctggtttaggtagaataaatgtaagcaatgacaagcgatatatacctcatcatgcttatattttcttttcttttttttttttttgagacagtgtctcgctctgtcgcccaggttggagtgcagtggcgcaatctaggctcactacaagctcctcctccctggttcacaccattctcctgcctcagcctcccgagtagctgggactacaggcgcctgccaccatgcccggctaattttttgtatttttagtagagatgaggtttcaccatgttagccaggatggtcttgatctcctgacctcgtgatccacccacctcggcctcccaaagtgctgggattacaggcatgagccaccgcgcccggcctcatcatgcttatattttctaaatattgaaaagacttaatagcaatcaattattccctccttttctccctcctttatcctttcctttctttcatcatatacataatatatataaatattagatatataaagtgcttataatgtatcaacgtacaacatcagtcaaaatccctacccttaaaacagactagtcagtcttcttttcttcattacattttcatttctttctgccttcctttctttcaattataagatgtaattcaggaatatatcattcctccctttttttttcttctcctcctttcctttctcccttccttccttttttattttcttcctcccttccttccacaggtattccacgaataagtacatgtaaaagatccaaatgatacggaagtataaagagtaaaatacaaatgcctacaactgcccttcttgtattctactgctcagagagcaaatgtgggtcatgagaatactccaaacaaatattctgcttcaggagaagaatgacagattttgtatggaggtttagcaacagagtcagttgtagatcagttggtttggggaataattactccaaactggttcttaaaagagggaggaatttatgttgtgaattagctgtcaaaggctgggcaatttgtgttttcaagaatggtgaggtggaacagttagggcctaaaaatatgtcggtgccagagtgggaaatattaagtcctttgtggtctcttacctatatttcataattatctctcattgtcaagtaatgagatgctccccctgagttcattttctacacatttaaaacttacccctgtgaacaggcacatattttttttttttttgaaatggagttttgctcttgttccccaggctggagtgcaatggcgcgatctcagttgaccacaacctctgtctcccgggttcaagtgattctcctgcctcagcctcccgagtagatgggattacaggcgtgcaccacaacccccagctaattttgtatttttagtagagatggggtttctccatgttggtcaggctggtcttgaactcctgacctcagttgatctgcctacctcagcctcccaaagtgctgggattataggtgtgagccaccatgcccagccaacagccaaacattttataattattttaatatttgtgacagaatgcttcctaaatggtaacaacagattgctataaggattattcccaaaagaaaaaaatcaaaattttttattgaatttcaataatgacctacaactttactaccttctatggctatgggttatttatctacaggttaaaacaataaaaatagctgtgtttcaggattttgtatgatgttgactttcattttcaaaattaatttcatattttcactcatattacctgcttattatcacctgtttttttttccttatttttccacccccactttctgataattattatgcatattaaaacaaacatatatactatcaaactgggaaggcataaattattgctgagtaaaatccccataccactttcccccagtcccaccttttgaaggtaactatttctaggagtttgctgcacagtcgtcttactatattttatgagtattccagtatacatatgttaaagcaaaggcaaacatttcatctatatatatacatatgtgtgtgtgagagtgtgcgtataggcatataatgtcttttaaatacaaatttaattctacagttcatataattttgcatttaaaaatagaacaaaatcatcatggatatttttttggatcagtacatagagatttattatattctttaacttctttgtattataggcagacttgtaactaacagctcctttccactttctaatttaatctgattttgtaaatcaaagattgcaccacttagaattgcactgtatttacttactggatgagagtgattgtctaaaacattctcctatgaatcaagtagctaagtcttcacaatttatttcaaacgtcacattctcacagcagccatcaccgaccactgtctataaagttgcacctcccaacatacacccaccccatcacactgtatctttcctttacagtgctaagcacgatatgaaattatcttttttttgcttcttcactgggactaaatcttcattaatcaaaatccttgtttggcctcttctttgatctatttccccgtatctagatacctccctgacacatagtacatattcaatatacattgataaaatgattgaatagatgaatgcatgggtgtgtccttattgcatcaactttacttacacatttacctgtcccttatttacctgtccttttacactgtagaatgttgagaatgccaggttagtgaactgtaagaaaatgatcaagaatgcatacaaactggaagacctagactcctaggagtaatttcacaaaacgcagatctgaagcttgaaaaactaaagttaagaataacttgcagggtttttagaatcattttcagagcatgactcacaacagcaaaaagatcacagtctaatttattgagagtagatggggcaatgttatgaggtgacagaaaaaaaagtaaaatgccttagcttctattttgtttcatttttttcttctgccagagtgaaagagcatcagactggaggggatagaacaaataattcaatgaaaacattgaactttaaaacaagaggagagactaaaataatatctccctcagaatgagttgtgttgtaagactgaagacagtctcttgatatggattctcctaaaagtcaactttgattctaggcatgggtgtaagtaatttatctgaaaagttatctaagaaagcacaagtagggaacactaaggtggggaagagagaatggcaatcaaaggcatattaatgagtggcttactcatacaagttttgtcagcctttttgggattgggatcaaagcatcagcagtttttaaagttccccaggttattctaatatgcagccaagttagagccagcgttcaaaaacttaatatttaaagtgtgttccttagagcagcagcaacaacaccagcagcatcttggaagtattgagaatgcagaatcttgggcctggcccagacctgaaaaatcagaatcttcattttcacagtatcccccagttatacacatgaacatttaagtttgagaagatttagtacttgatatggtttggctgtgtccccacccaaatctcatcttgaattgtagttcccataatccccaggcgccttgggatagacctggtggtaggtaattgaatcgtgggggtggttacctccatgctgttcttgtgatagtgagtgagttctcaggagatctgatgattttataaggtacttcccccttccttcactctgcacttctccttgctgccaccatgtgaagaaggatgtgcctgctttcccttctgccatgactgtaagttttctgaggcctccctggctgtgctgaactgtgagttaattaaacctctttcctttataaatcacccagtctcaggtatgtctttattagcagcatgagaacagactaatatagtaaattggtaccaggtagtagggtgctgctgtaaagataccccaaaatgtggaagcgactttggaactgggtaacaggtagtttggaacagtttggagggctcagaagaagacaggaagatttaggaaagtttgaaacttcctagagacttgttgaatatctttgaccaaaatgctgatggttatatgggcaataaaatccaggctgaggtggtgtcagatggagatgagcaatttgttgagaaatggagcaaaggtgacccttgctatgccttagcaaagagacttgtggcattgtaccccgaccctagagatctgtggaactttgatcttgagagagatgatttagggtgtctggcagaaggaatctcctaagcagcaaaacgttcaggaggatgcagagcataaaagttggtaaatttgcagcctgatgatgtcatagaaaaataaaaccaattttctggggaaaattacaagcctcctgcagaaatttgcataagtaatgaggagccaactgttaatcaccaagacaatggggaaaatatctccagggcatgtcagagaccttcatggaaacccctcctatcacagccactagggcctaggaagaaaaatagttttgtgggcggggcccaggactccccagctgtgcgcagcctagggacttggtgacctgcatctcagccactccagccttggctaaaagggaccaaggtacagcttgggtcgtggcttcagagggtgcaagccccaagacttggcaacttccacgtggtcttgagcctgcaggtgcacagaagtcaagaattgaggtttgggaacctctacctagatttcagagaatgtatggaaatgcctggatgtccaggaataagtttactgcaggggcaaagtccacatggagaacctctgctagggcagtgcagaaagcaaatgtaaggtgggagcccccacacagagtccccactggagcactgcctagtggagttgtgagaaaagggccatggtcctccagaccccaaaatggtggattcactgacagcttgcactgcatgcctggaaaagcaacaggcactcaacaccagcccctgaaggcagctaggagaggggttgtaccctgcaaagccacaggggcagagctgctcaaggctgtgggagcccacctcttgtacagtgcgacctggatgtgagacatggaatcaaagaagatcattttggaactttaaggtttaatgactgccctattggatttcagacttgcatgcagcctgtagcccctttgttttggccaatttctcccatttagaatgggtggatttacccagtgcctgttctctcattgtatctaggaagtaactaacttgcttttgattttacaggctcataggtggaagagcatgccttgtctcaaatgagactttgaacttggacttttgagttaaactgagaatgagataagactttgggggactgttggaaaggcatgattggttttgaaatgtgagaacatgagatttgggaggggctaggcctaaatgatgtggtttggctctgtgtccctaagcaaatctcatcttgaatggtagttcccataatccccacatgccctgggggagacccagtggcaggtaatagaaacatggcggttgttacctccatgctgtgctcatgatattgagggagttctcacaagatctgatgattttataaggcacatgcccccacttcactctgcacttctccttgctgctgccatgtgaagaagggtgtgcctgcttcctctcccaccatgattgtaagtttcccgaggcctccccagcgatgctgaactgtgactcagtcaaacctctttcctttaaaaattacccagtttcaggtatgtctttattagcagtatgagaatggagtgatacagtaccacacattgaaatcacttgtgaagttttacaaacattaatacctaaaaaccaaaggcaccacccccagaaatagtgatttttttagtctggtgtacagcctgggaaacgggcacttcacaccctcctccagctgattaaattatgtaacaggatttgatgctgctgttatttctgtttgagttagatttaaagaggtttctaggtttcttctatagtatctcaatgccccgcccttataaagattattgtgctaattgtaaagattatcatttcactttgattctttgttttctcaattaccactgaattctatgttctattttctttattgtcttgtacttttacatctcatgtttttcactcacctgccacttccttacttgatccttctacctgagactatatttacaaataattcagtttttcaccttagctgctctttagaatcatatgggaaacttaaaaaatactgatgtttgggtactatgccagagaataagattcaattatttgtggtagtttcaaatatgcctttttttctttaattataatattctgctgatgacttcaatgtgcacctaggattgagagcctatgggtttatttatcttgtctgaaaatttaaaagacaaacagaaaaggataaatggttgtatagaacttgtaaaatgcttttgtgtataaaccccttaatagttccatctgtgcattctcattttattgtttagtgctataactgtacacttttaatgtttaataaatacttggtgaaaaactggaaataaatagtactaaaaattctcttatttcattttcacaacacccttgagctagatattttttcatgatgcagatgaggttatttggtggagtaaggatctccgtgaatttatggttattagaataagatggatcatgttatcattcataatatttttcctagctaaggaacagaactggtaacacttgctccatattgctcccagggtaacctcatgtgtatcttgctataacatatgcaatctagaggtatgaaatgttagaacagttataaaattgagtgctatgtaaattcgtggattttcatgaagatgcatccaattctgggacaggagatggattacttttcctgctattaaaagttctactcaggccaggcgtggtggctcacccctgtaatcccagcactttgggaggccaaggcaggtggatcacctgaggttgggagttcgagaccagcctcaccaacatggagaaaccctgtctctactgaaaatacaaaattagccgggtgtggtggtgcatgcctgtaatcccagctactcagaggctgatgtaggagaattgcttgaacctgggaggcagaggttgtggtgagccaagatcatggcattgcactccagcctgggcaaccagagcaaaactccatctccaaaaaaaagagagaaaaaaaaatgttccactcaggctaagtgcagtagctcatgcctgtaatcccagcacattggcagactgaggcagaaggatcacttgtgtccaggagtttgagaccaacctgggcagcctctacaaaaaataaaaaattagccaggcatggcaatgcatgcctgtagtcccagccatttgggagactgaggtgggagtatcatttgagcccaagggaccgaggctgcagtgagctacgatcacaccactgcactcagcctggttgacagagtgagaccctatctcaaaaataaaagttccgctcaagttattgttgtcaatttttttagtataaaattatttatattttctagtattcaaagaagtttaattatcatctattaaataggcataatgtctaatttattggttgtaatgatatgaattatttataagctataattactggacctacaggagatgtatagtatggtaattcttagtattaatattgattatcttatcaacgacatctaataaggagcagaaatatatttactattgatatgctaatgagcatggcattcatacatgcttctagatattctaaatttattcatgtgataaaatgagcttagagtttcttgaagtgagaagtgtaaaagcctggtccctcagaatgttaaccagctttagtctcaaataattcttgtgataaaatgcgtttgaaaaatactagtttgagtaacttttagtaggttcctttgtgatggcctattcagagcctatagtgtggttttattaggaatatacaaagggttataatatagtatacagcatttcaacaacttaatttgggtattttgaacatcttattatattatggaattgatattccttggaacacattttgaaaaacatccatttaaaccattagcttataccatatcaagttagtctccagaacaactgacttttctgaaatgcactttaatgttttgtgttcagtatctctcataggtaattataagaaagatctctataatatatagcattcacctttgctatgatatgtaattttcatcaatgtacaccttatcataaaatgatctgtaggttaatttctatcgagaatttgtaggactttagttccagagatacttacaagttctctaaataagtgctatgcttttccatgctgattatgagagctatgtcgctccatgatgtttggccttccttgctcaaatatcaaaagtcaaattttatgcacacttattgcagatcgtaaaagctctcactgttggatattttaatttttcttcttttcttggaccaaatattcagagtctatactgtatttttattgtatataggttttacttgaagcccctacaaaccatttcagagacgtggcatagaagtaagctttataaatggaattcactgcctcctattttttcatgcctcttctgggctatctgtaattacccttggctccagtgactctatgcttttcattctgagcctcagctggggccattttttttctcctcaggaaatcttaccatttgagtatgaaaatgcctcttttccagtcaaagctatcagaacaaaaaccatttctttatttaactctcattcatctttgcatgaaggacgtttccagtggcagaaactcctctgcatcaaaatcattagaaataaaattgttattccaagcttctgcctttaatactttaccaaacatctattgaagttatatgaccttttctcagattaactgtagttcctatctatgatctcctgagatttcctatggaatgtctgcttctgtcatgtttttaaggattggaccagtcatgtcctatttgtccccagatcaattactgtcttccctgctctccccttcactaccggagatagaccactgaagactatatgtctcaggtttccttgtcaaaaagattcctgttgggttcgaccaagaagaggtactggcagttgattaaaacaagggaggaagcaagaagccagagtatttccgttacctctctctgattaagcagtgtctccacaaagttgttgcttctgcagtatgtttcctctgtgattctagccttcagtggaaattatcttcattcatggtcttagctcatacctttcattccccactgtgttgccttaattttgtcatgtcttcttaccccctttgttccttcagtcctagaagaagtaagaccttcctgatgttgaaaatctctggattactttgctttagattactttgcttttgtgtgtgtgtattttctatatattattttctttttttttgagacggagtcttgctctgtcgcccacgctggggtgcagtggcacgatctcggctcactgcaagctccgcctcccgggttcacgccattctcctgtctcaacctctcgagtagctgggactacaggcacatgctaccacacccggctaatttttttgaatttttagtagagaggggtttcactgtgttagccaggatggtcttgatctcctgacctcgtgatccacccaccttggcctcccaaagtgctgggattacaggcgtgagccactgcacctggccgtgcgtgtgcattttcatttcttccaacatatgtacgtatttgctatagaactatctggtgagggtttccttttcctgcctagaatgtgacttatatgagtatttaaatattatcttattttttcccagtttatgatttccttaaggaagtatatttatattttaatgaaaaatgtatttctaaaatgttctcacaaagttgtaacatatctagatttctatttttcatctactcataaataaacattaatgcattgtgactttgttatttagttgcactaatatttgtacacacaaatatatatttggtgacaaattatgacaactccttttgtacatatataagttggtttgattttgaattcaaaccagaataatggaaaccacatgtttttaagaaaaattccatataaacatgctgggtatatccactgcattgaactaacttccaaaattaatagatgtaggaaaatgccaacatcacatgcagtgatagctaagcatggctggtaattatttggtattatagttgagaaccactgattaaatatgcaatttataatgtacactgctgatataagtagttttgttctattgctgctgagaattagccatatttccatgttacatgtgtattttgcatttcatttcgataaactcttaaatatgtaatggtctcaacagttataattttcatttatcttacacaaaaataggcatcattgtatggttttgatagctggtttgtcatgcaaggttttaattctctttccttcagaaatagcatgttcatgataaaataagacagatcaaagagagtatatgtttaaaatttagtttcacggaaggaataaaaatgtggtctctgagtaattagaaagtatcattgatttttctcagtatgatgattggtacaaaatctattctggagtttctttttcatcaagaaggacttaaggtggacttagataaaattatagtattaagagcggcttgaatatagaggaaagcattagaacataggttttataaatattattaaatgtatttaggccatgtaaataatggaacccatattagcagataattttttaaattttgaactgcaattaatggttttacttttatttctttccaaaatatcagagtcagtaaataaggttataagtagcaatggtaatattggaaaagtagggacaagcttgaaaagtgaagtagagcacctttaaacattactcaaggaaaattaattaggttttcttcgtttaacttatttattattaaggaaatgtgtcatcctctgccactatccctatcacattagagtgtaccttggaaaagaaattctcaaaatagccttttttcgagtttaaatgagcaaaacatatagcaacaatgacaaaatttcacctttttaaaattctatttctggataatgtatttttctattaattaaaatgaaggttgcctttgtctctatacataaaatcactttgggatgtgtattatttcaattattgtgaaatactgaaatgtattcaactagaccatgtctagcagaccctaaattccatgttcacgacttgtgactaaaatacttgcaagaatatagaaaacaaacaagaacagaggtaggtggttaatttggtgtaagaatccacgaaaaattttcactagcatcaagaactgtgaagcaattacactggttgtaaaagaagatggtagggagctacataggcgactctctccctggtgtttccttggctccagtgaaaataagcccatgtagatatttctctgacaaatgctacttgtagtttgtagttccggaagccagattgtgaaagtggattggtgatagccaacgacattctgggaagtgtagtttttcatacacaaactgccaatgtcaggggtataatttggaaggattctggtagcagaattattctccatgagtttggaaagtcaggaagtggaaaaaaataaaacaccaaatatttagtttccattcttaataagtggatgctgcatatttttagttaaaataacttctgtgtatattaattttcctgaaatttacatttgatatgcagatactttcagctccttaaatgacaataaaagtaaaaaaaaaataagaagaagaaatgaaacaacaaacatcctatggaaacaaaaccttttctgaaacctgtgagaaaaaatatatctgtatgctattatttttctcacagtaatgtttcttgcagatggttcttggagatttgtagaggtgtaccaccttgttggtctttgacaagatccaggcgatttttctccattaccaggcagagactcgtgttctcttcccttactttctcccaaacaaatagagtctttctctctctgttctgagccacctaaagctgggaatggagtaacacaagcacctctgtggccaccacgactatgactgtgctgggtcagacccaaagccagcacagcactgtgtctcacccaaggcctgctgttgaccactctctggctactgcctatgtttgctcaagtccttggagctgtacaatcagtgtgtggcaaagtcagccaggcctctgtcttttcttccagggcagcaagttctcccagtttccagggagttcaagaggtgctctctgggagacagggactagagtaaataaccttagaaatgtacctggtattctattatactgcagctaagctgacactgagaccacaaaatggagtcgtttccacccttccatccccttttcaaaggcagaggagcctcaccttgtggccactgccaccacaagcctatgaggaattctgccagactactgctgtttcctgaagacccaaggtctcttatgtcagtttgtcatgaatgcatcctgaccagagactcagccttcaaggcagtgtgctcccctctggctcagggcaagtccagaaatgctgtccaagagccaagttctggaactggtgaccccaagagcccacgtggtgctctagctccctgtggctgatctggtcacagatcaagtccaagaccaagtgccctttacttttccctctactcttctcaagcagagagtctgacttcatagccaccacagttgagaatgtgtcgagtctctcctgaagccagcagatctcaaattatcacccaaggccctcaacgtagttcccgggtatcactgctggttattcaaggcactcagactcttcagttagcaggtaatgaatcctaccaggactaggtcattctttcccaggcagcaggctcctttctggcctgaagcatgtctagaaatgtcatccaggagctgcggcctagaaagaaggccttatgcttccaaccactactctatcttactgcagctgagctcgtatccaaggtgcaagagaaagtcctgtttattcattcctcttctctcctcaagcagaaggaagggatcttttttggagccatgagctgttcatcctggggttatgggaggggtgatgccagcactgccttagctgccaaagctgtcgtctgttgtcccagtgggtcacatgacccccctagtctattctgggcccagatcagcactaaaactttcctaaaagtagcagtcctggtggcctaggctgcttttcacatttatttagagccacagagcagtttagcccacggtggtaaagtttgtggaaactttttgagatcagtaattcccctaaggctagaggtggtttaaatgctccctccattggcaggcatctgctgagtttggtctcattttcctttctgctataacaggacatcactgagttaaatgtctcaaaattgctgtactctctctctcccagtacacaaaaatgctctccataccatgctgtgtctaccaagtggtgggagaggggttacgttgacgattcaagactctttttaaaatagttaggattcaaataatagaaaggtctctgaactgaaaaaatattaagctttccagttgaaagtattccataggtccttattggagagaaaaccttataagctttcagataacaagtaggttacttgcaagttcagaggcctttctattattttaatccctgaagtattcaatagatatacactaacacatacatgataataataaagatatatactgatttgagagtaaataaaattttataattatttacattgtcctgggaacaaaaaagagaaattctcagacatgttatgattcagaaagaaaaccatcactgtgtatcaaaaaacaaagaattaggaatttcaatatcagaaataatgccattgaaggccacatgcatcaaatgtgacaaaaacagtattttggtatcataaaaaaagatgctgtgcaaattatacatagcagtcataaaattttatgcgacaaaagacataattgtgaaaaacacaagaaagaattctccgagaaataaaaagttaaagtctctgtaatggttgtaaccttcattatactccttttaaaatttgatctgtcaagtgtacaaaatgtaagcaaagatataaaagataggaatgcaataagcaagtcagctgaagatttattatttcaatacaaataaagaacagtatatttacactaatggtattatatataatagtatatagtatatactctgaggcaagggaataattcagttaactgacaagttccatgaccttgtaagcttacattcaagttgaagaaacagaaaataaattttaaaatattttcaaaaatttaaagtttttagtaagacctacaaataaacaggtgataaaattgtatcacctgttaaaggtgataaatagagtaacaaggccccttaggtacaaattagaatggaatgcacggtgtgtggagaaagcaaggagtcagggtgaagatcacctttagttctcagcccctttagttctcagcaccttcaggggtctccttgagctgcagagctgttttcccccaatgcacacccttctcaaggtagcccacttcctatgacagatcaaggtagggttatgaaggcccagacattttggctaggtgctagacaactctgataggtgatgtactttccagagcaccccataagattagctgagctgtcaggcctggataagacttgcatttctccttctgctcaattctgagtttttctgctcctttctacaggtaataataacaagggcattccttaataaacatactgcagactacactttgcctcagcacccaacctgtaaaatacacaggagataatatatgtatataggcctcattaagctatggtagcaacttagagttttttcaaactgcagtggaattaaaagaaaaattttcagcatacttttcacatgtccacgaaatacttaccaatattgagcatatacatggccataaaaatgtaccttaataagttccaaaaattagatatcacacaggtcacatgctcttgatttaattatatgatctatgggtgcctgagtgtatcgtgaactgccagtagaatacaactgaggacctcatggtgttcaattatcttcactgcctctaccatatttaaaaatttttataatgtttcacattcataaaattattcttgacctacaaatgttcttttcttgggattaatgaatgctcatttcatggaatttcttgattcttatttaggtatttgctatggtttgaatgtcccctctaaaactcatgttgaaatttaattgccattgtgataatattgagaggtggagcctttaagaggtgattagctcatgatggatggattaatgccattataacagaagtgggttagttcttgcaggaatccaggctctgtgtcttgtgttcttacttgcccttccgtcttccaccatccactgagggataatgtggcaagaagatccataccagatgcaacccctcagtcttgaaacttcccaggcttcagaaccataagccaaataaacctcttttcttcataaactgcacagtctgttgtagttattctgttatagtagcagaaaacagactaagaccacatttattcaagaagagttaggttgtaccttttcatgttttagacaatatcctagggactgcggattgagtgataaaaataacagccttgcactgactgtctaggggaagtaaatgaaatttcaaaaaacacattcttatctagaatttttctatgttctcacctccctccctccctccctctctttatctcttgctacaaatctgtatcaataatcccattcaatttgacaaatatttattgactgcttcttaagtactaggaggcaatgacccgtatattgtgaatacaacactggtcttgtgcctttagacagagatatttactctaaaaatttcataaggtttcccctatctaaccagtagaatctttccataggtctagtgaattttctcttttctgttttaagtaaaagctcagctgtgttgatttagctcttgctacagctgcttctctgggagaaaattcttctgtcccttgtttgttgaggctacctgctcccagaggatcacccaaaacagacattcctttatgcttgcttgctgagaagtgtgtgagtgtgtgtgtgtgtaattccatttttcttctaatgagcttttagctttctgaaaatgagatactactgcgtttctgttagagtctcctcctctatttctcgggatacagaattagaaataaagtataagcataaatactaggatataattaaaagacaaataaaactttatacataacacctgggtgaatcaaaatggacattctagccatgttcaaatatctactcaattgttaccttcttcatgaaatgttttgtgatccataaataggttagaatgtctttcttcttggaatgtttatagttctttaagattttaataagatattctcataaaacttgaaactttcatgttgttgatagttgaaattaagtgccatccttcacatgacatatagattgataaagacagacattttagcctaaatgatataagtaaagatgatcaatattgcacccacacatttacataggcatagattgtgcagtggttcttgcctgtaatcccagcaatttgggaggctgaggcaggaggatcacttgagcccaggagttccagaccagcctggacaaaatagcaagatgtaatctctacaaaaaagagttttaaagaattagccaggcatggtactgcatgcctgtagtcctagttactcagaaggctgaggtgggagaaccacttgagcccaggagttccaggtagcagtgagttataatcacaccactgcactccagcctaggtgacagaaggagaaattttttttttttaaggtaaggacaaagagaatggttcccaaatttttctatagaattatatcatctggatttctttaaaaatcttgatgcctggctcctacttcaaaaattctgatttactctatctgaggtgtgagctgggcacactcaactaaaaccactaaattagggtcgtagctcttcttccacaaatgagaggtaaagatatttaaatttgtcttataagttagggtaataccctttaaactccgattgtagaaaggaatagccgtcattcttaagaaaaatgtactccaagatttggggctgagtatctgagctatttttggtgtgaaggccaactgggaaaatcttgctgaatgcctttcctgaccagataccattttgcctcatgtcaactccagaaaaaaggcctgaagctgtgtaattcaaaataatttttaagactaaagaactgtatcaattggggctgggtgagttttgctgttgggccctactgattgtgcataactaagaatgttctattgtaacttgtcaaatcacttaagttatagaaaactagcaaagatatcctctagtaacaaatagtgcacatgagtggaataggggtatgtgtggtgtgggtggcttgttcaggacctcatctttctgttgtggccaggatttcaatggtatgatcagaaactataattgccaagacaggcatccatgcagctgcatggacaggtggaacctacgagttggaatcctcaaggagtcagttgatgcacagtctagcctcatacacaagtatgctttaggcaagtcaaaaaaggtgcctgaaagctgtgggtgattgcccactgggtactggtactcaaacttggggactctttgaaatatgtgaaaagaggcaccacatgtgaaagttgatcataagaattgggtcattcttgtcacaaccaactaaaacagagttgaagcgaaaaggcattcagggtacaaaacattgctccaagtaactctttgcaagcctaactggtaaaactgcttgttgtgagctaaaaccagtttttttctatagcttctgagataacttgctgaaactctgggactaatttcgcctaccactgtaactcaccaattggagcttaccaactccccaaacccttactagtgtcaaagaactttctcaaagagcaatacgtaacatttctccttttaataaaacctttaaccttctctttgttattgagacataccaaagaccacctggtctgcatgtatgccctaccatgcaattctttcttcccaagtaaaacattaagtttagagattagtctcttcatttttattttgactctgacccttactacaggctagatttgctgctaaacaggcctgtcagcacttgtccaatgtattttggatatttgatgatgtgaccttatttggaagtcggatttgttgagaaatctacctgtattttgtacttggcatctgtgctttggggctttgtcttattcctctaccggcctcactagttattaatatcaaccaaaatttaagagaatttaagagggctgactgtgaccttgaaagcttagattctaatcttggctcagtcttttcacaaaggtgtgattttagatttcttaacctgagtatgaaataagaagcataatatacctgacaaatagttctcttcttacattaattgaaatattatagataatgcatttggtatttctcctgatatatagtaaatgatcagttattagtaatcattgattgtattttatattgcctgaaatcgacagtacaatgttttgtatatgatagctatttaataagtatttctttttgataagaactgtattctgatgacatcaacctgaaagagatgtatgtttgactgactggattgaggaaaagggtgtattttagaaagacaatctttttaaacccaaactgtttttattctaagcagcaaaatgtttccagaaatatttgagacagtacgaaagaagattgtatatttgatggaaaatgatgagatttgtagctaaaaaacatggagcaccttcaaagtgttcagaaaatttattgccctatacatttggaactaagctgatcagcaagcttaaacagtatatttatatgtacttccaatgtaagcatactgatatctcttgcaccttgagtagattttcttcctcttagtcttttgatagttaggagggaaaagaaaataacttcaagtgccattttatagttttattgcttaggtatttcattcgacttcttcaggctcagcttccaaagattcattcatctaaatcagccttaggcttcacttatctctaatccccccaaaatcatgttcagactgatgccataaagcagagatctcactttaaatttatttaaccttccatttcagaagttacaatgtgattttttttattctgctcaagcaatcacaaattttaagtttctttgagtttgttctttagtggaagcctttaggatgcacttagaaaaccccattacaagtaagagtggcaagcaaataggacacatttcctcagcattcatgtgttgctatcctagggcttacccaccttgctaaagtgttcatgacatactatttttttaaaaattgctcctgccttgaaatgtagtgctcattcttatttagcttatattttctcttttaaatgtgcctatacataactctcatgaattcttatcaactaacttgcacatcagttctgatcttcctgtttcttagatatctctcaatcagaatttatctgattaataagtgagttgaagaaattgcttttgataattttattattgaatgcttatttttatgaaaaatgtttgctcagtataaagcactgcaacacatagagtaaaaatttccttctttacagtaaaatatggacttctgtttttctttgtgtttaatagaaaaaaatactagctattcaagtgccaaaaatggtcaatgtgactcagagtttcctaatctaactgtaaattctccaacacaaggaaactaacatttgccctcccaaacactatgtacaaacaaagtatgtctttgtgaaataaattatattagtacagataggatgtaagcttggtccataatgaaaatatagatttttgagctgtttttgtcatctctcctatttaaaaaaaacttttgagaggaagcatttgaaatgtggtgttctgcctttgtcaacactgtattacaatgttctcctgtcctacatttattcagatttattagctagaaatttgaatatgttcacctgtatatccttgttattaacaattattagaataattgttcttctaattaacaattagaagaatgttttcaatatatattgaaatctttctattgaaacaattttaaaaaggtgatttgcagccaaaatggaaagctatttaattgcacaaattggtagacaggaatcaaaaaattatgataacttcaagaaatagaacagaaattctaggactctaccaatcattatgaataaacctaccaagaaaaggcagcttcaagttcaactgtccatgatgatacagactaaagaagaagcatgcctgcttttccatggcaactttcccatatgttctcattatttttgttttcttaggacatttctcttctggaagtggctatggaaaaagcgacatgctatggtagacatgcagggtctcagaatacttgagtcttggctttgccacatttaggtcatgtcatgcctgttacctatttgtaaaattatacctgtcccatctaccttaataaattgttataaggatcaaatgacatgtactttatgcaaattccttgaacattataaattgctataaaaatatgaggaattattattctgcacgaagcttttcccaatattgaatcttagtaattttcaacttgttaagtcaaataattaggtatcgattaaatatactcgaggcattattactttttgctaaatgcttctatcatgatccctaccttttgattagcttctctcaaaccccttctgggcttggatatgtgacttgctttggcatatctgatatgagtaggcatgacgaaagcagaggattgaaatgttcttttgcattagtcttgccctcttgatgttctgccatcaccatgataaaagctggtccagctagcccagatagcctgcgggtctcagaagaattaggggcatgtgaagcagacctcaaccaatctgagccctggagataaagcccagattaaaccagcctaaatcatctgaatgccaaacaattcacagatgtgagaatgtaaaattaatgtttcttactataagccacagagtggaatgacttgttaggcaaaattatggtgagtatatattactcatacagaaatgcatactagaggcaggagagtgccatcacagaaacttaattattgtgtttgtttgtttgtttgtttgtttgttttggaaccaggtagcaggcaataaggaagctcacttagaagactgggataaaggcaatttgtattatttagaggcaatgcgttttggtaaaagagttgcttgacataatgtgtaagatatgaaatgaacagaatgaccatttacactgggtgagggaattttctaggcagatggctaaaagcataaactgattgctgccagttacgtataataaggcactaaaagagaaagatgagaaagtggaaaactgggtgatatacaaacaaaaaatgatgttatgacacagcttcaggttaaaaatcaaacaaatttagactaatgcccataagacatagcgaacaaaataaaactttatgggtccaaggtatgtataattaagtcttgagagagaggcatgtagatgtgtggctttagaacatggcaatcctgtgtttaaagccagtacatagaaaattcaaaaaatatacactcttacagattttaaaagattacagaaaatctaaatttcaactggcaagcattgaatacaaattataggaggccatggttttggactaaactcccacattaggcacctacagactagactaaaaatcaaaatggggtcacccatgcttaagttccatatccccaatcccaaagtaagttgttatctgacctttcaagaaatcagatgtttgcagatgacatcctatatagagaaaatcccactgtctcagcccaaaagcttcttaagctgataaacaacttcagcaaagtctcaggatacaaaatcaatgtgaaaaaatcgctagcattcctatacaccaacaacaggcaagctgagagcccaatcatgaacaaactcccatttacaattgccacaaaaagaataaaatacctgggaatacaactaacaagggaagtgaaagatctttacaaggagaactacaaaacactgctcaaataaatccgaggtgacaaaaacaaatgtaaaaacattccatgctcatggataggaagaatcaatatcattaaaatggccatactgcccaaagcaatttatagattcaatgctattcccactaaactacctttgacattcttcagagaactagaaaaaactattttaagattcatatggaaccaaaaaagagccaaaatagccaaggcaatcctaagcaaaaagaacaaagctgcaagcatcatccaaactgacttcaaactatacagcagggctatagtaaacaaaacagcatgatagtggtacaagaacacatagatcagtggaacagaacagagaacccagaaataagaccacacaactacaactatttgattgttgacaaacctgacaaaaacaagcaatggggaaagaattccctattcaataaatggtgctgggacaactggttagccatatgtagaaaattggaactagacccctaccttacactgtatacgaaaaatcaactcaagatggattaaagactaaaatataaaacccaaaactataaaaactctcgaagaaaacctaggcaatatcattcaggacataggcacgggcaaagatatcatgatgaagatgccaaaagcaattgcaacaaaagcaacaactgacaaatgggatctaattaaactaaagagcttctgaacagcaagggaacctatcaacattgtaaacaagcaacacacagaatgggaaaaaaattgtgcaaagtatgcatctgacaaaggtttaatgtccagcatctatatacaatttaaacaaatatacaagaaaaaaaccaaacactcccattaaaaaagtgggtaaagaacatgaacagacacttttcagaagaaggcatacgtgtggccaacaagcgtgtgaagaaagcttaacatcagtgatcattagagagatgcaaatcaaaaccacaatgaggtatcatctcataccagtcagaatgagataatagccaatttcccaaacagggcagtttaaatcttcaattgtcatgataataaaatttcctctactttaatccttacacaaaaaaggtagcctagtgtaacctgatgttacctaattttttgcgttgttatgtctccccttccctgccttacaagaaaagtagctttagtaggactaataacactatgtgttacttgtttctgctttcttcaacccttctctgtctataaagtcacttcttgtgctcaactcatcagaacacttattctgaaatgtatggaatgaagtgttgcctgattctagaattgctaaaaaagccaattaagatttttaaactaaatttgttgtaattttgtcttgtgacagaattgatgaccaatcaagggacttgataaagacttctgatagccctgagaccccttgaggaacacacataaaggcaccactaatcccctttgttgtgggtgatggtattttttcttcctcatggggcccagagagccccaaatgcctctcaggtgtgagctctgctgttttttgcgtttgaaccctctgatctttttgtaatcatctaacaggttcttcctgcccactgaacagacaaaaccaattcactgagacaatgctattgcagtaagaaaagaatttaattaacattatgccagccacatggcagatgaagttattacttaaatcagtctccccgaaggctcagaagttagggtttttgatgaataatttggtgagcagggggctaggaaatgggtgctgctgattggttggagatggaatcataggggtgtgggaaacagtcttcatgcgctaagtctgcctctgagttggggcgggggtcggggtcggggtgcacaggaccagttgagtcatgaatcacaagtctagttggggtcagtctgttgccagaattcaaaagtcttaaaaacatctccaaaagatcaatcttaggttctaaaatagtgatgttatctatgcaatagtgagggagttctcatgagatctgatggtttaaaagtggcagttttccctgcacactctctctctcttcttccaccaagtaagatgcaccttgcttccccttcaccttatgccatgattttaagtttcctgaggtgtccccaggcatgtggaactgtgagtcaattaaaacccctttctttataaattacccagtctcagtaattttatggcagtgtgagaatgaactaatacaacagtctattcactctctgtctgaattacattttttcccctgaaaagaaatgttaaacactctccttatgatagaaccacacaaaaattcaggaggtaatccccaagtgacttaccctccctagaaaaaaactgagttcaaagccatagttaaaaattttcttaaacttacagaaaaccttcaaaagttttctaaagaattgagggccttaattgtaacttttcaacctgaaatacctgacctctgctaaccatacaacatgttggtgagaactggggagttccaaaaaggataaaaaaggcagaatagtgttctcctgagaatagtattaaggacccaattgcaaatgattttttgaaagccattcccggccgggcacggtggctcatacctgtaatcccagcactttgtgaggccgaggcgggcggatcacaaggtcgggagttcgagaccagcctgaccaacatggcgaaaccccgtctctactgaaaatacaaaaaaaaaaaattagccaggcgtggtggtgggcgcctgtaattccagctactcaggaggctgaggcaggagaattgcttgaacccaggaagcagaagttgcagtgagccaagatcgtgccattgtactccaacctgtgcaataagagcaagactccatctcaaaaaaaaaaaaaaaaaaaaaaagaaagccattcccaaagtgtttcagctccatggcaattaacaactgagaatgacttttaggcctgccctaggccgcttgtccaataagcaacccataaaacaacagtttctaaagaatttttgccatttgtgcaaacaaccagtaaattggaaaagggactaccccaaagttttcaaagaaagcccctgaaaacaggctactaccctctgataatctccgtgataaacaccaggactgagtggcctccaagggaagctcctgcaagtttctattggttatgctttgccctgcttgttaaagggctcagccttgaagttggtaatttaatgtaaaaataagcaacattaaagtgaccactattaaactgaatggtctccaaaatacaactttctgacatttatctagctattttgaaactctttgtagaagatatttacacctataaaggcaatctccatttataagggcatttcactctctgcacctaaaacactagaaacttttacaatggaaaatacattggtttaaaatttatacaacaaaccttacctttctttaaggtacatttcctagtcggcttgtcttaattgggcctttatctacacctttcttttttctgcaactaatagtgtttagatctatgttctgtaaatttgactacatggtttcatccgggatgtttgtctaaaggagggaaactgtttgaaaaatgacaaagaatcttattggagctataagatgtgcatctgaaactgcctttgaaaaaattataactgaggaaattatgacagtgaaagagatcagacctaaccaactatatcttgcttctaacctttaagctttccttgttcattcctgggtgtaggcagaactaactttggaaaggaattcagttcatagtttgaaacaaaattgatgatagccctttcctgaaaagagctccttttgtcttggggactagtctgccttctcaggactaacaaattggctacgagattagaaattacagtttaggggtaatgcagcctctggctccaagagtcttgtaaaacctaagaacagtgcttgagctattttgcagaccctgcactggatggattatctgacaccacccaggtcagtaatctggctcaaccagttctgccatcctacccaagaacagaggacggcaagaaaaactcacttcaaccccctatgattccatctccaacctgaccaatcagcactccccacttcccaagcccctacctgccaaattatctttaaaaactctgttacctaaatgttcaaggagactgatatgaggaataataaaattcctgtctcctacacagctggctctgtgtgaattactctttctcccttgcaattcccctgttttaataaatcagctctgtctctgcagcgggcaaggtgattgtgttgggcggttacacttctgcctgagtgtctgtatgtctacatgtgttatgtatatgtgatacttttctgccaaaatgtgtgagagagctctaattaatttacttaaagaaaaaagtaagtgcttaaataacatgttttaccataaaaaaagaacctaactcaaatgctttggttcgtgtgacttgggtaaaattttggtaaataagactggaaaagagctgtgtcttctgatcagaaaacaacatatatttgactttaggaggtggtgactgcctaacttttacatgctgtagaaaatggctaagagggaaataggttaagatgatgtaaaccaaaaataaaattctaagattccccccaacctacagatagataccccctttagtccaagggcatttgaaagtaaaattgaaaatctagttcaggatctgacatgcctcattataccctcttctctttggaattcaggaacaactgaccagcattaacattaaaactgagatcttaagactgacaaaacagactttttatagcaataagacacccaattcaagcctgaatctagtatagcatcacataacagaaagcaagccctgaaagaagtattttacccctaaatatatttatttgacatattttgaaatggccctgcaaagctgtttcttgtgaagaaaacctacattctgtacagaatcccctttcctttccaggtctttcctctgatccaggagagaattaattaagactcaggcaactttttaggtctaattacagctctgaagactgctacctggaggtttcatttgcatgataaaaccttggtctccagaaacccttatcttaaccctttctactgattccagctctttagataatatctctttcaactaattgccaatcagaaaatctttgaatcttcctatgacctggaagcccccaactccctgtttctagttgttctgcctttccagaattctgggtgaaccaatgtacatcttacatgtattgaatgatgtcttatgtctccctaaaatgtataaaaccaatctgtagcctaatcaccttgggcacgtgttctcagaatctcctggggctgtgttttgggccatttctcactcatatttggctcaggataaatctcttcaaatattttacagagtttgagtcttttttaatcaacaataatggctagttttgtttcacgtctcataaaatttgccaaaagagttctaacataattgttaaaaatcagtatattaggtaagtatcaatggcataaacattcataaattcttcataatttaaaagcaatttttttttgataatgtaaactccaaatatctgagacaggtcccagtcaatttagaaagtttattttgccaaggttaaggatgcaatctcaggaggtcctgacagcatgcgcccaaggtcgtaggggcacagcttggttttatacatttagggagacatgagacatcaatatatgtaagaggaacattggttcagtctggaaaggtggaacaactggaagcaaaggcaaaggcgggacaacttgaagtggggagggtgcttccagatcacaggtagataagagaaaaagggttgcattcttttgaggttctaattagtctttccaaaggaggcagacaggtacgcatttatctcagtgagcagagggatgactttgaatagaatggaaggcaggtttgccctaagcagttcccagcttgacttctccctttagctcagtaattttgggtcccaagatttgtttttctttcacagtaccatgaaacgttaaagtgaaattgagtaataggtactcattaaatgtctgggtcattttctaaaaaagttaaaatacgaaaacattttgattaagcctaagtgtaaagtttatatactttggcattttgtttttatatggtatagagcagctaaatatttgagtctataagtaaagatttttttaaaaattgttctgtgaggaagtgcatgtttctaaatattgtaaaatatgcatttaaaaaatgttggtttgatagagttcaaaattgcttatttcctaggttgtcacaaaaaattaaagttactgagagttaagaattctaactatatgtgtaattaaaactactagaagtagggggaaaattctgtatgcaaagtatagaaggaaagtaagatgtgtttttgctgagaaaaattgtaaaaaatagaaggatatatttttgtttagaaagagcatttttttaattcagagattattacagattgttccaaaatacagaattgggaaggaaatagaaacaaggcaggaaggtactagttagtaggagagatgtgaaaagaagttataagtatgaggaggcattattggtaaagagggatgaaaagtgagagtaatatttacttttgtatgagagaaaactttgcatggttaaaatgatgaggaagaagggaaaataggtgtttgtcctaatatgccaggccaggtctccattagcaaccagagccgtcagcctttaccagcaccttagtgtcactctgatgaatgtataagttaaacattaaagaactggagaaactggtgccttagtacagaggctagaatgtaaaaacaagtccattaagatactgtctgggctttctcagaccttagaatttaattaaaataatggagacatacttgcacaccatgtaccaggacccactttagattaagtaatttttccaagtctctgaagtaattgtccagaccctggaccctagttaaagatgagatagagtgaaacactttggctttcggcttgtaggtgcactgaatgtatataagcactaggaaaaacttgtaactttgagttggtctggtgggttactccaacctcctccctgtaaccagctacagaaatgaactcccttctttcccagtctgtctgcatcttgttattgaaccgtgagagcaagcagccggaccttgttctgtccaggaacaaatctagcaagccagacaggagggagctgccctcagtggccagcctcttgcaacgagatggtcactgggaaactcccagcacctgccaggtacagtttgtcctgagcttacctgatgcaaagactgcccatccttctattgctgggtaagggcagaggttaggagcaaacatgcttgaaggatcattcaaactggattgtaagtggattgtaagccagaagactattatttcctctatttgggctcacgtagccatttgttttggtaccattgagaaagcaatatgacttgtttgtgtaactgctttgcatttgtttgaggattcatttgcatttgtttgtgaaaatttgttctgtttgtctgatatttgttaagtttagagtactcactatgggcaacactgcatctattcctacaaatagtcctctggggagaattttgtcagattggaagcactttggttatccacccatgactaaaaaaataatctattgtagcagagcttggtcaatgtatgttttggggtctgtgaaatggtggccagttttggatctctaaattttcataccctctatcaattagaattgttctgccagaggtcaggaaaatgaggcaaaatacattatgtccaggcatttatgttactgcttaataaggatggtaaagaaaatggaaataagctaatggtgcagtacactgctaaagtctgtcccgactcccaaggggagagagaaaaaacctctgaaatccaacagttaatgaacactctaaaccccatagtggctgccctcccatctcaggaaagagaaggaatgtcactgccagagtacagggaagtagcagagctactgtcttcttctcggactaaccaaggtactaattttggctggggagtcaccgagtccaaagcagggctattcccactacgataatacccagtaggagtcaatcagcaaggagttccagccagatgttattgggcctataataccactatatttgctacacaatgtcccacctaagatgtgcaggctctcctaaacattaaggtatctggttttaaataaagcaaaggaagaggcgcaacatcttcataatgaaaatccaaatgacactccagatcctgacagggcgattcaccacatggacccaaattgggatattgtagaggacgtacatcgcagtgtaactaacatgtatactaagttcccttattttcctggagatcataaagggtttatactattggatttaaaagatgctttcttttgcattctcatagacacagaaagtcaattgttgtttaactttgaatggacagatcttgaagccgcaatgcagtttcaatattgctggactgtactcccaccaggatttaaaaactctccgactacatttggaaaagccttcgtttgaaatttaaggagtttaagattgggaaatggaatactgttacaatatttggataatttactaatagctaccccatgtgaatgggaatatcacaataatactattaaaactttggaccatctagcaacctgtgggtataaggtttcaagtaaaaaggctcaaatatgccaacaaactgtgcaatacttaagttttttcttacagaagggaaccagagctctaacaatggaaaggtaaaatacaatcacttccattgcagcacccactaccagaaggttgctgagaggatttctagatgtggcagggttttgtctattggatatggattcctaaccatggactactggtaaagccactgtttgaactgtttaaaggagctaacaataacatctttgactgggagcaaaacaccagcatgcattcaaacaactgaaacataagttaacccccaccctagccctggggctcccaaatcctcataagccatttcaactgtgtatgcatgagagactgggtctagtgctcggggtccttatgcagaagttaggagaaataagacagctggtggcctacttttctaaacagctggacacagtggctacaggctggcccccctgtctgagagcacttgccaccaactgcctattattaaagcaggctgaaaagctaaccttgagaaagcctattacaatctacatgcctcatcaggtactagtgctactttagcaaaagagaggctattgactgacagctgatgggttaggcaaataccagggcagactcttagatgaccccactatgaaattacaaaccaccagagctctaaacccagctacattactacatcctaccaaggaatcagaggaccccatgcgtaattgtttggaaatcattatcaagtgttttccagctgccctgatttaaaggatacggacttgctgcatgcagactggatattgtttgtggatgggaacagcctggtagccaatgggaaaagaaatgctgcatatgccatggcaaccttttcagaggtaatagaagcaaagattgtaccaatgggaacctctgcacagaaggcagaactgattatccttgtgagagacttgcagttgtcccaagtatacaaggcacatggaataaattggagactacagtcagcatggagaccacaatcttctggacagactaaaagtataaatcaaacactaaaaacaattattgccaaactgcgccaggaaattcaaccaagataggctcaggtagttggcattgcactgctccaggtaaaagtgaccctcagaagtaggagtaagttaagtccctatgaaattatatattacgagaacctttgccgctaatctgtctctggttactagggtggtccttaatagaaagtcaactattaagcaggatgttgctcatttgggacaaattcttaacattttgcataagcttgcttccatctggagcattgtctggtgatcaagtactgctaaagaatggagggcccaactcaacaactacaggagaaatgggaaggaccctacaacgtgttgctgaccaccaattcggcactgaaactggtgggcatcaagccaccacatatgggtaaagaagtttctactagatgaaacatccatgacagaggacaccaaggcccccaaatgggagttggaacccatggaaggcctaaggtttctgttcaaaagatgataagctattcttttataatatttttcttcactgttcctcttgttgtttctgcttacacctctaaccttttcctataatgggcacaagaatatgcagatagcctacagcaagactcttgctggatctattacccctctctagtaccacaggactgctttggtgggtctccccccatacaaggaaaattgggttacttcctagaaaatcataaaaaatgggcagggtcgcaggtgagggggataactagaaaaaaagtatttctgaatggcctataaataaaactttaaataatccagggcacaggttccttcttgagctataggtaaaactgaatgttgtatgtatattcccaataactcagaaaacatttatttagctttaaagaatatgaaccaacagattgaagccctctatagctctgcactgtctctcaataaattaatagcatcttggttgggtgaaggaccttcttggtggcagaaaattctggttgtcctagccaccctcttgggcataggcataggcataacaccatgttgtggactatattgttgttgtacgctgttccaaaacattccctgagctcataaaatcatgtttcaacaggcactggctttgagtccccgaaaccaagaacactaccaatggcaagtagatatttaacactccaatgtctcttgacgatgaccctcttcagtaggaagtagccagagagaataagtcatccacctgcccttactgctattatattatagcttatactctgtactaacccataatagattaatgcttgaaactaacatgatggaaatcatgcacaaattgacagtgatgattgtggcaggccgggtctccatcagcaaccagagccgccagcctttactgacaccttactgtaactctgatgaatgtataagttaaacattaaagaaatggagaaactggtgcattagtacaaaggctaggatataaaaacaagcccgttaagaccccacctgggctttctcagacctttgagtttaattaaaataatggaggcattcttgcacactttgtaccaggacccactttaagtaatttttccaaatctctgaagtaattgtctaaacagaccccagactccagatgaagattacacagagtgaaacactttggctttcagcttgtaggtgcactgaatgtatataaaccataggaaaaacttgtaattttgagttggtatggtgagttactccaaccttctccctgtaactggttgcagaaatgaactcccttctttcccagtctgtctgcatctcgttattggacttcaagaataagcagtcagaccccattctgtctgggaacaataaggtagaatgccaagatgttttttataaaagaagtataagacaaaaccgaacgtttaagcaagttgtagaagatttgtggaagataaatgtcatgaaagaaattttatgtgtgatcaagatgggtaaaatgagaagggaattatttatgtttctttctagaaattgaatgttaatatcaaaatacactaatgcaaggataaagtttgagcccatgtgttggaacaacagaattttttcagagcattgaaacgctctttaagaggaaattttgagaggtctatttttactttttagataactggcctaggaggcagagattctattttttaagataatttattgtgctttgtggctttaaatattttagcagtttggtttgatttcctagtgacctatgatcctattttgatcaaatgttttaaatctttgatatttgacaaacttctcaaaaatcaatgttaaatcattttaatctccaagcaaagttgggacattccagtgatacctggaatttctccaaggatctgtaaaagagagatattaaacctgttgatttaatgtgatacgttaaattacatgggaagcattgacaaaataaaaaatgatgtttaagcttctacaagttatattaatataaatatgttattaatatgtgttctaaaactgtataaagttcctagaaatctaatataacttggtagagatgctattagtcataattttgctttagaaataacaaaatgtcttggcaattgtgttattattataatgaactctcatcaggtttttagccatgtccattgtaattcttgatgtctactgtgaattcctttattcttatgcttttctgaaagcttcttgcaagcaattataatcctgaagttttctgtctttaagcagcttcatggaaagaataaaaaaacctctgaaaagtacaagtttctaataagtttacttgaattttcaaaattctaatgaagaaactgatgggtttgttaaactgctaaacaagaacagagctagaattaattacatgagacaataaactgatgaccaaaaaatgggcttttaaggcttcatttcaaaccttgctggttctgttagtgttttcttttcaagatttaagaagctgtttcctttaatctctctatagcttacaaaaatttggaaaaacatacttttctaaacaaaaattgaaacattttcttttcctctctccttggtctcttcagaattcagaaagtatttgtgagtattcttatttttatggcaatatgattatttgtataagttcaatacaaaatatgtttttttataacaagatactcttgaaaacattgttatattgccaaggctttgactggaacgttatatttgaaaatttcccatttgagaatgcctggcttcaaaaatttctggccttagagtgagtgggcaaaagttttcacttcctggaaggctcagaaacatcaagacattagatacagaatgaaacattgaatgtctgccttggtttggcttattagcattgagagatttttaaaagttcaatctgaaattccttgtcaaaacttccagcatggcaaattttaaagggatgtatttaattattcttgccacataaatacataaataatcaggctaaatttgacactaaatttattttgcaaccactttcgtcttactatgatcatctttggtagaaatgggagtcactatagagataaaaattattttccaaaagaaaactcagtacacctgttattagattgcagtgctgttcattgttttttagtttttcctgtctacttataggtaactggattctaaattctaaattcttctacttttctctaatatatggctacaactttccaatgaagaatgaaaactgctcagttactgaagccctataagccaaaattggacaaattttatgtaaattacaaggaacaagtctcatgccagatctgtgggttccatagagttcaccagaatatcctatgccacaactggagacatttaaacttcaaaccaatacaagaagttgctgacttcatgctgtggacagcatttccaagaccatcagaacaagattttctgtcatgttgagactcttacccctcttaatatttccttatgcctgcctctttcacttggcaggaaaatgctgtagttaaaatttcacattcagtagatttagcaagtaacttgtacttcctgctttaatttaacccagtcatgggatgctagattacctattattttcatagagagaaatctatgcagatgatgacctttattgtcaacatggataaatacagtgggtattatagagtggactacttggttcaaatgtgtaagctccttgtctggttatttaattttagttggcttggttcacggggacggtggttaagaagcatactccaaactcttgttattatcttcctggtagtcataacagtagtcttcctggtgtgccgtatccacctaaaaagttttgaatgtttctatatagccatcggtcaaacatcaaatattctctctctggctataacaacaaaactcaaagaaatgcataataatgaggaggacactgtaacccataaatgacatgctaagacaacaaacacaaaattatggtaaccaggagtagcaatgatgtcctatggtgatgtctcacctaggtgagaacctggcagaaagaagggaattgtaaaataaaaattttaggagaccattattttggactaagcttctgcactaggccttaacagaccagactagaaatgaaagtagagccacccgtgctaaagttctatgttaacatacccaaactaagttcttatgtgaccttctgagaaatcaggaaaaaaagagataacagccaattttccaaacaggcaagtttaaatcttcactcagcataatggagttccctttgcttaatccttacacagaaaaggcacgtgttggtgatcagatgacccccagaaaaactgcagatgcgtaagtgagatataaatgattattcttacattccactgagttttgggttagtttgctttatagcaatattaagctgactgatagaagcatcattgctagactaaatttttataaatctggaggaatttaatggatttcaaattgttggcctgtaaaatgaatgaaaaatatgttcatagtggtagcacatcgtgtgctggtatgaaaggttacctaagttttgagtcaaaagagtagggttccagaaacagtatgtttttttatattgggcttttataagttctctcaactttttttttttttttttaccattttgatatgttagtctttctaataaaatgatttgccttttagtgacagtattgcatttttgataagataaagcacaataacctgaactatctgaagaaacaagcatcatagagccataattgctgtgttaaaagttttcctagaataaacacaaaaaataattgaaatacctatataataagtaatattaattacatagagttaatggactggaggaaaagaagcattatagttattaaacatgatatctcaaattgtttctggtagaaggtatccaagttactggcagtgaatctgtacgagtctacagcaacaattcttgcctcctcagaagaaagaatttgactgaggagcacaaggcagaaaaagagaccaaggcaaatttcagagcagtaatgaaagtttatttaaaaaggatttagaacaggaaagaaaaaaattatgctgggaagaaaaccaagtgggcaacttgaaggacaagcgcagtgctgaaccttgatcctaggactttatagggtggcccaactctggcattttgtgcctctttcccatgattctttccttaggctgggctgcctgcacgtgcagtgccctccttatcctttggaagtgagcacacacagtgtatttaggaagttgtgcacatgcccatcggagactttcttcccttttccaggggagtgccaccagaagatcatacgctaccattttctctctttttctttgtcttttctttctttctttctttctttctttctttctttctttctttctttctttctttctttctttctttctttctttcctttctttctttctttctttctttctttctttctttctttctttctttctttctttcttttcttttcttttcttttcttttctttctttctttttttttgagacagaatctcgctctgttgccaggctggagtgcaatggcgtgatcttagctcactgcaatctctgcctcctggtttcaagtgattctcctgcctcagcctctcaagtatctgggattacaagtgtgtgccatcacacccagctaatttttgtattttcagtggagacgggggggtctcaccatgttggccaggatggtctcgatctcctgacctcatgatctgcgcgcctcagcctcccaatgtgctgggattacaggcgccagccactgcgcctggcccattttgtctcttaatgcacatgcccaggaagttgtttctccctggagcctgcattcaattaacacttaagtgcaacaggtgtggaccatcaggaactggccttcccctggcaccagctgccaattatcattttcagagaggcaatgtgataattgtcgaaccatcacctgattttcctggtgggtgggggaagccttcctctgccctactcatgcctatctaactgtctgtaacattccccctgtcaagagcccaataccccacatctttggggtaaacttggtggtcagtgttctataactacctcccactgacaaagtggtggtgattctctgggtcttggcctcttgctagctgtgagggcaggagggtgactctgtgtgttggtgaaagcagtgtatagccaggtcaaagggagatgggcaggatttcacatccttcctgtcccactgatgggcagcctaggggtcccctgtagaagggtgcctcttgaaaatttagaggacagtatccctcactgagaatcttctggagcatgatggcctaaagcagaggagacaaattaggttattataattagaagaatgttaaaatgaaataaggtagtgaaaacagctccaaaaaatcctgaggcagtcaacactacatgctaaggtaactggtagctatagacatgcctgctaaaacttggatgcattgagctgctagccaattccaatgtgtgcccgtaattagaatattatctagatttttacattacccatcctgtttatttcttctgagctgcagcaagagatcactggttggttcacaggaataagcagggttgttctaaaatgcagacaaaaacttaaaaacaactgatgagactagaatctaatgataggtgtaccataacttttgaaacataatttctgtctctctagtcctcatttttgttaaaaacaaatcatgataggattgatttgtccaaaaaataaactttagtcttattatacttggcctcattattatcataaagtgcaacaagaatagttatttttcacataggcttttaacttggctttgatggaactttgttccatagaaggaatctcagataagacttttttaaaccccaggccggccatggatttgtaccatcaaatacctagtggggtaaatttctcttctcttgaggtcccaaaataactttgacctcctgatctgttagaaagtgacattctttacttaccacaggtcagcaactctgtacaggactgtgtagacaaggtatgaagccaggtttcccaaggggtttttattggctctataagtcaaatttgattccttaaaggaaagcatgccattccagtgaaagccttggtaagacaacccttttctccaattgtcctgttacaaaagaaaacattctcatgcacttatgcaaataaccatattgccgtaagttaagaatactcacacatagtttccaaattatagagaaatcaggtagagagaagcaaatatgcaacaaattttgttcacaggaatatcctgtactcaattgctacaatctgtcaattgctcaaaagaaaagtttccttgactctgaaaaacaaagcaaaggatcagcaacattttaaacaaaaagtcaaaaaagattacttcagtcttctgttaattcacttcattcagttaactgctattctgctttatattcatgaacattttagctctccatgagagtcatgaaggatttttcttttattctaatgtcacaatctccaaagttatcagaaatctgcatttaagaacacctgttaatgttgtatagctgattataaaaccaccatttaaagaggattaaaacaagacaacaattgtctatgaatgaccaagagtcttagggcagccacagttaaagaaacaattgacaaagaaatgtgttacctctgtggcacacaacagttttacataacaattttaattattaataacatatactaagttgtattagaattccatagttttggagcacataccaataacatatttatatgaatacagctcagagaaagaactcttagcaacttttggtgaaaaacctagttagtaagcaattttaattatgtgcttggtttggagcagataagaggtacagataagatctgactcttttgagaatagctaggggtgtggctaactccacatatccccaggtcttacctacctgtaaagcaggcaagttgtatagttaagattcatagtgaagcattgaggaggtctaataacaattaaattgtataacatttattgtataaattacctttcatgaatcctttcacggcttacactgaccatctttgacatgctcggacattctgatttgtcctaaatatccctctttttaaacaaccagtcattttactttaggacaataagattccttcttatataaaatctcttttctttataacctctctaccaaaaatacctctttgcctttataacctttgaattaggcaaaagtcattttccttctgttaaaaaattaaagtttgtactgcacattgctatgcaggccctgtgaagggagagtaaagacattatctacatactgtagaatttagctctcctcaagtgattacttggttagatttttgctagggctattagagaggaagatgaattggacaaatattaagtgaacacccatcttggagggtacatttttgcaccaaagaggtgaggggtagccagaccttacaaggcactgttgagagaatggtaattggtcccttaagtgatataaaggggtgtgaatctctttttgagggaggggatgctatttgcctcacccaacaggtttatccctgtcctccttattctgctctcggttataaaagactaaagaacctaatctgaagaccccctgcacaggagcactgtgttgcaaggctgacttttgtaatttcctaccagttcatttttaagccaaacagtttaaggttagggaaaattaaacttttcccatttttagggaatgcatccaaggggtgtgtcctgtggtatgaagacacagttactcatctgccatttgtgaagagggaacagaggggaaaaaaagaggaaaaagaaaaaagaaggcatctcccctttcttcctattatcccaaatggggtgtcccccatcatcctgggttctggacttaagcagtctttaccatgtaccattggtcccatcttgtcacaattacccacttgagaacagaggagatattggaatgaacagttggtccctgttcattcctggagtttcagaattaagtggtcctcactgtgtaccaccccccagcctttcatctctgttctcatggtaatctgttagcctgggaccacccttcatctctgttctatgggtctcttgcatctgtggccttgggccagcctccttgtctccataaccttagagtgaccctcactcagagcattttacgaataaaatgattatcccttttcttagaagaatgtttctccattaactgctgcaaggactggacttctttccctcctcccttagaatatgaccttgaagatcttgatacaggttgagaagggcatggaagtaattagagaaatggaggctgcaggaggaagtagaaggaagtgagagaaatattcatggaaaggcttcatatgctcttgaaaatagctgctcttggattccagagggtcatgtgtattcaccctctggacataaagcagtaacctccggaggacttggggcttggggtaagaatttctcctcttcccaaagtcgtgctggctaaaaaggcaagagggtggaatccttaaagggccagagtgaagccacatgcagccagacaagcttgttatgatagctatcagaaaacttagcccttgggcataacagcaatgaaaagcacctggtgagttctaagaagctggcagagctgaggttccagttagtgtcctggccatgtgccagcagggatgggaaggattgaaggtcatctgaactggcaaaaaacaaatataaacctccagaggtattcgcaagggagtccatgactttgctgctgcacaaacgcagagaaccatgggggcatcaataacagggagtgtgtatttaagaagtcacatggcatgcaaagtaaaagcaaagaagcaggcttgtccccaaggtggaaggtccagtggatgtccaaagccatttcagaacacacatacagagaaaacaggaaattgagcagttcaggtttttggaaaagagctgattttagatggaagaaataaaagcagaagcatccccagacattgcatagtttgtaagccttagcctcaccactctcaggaccctcctgtctaagagggccatttagtgcctctaatcttctcattgtgaaccctaaggtctttcctacccacaggagccacctataagggtgagctgagaaatttgctggggaaagcatcgtcacctaaggccaagaggaattgttctgggggttggttagtaagcaggagagagagagagagagagaggaaaaaccacacacggagttggatgcctccagccaaagaagacgaggcatagagatatcttaccactaaggaacatatctgagtcacgtggcaccaaatatgttagtggtggcaaatatcaatatctgagtcacttggcatcaaatatgttaccagtggaaggtatctgtgttaccagtggtgaatctgtataggtcagcagcaatctcaattcttccctcctcaggagaaagaatttgaggaacatattctccaaaagagaccaaagcaagtttcagagcaggagtgaaagtttattttaaaaggctttcaaacaggaaagaaaggaaagtatgcttggaagatacccaagcaggtgacttgaaggacaagtgcagtgttgaaccatgatcctaggactttataggctgacccatctctggtgttttgcacccctttcccatgattcttcacgtagggtgggctgtctgcatgctcagtgccctccttactgtttgaaagtcagcacgcactgtgtgtttaggaagttgtgtgcatggctatctgaggctttttcccttttctagtggagtgcccaacagaagacgattctctgccattttgcctcttaatgcacatgcccaggaagttacttattcctggagtctacattcaattaacactttagggcaacaggtgtggaccatcaggaaatggcctctccttggagccagatgccaattatcatttttagagaaccaatgtaataattgtcaaatcatcacctgatattcctggtaggtgggtggagccctctcctgtctaactacctgtaacaaaatgtatttgagtattgtcagcccaatcatgattttagaaatggagagattcttcaaaagacctaaaaatcaatgttaaaaaaacctattttcctgtaacctatgaaattagtataaaagaaatatttaaaaaattgtttactttcataaaatttagctattatatgtaatttatcttgacattaacactgtgactctgaagcaaaacaatgttagtggcagctgaagttttaacttaagcaaaatgtataggtttaattgattttttcaaaattttattaatagcaaagttgggaaatgtaaggtgggtaataaatagaatcttataattttttctgtgcaaatgaggatgttttaaatattatttgtcttcatcttttaaatgctagcataaaataaaaacaatgtactagacatgttctataaacttttgtaaacaaatttacatttgttaatatgaaataaatggtaacatgactaattttagaatctttataatgttgcaaattgtgtattgatatacacaattacaggcatgagccactgcacccagccttagttttttttaatcatcagtttaaaaatgatcagttttattacaaattagtaattttacaataatattaaggggtttaagaggctctatttcttttattcaattattgtctatttatttggatccaaacataattatcaccaaatatttcattttttccattgtttaaccccttaaagttctatctaaaatgaattacgtgattggacttaataaatttttgctgatgataattatctctctgtctgtactcctggagataaactccaggagtttactccacaggagtaatgttaatagatcccatctacatgtaagacctgtctagacatggagacgagtagggggtttgaaggcatcactttatgcgagagtaacaataagaggagccatccacgcactgtatcattgaaataaagtttaacaaaatcacaagatgttgtgggaagtcagggaccctgaacggagggactggctgaagccatggcagaagaacataaattgtgaagatttcatggacatttattagttccccaaattaatacttttataatttcttatgcctgtctttactgcagtctctgaacataaattgtgaagatttcatggacatttatcacttccccaatcaatactcttacaatttcctgtgcctgattactttaatctcttaatcccgtcatcttcataagctgcggatgtatgtcccctcaggaacctgtgatgattgcgttaactgcacaaattgttcataaagcatgtgtgtttgaacaatgtgaaatctgggcaccttgaaaaaagaacaggataacagcgatgttcagggaacaagggagataactattaggtctgactgcctgggagccggggcaggacagagtcatatttctcttattgctgaaaatgggtaagagaaatatcgctgaattctttccccagtaaggaatattaataattaacagccctgggaaaagaatgcattcccagggggtggcctctaaaatggccactctgggagtgtctgccttatgcagtggtagatagggatgaaacacgccctggtctcctgcagcacctccaggcttgctaggattaggaaattccagcctggcgaattctagtcagactggttctctgctcttgaaccctgtttcctgttaagatgtttatcaatgacagtgtgtgcacagtgggacatgaaacttcatcagtagttctagtttcgccctggccttgtgacctcgccctgcccatttgccttgtgatattttattgcctttgaagcatgtgatctctgtgacccacaccctatttgtacactccctcccctttgaaaatcgctaataaaaacttgctggttttggggctcagggggcatcacggaacctgccgacatgtgacgtctcccccggacacccagctttaaaatttctctcttttgtactctttccctttatttctcagaccagccaacacttagggaaaataggaaagaacctaccttgaaatattgggggctggttcccctgataacaaggaaaagttgaaagaaactgagtggagttttattctttttatcttttagttttttaaatttaaatgaaattgtatatatttaaaatgtacagtgtgatattttgatatacatatacatggtgaactcattactacagtacagttaatgtgaattaacattcgtggttgtattttttttcttgtgttgagaatacttgggacatgcaatcttagcaattttttttctaaagaagacatatatatatggccaataggtataagaaacagtgccaggcacagtggctcacacctacaattccagcactttgggagaccaaagtgagagaatcacttgagcccaggagttcaagaccagcctgggcaacatggtgagactctgtctctacaaaaattagaaaactagtcaggcatggtggcacatgcctatagtctcagatactcaggaagttacggcaagaggatcccttgagcccaggaattcaaggtggcagtgagctgttattgcaccactgcactccagcctgagtgacagcaagactcagtctcaaataaaaaggaaaaaagtgctcaacaccactttgcattaggaaaatgcaaatgaaaaccaccatgagatataatcataccccagttagaatggctagtatagaaagatgaaagataacaagcgttggtgaggatgagaagaaaaggaaaccctgtgcactattagtgttaatgtaaattagtacagtcattatgaaaaaatatgaagttttctcaaaaagctaaaaatggaactaccaagtagatattttcactttgaagtttatcagagaaaaatacaacattgatgaaactggaaataattaggttaagtgaaataagccaggcacagaaagataaacatcgcatgttctcacatatttgtgagatgtaaaaatcaaaacaactgaactcatgagcatagagagtagagggatggttaccagaggctgggaagggtaatgagggctgtgggagaaagtggggatggttaatgggtacaaaaaaaaattgaaagaatgaataagacctagtatttgatagtacaacagggtgactaaaattaataataacttaattgtacattttaaaataattcagagagtataattggattgtttgtaaatcgaaggataaatcctagagatggatactccattctccatgttttgcttatttcacattgcatttatgtacccacaagaattaaaaaatcaaaaattaaaaaattaaaaaagaaaaatacaatgtgtttattatatcttttaaaaaattggtgttttgtttttgtaaaagaaaatacagtaattatttggttgattgcttcataacatatgtaaactaacagccaactagcaagataacttgaaatattaattttttggcccatttttattcctgctcttccagatgtatgaacttctctcctacttagaaaaaataaattgcataaaaaattaagatttccataatttattagtttttactttccaaaatataccttgattagacacaacagtttcggaagccaaaattttctttttttatataggtttgtttagatcaaaggtatttgacaatcaaaagcctgtacatgaaaaattttgagtttattccatttcaaagaattggggaagagaatcaatagacacgtagactaggtaatctttaggaaagactggaggagagtacctgggctgaggaagacaggagtagttgatgcagcaagggtaagtaggactatagaaactgacaaggaaggaatcgcatctaatggaggaggagtgggataggagattcagtacaaagagactgttgaacactcttgcttagactattaagcactcttgtttatagcaccagaaagttggataaatgggagttggtgcctacagagtgctctggtctgaatgcgtcccctaacattcacagtgtcgaaacttaactaccaatgtgatagtattaagaaagtaaggccattaggatgtgattaagtcaggagtgaagagccctcatgaatgggattagtaaactcataaaagagactgaagggagtgacctagtccttttttgccctttttttcttctttgaccatatgaggatatagtgtccaccctcattggaggatacagcaacaagatgccaacttgaaagtagagagtgagcccttaacagacaccaaatcttctggcaccttgatcttgtaccagctttgaatatacttttaagtaattattgagaagtaaatttttattatttttgaattattttatctgtggtattttcttatagcagcagaaacagactaacacagagataatatgttatcacaggcctttgagtgaggcttgcctatgatgagtagctgctgtcattgtttttgtcactgttgagaggcaatcatgacagctctctgaatccccaaaagattttccagattaaatcagaactacctgtgattgacttgttcagtccactttatctgcttataatgacaaatctctttcagtaatatatggtcttgaggctcctaaaacagagggcaggatcttgaatatccagactacacatgttggtggtggttataactgtttagaagggaaaccacttctaaacttcttagtcccaatacttgtatgagtccaaagcagtggtcacaatttgctaccacaccaattccattagctgtttttgtgttatgttataaggtgaacaattcatattgtaaatgggaagtataatggtgagaatagactctcatctgtgacaaattgttttcaggtggagtcatgagtcttgaaagatgagtaaaaaaaattccaggcttgggccaggatattggtgtgagtgtatatatctagcaataaaaaattgttttaaacatgaaaatactgaacaatataagtcattatagatgaatttgaaggatcaatgatgagataaggctggagaattaggaaatttctatatcatcaaggaattcttttcacttgaaatctattagattttatcctctaggccaagggtccccagtccctgggctgcggaccagtagcagttcatggcctgttaggaactgggccatacaacaggaggtgagcagtaggtaagctagcattaccgcctacactctgcctcctgtcagatcagcagcggcattcgattttcaaaggagtgcgaaccttattgtgaactgcatttgtgagggatctagattctgtgccccttaagagaatgtaactaattcctgatgatctgaggtggaacagtttcatcctgaaacaatcccccacctcccgtcccacggaaaaagtgtcttccacgaaaccagttcctggttccaaaaagggtggggatgactgctctaggccaaagagatttttaaatctccattgaggaatttcaaagagatgaaggaaatgataagatttgcattttagaaagattactctgtgccgtgatcaaggatgttcagactgaaaagagacctttgaaatgctatagaccttgagtcttgcttgaagtgtaattagaactaagatacatggttcttttgaatatagttgtaagtaattattaagaaacttctgctattgctatttttattttatttatgctttgtgtgtgtgtgtgtgtgtgtgtgtgtgtgtgtgtgtgtgtgtgtgtgtggcagggtctcgccctgtcacccaagtgggagtgcagtggcatgatcatggctcactgcagcctccacttcctgggctcaagtgatcctcccacctcattttttgatttttttttgtagagacgaagtctcaatatgttgcccaagctggttttgaactcttaggctcaagcaatcctcctgcctctgcctcccaaagtactgggattataggcttgagccactgcacccagctgttgctatttttaatatttcataataatttatcttctacattttgtttttatgagcatgtattttttattacaggtctgttgtcctttatttcatgtggactataaagccctattttatatctagtatactgagtcacggtggtggcaggcagaaggagagaaagacaatatttattgaccattttctgtttaatatgtactctgctaggttcttttaatttatagctacctaaatgatattcagtgagaagtagttaaacagaaataaaagtttagctgctatatctagggatagagttactgcttttttagcaaatatgtgatggtgtttgtttttcagcctgaagggactatatgtttgattttcaaccacaataaagaaatagcctttcttattaaataattgttaaagttatttcagatggcacaacatgtgaagaatgtgttttgttgtagtgagtaagtaaatataacacacgtacataagccaccaagttattaaaatagaaaagcatttatagaggcacacaaaacgaaaagtcacatcaagaataatcccttgttaacaaagggcagaatagaccagaacaagaatattcttgaagtagattcatcaacagaagaaaaaggaataaagactatcataaaagaatcgctacttgtagtaatattaggtcaaggattttccattgctctttagtgaggggtaatggcaaagttagataaaaccttcactgtaaggtgttcactcttgccatttgtaaggctagattatgctattaatctttgatgaaggttctgctagtcccaacaaatacctttttttctttataaatctcctacttaagcatgccatccaaatattgtttgaaatagataactggattggatgatcctttattaacttttaatcaagattttgattcccagaatgaagcatggtgaaccatatccctcacagacttttgtttttacttaataaagctaattattacatattctacttgattcacataaccagtctataagattttattcacattttacagaaaaattgaagttcagaaggaattatgcatcttaatcaagaccacatatccagtaagaagtagatacaagaaacaaacataaaattgggtaattttgttttattttcagttgccatgcctttttaatattttttaaactggaacagtttctggatcctttattgtatttcttgacattgatgtttttgaattgcacagaccaattgttttgtagactgtcttagtccacttgagcttctgtaagaaactgccatagactgggtggtttatgaaaaacagaaatttatttctcacagtcctggatgctggaaagttccataatctaggcaccgacagatttggtgtctggtgaaagctagctttctggttcataaagggctgttttctcactgtgtccttacttggtggaaagggaaagagagtcttttgggatctcttttgtaagtacactaccctcatgatctagttaatgacttatcaaaggccccacctccaaatatcatcacatttgggatcaggacatacatttagcctatagcatagactatccaacttgagttttttttaaatatttttttcaaattttttatttatgtttccataggatgagattcaggtcatacaattgtggcaggaataccacaggagttatgctaagttattgtatccagaggtacatgcattactgataatcttatctttgatcatcttggtaaaatgttgtcttccaggttactccactataaagttactatttttcccccttagtaattaaaaagtatttgtaaggtgataatttgagaccatgtaaatacattgttatttcttaagtttttacctaagagatttagaatccattgatgattcctgcctgaattatttattaccatgatgattgctgtcatagcccattgtatgcagctatgccagaataccacagactgggtaatttacaacaagcagaaatctatttggctcatgtgttctagaggctggaagtccaaggttgaggggccacttttttcctgtgttatcccatggtgaaaggtatcaagtgggtgagggagagggaaggggaccaagcccatttttttgtaagcaacctacttcccggtaaatggtaataatccattcacaagagcagagccctcatgacctaattctcttaaaggttcaatctggcaacactgttgcacaggggattaagtttccaacatatgaaatttagagatgcattcaaactttggcagttgctaaggggtactttttaattctatcatttcttcttatcagttggctttctactatgtgtaaggatattccaacttgttgtttgtttctgtgtagactgatggattatttaataggttataatgttttaatattgttagttcatattattatttattttgatgttcttattgtcccagatttggacaaaatatgctgtttttaatatgttctttgttattttaacatgtcagtatcattagttgagtacttttttactttttggcaaaaagatattttagattcttgtaattgtccctcctccagccttggtatcagctaccctttttaaatacccccagttccttttagtagaaaatgcctttacaaactaagatttgaggagtaggtatgctgattgttattggggagatgttgcttctagtctttcagcagaaacatctagggaaaaagtatatgtgtatacatacatatataaacatatacatacataaaaatacccacacatatctgtatttttgtgtatgtttaggtgtatgtagatatgaagcctatgattataattagaatcaaaatcatcattgtgaaattaaatttaggtctgaactttcttgaagaaataacagataaagaaacctgagaatatttatgttttcaggatagaaattttttcctgtaattaattctaagacttcttattatgatctttgtacaaagcaaaccgctaatgtttttaacagtagttttatgtgagttgcataaatgtacataattaatcatagataccttcaaatgttcttatatttactcttgatacaaatcaaactattaaaccattattccatttaagtattattatagaaatttaaatcattacaggtcttgtgacttgatattgaaaaagagcttagtacacatagttcaatgactttttagtcttgctatttgattatctttctcatatattacttgtctcaatttaacttggcagaagcttgattacagaaatgaaatggtggtcaattcaatatttggttcttttaaaaacctgggaattgacaatttataattgtatacattttgggggcacaaaatgatgttaaaatttatgaacacagtatggaataatgaaatcatgctagctaacatactcgttacctcaaatacttaaattttattgttgtaagaacatgtgaaatttactttctcagcaatgttgaaaattaactatattctccatactgtattattaactatattctccatactgtgcaataaatctcaaaaagaaccctatatccttcctgttctactaagattcaatgtcctttggatatcatcttcctattcccctcaaccccagcttctgtaaaccattcaattctctgcctctgtcagttttattgttttagattccatacatgcagtatttttttatttctgtgcctggcttatttcacttaacctattgttctccaattccttccatgctgttacaaatgacaattttgtttttaatgtttaaggctgaatggtattacattgtgtatttatactaaattttctttattcatctgctgatgaacaattaagttgattctataacatagctattgtgaataatgctgtaatgaacatggtagtgtagatgtctctttgacaaattgtttttaaatatttttgagtaattacccagaactggggctggtggattatatggtaattgtatttctaactttttaagaaactattatagttttccataatgactttactaaattacattcccaccaatggtgtacaagggttcccttttctgcatatcctcgccaacatttattatcattcatgttttttataatatacattctcacaggcatgagatgatatctgtattagtctgttttcatgctgctgataaagacacacctgagactgggcaatttacaaaagaaagaggtttaactggacttacagttccacatggctaaggaagactcacaatcatggaggaagaaaaggaagagcaagtcagcagcttacatgtatggcagcaggcaaagagagagagggagcttaatgcaggggagttccatttttaaaaaacatcagatcttgtgagacatattcactatcatgagaacagaacaggaaagacctgtccccataatttaatcatcttccaccaggtctctcccaccacacatgggaattatgggagctacaagatgagatttggatggggacgcagagtcaaaccatattattccacccctggcacctcccaaatctcatatcttcacatttcaaaaccactcatgccttcccaacagtcccccaaagtctcagcttatatcagcattaactaaaaagtccaaagtctcatctgagacaaggcaagtcccttccacctatgagcctgtaaaatcaaaaggaagttagttaattcctagattcaatggaggtacaggcattgagtaaatacagccattccaaatgggataaattggccaaaacaaaggggctacaagcctaagcaagttcaaaatccagtggggcagtcaaatcttaaagctcaaaagtaatctggtttgactcgctgcctcacatccacgtcacactgttgcaagaggtaggttcctatagtctttggaagctccgcatttgtgactttgcaggatacagcctccctcctggctgccttcatgggctggcattcagtgtctatggctttttcaggagcacaatgcaagctgtcggtggatctacaattctgggatctggaggatggtggccctcttctcacagctccactaggtggtgccccagtagggactctgtgtgggggctccaaccccacaattcccttcgccattgccctagcagaggttcttcatgagggcctacccctgcagcaagcttctgcctggacatccaggcatttggatacttcttctcaaatctagatggagcttcccaagcctcagttcttgacttctgttcacttgtaggctcaacaccatggggaagctgccaaggcttgggacttgaaccctctgaagccatggccagagctctatgttggcccctttcagccacaggtggagtggctggggcacagggcaccaagtccctaggctgcacacaaaagggggaccctgggccaggcccatgaaaccactttttttcctaggccttcaggcctgtgatgggaggagctgctctgaagacctctgacataccctggagacattttgcctattgttttggggtttaacattcagctcctggttacttatgcaaatttctgcagccagcttgaattactcctcagaaaatgggtttttcttttctatcaaattgtcaggctgcatattttccaaacttttatgctctgtttcccttataaaactgaatgcctttgacagcaaccaagtcacctcttgaatgctttgctgcttagaactgtcttctgctagataccctaaatcacctctcttaagttcaaagttccacaaatctctagggcagggataaaatgccaccagtctctttgctaaaacataacaagagtcaactgtgttccagttcccaacaagttcctcatctctatctgagaccacttcaacctggatcttattgtccatattgctatcaagcttttggtcgaagccattcaacaagtctctagaaagttccaaactttcccacattttcctgccttcttctgagccctccaaactgttccaacgtctgtctgttacccagttccaaagtcgcttccacattttcaggtatcttttcagcaacaccccactctactaataccaatttactgtgttagtccattttcatgctgctgataaagacacacctgagacccggcaatttacaaaaaaaaaaaaaaaaaaaacagatttaattggatgtacagttccacatggctggggaaacctcacaatcatggtggaagacaaggaggagcaagtcacattttacatggatggcaacaggcaaagacagacaaagagcttatacaggggaactcctctttttaaagctatcagatctcgtgagacttattcaccatcacaagaacagcataggaaagacccaccactgtaattcaatcatctcccaccagttccttcccacagcacatcgaaattatgggagctacaagatgagatttggaaggggacacaaagccaaaccatatcaatatcccattgtgttttaaatttgcatttccttaatgattagtgatgctgatcatttttcatgtctgttggccatttgtatatcttcatttgagaaatgttgatatgtacctgtattagtctgttctcacactgctaaaaataaatacccaagactgggtaatttataaagaaaagtggtttaattaactcacagttctgcatggctagggacacctcagggctcttacaatcatggagaaaggcacctcttcacagggcagcaggagaaagattgattgccagcagggtaaatgccagatgcttataaaaccatcagatctcatgagaacttcctcactatcatgagaacaacgtggggaaccatgcccatggttcagttacttctacctggtcctgcccttgacacatggggattatggaactacaattcaagatgagatttgggtggggacacagccaagccatatcagtaccccttgcccacttttaagtgagtttcagttttcttgctattgagttgtttgagctccttatatattttttatattaccccattatcatatgtatggcttgcaaatattctctcccaattaatagattttcttggcatagtgttgattgtttcctctgctgtgcagagctttttagtattatgtaatcccagttgcctatgtttttgtggcctgtgcttttagagtcgaatcaaaacaaaaaaaattattgcccagatcaatgtagtatcattttactcctgtgttttttttaatacttttagagtttctggtcttttatttaagtctttaataaaactggctatttaaaatcacatatcttttttgccaaatgaattttatctgtatatgcatcatatctgtgaatgtcctattaaatttctcactgaattacaagtggtattggtgtgtcaatggaataactaaggataaaagaaaatgttattttatttacccattcaacaaatatgtatttaatggctattgtatgccaagttcagtctaagagattgttctggagataatggctgttgtattctgtgtaaggtagttggtatttgtcaagaagagtgttggagaacattaaatgtagagtcctttgtatgagaatgagatgtagtgcttgaagagatgtcagaatacactgggttcctagaaattacaatgaacagatcttgatggaataaccagatttaaccttttgcacattttcattaatggatacattctctttgagagaggttaatatagaggtgcttgaaagtaaggatttgaaatgtcaacattttccagttatctcttagtatacagtgatgtattcttaatctttctaaatgctttttttggaccaaatgaattaccaagtaaatcaagaaacaatctttcgatacctaacaaaactgacatcatgaaagaaactagatttttttcagctaatgaaatagcgtacataaaatttaccataatttttacattttttcaacatttaaaaataataaggcattctaggtttttaaaccatttacaacaaattttttttttcaatcacaaagaaaaatctaaaatattcttatagtaaatccactgatatagtttggatatttgtccccacccaaatctcatgttgaactataatccccaatgttggaggtggggcctggtaagaggagtttgggtcacaacggtggatccttcatggcttggtgttatcttcaccaaagtgagtgaattcttaggagatgtggttgtttaaaagtttgtggcatctcccaccacctcttgcttttgcttacactatgtgacatgcttgcttccactttgcctttcaccatgagtaaaaagctccttgaagctttccaagaagccaagcagataccggtgccatgcttgtacagctcacgaaactgtgagccaattaaacctctttttttaataaattacccagtctcagatattcctttatagcaatgcgggaagagcctaagatacctacataccttccatctagattctataattataattttttctacattctttaccatatatatatctatacttccatcaatttgtcagtttatcttatttttacattacagttccaaagaagttacatacatcagtaaatcttacacctaaactcttcaatatgcatattatttacttgacatccatatttatgttatttttcttacaatatgaatgaggtataatttatatgcaataaactacacacattcaagtcacacaattttacaagttttgacataagtatgtatacatgtaggaatccaacacttcaatcaacatacggaaaatttgtttcacccacaaaaaaatttctcagatctttttgaaatccctccctctctctaatccctacataaccactgatctgttttttcaacagcatgtattattgttcactttttaaaattttatatggatgaaataatacagtatctgactacttttgctcagcataatgcttttgagattcatccacattgttattttatcaacttatttttcctttttattgctgagtagtatttcattgtactcaaaaatgttgctgggaaaactggatatcattatgcagaagaatgaaactagacccctgtctctcaacatatacaaaaatcaaatcaaaattatttctctctatattcatactacagtttatttaccatgctcttgttgatgagcaaactggactgtttgaagtttggtcaataataaaactgaattttacattttaaaataacttaaagactttaattggattgtttgtaactgaaaggataaatgcttgaggggatagatacctcattttccatgatgtgcttatttcacattgcatgcctgtattaaaccatgtcatgtacctcatgttggaggctcaaatgaataaatctactgttcttgtattgccattcttgtactagacttttgtattcatgtttcatttccttggatgaatgaaattgggaaatagtgtgtaaaatataatagttaaaatacaatattgatcttataaaaacaaaaaaaaattatctatcatatgttaatagtgtttttttacaggaacctctgtcacaccctatgccttagggattattcaaatgttaaacaaatgtatcataaacaatagccttttaatttttcagtcactacaattctttggatgaagttacatgtgaacacaattgttttatcatgaattttacttagtatatattggtgtcagtatagttaacagacttattttctaatagtctagtgaccatcaagcttttaaaatttgaatctagacgagattgtcataattctgtaattttttccttcacattatggagtaacaaattgttaattgctttagtggtgagaactgaaaagcaatgaacaagtttaatggtacatttctcttttttgtccctcaaaatcaccaagtatgagatgattttcagaatgtctagattttggaattatcatcattgttgattatttggttttgccaatacatttattaaccttttcagaaaacaatgtcaatgtttttggtaaaacattggattgattataaagaccctcataaacacacatacacatacacatacatgcacacacacagacatgcacagaagcatccatgcacatacagagacagatagcattgtagttagctaagattaccgccttttatagcattgaggcagccacagatagcagaagtaaagtattacttttttgcaattgcccttggttcctaaaatctctaaagaaggcatttgattgtgtgacataatgcccaccgaggcttatgccctacttcactggagtagctattttttgttgtatcattcagaaatgaagaaaatagccatgatctgaaatattaagagactttcaggaactggaacgtttctgttctccagccaaacttagcatcagctaggctacattccctaggaagaaggaagacaacaaaatatccagatgcacagtgatattgtccaactaaatgtcaggtgatattgtccagaaatcctcaaataatatatctccataattccagtattcctgagaaccaagttatctccccaaatatttgataataaaataatttaatagcatgcttcctcattgaatcttagggtgacatcaaaatactaaaataacgttattttgtaagagcagaaatatcttgatttagatctcagaactaatatttgcactatgcactacactcagtgaagaaaggcactaaatcaaataacaaaaatcacattaagaaacttgagaattatttcatatataaaagcctcattcatagctcccacttcgaacaattaggtaagtgaaagtactaaggtttgaatattatctccctttccattgtatattgtggcagttttaaaaagcaaatccacagtgttgtcattcctctcctcaagagagggagcttaattcccctctttttgagggtggactcacttagtaactgttctaaattttagaagtgtttgcgtgtcacttctgaatttaacttattaaaaaaacacagcttgcatcttgggttcattctctctctctctccctctctctctctctcatcacttgccctggaaagcagactgccatttataatgagccctacggagaggccatgtggcaagaagctgaggctgccagagggaacctgaggcctgccagcaaccacatacatgagtttggaagttaattcttcagcttcctttgagtcttgaggtagctacagcctggccagaacttgactaaacttcataagggacactgagccagaaacacctaactaagcaaattctggttttatga

SEQ ID NO: 4472 - DNA, 527 bp, human
cgccggtgcgacggtaccaccatcccagctgtgaggctgccatcaacacccacatcagcctggagctccacgcatcctatgtgtacctgtccatggccttctacttcgaccaggacgacgcggccctggagcactttgaccgctacttcctgcgccagtcgcaggagaaaagggagcacgcccaggagctgatgagcctgcagaacctgcgcggtggccgcatctgccttcatgacatcaggaagccagagggccaaggctgggagagcgggctcaaggccatggagtgcaccttccacctggagaagaacatcaaccagagcctcctggagctgcaccagctggccagggagaacggcgacccccagctctgcgacttcctggagaacgacttcctgaaccagcaggccaagaccatcaaagagctgggtggctacctgagcaacctgcacaagatgggggccccggaagcaggcctggcagagtacctctttaacaagctcaccctgggccgcagccagaaacac

SEQ ID NO: 4473 - DNA, 1338345 bp, human; identical to SEQ ID NO: 3315

SEQ ID NO: 4474 - DNA, 1338345 bp, human; identical to SEQ ID NO: 3315

SEQ ID NO: 4475 - DNA, 2276 bp, human; identical to SEQ ID NO: 3316

SEQ ID NO: 4476 - DNA, 71588 bp, human; identical to SEQ ID NO: 3310

SEQ ID NO: 4477 - DNA, 71560 bp, human; identical to SEQ ID NO: 3311

SEQ ID NO: 4478 - DNA, 71588 bp, human; identical to SEQ ID NO: 3310

SEQ ID NO: 4479 - DNA, 72101 bp, human; identical to SEQ ID NO: 3313

SEQ ID NO: 4480 - DNA, 71588 bp, human; identical to SEQ ID NO: 3310

SEQ ID NO: 4481 - DNA, 1338345 bp, human; identical to SEQ ID NO: 3315

SEQ ID NO: 4482 - DNA, 5096 bp, human
agggcccagagctctggccggcggaccttttccttctggagtttccccggcgggtgtgagttgttgcggggtctgggggagctgggaggcccggtttgggaagttttgcaggcaggtgcatgagccatctttctctgaaagtgtttaagaaatgttcaagaacagcggccagagtcaagaaactgggggatgaagggttatctcgagactagacggaaggaaacgtatcaggggaggggtggaggccagaaggaaggagttaggtaggggccctctcccaagctggcgtttttgctgggtggaatccttttgctagatcccttggatttccgttttccgtgtgttatcacactgttggaactgggaagaagagaaaaagaggcaagattttggcatttagtaagttaagtctgaataccgagttttcatccgggtgcatacgtacttaaaataccaaatgggtccaggaagggggacaaagtacgctttaatttatgagaagatcagctactagaaactgtatatctgtttttctcgagttttcttcttgcagtgctctttcaatctcattggacatattttatattattttcctgcttaagcactgggggttgggtggaaggatctgtggctcatcataggcaatttccacacttttaaggtttctgactcttcacataaacacctctcactatgatgaggtcctgtatcaagtacaattaatctttgtactttacaatttacatagtgatttttatttacattatcatatttaaacttaatcaaagtccttggcacggcccatggaacaagctccatttttttgataaagaaactgaggctagaaaagtttctatgtgtgcagagaaggaaggtgaaattattttaatgcttcaaagttatataatgcttcctgcctccctgtatttttctttccattgatcttccttcaaaaccctgataggtctatcccagttttgcaagtaagaaaacatgggctgtgatgtagagctaatacgttttggggtagtgggtcctcagacttaggtctgtctccaagggtcactgactttgttttgttttgtttgttttttgtcaacagattagtccttgtggcaccaagtcagaatttcattcaaaagacaattaggaagatggttttctatggaaaatatttaagtgtaggtcttaatgtgaaagaaagagggagagaaagaaacccctttattatgttctcccttccttaggcattttttgtcccgtgggaaaaaactgtactagggacagagacctctgttaagttttagagaaaagggatcttttttttttttatttgagacagagtcttgctctgtcgcccaggctggagtgcagtggcacgatctcggctcactgcaactccgcctcctgggttcaagcaattctcctgcttcatcctcccgagtagctgggattacaggcgctggccaccacgcccggctaatttttgtatttttagtagagaccgggtttcaccatgttggccaggctagtctggaacccctgactttgtgatccgcccgcctcggcctcccaaagtgctgggattacaggcgtgagccaccgtttcaggccgagaaaagggatttaaaatgagaagcttgaatcttattgaacataattgtaggactgccagagaggactggtggatgaggaatatggcaagggacatgagatgggaaaaattaaataggctgtggtttggaagtctcaaagtgaaattcaaggtgcaaggctcttaaaagttaaatccagcgattcggtacatagcttaggccctattaaatgacccagtgctttaagaactatcttttgaaaggaacacttcacacaagcaccctcaaaaataattagacacctccccatttctctgttaaatggtgaaagacacccaagactagacctaactactgtcaccctctcctggcctcttggcagccaaaaggccacatggcccaggctctccagcatcactgtgtagccgacttggacaaaaatggacttctccccattgccacttgcagatctcttcaaagaatcagcagatctgatagtgtgcccctcttcatccccggcaaccactgttaaaggaaagattgggaaagatcccaccccgccaggagggaggcaaaagcctctgacgctcccctccccccatagctgaccaaggccagggccactgcgggagcaccgcgcgtccacgtgcacccagcatgcccggtcaccctttattacgtaagagtcccaggatggagttgtacctgctgccggcccctcttccccgacggctaataataaacccgggttcctgtttcccggccgcggccactccagattcggggctgaggggctcactctgcaaccaaggcacgtgcattctggtcatcccacgcggggagcgcgcgcaaggcccgcccagcccccacatgccagccccaccctccagtcggtccggacgccgacgcctttttgaccctcgctgtgcccggccctcctcatctggcctgcccagggcttggtgctggcggggtccagctgctccaatccctcctcctctgctctgccctgccctgccctggcctgccccggcgccctccctcagcccgggtatcaggcgagaggcggagctggcccggcgcgccccgcccccgctgtagaaagggccgggcgagtgttactcgcggtcatcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggtgggtgcccacgccccatcgctgccccggccagcttggttgcttgagctcaggcttttcggagggagaagttgtggtggtggggggacacccttctccccgcggccgtaggtgggcgaggaggtgggactgcccagccgcggggagccacccaggcgccgtcccggacgagctgtagccagagaagggggtgcgcgcgggcaagggcgccaggccccctagcagggtgaataatctaatctgttctttcgtctccgtgtatcaaacaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaactaaattggacaagcgtctggtcctcattaatctgccaatgaatggtttcgtcattaaataaaaatcaatttaattgatttactagc
